United States Patent
Olek et al.

(10) Patent No.: US 9,719,131 B2
(45) Date of Patent: Aug. 1, 2017

(54) METHOD FOR DETERMINING THE DEGREE OF METHYLATION OF DEFINED CYTOSINES IN GENOMIC DNA IN THE SEQUENCE CONTEXT OF 5'-CPG-3'

(75) Inventors: Alexander Olek, Berlin (DE); Christian Piepenbrock, Berlin (DE); Kurt Berlin, Stahnsdorf (DE); David Guetig, Berlin (DE)

(73) Assignee: EPIGENOMICS AG, Berlin (DE)

( * ) Notice: Subject to any disclaimer, the term of this patent is extended or adjusted under 35 U.S.C. 154(b) by 0 days.

(21) Appl. No.: 12/847,005

(22) Filed: Jul. 30, 2010

(65) Prior Publication Data
US 2011/0136687 A1   Jun. 9, 2011

Related U.S. Application Data

(63) Continuation of application No. 10/363,345, filed as application No. PCT/EP01/10074 on Sep. 1, 2001, now abandoned.

(30) Foreign Application Priority Data

Sep. 1, 2000 (DE) .................. 100 43 826
Sep. 5, 2000 (DE) .................. 100 44 543

(51) Int. Cl.
C07H 21/02 (2006.01)
C12Q 1/68 (2006.01)

(52) U.S. Cl.
CPC ......... *C12Q 1/6827* (2013.01); *C12Q 1/6883* (2013.01); *C12Q 2600/154* (2013.01)

(58) Field of Classification Search
CPC ............... C12Q 1/6827; C12Q 1/6883; C12Q 2600/154
See application file for complete search history.

(56) References Cited

U.S. PATENT DOCUMENTS

| 5,985,551 A | * | 11/1999 | Brennan | ............. 435/6.11 |
| 6,214,556 B1 | | 4/2001 | Olek et al. | |
| 2003/0165823 A1 | | 9/2003 | Cronin et al. | |

FOREIGN PATENT DOCUMENTS

| CA | 2310384 | 5/2007 |
| DE | 19754482 | 7/1999 |
| WO | 9511995 | 5/1995 |
| WO | 9826095 | 6/1998 |
| WO | 9954461 | 10/1999 |
| WO | 0044934 | 8/2000 |
| WO | 0168911 | 9/2001 |

OTHER PUBLICATIONS

Wong D.J. et al. Cancer Research (1997) vol. 57, pp. 2619-2622.*
Ahen H. The Scientist (Jul. 24, 1995) pp. 20 and 22.*
Cordier C. et al. Eur. J. Biochem. 261, 722-733 (1999).*
Raineri I. et al. Nucleic Acids Research, vol. 19, No. 14, p. 4010.*
GenBank Locus: BG772557 (May 15, 2001), from www.ncbi.nlm.gov, 2 pritned pages.*
NCBI Blast: 12693 result, alignment of SEQ ID No. 12693 and NG_011683.1, from blast.ncbi.nlm.nih.gov, 1 printed page from Aug. 18, 2015.*
Strausberg R.L. et al. Science (Oct. 15, 1999) vol. 286, pp. 455-457.*
"602720653F1 NIH_MGC_97 *Homo sapiens* cDNA clone IMAGE:4837716 5-, mRNA sequence" (May 14, 2001) from www.ncbi.nlm.nih.gov, pp. 1-2.*
Meldrum D. Genome Res. 2000;10(9):1288-1303.*
Armstrong et al. (Jun. 1, 2000) "Suspension arrays for high throughput, multiplexed single nucleotide polymorphism genotyping," Cytometry. 40(2):102-8.
Behr et al. (May 28, 1999) "Comparative genomics of BCG vaccines by whole-genome DNA microarray," Science. 284(5419):1520-3.
Belinsky et al. (Sep. 29, 1998) "Aberrant methylation of p16(1NK4a) is an early event in lung cancer and a potential biomarker for early diagnosis," Proc Natl Acad Sci. 95(20):11891-6.
Eads et al. (Apr. 15, 2000) "MethyLight: a high-throughput assay to measure DNA methylation," Nucleic Acids Res. 28(8):E32i-viii.
Genbank Accession AF089750 (Mar. 29, 2000) "*Homo sapiens* flotillin-1 mRNA," complete cds, p. 1-2.
Gentalen et al. (Mar. 15, 1999) "A novel method for determining linkage between DNA sequences: hybridization to paired probe arrays," Nucleic Acids Res. 27(6):1485-91.
Gonzalgo et al. (Jun. 15, 1997) "Rapid quantitation of methylation differences at specific sites using methylation-sensitive single nucleotide primer extension (Ms-SNuPE)," Nucleic Acids Res. 25(12):2529-2531.
Grunau et al. (Jul. 1, 2001) "Bisulfite genomic sequencing: systematic investigation of critical experimental parameters," Nucleic Acids Res. 29(13):E65-5.
Herman et al. (1996) "Methylation-specific PCR: A novel PCR assay for methylation status of CpG islands," Proc. Natl. Acad. Sci. 93:9821-6.

(Continued)

*Primary Examiner* — Stephen Kapushoc
(74) *Attorney, Agent, or Firm* — Lathrop & Gage, LLP; James H. Velema, Esq.; Sean M. Coughlin, Esq.

(57) ABSTRACT

A method is described for the detection of the degree of methylation of a specific cytosine in the sequence context 5'-CpG-3' of a genomic DNA sample. In the first step, the genomic DNA is chemically treated in such a way that the cytosine bases are converted to uracil, but not the 5-methylcytosine bases. Then segments of the genomic DNA which contain the said specific cytosine are amplified, whereby the amplified products are given a detectable label and in the following steps the extent of hybridization of the amplified products on two classes of oligonucleotides is determined by detection of the label of the amplified products, and a conclusion is made on the extent of methylation of said specific cytosine in the genomic DNA sample from the ratio of the labels detected on the two classes of oligonucleotides as a consequence of the hybridization.

7 Claims, 2 Drawing Sheets

(56) References Cited

OTHER PUBLICATIONS

Nagane et al. (Apr. 2000) "PCR amplification in bisulfite methylcytosine mapping in the GC-rich promoter region of amyloid precursor protein gene in autopsy human brain," Brain Res Brain Res Protoc. 5(2):167-71. [Abstract].

Niemeyer et al. (1999) "DNA Microarrays," Angew. Chem. Int. Ed. 38(19):2865-9.

Park et al. (May 2000) "A latex bead-based flow cytometric immunoassay capable of simultaneous typing of multiple pneumococcal serotypes (Multibead assay)," Clin Diagn Lab Immunol. 7(3):486-9.

Peng et al. (Jul. 1994) "Multiple PCR analyses on trace amounts of DNA extracted from fresh and paraffin wax embedded tissues after random hexamer primer PCR amplification," J Clin Pathol. 47(7):605-8.

Rajeevan et al. (Mar. 1999) "Chemiluminescent analysis of gene expression on high-density filter arrays," J Histochem Cytochem. 47(3):337-42.

Rein et al. (1998) "Identifying 5-methylcytosine and related modifications in DNA genomes," Nucleic Acids Research. 26(10):2255-64.

Richmond et al. (Oct. 1, 1999) "Genome-wide expression profiling in *Escherichia coli* K-12," Nucleic Acids Res. 27(19):3821-35.

Tsuneyoshi et al. (1997) "Mass spectrometric gene diagnosis of one-base substitution from polymerase chain reaction amplified human DNA," Rapid Commun Mass Spectrom. 11(7):719-22. [Abstract].

Umezawa et al. (Sep. 1997) "Methylation of an ETS site in the intron enhancer of the keratin 18 gene participates in tissue-specific repression," Mol Cell Biol. 17(9):4885-94.

Volonte et al. (1999) "Flotillins/Cavatellins Are Differentially Expressed in Cells and Tissues and Form a Hetero-oligomeric Complex with Caveolins in Vivo," J. Biol. Chem. 274(18):12702-9.

Yan et al. (Apr. 2000) "CpG island arrays: an application toward deciphering epigenetic signatures of breast cancer," Clin Cancer Res. 6(4):1432-8.

Yuan et al. (Jul. 1, 1999) "Isolation of a novel gene, TSP50, by a hypomethylated DNA fragment in human breast cancer," Cancer Res. 59(13):3215-21.

International Search Report corresponding to International Patent Application No. PCT/EP2001/010074, mailed Nov. 4, 2003.

* cited by examiner

C

B

A

METHOD FOR DETERMINING THE DEGREE OF METHYLATION OF DEFINED CYTOSINES IN GENOMIC DNA IN THE SEQUENCE CONTEXT OF 5'-CPG-3'

CROSS-REFERENCE TO RELATED APPLICATIONS

This application is a Continuation of U.S. patent application Ser. No. 10/363,345 filed Mar. 3, 2003, which is the U.S. 371 nationalization of PCT/EP01/10074 filed Sep. 1, 2001 now abandoned (WO 02/018632 published Mar. 7, 2002), which claims priority to German Patent Application Nos. DE10043826.1 filed Sep. 1, 2000, and DE10044543.8 filed Sep. 5, 2000, all of which are incorporated herein by reference in their entireties.

FIELD OF THE INVENTION

The invention concerns a method for the detection of the degree of methylation of a specific cytosine in the sequence context 5'-CpG-3' of a genomic DNA sample.

SEQUENCE LISTING

A Sequence Listing comprising 40,723 SEQ ID NOS and attached as part of this application is incorporated herein by reference.

The levels of observation that have been well studied in molecular biology according to developments in methods in recent years include the genes themselves, the transcription of these genes into RNA and the translation to proteins therefrom. During the course of development of an individual, which gene is turned on and how the activation and inhibition of certain genes in certain cells and tissues are controlled can be correlated with the extent and nature of the methylation of the genes or of the genome. In this regard, pathogenic states are also expressed by a modified methylation pattern of individual genes or of the genome.

The present invention describes a method with which many cytosine bases in a given DNA sample can be investigated simultaneously for the presence of a methyl group at position 5 by means of hybridization. It also describes nucleic acids, oligonucleotides and PNA oligomers which are useful in order to employ the method for the diagnosis of existing diseases or of predisposition for diseases.

5-Methylcytosine is the most frequent covalently modified base in the DNA of eukaryotic cells. For example, it plays a role in the regulation of transcription, in genetic imprinting and in tumorigenesis. The identification of 5-methylcytosine as a component of genetic information is thus of considerable interest. 5-Methylcytosine positions, however, cannot be identified by sequencing, since 5-methylcytosine has the same base-pairing behavior as cytosine. In addition, in the case of a PCR amplification, the epigenetic information which is borne by the 5-methylcytosines is completely lost.

The methylation of CpG islands is often equated with transcription inactivity. Although there is clear evidence that CpG islands are to be found in promoters of genes, not all CpG islands and methylation sites are localized in known promoters. In various tissue-specific and imprinting genes, the CpG islands are localized at considerable distance downstream of the start of transcription, and also many genes possess multiple promoters. Methylation of CpG dinucleotides has been detected as a causal factor for a number of diseases. In contrast to classical mutations, DNA methylation involves a mechanism, which describes a substitution on the base without modifying the coding function of a gene. This interplay between epigenetic modification and classical mutations plays an important role in tumorigenesis. For example, focal hypermethylation and generalized genomic demethylation are features of many different tumor types. It is assumed that tumorigenesis and tumor progression are caused, first of all, by hypermethylation of induced mutation events, and secondly, by the turning off of genes which control cellular proliferation, and/or the induced reactivation of genes, which are used only for embryological development, via demethylation.

In hereditable non-polyposis colorectal cancer, e.g., the majority of mutation-negative cases of colon cancer are based rather on the hypermethylation of the hMLH1 promoter and the associated non-expression of hMLH1, a repair gene for erroneous base pairings (Bevilacqua R A, Simpson A J, Methylation of the hMLH1 promoter but no hMLH1 mutations in sporadic gastric carcinomas with high-level microsatellite instability. Int J Cancer. 2000 Jul. 15; 87(2): 200-3). In the pathogenesis of lung cancer, the loss of expression is correlated with the methylation of CpG islands in the promoter sequence of an RAS effector homolog. (Dammann R, Li C, Yoon J H, Chin P L, Bates S, Pfeifer G P, Nucleotide. Epigenetic inactivation of a RAS association domain family protein from the lung tumour suppressor locus 3p21.3. Nat Genet. 2000 July; 25(3):315-9). An epigenetic inactivation of the LKB1 tumor supressor gene, including the hypermethylation of the promoter, is associated with the Peutz-Jeghers syndrome (Esteller M, Avizienyte E, Corn P G, Lothe R A, Baylin S B, Aaltonen L A, Herman J G, Epigenetic inactivation of LKB1 in primary tumors associated with the Peutz-Jeghers syndrome. Oncogene. 2000 Jan. 6; 19(1):164-8).

A plurality of diseases, which are associated with methylation, have in their etiology a close connection with the tumor suppressor genes p16 or p15. Thus a relationship between Mycosis fungoides and hypermethylation of the p16(INK4a) gene is assumed (Navas I C, Ortiz-Romero P L, Villuendas R, Martinez P, Garcia C, Gomez E, Rodriguez J L, Garcia D, Vanaclocha F, Iglesias L, Piris M A, Algara P, p16(INK4a) gene alterations are frequent in lesions of mycosis fungoides. Am J Pathol. 2000 May; 156(5):1565-72). Also, there is a strong correlation between the turning off of the transcription of the p16 gene in gastric carcinoma and the de novo methylation of a few specific CpG sites (Song S H, Jong H S, Choi H H, Kang S H, Ryu M H, Kim N K, Kim W H, Bang Y J, Methylation of specific CpG sites in the promoter region could significantly down-regulate p16(INK4a) expression in gastric adenocarcinoma. Int J Cancer. 2000 Jul. 15; 87(2):236-40). The pathogenesis of cholangiocarcinoma, which is associated with primary sclerosing cholangitis, has been related to the inactivation of the p16 tumor suppressor gene, which is again dependent on the methylation of the p16 promoter (Ahrendt S A, Eisenberger C F, Yip L, Rashid A, Chow J T, Pitt H A, Sidransky D, Chromosome 9p21 loss and p16 inactivation in primary sclerosing cholangitis-associated cholangiocarcinoma. J Surg Res. 1999 Jun. 1; 84(1):88-93). The inactivation of the p16 gene by hypermethylation plays a role in the genesis of leukemia and in the progression of acute lymphoblastic leukemia (Nakamura M, Sugita K, Inukai T, Goi K, Iijima K, Tezuka T, Kojika S, Shiraishi K, Miyamoto N, Karakida N, Kagami K, O-Koyama T, Mori T, Nakazawa S, p16/MTS1/INK4A gene is frequently inactivated by hypermethylation in childhood acute lymphoblastic leukemia with 11q23 translocation. Leukemia. 1999 June; 13(6):884-90).

In addition, it is postulated that the hypermethylation of the p16 and p15 genes plays a decisive role in the tumorigenesis of multiple myeloma (Ng M H, Wong I H, Lo K W, DNA methylation changes and multiple myeloma. Leuk Lymphoma. 1999 August; 34(5-6):463-72). The VHL gene, which is inactivated by methylation, appears to participate in predisposition to renal carcinoma (Glavac D, Ravnik-Glavac M, Ovcak Z, Masera A, Genetic changes in the origin and development of renal cell carcinoma (RCC). Pflugers Arch. 1996; 431(6 Suppl 2):R193-4). A divergent methylation of the 5'-CpG island may participate in nasopharyngeal carcinoma, possibly by the inactivation of transcription of the p16 gene (Lo K W, Cheung S T, Leung S F, van Hassett A, Tsang Y S, Mak K F, Chung Y F, Woo J K, Lee J C, Huang D P, Hypermethylation of the p16 gene in nasopharyngeal carcinoma. Cancer Res. 1996 Jun. 15; 56(12):2721-5). An inactivation of the p16 protein was detected in liver cell carcinoma. Promoter hypermethylation and homozygous deletions are the most frequent mechanisms here (Jin M, Piao Z, Kim N G, Park C, Shin E C, Park J H, Jung H J, Kim C G, Kim H, p16 is a major inactivation target in hepatocellular carcinoma. Cancer. 2000 Jul. 1; 89(1):60-8). DNA methylation as a control of gene expression was detected for the BRCA1 gene for breast cancer (Magdinier F, Billard L M, Wittmann G, Frappart L, Benchaib M, Lenoir G M, Guerin J F, Dante R, Regional methylation of the 5' end CpG island of BRCA1 is associated with reduced gene expression in human somatic cells FASEB J. 2000 August; 14(11): 1585-94). A correlation between methylation and non-Hodgkin's lymphoma is also assumed (Martinez-Delgado B, Richart A, Garcia M J, Robledo M, Osorio A, Cebrian A, Rivas C, Benitez J, Hypermethylation of P16ink4a and P15ink4b genes as a marker of disease in the follow-up of non-Hodgkin's lymphomas. Br J Haematol. 2000 April; 109(1):97-103). CpG methylation also brings about the progression of T-cell leukemia, which is related to a decreased expression of the CDKN2A gene (Nosaka K, Maeda M, Tamiya S, Sakai T, Mitsuya H, Matsuoka M, Increasing methylation of the CDKN2A gene is associated with the progression of adult T-cell leukemia. Cancer Res. 2000 Feb. 15; 60(4):1043-8). An increased methylation of the CpG islands was established in bladder cancer (Salem C, Liang G, Tsai Y C, Coulter J, Knowles M A, Feng A C, Groshen S, Nichols P W, Jones P A, Progressive increases in de novo methylation of CpG islands in bladder cancer. Cancer Res. 2000 May 1; 60(9):2473-6). Transcription inactivation by esophageal squamous cell carcinomas has been related to the methylation of the FHIT gene, which is associated with the progression of the disease (Shimada Y, Sato F, Watanabe G, Yamasaki S, Kato M, Maeda M, Imamura M, Loss of fragile histidine triad gene expression is associated with progression of esophageal squamous cell carcinoma, but not with the patient's prognosis and smoking history. Cancer. 2000 Jul. 1; 89(1):5-11). Neutral endopeptidase 24.11 (NEP) inactivates the increase of neuropeptides which participate in the growth of androgen-independent prostate cancer. A loss of NEP expression by hypermethylation of the NEP promotors may contribute to the development of neuropeptide-stimulated, androgen-independent prostate cancer (Usmani B A, Shen R, Janeczko M, Papandreou C N, Lee W H, Nelson W G, Nelson J B, Nanus D M, Methylation of the neutral endopeptidase gene promoter in human prostate cancers. Clin Cancer Res. 2000 May; 6(5): 1664-70). Adrenocortical tumors in adults display structural abnormalities in the tumor DNA. Among other things, these abnormalities contain an overexpression of the IGF2 gene in correlation with a demethylation of the DNA at this locus (Wilkin F, Gagne N, Paquette J, Oligny L L, Deal C, Pediatric adrenocortical tumors: molecular events leading to insulin-like growth factor II gene overexpression. J Clin Endocrinol Metab. 2000 May; 85(5):2048-56. Review). It is assumed that DNA methylations in several exons in the retinoblastoma gene contribute to the disease (Mancini D, Singh S, Ainsworth P, Rodenhiser D, Constitutively methylated CpG dinucleotides as mutation hot spots in the retinoblastoma gene (RB1). Am J Hum Genet. 1997 July; 61(1):80-7). In chronic myeloid leukemia, a relationship is suspected between the deregulation of the p53 gene and a change in the methylation pattern with progression of the disease (Guinn B A, Mills K I, p53 mutations, methylation and genomic instability in the progression of chronic myeloid leukaemia. Leuk Lymphoma. 1997 July; 26(3-4): 211-26). A connection with methylation has also been detected for acute myeloid leukemia (Melki J R, Vincent P C, Clark S J. Concurrent DNA hypermethylation of multiple genes in acute myeloid leukemia. Cancer Res. 1999 Aug. 1; 59(15):3730-40). A tumor-specific methylation site in the Wilms tumor suppressor gene has been identified (Kleymenova E V, Yuan X, LaBate M E, Walker C L, Identification of a tumor-specific methylation site in the Wilms tumor suppressor gene. Oncogene. 1998 Feb. 12; 16(6):713-20). In Burkitt's lymphoma, several promotors have a complete CpG methylation (Tao Q, Robertson K D, Manns A, Hildesheim A, Ambinder R F, Epstein-Barr virus (EBV) in endemic Burkitt's lymphoma: molecular analysis of primary tumor tissue. Blood. 1998 Feb. 15; 91(4):1373-81). It is assumed that DNA methylation plays a role in thyroid carcinoma (Venkataraman G M, Yatin M, Marcinek R, Ain K B, Restoration of iodide uptake in dedifferentiated thyroid carcinoma: relationship to human Na+/I-symporter gene methylation status. J Clin Endocrinol Metab. 1999 July; 84(7):2449-57).

Not only are many cancer diseases associated with methylation, but there are also many other diseases that are related to methylation. Investigations of inflammatory arthritis have indicated that this disease is associated with a hypomethylation of genomic DNA (Kim Y I, Logan J W, Mason J B, Roubenoff R, DNA hypomethylation in inflammatory arthritis: reversal with methotrexate. J Lab Clin Med. 1996 August; 128(2):165-72). A methylation-regulated expression has been detected for the ICF syndrome (Kondo T, Bobek M P, Kuick R, Lamb B, Zhu X, Narayan A, Bourc'his D, Viegas-Pequignot E, Ehrlich M, Hanash S M, Whole-genome methylation scan in ICF syndrome: hypomethylation of nonsatellite DNA repeats D4Z4 and NBL2). The participation of methylation is suspected in systemic lupus erythematosus (Vallin H, Perers A, Alm G V, Ronnblom L, Anti-double-stranded DNA antibodies and immunostimulatory plasmid DNA in combination mimic the endogenous IFN-alpha inducer in systemic lupus erythematosus. J Immunol. 1999 December; 163(11):6306-13); and there may also be a relationship between the Duchenne muscular dystrophy gene and a CpG-rich island (Banerjee S, Singh P B, Rasberry C, Cattanach B M, Embryonic inheritance of the chromatin organisation of the imprinted H19 domain in mouse spermatozoa. Mech Dev. 2000 February; 90(2):217-26; Burmeister M, Lehrach H, Long-range restriction map around the Duchenne muscular dystrophy gene. Nature. 1986 Dec. 11-17; 324(6097):582-5). An epigenetic effect, which involves the hypomethylation of the amyloid precursor protein, which is related to the development of the disease, is suspected in Alzheimer's disease (West R L, Lee J M, Maroun L E, Hypomethylation of the amyloid precursor protein gene in the brain of an Alzheimer's disease patient. J Mol Neurosci. 1995; 6(2):141-6). The methylation state also plays an important role at the chromosomal level. For example, in mental retardation syndromes, which are coupled with the fragility of the X chromosome, the degree of chromosomal fragility is determined by the methylation (de Muniain A L, Cobo A M, Poza J J, Saenz A. Neurologia. 1995 December; 10 Suppl 1:12-9).

A relatively new method that in the meantime has become the most widely used method for investigating DNA for 5-methylcytosine is based on the specific reaction of bisulfite with cytosine, which, after subsequent alkaline hydrolysis, is then converted to uracil, which corresponds in its base-pairing behavior to thymidine. In contrast, 5-methylcytosine is not modified under these conditions. Thus, the original DNA is converted so that methylcytosine, which originally cannot be distinguished from cytosine by its hybridization behavior, can now be detected by "standard" molecular biology techniques as the only remaining cytosine, for example, by amplification and hybridization or sequencing. All of these techniques are based on base pairing, which is now fully utilized. The prior art, which concerns sensitivity, is defined by a method that incorporates the DNA to be investigated in an agarose matrix, so that the diffusion and renaturation of the DNA is prevented (bisulfite reacts only on single-stranded DNA) and all precipitation and purification steps are replaced by rapid dialysis. (Olek, A. et al., Nucl. Acids Res. 1996, 24, 5064-5066). Individual cells can be investigated by this method, which illustrates the potential of the method. Of course, up until now, only individual regions of up to approximately 3000 base pairs long have been investigated; a global investigation of cells for thousands of possible methylation analyses is not possible. Of course, this method also cannot reliably analyze very small fragments of small quantities of sample. These are lost despite the protection from diffusion through the matrix.

An overview of other known possibilities for detecting 5-methylcytosines can be derived from the following review article: Rein, T., DePamphilis, M. L., Zorbas, H., Nucleic Acids Res. 1998, 26, 2255.

The bisulfite technique has been previously applied only in research, with a few exceptions (e.g., Zechnigk, M. et al., Eur. J. Hum. Gen. 1997, 5, 94-98). However, short, specific segments of a known gene have always been amplified after a bisulfite treatment, and either completely sequenced (Olek, A. and Walter, J., Nat. Genet. 1997, 17, 275-276) or individual cytosine positions have been detected by a primer extension reaction (Gonzalgo, M. L. and Jones, P. A., Nucl. Acids Res. 1997, 25, 2529-2531, WO-Patent 95-00669) or an enzyme step (Xiong, Z. and Laird, P. W., Nucl. Acids. Res. 1997, 25, 2532-2534). Detection by hybridization has also been described (Olek et al., WO-A 99/28,498).

Other publications which are concerned with the application of the bisulfite technique for the detection of methylation in the case of individual genes are: Xiong, Z. and Laird, P. W. (1997), Nucl. Acids Res. 25, 2532; Gonzalgo, M. L. and Jones, P. A. (1997), Nucl. Acids Res. 25, 2529; Grigg, S. and Clark, S. (1994), Bioassays 16, 431; Zeschnik, M. et al. (1997), Human Molecular Genetics 6, 387; Teil, R. et al. (1994), Nucl. Acids Res. 22, 695; Martin, V. et al. (1995), Gene 157, 261; WO-A 97/46,705, WO-A 95/15,373 and WO-A 95/45,560.

A review of the prior art in oligomer array production can be taken from the special edition of Nature Genetics that appeared in January 1999 (Nature Genetics Supplement, Volume 21, January 1999) and the literature cited therein.

Probes with multiple fluorescent labels have been used for scanning an immobilized DNA array. Particularly suitable for fluorescent labels is the simple introduction of Cy3 and Cy5 dyes at the 5'-OH of the respective probe. The fluorescence of the hybridized probes is detected, for example, by means of a confocal microscope. The dyes Cy3 and Cy5, among many others, are commercially available.

Matrix-assisted laser desorptions/ionization mass spectrometry (MALDI-TOF) is a very powerful development for the analysis of biomolecules (Karas, M. and Hillenkamp, F. (1988), Laser desorption ionization of proteins with molecular masses exceeding 10,000 daltons. Anal. Chem. 60: 2299-2301). An analyte is embedded in a light-absorbing matrix. The matrix is vaporized by a short laser pulse and the analyte molecule is transported unfragmented into the gaseous phase. The analyte is ionized by collisions with matrix molecules. An applied voltage accelerates the ions in a field-free flight tube. Ions are accelerated to varying degrees based on their different masses. Smaller ions reach the detector sooner than large ions.

MALDI-TOF spectrometry is excellently suitable for the analysis of peptides and proteins. The analysis of nucleic acids is somewhat more difficult (Gut, I. G. and Beck, S. (1995)), DNA and Matrix Assisted Laser Desorption Ionization Mass Spectrometry. Molecular Biology Current Innovations and Future Trends 1: 147-157). For nucleic acids, the sensitivity is approximately 100 times poorer than for peptides and decreases overproportionally with increasing fragment size. For nucleic acids, which have a backbone with a multiple negative charge, the ionization process via the matrix is basically less efficient. In MALDI-TOF spectrometry, the choice of matrix plays an imminently important role. Several very powerful matrices, which produce a very fine crystallization, have been found for the desorption of peptides. In the meantime, several effective matrices have been developed for DNA, but the difference in sensitivity has not been reduced thereby. The difference in sensitivity can be reduced by modifying the DNA chemically in such a way that it resembles a peptide. Phosphorothioate nucleic acids, in which the usual phosphates of the backbone are substituted by thiophosphates, can be converted by simple alkylation chemistry to a charge-neutral DNA (Gut, I. G. and Beck, S. (1995), A procedure for selective DNA alkylation and detection by mass spectrometry. Nucleic Acids Res. 23: 1367-1373). The coupling of a charge tag to this modified DNA results in an increase in sensitivity of the same order of magnitude as is found for peptides. Another advantage of charge tagging is the increased stability of the analysis in the presence of impurities, which make the detection of unmodified substrates very difficult.

Genomic DNA is obtained from DNA of cells, tissue or other test samples by standard methods. This standard methodology is found in references such as Fritsch and Maniatis, eds., Molecular Cloning: A Laboratory Manual, 1989.

Figure 1:
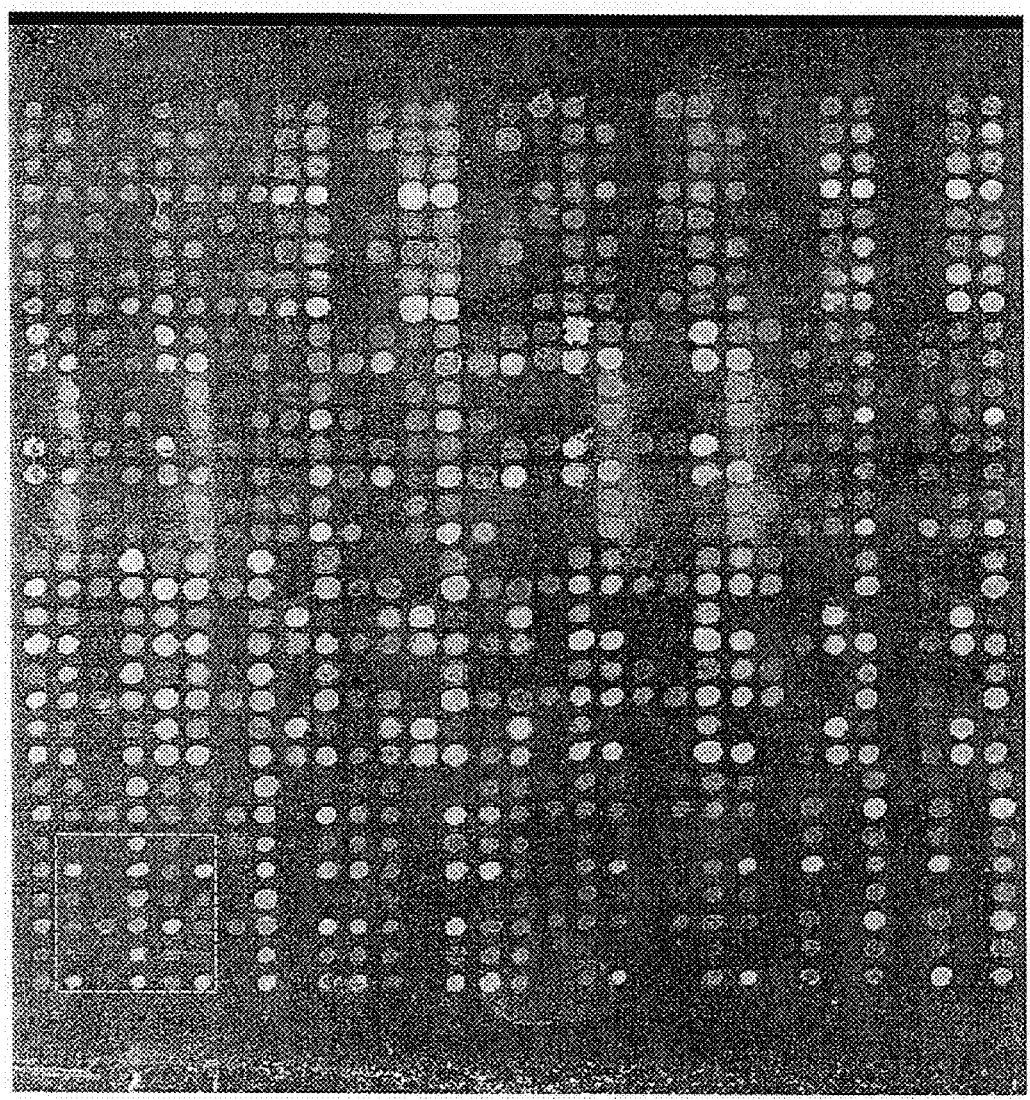
FIG. 1 shows a DNA chip after hybridization with the ELK-1 fragment. The varying intensity of the spots represent the degree of hybridization, whereby the degree of hybridization decreases from light spots to dark spots.

```
CTACTCAACAAAAACAAA (left)    (SEQ ID NO: 40717)
and

CTACTCAACGAAAACAAA (right).  (SEQ ID NO: 40718)
```

FIG. 2B shows the spotting pattern for an unknown methylation state of the tissue sample.

FIG. 2C shows the methylation state for the methylated reference sample.

The present invention will present a particularly efficient and reliable method, which permits investigating many cytosine bases in a given DNA sample simultaneously for the presence of a methyl group at position 5 by means of hybridization. Oligonucleotides and PNA oligomers are also presented for this purpose, which are particularly suitable for using the method for the diagnosis of existing diseases and of predisposition for diseases by analysis of a set of genetic and/or epigenetic parameters.

Genetic parameters in the sense of this invention are mutations and polymorphisms of the claimed nucleic acids (Seq. ID 1 to Seq. ID 40712) and additional sequences necessary for their regulation. Particularly designated as mutations are insertions, deletions, point mutations, inversions and polymorphisms and particularly preferred are SNPs (single nucleotide polymorphisms). Polymorphisms, however, can also be insertions, deletions or inversions.

Epigenetic parameters in the sense of this invention are particularly cytosine methylations and other chemical modifications of DNA bases of the claimed nucleic acids (Seq. ID 1 to Seq. ID 40712) and additional sequences necessary for their regulation. Other epigenetic parameters, for example, are the acetylation of histones, although this cannot be directly analyzed with the described method; however, it is correlated in turn with DNA methylation.

The present method serves for the detection of the degree of methylation of at least one specific cytosine in the sequence context 5'-CpG-3' of a genomic DNA sample. The method is particularly preferably used for the simultaneous detection of many different methylation positions.

The object is solved according to the invention by a method for the detection of the degree of methylation of a specific cytosine in the sequence context 5'-CpG-3' of a genomic DNA sample, which is characterized in that
a) the genomic DNA is treated, whereby the cytosine bases are converted to uracil, but not the 5-methylcytosine bases;
b) segments of the genomic DNA, which contain said specific cytosine, are amplified, whereby the amplified products are given a detectable label;
c) the amplified products are hybridized to two classes of oligonucleotides and/or PNA oligomers, each of which has at least one member;
d) the extent of hybridization of the amplified products on the two classes of oligonucleotides is determined by detection of the label of the amplified products;
e) a conclusion is made on the extent of methylation of said specific cytosine in the genomic DNA sample from the ratio of the labels detected on the two classes of oligonucleotides as a consequence of the hybridization.

A method is particularly preferred in which a hybridization of the amplified products is conducted in step c) on two classes of oligomers (oligonucleotides and/or PNA oligomers), each of which has at least one member, whereby the oligomers of the first class preferably hybridize to the sequence which arises from the chemical treatment of the genomic DNA, if said specific cytosine was present in the methylated state in the genomic DNA, and whereby the oligomers of the second class preferably hybridize to the sequence which arises from the chemical treatment of the genomic DNA if said specific cytosine was present in the unmethylated state in the genomic DNA. One of these two classes of oligomers, for example, can be formed by oligonucleotides which contain a CG in the middle, and the other class can be formed by oligonucleotides which have a TG (or a CA, in the counterstrand) in the middle. The remaining segments of the oligomer sequences should preferably be the same in the two classes. In this case, oligonucleotides of the first class hybridize to the sequence (around the specific cytosine to be investigated) if it was present in the methylated state before bisulfite conversion, and vice versa, those of the second class would hybridize to the sequence if it was present in the unmethylated state before the bisulfite conversion.

A method is also particularly preferred in which a hybridization of the amplified products is conducted in step c) on two classes of oligomers (oligonucleotides and/or PNA oligomers), each of which has at least one member, whereby the oligomers of the first class preferably hybridize to the sequence which arises after the chemical treatment of the genomic DNA if said specific cytosine was present in the methylated state in the genomic DNA and less preferably hybridize to the sequence which arises after the chemical treatment of the genomic DNA if said specific cytosine was present in the unmethylated state in the genomic DNA, and whereby the oligomers of the second class hybridize to the amplified product to be investigated essentially independently of the degree of methylation of said specific cytosine in the genomic DNA.

Correspondingly, a method is also particularly preferred in which a hybridization of the amplified products is conducted in step c) on two classes of oligomers (oligonucleotides and/or PNA oligomers), each of which has at least one member, whereby the oligomers of the first class preferably hybridize to the sequence which arises after the chemical treatment of the genomic DNA if said specific cytosine was present in the unmethylated state in the genomic DNA and less preferably hybridize to the sequence which arises after the chemical treatment of the genomic DNA if said specific cytosine was present in the methylated state in the genomic DNA, and whereby the oligomers of the second class hybridize to the amplified product to be investigated essentially independently of the degree of methylation of said specific cytosine in the genomic DNA.

Thus, in these cases, the second class of oligomers hybridizes to the amplified product without producing an essential methylation specificity, and thus accordingly, preferably to a position of the amplified product which does not correspond to methylatable cytosine positions. Thus, only the concentration of the amplified product is determined by the intensity of hybridization. In this regard, hybridization to the first class of oligonucleotides results as a function of the degree of methylation of the specific cytosine to be investigated.

It is preferred that the method is conducted not only with the genomic DNA sample, but also logically with standard DNA in which it is known whether the cytosine at said specific position is present in methylated or unmethylated state, whereby the ratios of the labels detected on the two classes of oligonucleotides, which are measured each time with the unmethylated standard DNA, serve as a calibration value for a degree of methylation of 0, and correspondingly the ratios of the labels detected on the two classes of oligonucleotides, which are measured each time with the methylated standard DNA, serve as a calibration value for a degree of methylation of 1, and these calibration values are used for the determination of the degree of methylation of the genomic DNA samples.

It is particularly preferred that additional known standard DNA samples, each of which has any known degree of methylation of said specific cytosine, are used for calibration.

The standard DNA samples used and the samples (the amplied product prepared from a genomic DNA) are each preferably given a different label. The standard DNA samples used are each preferably labeled in turn with different labels.

A method is also particularly preferred in which amplified products originating from different genomic DNA samples are provided with different labels. In this case, it is possible to measure different samples simultaneously with one set of oligonucleotides of the two classes, for example, on an oligomer array which contains oligonucleotides of the two classes.

A method is also particularly preferred, in which amplified products originating from the same genomic DNA samples are provided with different labels in order to achieve an increase of measurement accuracy by an averaging of the values obtained from different detection methods. For example, this can be carried out by labeling with different fluorescent dyes. In this case, the measurement is conducted with a fluorescence scanner, which provides several channels for the measurement of individual emission wavelengths of the fluorescent dyes.

Accordingly, a method is also particularly preferred, in which the labels are fluorescent labels.

According to the invention, it is further preferred that said label is a fluorescent label. It is preferred that said label is detected by chemiluminescence, its UV absorption or fluorescence polarization.

It is particularly preferred according to the invention that the DNA treatment in step a) is conducted with a solution of a bisulfite (=hydrogen sulfite, disulfite). A method is also particularly preferred, in which oligonucleotides are used for the amplification, which comprise a sequence segment of a chemically pretreated DNA which is at least 18 bases long according to one of the Seq. ID 1 to Seq. ID 40712. It is assured that primers complementary to the bisulfite-treated DNA are used, which can amplify regulatory regions (CpG islands) which can then be investigated with respect to methylation.

A method is also particularly preferred, in which, in a hybridization step, oligonucleotides and/or peptide nucleic acid (PNA) oligomers are used, which hybridize to a sequence segment that is at least 9 bases long of a chemically pretreated DNA according to one of the Seq. ID 1 to Seq. ID 40712 or correspond to this segment, whereby the base sequence contains at least one CpG dinucleotide and the CpG dinucleotide is found in approximately the middle third of the oligomer. These oligonucleotides are suitable for investigating specific CpG positions with respect to their degree of methylation according to the method of the invention. They preferably bind to the amplified products of treated DNA, which originates from a genomic DNA sample methylated at the respective cytosine positions.

It is also preferred that the labels are radionuclides.

It is further preferred that the labels are removable mass labels, which are detected in a mass spectrometer. It is particularly preferred according to the invention that the PCR products as a whole or their characteristic fragments are detected in the mass spectrometer and thus are clearly characterized by their mass.

It is particularly preferred according to the invention that the oligomers (oligonucleotides and/or PNA oligomers) of one class contain the sequence 5'-CG-3'.

It is particularly preferred according to the invention that the oligomers (oligonucleotides and/or PNA oligomers) of one class contain the sequence 5'-TG-3' and/or the sequence 5'-CA-3'.

It is also particularly preferred that the oligonucleotides of the first class contain the sequence 5'-CG-3' and the oligonucleotides of the second class contain the sequence 5'-TG-3' and/or the sequence 5'-CA-3'.

It is also preferred that the oligonucleotides of the first and of the second classes are immobilized on a common solid phase. It is also preferred that the oligonucleotides are arranged on a planar solid phase in a rectangular or hexagonal grid and the site of specific oligonucleotides on the solid phase is correlated with their respective sequence.

It is also particularly preferred that the oligomers of the first and second classes are immobilized on beads, which are coded with a set of separately detectable labels. The latter serve for identifying the bead, i.e., the sequence bound to the bead in question. The amplified products bound to the beads are then identified by means of other labels, which are bound to the amplified products. Instruments for conducting such measurements based on beads are offered, for example, by the Luminex company.

A method is most particularly preferred according to the invention, wherein step b) is conducted in two sub-steps as follows:
a) a PCR pre-amplification with at least one pair of primers of different sequence which hybridize nonspecifically to a DNA sample pretreated according to claim 1 and thus produce more than one amplified product in the PCR step;
b) a PCR amplification of the product formed in the pre-amplification, with primers of different sequence, which are each identical or inversely complementary to a segment of the DNA sample that has undergone pretreatment according to claim 1, and hybridize specifically to the DNA to be amplified.

In connection with this invention, hybridization is understood as a hybridization of two single DNA strands that are completely inversely complementary to each other according to Watson-Crick rules without the occurrence of an erroneous base pairing. Uracil is considered in this respect as thymine.

It is also preferred according to the invention that the amplification of several DNA segments is conducted in one reaction vessel.

It is further preferred according to the invention that a heat-stable DNA polymerase is used for the amplification. It is also particularly preferred that the primer oligonucleotides used for the amplification contain either only the bases T, A and C or the bases T, A and G.

It is also preferred that at least 10 CpG positions in different sequence context are analyzed simultaneously. It is particularly preferred that at least 50 CpG positions in different sequence context are analyzed simultaneously. It is even more particularly preferred that at least 100 CpG positions in different sequence context are analyzed simultaneously. It is even more preferred that at least 500 CpG positions in different sequence context are analyzed simultaneously. It is most preferable that at least 1000 CpG positions in different sequence context are analyzed simultaneously.

The method is preferred according to the invention, whereby the genomic DNA sample has been obtained from cell lines, blood, sputum, stool, urine, cerebrospinal fluid, tissue embedded in paraffin, for example, tissue from eyes, intestine, kidney, brain, heart, prostate, lung, breast or liver, histological slides or all other possible combinations thereof.

The use of a method according to the invention is preferred for the diagnosis and/or prognosis of adverse events for patients or individuals, whereby these adverse events belong to at least one of the following categories: undesired drug interactions; cancer diseases; CNS malfunctions, damage or disease; symptoms of aggression or behavioral disturbances; clinical, psychological and social consequences of brain damage; psychotic disturbances and personality disorders; dementia and/or associated syndromes; cardiovascular disease, malfunction and damage; malfunction, damage or disease of the gastrointestinal tract; malfunction, damage or disease of the respiratory system; lesion, inflammation, infection, immunity and/or convalescence; malfunction, damage or disease of the body as an abnormality in the development process; malfunction, damage or disorder of the skin, the muscles, the connective tissue or the bones; endocrine and metabolic malfunction, damage or disease; headaches or sexual malfunctions.

The use of a method according to the invention is also preferred for distinguishing cell types or tissues or for investigating cell differentiation.

The subject of the present invention is a kit comprising a reagent containing bisulfite, primer oligonucleotides for the production of the amplified products and/or preferably oligonucleotides immobilized to a solid phase as well as instructions for conducting the method according to the invention. The primer oligonucleotides and the immobilized oligonucleotides, as described above, are derived from the Seq. IDs 1 to 40712.

This genomic DNA sample has been obtained preferably from cell lines, blood, sputum, stool, urine, cerebrospinal fluid, tissue embedded in paraffin, for example, tissue from eyes, intestine, kidney, brain, heart, prostate, lung, breast or liver, histological slides or all other possible combinations thereof.

In this method in the first step, a genomic DNA sample is treated in such a way that except for the 5-methylcytosine bases, all cytosine bases are converted to uracil. This chemical treatment is preferably conducted with the solution of a bisulfite (=hydrogen sulfite, disulfite). This step of the method can be conducted not only with the genomic DNA sample, but also preferably and logically with standard DNA in which it is known whether the cytosine at said specific position is present in methylated or unmethylated state.

In the second step of the method, the segments of the genomic DNA that contain said specific cytosine are amplified. This step can be particularly preferably conducted in two sub-steps:
1. First, a PCR pre-amplification is conducted with at least one pair of primers of different sequence, which hybridize to a chemically pretreated DNA. This treatment was chemically conducted in such a way that the cytosine bases were converted to uracil, but not the 5-methylcytosine bases.
2. A PCR amplification of the product formed in the pre-amplification is conducted with primers of different sequence. These primers are identical or inversely complementary to a segment of the chemically pretreated DNA and specifically hybridize to the DNA to be amplified. The amplified products preferably contain a detectable label.

In the following third step of the method, a hybridization of the amplified products takes place on preferably two classes of oligonucleotides, each of which has at least one member. In a particularly preferred variant of the method, the oligonucleotides of the first class contain the sequence 5'-CG-3' and the oligonucleotides of the second class contain the sequence 5'-TG-3' and/or the sequence 5'-CA-3'. The oligonucleotides of the first and the second classes are preferably immobilized on a common solid phase. The oligonucleotides are arranged on a planar solid phase in a rectangular or hexagonal grid and the site of specific oligonucleotides on the solid phase is correlated with their respective sequence.

The oligonucleotides of the first class preferably hybridize to the sequence which arises from the chemical treatment of the genomic DNA if said specific cytosine was present in the methylated state in the genomic DNA. The oligonucleotides of the second class preferably hybridize to the sequence which arises from the chemical treatment of the genomic DNA if said specific cytosine was present in the unmethylated state in the genomic DNA.

The amplification of several DNA segments is particularly preferably conducted in one reaction vessel. The amplification is preferably conducted with the polymerase chain reaction (PCR), wherein a heat-stable DNA polymerase is preferably used.

The primer oligonucleotides used for the amplification contain preferably either only the bases T, A and C or the bases T, A and G.

In the fourth step of the method, the extent of hybridization of the amplified products on the two classes of oligonucleotides is determined by detection of the labels of the amplified products. The labels are particularly preferably fluorescent labels, radionuclides, or removable mass labels, which are detected in a mass spectrometer.

The labels are preferably also detected by chemiluminescence, UV absorption or fluorescence polarization. The PCR products can also preferably be detected as a whole or as their characteristic fragments in the mass spectrometer. Thus the PCR products are clearly characterized by their mass.

In the last step of the method, a conclusion is made on the extent of methylation of said specific cytosine in the genomic DNA sample from the ratio of the labels detected on the two classes of oligonucleotides as a consequence of the hybridization.

The ratios of the labels detected on the two classes of oligonucleotides, which are measured each time with the unmethylated standard DNA, preferably serve as a calibration value for a degree of methylation of 0.

Correspondingly, the ratios of the labels detected on the two classes of oligonucleotides, which are measured each time with the methylated standard DNA, preferably serve as a calibration value for a degree of methylation of 1.

The calibration values are particularly preferably used for the determination of the degree of methylation of the genomic DNA samples.

Preferably, additional known standard DNA samples, each of which has any known degree of methylation of said specific cytosine, are also used for the calibration.

The method is further characterized in that preferably at least 10 CpG positions in different sequence context are analyzed simultaneously. In addition, preferably at least 50 CpG positions in different sequence context can be analyzed simultaneously. It is also preferred that at least 100 CpG positions in different sequence context are analyzed simultaneously. The simultaneous analysis of at least 500 CpG positions in different sequence context is very much preferred. The simultaneous analysis of at least 1000 CpG positions in different sequence context is finally particularly preferred.

The described method is preferably used for the diagnosis and/or prognosis of adverse events for patients or individuals, whereby these adverse events belong to at least one of the following categories: undesired drug interactions; cancer diseases; CNS malfunctions, damage or disease; symptoms of aggression or behavioral disturbances; clinical, psychological and social consequences of brain damage; psychotic disturbances and personality disorders; dementia and/or associated syndromes; cardiovascular disease, malfunction and damage; malfunction, damage or disease of the gastrointestinal tract; malfunction, damage or disease of the respiratory system; lesion, inflammation, infection, immunity and/or convalescence; malfunction, damage or disease of the body as an abnormality in the development process; malfunction, damage or disorder of the skin, the muscles, the connective tissue or the bones; endocrine and metabolic malfunction, damage or disease; headaches or sexual malfunctions.

The present method is particularly preferably used for distinguishing cell types or tissues or for investigating cell differentiation.

By determining the hybridization ratios between the two classes of oligonucleotides utilized (e.g., containing CG/TG), the method is not dependent on the intensity of the total hybridization of unknown tissue samples.

Unmethylated and methylated reference samples are utilized as standards for calibrating unknown tissue samples.

A component of this method is also a kit, which comprises a reagent containing bisulfite, primer oligonucleotides for the production of amplified products and/or preferably oligonucleotides immobilized on a solid phase. The oligonucleotides (first class) comprise the sequence 5'-CG-3'. The oligonucleotides (second class) comprise the sequence 5'-TG-3' and/or the sequence 5'-CA-3'. Instructions for conducting the method are also included in the kit.

The subject of the present invention is also nucleic acids that are particularly suitable for conducting the method.

The subject of the invention is also a set of at least 10 oligomer probes (oligonucleotides and/or PNA oligomers), which serve for the detection of the cytosine methylation state in chemically pretreated genomic DNA (Seq. ID 1 to Seq. ID 40712). The analysis of a set of genetic and/or epigenetic parameters for the diagnosis of existing diseases or for the diagnosis of predisposition to specific diseases is possible with these probes.

The subject of the present invention is also a sequence segment of a treated DNA which is at least 18 bases long according to one of the Seq. ID 1 to Seq. ID 40712. These segments of 18 base pairs in length comprised of Seq. ID 1 to Seq. ID 40712 are utilized for the amplification of the treated genomic DNA. Oligomers with a length of at least 9 nucleotides are used as detectors of these segments.

The oligomers preferably contain at least one CpG dinucleotide. The cytosine of the corresponding CpG dinucleotide is found in approximately the middle third of the oligomer. It is a deciding factor that at least one oligonucleotide from Seq. ID 1 to Seq. ID 40712 is present in the respective set of oligomers for at least each of the CpG dinucleotides.

The oligomers are preferably produced on a support material in a fixed arrangement, whereby at least one oligomer is coupled to a solid phase. Methods for binding oligomer probes to solid phases are known to the person of average skill in the art.

It is also important in this connection that it is not individual CpG dinucleotides, but the large number of CpG dinucleotides present in the sequences, which must be analyzed for the diagnosis of genetic and/or epigenetic parameters of the claimed nucleic acids (Seq. ID 1 to Seq. ID 40712). In a particularly preferred variant of the method, all of the CpG dinucleotides present in the sequences are to be investigated.

It is further preferred that all oligomer probes have the same length. In addition, all 18-mer which have a CpG dinucleotide in the center and which hybridize to one of the Seq. ID 1 to Seq. ID 40712 without erroneous base pairing are particularly preferred.

In another preferred variant of the method, at least ten of the oligomers are used for the detection of the cytosine methylation state and/or of single nucleotide polymorphisms (SNPs) in chemically pretreated genomic DNA.

The oligomers are preferably used for the diagnosis of undesired drug interactions; cancer diseases; CNS malfunctions, damage or diseases; symptoms of aggression or behavioral disturbances; clinical, psychological and social consequences of brain lesions; psychotic disturbances and personality disorders; dementia and/or associated syndromes; cardiovascular disease; malfunction, damage or disorder of the gastrointestinal tract; malfunction, damage or disorder of the respiratory system; lesion, inflammation, infection, immunity and/or convalescence; malfunction, damage or disorder of the body as an abnormality in the development process; malfunction, damage or disorder of the skin, the muscles, the connective tissue or the bones; endocrine and metabolic malfunction, damage or disorder; headaches and sexual malfunctions, by analysis of methylation patterns.

Also, of the nucleic acids or considerable segments thereof listed in the sequence protocol (Seq. ID 1 to Seq. ID 40712), preferably at least one will be used for the analysis of a set of genetic and/or epigenetic parameters for the diagnosis of existing disorders or for the diagnosis of predisposition for specific disorders.

The person of average skill in the art understands that the oligomers fulfill the same objective when thymine is exchanged for uracil.

The genomic DNA to be analyzed is obtained preferably from the usual sources for DNA, such as, e.g., cell lines, blood, sputum, stool, urine, cerebrospinal fluid, tissue embedded in paraffin, for example, tissue from eyes, intestine, kidney, brain, heart, prostate, lung, breast or liver, histological slides and all other possible combinations thereof.

The subject of the present invention is also nucleic acids containing a sequence segment which is at least 18 bases long of a chemically pretreated DNA, according to one of the Seq. ID 1 to Seq. ID 40712.

The subject of the present invention is also an oligomer (oligonucleotide or peptide nucleic acid (PNA) oligomer) for the detection of the cytosine methylation state in chemically pretreated DNA, each containing at least one base sequence with a length of at least 9 nucleotides, which hybridizes to a chemically pretreated DNA (Seq. ID 1 to Seq. ID 40712). It is also preferred according to the invention that the base sequence contains at least one dinucleotide. It is also preferred that the cytosine of the CpG dinucleotide is found in approximately the middle third of the oligomer.

The subject of the invention is also a set of oligomers according to the invention, containing at least one oligomer for at least one of the CpG dinucleotides of one of the sequences of Seq. ID 1 to Seq. ID 40712. A set of oligomers containing at least one oligomer for each of the CpG dinucleotides of one of the sequences of Seq. ID 1 to Seq. ID 40712 is preferred.

The subject of the present invention is also a set of at least two nucleic acids, which are utilized as primer oligonucleotides for the amplification according to the invention of at least one of the Seq. ID 1 to Seq. ID 40712 or segments thereof. It is preferred that at least one oligonucleotide is bound to a solid phase.

The subject of the present invention is also a set of oligomer probes for the detection of the cytosine methylation state and/or of single nucleotide polymorphisms (SNPs) in chemically pretreated genomic DNA according to one of the Seq. ID 1 to Seq. ID 40712, containing at least ten of the above-named oligomers according to the invention.

The subject of the present invention is also a method for the production of an arrangement of different oligomers (an array) fixed on a support material for the analysis of disorders related to the methylation state of the CpG dinucleotides of one of the Seq. ID 1 to Seq. ID 40712, in which at least one oligomer according to the invention is coupled to a solid phase.

The subject of the invention is also arrangements of different oligomers (array) bound to a solid phase.

The subject of the present invention is also an array of different oligonucleotide and/or PNA oligomer sequences whereby these are arranged on a planar solid phase in the form of a rectangular or hexagonal grid. It is preferred that the solid phase surface is comprised of silicon, glass, polystyrene, aluminum, steel, iron, copper, nickel, silver, or gold.

According to the invention, a DNA and/or PNA array is also for the analysis of disorders related to the methylation state of genes, which contains at least one nucleic acid as described above according to the invention.

The following examples explain the invention.

EXAMPLE 1

Production of Unmethylated and Methylated DNA and Bisulfite Treatment

For the production of methylated DNA, human genomic DNA was treated with S-adenosylmethionine and CpG methylase (Sssl, New England Biolabs,) according to the information of the manufacturer. For the production of unmethylated DNA, the gene fragment ELK-1 (Accession number ep59011) was amplified by means of PCR with the primers GCTCTATGGTCTTGTCTAACCGTA (SEQ ID NO: 40713) and AGGTGGTGGTGGCGGTGG (SEQ ID NO: 40714), starting from human genomic DNA. The unmethylated and methylated DNA, which was prepared in this way, as well as also the human genomic DNA was treated with the use of bisulfite (hydrogen sulfite, disulfite), such that all cytosines unmethylated at the 5-position of the base are changed so that a base that is different with respect to base pairing behavior is formed, whereas the cytosines that are methylated in the 5-position remain unchanged. If bisulfite in the concentration range between 0.1 M and 6 M is used for the reaction, then an addition occurs at the unmethylated cytosine bases. Also, a denaturing reagent or solvent as well as a radical trap must be present. A subsequent alkaline hydrolysis then leads to the conversion of unmethylated cytosine nucleobases to uracil. This converted DNA serves for the detection of methylated cytosines.

EXAMPLE 2

Production of Cy5-Labeled Gene Probes

Starting with DNA samples treated with bisulfite, a defined fragment of 529 bp in length from the promoter region of the ELK-1 gene (Accession number ep59011) was amplified. The amplification is conducted with the primer oligonucleotides ATGGTTTTGTTTAATYGTAGAGTTGTTT (SEQ ID NO: 40715) and TAAAC-CCRAAAAAAAAAAAACCCAATAT (SEQ ID NO: 40716). By using primer oligonucleotides that are labeled with the fluorescent dye Cy5, the fragment is directly labeled in the PCR. (1) Unmethylated DNA, (2) methylated DNA and (3) human genomic DNA treated with bisulfite (hydrogen sulfite, disulfite) are used as the matrix DNA. Then these three different DNA fragments are investigated in separate hybridizations for their degree of methylation at a specific CpG position.

EXAMPLE 3

Conducting the Hybridization and Evaluating a Hybridized DNA Chip

Figure 2:
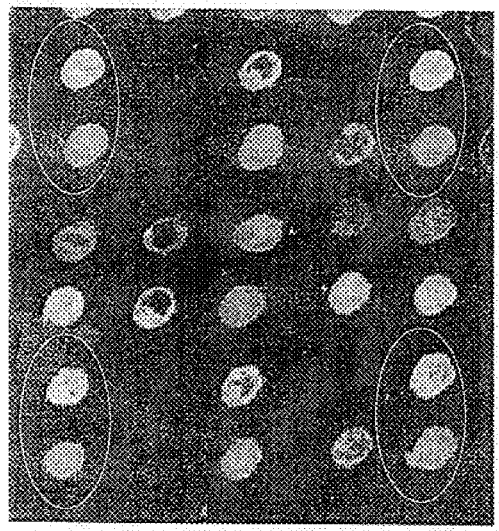
FIG. 2A shows an excerpted image from FIG. 1. The spotted pairs of oligonucleotides are circled in white to clarify the hybridization diagram.
Figure 2:
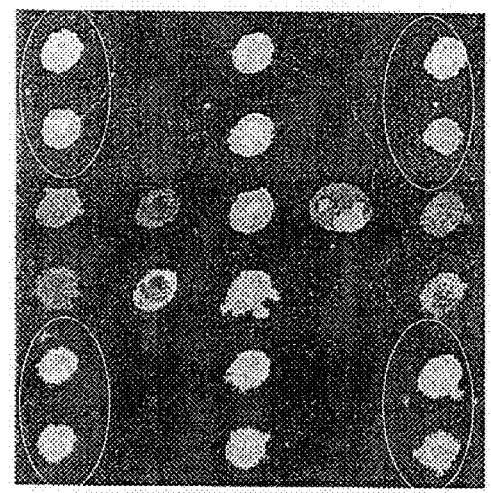
Figure 2:
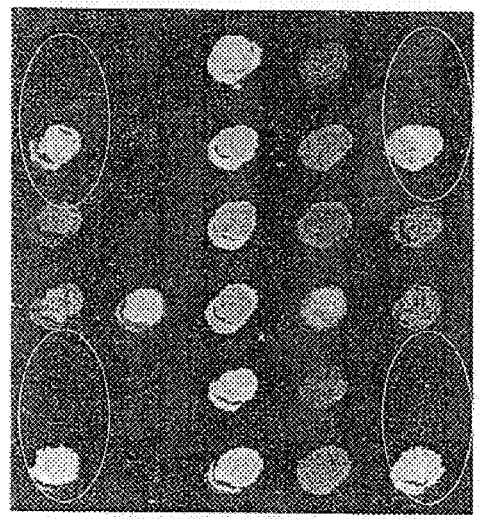

The gene probes prepared in Example 2 are hybridized to a DNA chip. First, oligonucleotides are immobilized on the chip. The oligonucleotide sequences are derived from the amplified fragment of the ELK-1 gene named in Example 2, and represent the CG dinucleotide, including the immediate surroundings. The length of the oligonucleotides amounts to 14-22 nucleotides; the position of the CG dinucleotide within the oligonucleotide is variable. After the hybridization, the DNA chip is scanned (see FIG. 1) and the hybridization signals are numerically evaluated (data not shown). The result of the hybridization for the oligonucleotides CTACTCAACGAAAACAAA (SEQ ID NO: 40717) and CTACTCAACAAAAACAAA (SEQ ID NO: 40718) is shown in FIG. 1 and FIG. 2. CTACTCAACGAAAACAAA (SEQ ID NO: 40717) preferably hybridizes if the cytosine of the ELK-1 fragment, which is found at position 103 of the amplified product, is methylated; CTACT-CAACAAAAACAAA (SEQ ID NO: 40718) hybridizes if this cytosine is unmethylated.

A DNA chip is shown in FIG. 1 after hybridization with the ELK-1 fragment. The pseudo-color image as it is produced after scanning is shown. Unlike the black-and-white illustration shown here, a color image is produced by the scanner. The intensity of the different colors represent the degree of hybridization, whereby the degree of hybridization decreases from red (this can be recognized as light spots in FIG. 1) to blue (recognized as dark spots in FIG. 1).

FIG. 2 A shows an excerpted image from FIG. 1. The spotted pairs of oligonucleotides are circled in white to clarify the hybridization diagram: ctactcaacaaaaacaaa (left) (SEQ ID NO: 40717) and ctactcaacgaaaacaaa (right) (SEQ ID NO: 40718).

The excerpted image of FIG. 2 B shows the spotting pattern for an unknown methylation state of the tissue sample and the excerpted image of FIG. 2 C shows the methylation state for the methylated reference sample.

TABLE 1

| Sequence of the detection oligomer | Sample A (unmethylated) Fluorescence (counts) | Mean | Sample B (unknown) Fluorescence (counts) | Mean | Sample C (methylated) Fluorescence (counts) | Mean |
|---|---|---|---|---|---|---|
| ctactcaacgaaaacaaa (SEQ ID NO: 40717) | 3352 | | 6102 | | 6002 | |
| ctactcaacgaaaacaaa (SEQ ID NO: 40717) | 2950 | | 6775 | | 7898 | |
| ctactcaacgaaaacaaa (SEQ ID NO: 40717) | 4196 | | 6360 | | 7485 | |
| ctactcaacgaaaacaaa (SEQ ID NO: 40717) | 5181 | | 5521 | | 11401 | |
| | | 3920 | | 6190 | | 8197 |
| ctactcaacaaaaacaaa (SEQ ID NO: 40718) | 20577 | | 7074 | | 7290 | |
| ctactcaacaaaaacaaa (SEQ ID NO: 40718) | 19709 | | 9171 | | 9985 | |
| ctactcaacaaaaacaaa (SEQ ID NO: 40718) | 24130 | | 7603 | | 9286 | |
| ctactcaacaaaaacaaa (SEQ ID NO: 40718) | 21601 | | 9434 | | 12435 | |
| | | 21504 | | 8321 | | 9749 |
| CG/CA | | 0.28 | | 0.74 | | 0.84 |

The mean is indicated each time for a wavelength of 635 nm. Column A gives the values for the unmethylated sample and column B for an unknown methylation state of a tissue sample and column C gives the values for the methylated reference sample. The CG/CA ratios represent the methylation state of the respective sample. The value of 0.74 shows that the sample is basically present in methylated form.

EXAMPLE 4

The following example relates to a fragment of the hMLH1 gene associated with hereditable non-polyposis colorectal cancer, in which a specific CG position is investigated for methylation.

In the first step, a genomic sequence is treated with the use of bisulfite (hydrogen sulfite, disulfite) in such a way that all of the unmethylated cytosines at the 5-position of the base are modified such that a base that is different in its base pairing behavior is formed, while the cytosines that are methylated in the 5-position remain unchanged. If bisulfite in the concentration range between 0.1 M and 6 M is used for the reaction, then an addition occurs at the unmethylated cytosine bases. Also, a denaturing reagent or solvent as well as a radical trap must be present. A subsequent alkaline hydrolysis then leads to the conversion of unmethylated cytosine nucleobases to uracil. This converted DNA serves for the detection of methylated cytosines. In the second step of the method, the treated DNA sample is diluted with water or an aqueous solution. A desulfonation of the DNA (10-30 min, 90-100° C.) at alkaline pH is then preferably conducted. In the third step of the method, the DNA sample is amplified in a polymerase chain reaction, preferably with a heat-stable DNA polymerase. In the present Example, cytosines of the hMLH1 gene, here from a 1551-bp-long 5'-flanking region, are investigated. A defined fragment of 719-bp length is amplified for this purpose with the specific primer oligonucleotides AGCAACACCTCCATGCACTG (SEQ ID NO: 40719) and TTGATTGGACAGCTTGAATGC (SEQ ID NO: 40720). This amplified product serves as a sample, which hybridizes to an oligonucleotide that has been previously bound to a solid phase, with the formation of a duplex structure, for example, GAAGAGCGGACAG (SEQ ID NO: 40721), whereby the cytosine to be detected is found at position 588 of the amplified product. The detection of the hybridization product is based on primer oligonucleotides fluorescently labeled with Cy3 and Cy5, which were used for the amplification. A hybridization reaction of the amplified DNA with the oligonucleotide occurs only if a methylated cytosine was present at this site in the bisulfite-treated DNA. Thus the methylation state of the respective cytosine to be investigated decides the hybridization product.

EXAMPLE 5

Production of Bisulfite-Modified DNA with Agarose Beads

In the present experiment, starting with DNA treated with bisulfite, a defined fragment of 529 bp in length from the promoter region of the ELK-1 gene (Accession number ep59011) is amplified. By using primer oligonucleotides ATGGTTTTGTTTAATYGTAGAGTTGTTT (SEQ ID NO: 40715) and TAAACCCRAAAAAAAAAAAACCCAATAT (SEQ ID NO: 40716), which are labeled with the fluorescent dye ALEXA 488, the fragment is directly labeled in the PCR. Oligonucleotides of the first class (here, for example, ATTAATAGCGTTTTGGTT, SEQ ID NO: 40722) and of the second class (here: for example, ATTAATAGT- GTTTTGGTT, SEQ ID NO: 40723) are immobilized at the surface of beads, which are distinguished by an individual color coding. In a following step, the amplified products of the ELK-1 gene, which were prepared with the above-named primer oligonucleotides, are combined with a mixture of both classes of beads, whereby the amplified products hybridize to the immobilized oligonucleotides, here, for example, ATTAATAGCGTTTTGGTT (SEQ ID NO: 40722) and ATTAATAGTGTTTTGGTT (SEQ ID NO: 40723), whereby the C or T to be detected is found each time at position 476 of the amplified product. Then the beads are separated, identified by fluorescence measurement based on their color coding and the degree of hybridization is determined by measurement of the fluorescent intensities, which are specific to the fluorescent dye ALEXA 488.

EXAMPLE 6

Use of Multiple Dyes for Internal Calibration

Starting with bisulfite-treated DNA, a defined fragment of 529-bp length from the promoter region of the ELK-1 gene is amplified. The fragment is labeled directly in the PCR by use of the fluorescently labeled primer oligonucleotides ATGGTTTTGTTTAATYGTAGAGTTGTTT (SEQ ID NO: 40715) and TAAACCCRAAAAAAAAAAACCCAATAT (SEQ ID NO: 40716). For the PCR reaction, which is conducted on a thermocycler (Eppendorf GmbH), 10 ng of bisulfite-treated DNA, 6 μmol of each primer, 200 μM of each dNTP, 1.5 mM MgC12 and 1 U of HotstartTaq (Qiagen AG) are used. The other conditions are selected following the manufacturer's information. For the amplification, a denaturing is conducted for 14 min at 96° C., followed by 39 cycles with the conditions: 60 sec at 96° C., 45 sec at 55° C. and 75 sec at 72° C. In conclusion, an elongation is conducted for 10 min at 72° C. In the present case, the samples to be investigated, here the tissue of healthy and sick persons, are labeled with the Cy2 dye. For the internal calibration of the methylation state, primer oligonucleotides are used for the amplification of samples for the calibration, which are labeled with the fluorescent dyes Cy3 and Cy5. The amplified products from the samples for the calibration represent a known methylation state, on the one hand, a state of one-hundred percent methylation, and, on the other hand, an unmethylated state. Since in this method, the ratios of the color intensities of the fluoresent dyes, which are measured with the use of the ScanArray 4000XL, Packard BioScience-BioChip Technologies, are calculated for two classes of oligonucleotides, here, for example, ATTAATAGCGTTTTGGTT (SEQ ID NO: 40722) and ATTAATAGTGTTTTGGTT (SEQ ID NO: 40723), wherein the C or T to be detected is found each time at position 476 of the amplified product, the ratio of methylated to unmethylated state of the unknown sample can be determined.

EXAMPLE 7

Use of Multiple Dyes for Increasing the Sample Throughput Volume and for Increasing the Complexity of the Analysis.

The present experiment serves for the purpose of analyzing different samples in a single hybridization step and in this way increasing the sample throughput volume. For this purpose, a defined fragment of 529-bp length from the promoter region of the ELK-1 gene taken from each of four individuals and, starting with the bisulfite-treated DNA, is amplified with the primer oligonucleotides ATGGTTTT-GTTTAATYGTAGAGTTGTTT (SEQ ID NO: 40715) and TAAACCCRAAAAAAAAAAACCCAATAT (SEQ ID NO: 40716). These fragments originating from four individuals are labeled with the four different fluorescent dyes Cy3, Cy5, Cy2 and Cy7 and hybridized to immobilized oligonucleotides, here, for example, ATTAATAGCGTTTTGGTT and ATTAATAGTGTTTTGGTT, whereby the C or T to be detected is found each time at position 476 of the amplified product. The samples with different fluorescent labels are then analyzed at different wavelengths without a mutual interference based on the fluorescent dye.

On the other hand, it is also possible to produce different sets of fragments from one DNA sample, which are labeled with different dyes, here Cy2, Cy3 and Cy5. If a set of oligonucleotide probes for 64 genes (set 1) is immobilized on a chip, then the specificity is sufficient in order to analyze 64 fragments, e.g., labeled with Cy3, independent of one another. Due to the fact that samples of set 1 are labeled here with the fluorescent dye Cy3 and samples of set 2 are labeled with the fluorescent dye Cy5 (and set 3 with Cy2), the detection of the methylation state via measuring the fluorescent intensities of the fragments of set 1 is not influenced by the fluorescently labeled amplified products of sets 2 and 3 (and vice versa). Therefore, despite the increased complexity of the amplified products, it is possible to produce data that are equally reliable to those for a complexity of 64 amplified products.

EXAMPLE 8

Use of Multiple Dyes for Verifying Experimental Reproducibility

In the present experiment, the same PCR amplified products are labeled with four different fluorescent dyes and these are verified by a 4× redundancy. For this purpose, starting from bisulfite-treated DNA, a a defined fragment of 529-bp length from the promoter region of the ELK-1 gene is amplified with the primer oligonucleotides ATGGTTTT-GTTTAATYGTAGAGTTGTTT (SEQ ID NO: 40715) and TAAACCCRAAAAAAAAAAACCCAATAT (SEQ ID NO: 40716), and hybridized to immobilized oligonucleotides, here, for example, ATTAATAGTGTTTTGGTT (SEQ ID NO: 40722) and ATTAATAGTGTTTTGGTT (SEQ ID NO: 40723), whereby the C or T to be detected is found each time at position 476 of the amplified product. The ratios of samples with different fluorescent labels are compared by employing primer oligonucleotides fluorescently labeled with Cy3, Cy5, Cy2 and Cy7, and in this way a higher experimental reliability is achieved.

SEQUENCE LISTING (40723 sequences)

SEQ ID NO: 1 - DNA, 510 bp, Artificial Sequence
  chemically treated genomic DNA (Homo sapiens) CpG-island No: 1
gcggcgaattcgagatgtggtaattatttttacgttagggtgttaggcggaggttaagttttttattcgggggcggagcgtggcgcggcgtgggcgggattttcggtttaagaagggcggtgattggggcggtagggatgtggtttttttcgggttaattaggtagttcggttgggttcgagagttagcgggcgggcgggttgcggattttagcggggtttgtcgggaaaggggcgggtcgagcgtattgggtcgaggcggggcgaagtgggggtgtttagttcgttgcggggggcggggtcgcgtttgtcgtagtaacggggtgcggtagggtggggaacgcgggagcggggttagtttttaggaaagttggtttgcgagcggtttttgttcggtttttaggtttttgcgcgatttcgtttttttcgagattttagtcgggttgtcgttcgcgtttcggaaggtgagtgggggaggggagatggagtttggggttgtcgagaagtaggg

SEQ ID NO: 2 - DNA, 510 bp, Artificial Sequence
  chemically treated genomic DNA (Homo sapiens) CpG-island No: 2
ccctacttctcgacaaccccaaactccatctcccctcccccactcaccttccgaaacgcgaacgacaacccgactaaaatctcgaaaaaaacgaaatcgcgcaaaaacctaaaaaccgaacaaaaaccgctcgcaaaccaactttcctaaaaactaaccccgctcccgcgttccccaccctaccgcaccccgttactacgacaaacgcgaccccgccccccgcaacgaactaaacacccccacttcgccccgcctcgacccaatacgctcgacccgcccctttcccgacaaaccccgctaaaatccgcaacccgcccgcccgctaactctcgaacccaaccgaactacctaattaacccgaaaaaaaccacatccctaccgccccaatcaccgcccttcttaaaccgaaaatcccgcccacgccgcgccacgctccgcccccgaataaaaaacttaacctccgcctaacaccctaacgtaaaaataattaccacatctcgaattcgccgc

SEQ ID NO: 3 - DNA, 510 bp, Artificial Sequence
  chemically treated genomic DNA (Homo sapiens) CpG-island No: 3
ttttgtttttcggtagttttaggttttatttttttttttttatttatttttcgggacgcgggcggtagttcggttggggtttcgggaagggcggggtcgcgtagggatttgggagtcgggtaggggtcgttcgtagattagtttttttgggagttggtttcgttttcgcgttttttattttgtcgtatttcgttgttgcggtagacgcgatttcgtttttcgtaacggattaagtatttttatttcgtttcgtttcggtttagtgcgttcggttcgtttttttttcggtaggtttcgttagagttcgtagttcgttcgttcgttggttttcgggtttagtcgggttgtttggttagttcggggagggttatatttttgtcgttttagttatcgttttttttgagtcgggaatttcgtttacgtcgcgttacgtttcgttttcgggtgagggatttgattttcgtttggtattttggcgtaagggtgattgttatatttcggattcgtcgt

SEQ ID NO: 4 - DNA, 510 bp, Artificial Sequence
  chemically treated genomic DNA (Homo sapiens) CpG-island No: 4
acgacgaatccgaaatataacaatcacccttacgccaaaataccaaacgaaaatcaaatccctcacccgaaaacgaaacgtaacgcgacgtaaacgaaattcccgactcaaaaaaaacgataactaaaacgacaaaaatataaccctccccgaactaaccaaacaacccgactaaacccgaaaaccaacgaacgaacgaactacgaactctaacgaaacctaccgaaaaaaaaacgaaccgaacgcactaaaccgaaacgaaacgaaataaaaatacttaatccgttacgaaaaacgaaatcgcgtctaccgcaacaacgaaatacgacaaaataaaaaacgcgaaaacgaaaccaactcccaaaaaaactaatctacgaacgacccctacccgactcccaaatccctacgcgaccccgcccttcccgaaaccccaaccgaactaccgcccgcgtcccgaaaaataaataaaaaaaaaaaaataaaacctaaaactaccgaaaaacaaaa

SEQ ID NO: 5 - DNA, 564 bp, Artificial Sequence
  chemically treated genomic DNA (Homo sapiens) CpG-island No: 5
ttttttcggtaaatttttttcgggtttacggtacgtatgcgtagtaattttcgtacgggttcggttagtttcgtgttttatgatttttttttaaaatacgcgtagtttttttttttttttttttttgttcgttttttttttgtttattagttttatttgatgggttcgtgtttttttcgttttcgatttattcgggtttcggcggttgttgtttgggcgttttcggtatcgcggtggtagttatagttattgtggcggcgttcggtgttattttcgttttcggcggcggggaatttcgatggggttggttttttaagttggcgcggttaatttcgttttcgggttgcgtacgtgcgagtttcgtcgttatttcgggggcgtggttttggtttagtggaggcgtggtttgtaatgacggagcggggtcggcgttcgtttgttttagtcgcgtaaatatatggcgtttacgattgtttgggaagtttgacgtcgtgatttttcgacgtcgcgagatttaaggaatgaatataataattttttattagtatgaaggagttgaggtat

SEQ ID NO: 6 - DNA, 564 bp, Artificial Sequence
  chemically treated genomic DNA (Homo sapiens) CpG-island No: 6
atacctcaactccttcatactaataaaaaattattatattcattccttaaatctcgcgacgtcgaaaaatcacgacgtcaaacttcccaaacaatcgtaaacgccatatatttacgcgactaaaacaaacgaacgccgaccccgctccgtcattacaaaccacgcctccactaaaccaaaaccacgcccccgaaataacgacgaaactcgcacgtacgcaacccgaaaacgaaattaaccgcgccaacttaaaaaaccaaccccatcgaaattccccgccgccgaaaacgaaaataacaccgaacgccgccacaataactataactaccaccgcgataccgaaaacgcccaaacaacaaccgccgaaacccgaataaatcgaaaacgaaaaaaacacgaacccatcaaataaaactaataaacaaaaaaaaaacgaacaaaaaaaaaaaaaaaaaaaaactacgcgtattttaaaaaaaaatcataaaacacgaaactaaccgaacccgtacgaaaattactacgcatacgtaccgtaaacccgaaaaaaatttaccgaaaaaa

SEQ ID NO: 7 - DNA, 564 bp, Artificial Sequence
  chemically treated genomic DNA (Homo sapiens) CpG-island No: 7
atgttttaatttttttatattagtaggaaattattatgtttattttttgagtttcgcggcgtcgggaggttacggcgttaggttttttagatagtcgtaaacgttatgtgtttacgcgattggagtaagcggacgtcggtttcgtttcgttattgtaggttacgtttttattgaattagggttacgttttcgagatggcggcgaagttcgtacgtgcgtagttcgggggcggggttggtcgcgttagtttggagagttagttttatcggggtttttcgtcgtcggaagcggaaatagtatcgggcgtcgttatagtagttgtaattgttatcgcgatgtcgaaggcgtttaagtagtagtcgtcggagttcgagtggatcggggacggagagagtacgagtttattaggtgaggttggtaggtaaggaagaaacgagtagagggggaagagagaggagattgcgcgtgttttaagagagggttatggggtacgagattgatcgggttcgtgcgggagttattgcgtatgcgtgtcgtgggttcgggaggagtttgtcggggagg

SEQ ID NO: 8 - DNA, 564 bp, Artificial Sequence
  chemically treated genomic DNA (Homo sapiens) CpG-island No: 8
cctccccgacaaactcctcccgaacccacgacacgcatacgcaataactcccgcacgaacccgatcaatctcgtaccccataaccctctcttaaaacacgcgcaatctcctctctcttccccctctactcgtttcttccttacctaccaacctcacctaataaactcgtactctctccgtccccgatccactcgaactccgacgactactacttaaacgccttcgacatcgcgataacaattacaactactataacgacgcccgatactatttccgcttccgacgacgaaaaaccccgataaaactaactctccaaactaacgcgaccaaccccgcccccgaactacgcacgtacgaacttcgccgccatctcgaaaacgtaaccctaattcaataaaaacgtaacctacaataacgaaacgaaaccgacgtccgcttactccaatcgcgtaaacacataacgtttacgactatctaaaaaacctaacgccgtaacctcccgacgccgcgaaactcaaaaaataaacataataatttcctactaatataaaaaaattaaaacat

SEQ ID NO: 9 - DNA, 1007 bp, Artificial Sequence
  chemically treated genomic DNA (Homo sapiens) CpG-island No: 9
cgggtgggcggcgtaaggagtttatagttaagtttttcggttatttttaaggtgatagcgacgagattcgtattcgtttttttcgtaggttttgcgttggtttacgtgagattcgttttcgtttcgtcggcgttgtcgttttttttagtttttagtttcggtttttaggtttttggaacgttttttttttttttcgaggatcggtttcgttattttgggcggcgcgttcgtttgttttttttttatttcggtcgtcgggtagcgggaatagattttagcgcgtatttattcgtagtttttttaagcgtttcgggagtaaagacgtagaggcggggagggttggcgttttttgtattattggcggggtcgtcgagaattcgtttcggaggtttcgggggcggcgtttgtatttgggggcgcgcggcgcggtattattttacgtttgcggcggttattaggcgggattcggagtttcggttttttcgttttttcgttttcggggtcgttagggggtggagtagggcggggagttcgggaaatttgtaaatagtcgaattcgggtttttcgttttaattcggggcggtttttttcgaaggttttattttagcggttcgttgcgggagattaaggttagtcgtcgttttaggggacggttttcggggaatttgaatgacgtgcgaggtcgtatttcggggcgttggatttcgttcgggcgttttcgtttttcgttttcgttttcgggttttaatttcgacgtttcgcgcgttttcggattaagtgcggacgcgttttacgtttttcggcgttagttcgggatagcgttgtatttgttgttacgtgcgacgcggcgtttagcggttgttattgtcgtcggcgtatttggttgtatcgcgcgtttcgggattacgttcgttttcgtaggagttcggggtttcgtcgtatttagcgttagggtttaggtcgggtcgcggtaggtgggggatttgatttttgtttgtttttggtt

SEQ ID NO: 10 - DNA, 1007 bp, Artificial Sequence
  chemically treated genomic DNA (Homo sapiens) CpG-island No: 10
aaccaaaaacaaacaaaaatcaaatcccccacctaccgcgacccgacctaaaccctaacgctaaatacgacgaaaccccgaactcctacgaaaacgaacgtaatcccgaaacgcgcgatacaaccaaatacgccgacgacaataacaaccgctaaacgccgcgtcgcacgtaacaacaaatacaacgctatcccgaactaacgccgaaaaacgtaaaacgcgtccgcacttaatccgaaaacgcgcgaaacgtcgaaattaaaacccgaaaacgaaaacgaaaaacgaaaacgcccgaacgaaatccaacgccccgaaatacgacctcgcacgtcattcaaattccccgaaaaccgtcccctaaaacgacgactaaccttaatctcccgcaacgaaccgctaaaataaaaccttcgaaaaaaaccgccccgaattaaaacgaaaaacccgaattcgactatttacaaatttcccgaactccccgccctactccaccccctaacgaccccgaaaacgaaaaaacgaaaaaaccgaaactccgaatcccgcctaataaccgccgcaaacgtaaaataataccgcgccgcgcgcccccaaatacaaacgccgcccccgaaacctccgaaacgaattctcgacgaccccgccaataatacaaaaaacgccaaccctccccgcctctacgtctttactcccgaaacgcttaaaaaaactacgaataaatacgcgctaaaatctattcccgctacccgacgaccgaaataaaaaaaaaacaaacgaacgcgccgcccaaaataacgaaaccgatcctcgaaaaaaaaaaaaaacgttccaaaaacctaaaaaccgaaactaaaaactaaaaaaaacgacaacgccgacgaaacgaaaacgaatctcacgtaaaccaacgcaaaacctacgaaaaaaacgaatacgaatctcgtcgctatcaccttaaaaataaccgaaaaacttaactataaactccttacgccgcccacccg

SEQ ID NO: 11 - DNA, 1007 bp, Artificial Sequence
  chemically treated genomic DNA (Homo sapiens) CpG-island No: 11
ggttagaggtaagtaggagttagattttttatttatcgcggttcggtttgggttttagcgttgggtgcggcggagtttcgggtttttgcggggacgagcgtggtttcgggacgcgcggtgtagttaggtgcgtcggcggtagtggtagtcgttgagcgtcgcgtcgtacgtggtaataggtgtagcgttgtttcgggttggcgtcggggggcgtggggcgcgttcgtatttagttcgggagcgcgcggagcgtcgggattgggattcgagagcgggagcggagagcgggagcgttcgagcggagtttagcgtttcgaggtacggtttcgtacgttatttaggtttttcgagggtcgttttttgggacggcggttggttttggtttttcgtagcgagtcgttggagtggagttttcggaaggagtcgtttcgggttggggcgggaggttcgagttcggttatttataagtttttcgaatttttcgttttgttttattttttggcggtttcggaggcggggaggcggggaggtcggggtttcgggtttcgtttggtagtcgtcgtaggcgtggggtggtgtcgcgtcgcgcgtttttaggtgtagacgtcgttttcgagattttcggggcgggttttcggcgatttcgttagtggtgtaaagggcgttagtttttttcgtttttgcgtttttgttttcggagcgtttgaaggagttgcgggtaagtgcgcgttggaatttgttttcgttgttcggcggtcggggtggggaggggataggcgagcgcgtcgtttagggtgacgggatcggttttcggggaggggagggggcgttttaggggtttgggggtcgaagttgagggttaaagggggcggtagcgtcggcggagcggaggcgggttttacgtggattagcgtagagtttgcggaagggacggatgcggatttcgtcgttgttattttgaaagtgatcgaggggtttgattgtggattttttacgtcgtttattcg

SEQ ID NO: 12 - DNA, 1007 bp, Artificial Sequence
  chemically treated genomic DNA (Homo sapiens) CpG-island No: 12
cgaataaacgacgtaaaaaatccacaatcaaacccctcgatcactttcaaaataacaacgacgaaatccgcatccgtcccttccgcaaactctacgctaatccacgtaaaacccgcctccgctccgccgacgctaccgccccctttaaccctcaacttcgacccccaaacccctaaaacgccccctcccctccccgaaaaccgatcccgtcaccctaaacgacgcgctcgcctatcccctccccaccccgaccgccgaacaacgaaaacaaattccaacgcgcacttacccgcaactccttcaaacgctccgaaaacaaaaacgcaaaaacgaaaaaaactaacgccctttacaccactaacgaaatcgccgaaaacccgccccgaaaatctcgaaaacgacgtctacacctaaaaacgcgcgacgcgacaccaccccacgcctacgacgactaccaaacgaaacccgaaaccccgacctccccgcctccccgcctccgaaaccgccaaaaaataaaacaaaacgaaaaattcgaaaaacttataaataaccgaactcgaacctcccgccccaacccgaaacgactccttccgaaaactccactccaacgactcgctacgaaaaaccaaaaccaaccgccgtcccaaaaaacgaccctcgaaaaacctaaataacgtacgaaaccgtacctcgaaacgctaaactccgctcgaacgctcccgctctccgctcccgctctcgaatcccaatcccgacgctccgcgcgctcccgaactaaatacgaacgcgccccacgccccccgacgccaacccgaaacaacgctacacctattaccacgtacgacgcgacgctcaacgactaccactaccgccgacgcacctaactacaccgcgcgtcccgaaaccacgctcgtccccgcaaaaacccgaaactccgccgcacccaacgctaaaacccaaaccgaaccgcgataaataaaaaatctaactcctacttacctctaacc

SEQ ID NO: 13 - DNA, 692 bp, Artificial Sequence
  chemically treated genomic DNA (Homo sapiens) CpG-island No: 13
tttttttcggtacgggtcggagttgatatttttacggaaaatcgtatagcgttttcgttttttttttacgggttgagggattaatgtattttcgtataggtttagggttttacgtttcgcgattagcgtcggaagcgtacggtatgttgggatttgtagttttttatttgtgttcggtaggcgtttagaacgcgaggtttagttggtattttgggatatatagtttttgggcggatgggggcggattcgttggtgtaattttttttcggtttaaagagttagaagcgatattatagatttcggcgggttatatgattttagtttagttcgtattgcggttttcgttcgggcgagttttcgttttcgcgcggtcgttgtcgaggagacggcgtatgtttcgtcgcgcgttgttttttttgtagtattttcgtttttttttttttattataatgagattttaagatggcggtggttgcggcggttggcgttgcgtagttgaggtcgaaaaggcggttattggggtcgaggtagttaggaaacgtgtgggtttttttgttgcggttttcgagggtcgatcgttgtcggcggcgggtcgtgggggttgattgtcgttttgtttttgataggagaggttgttttttgtagaggtaatgtttgcgcgtttttagtttttggtaatttagggcggcgcg

SEQ ID NO: 14 - DNA, 692 bp, Artificial Sequence
  chemically treated genomic DNA (Homo sapiens) CpG-island No: 14
cgcgccgccctaaattaccaaaaactaaaaacgcgcaaacattacctctacaaaaaacaacctctcctatcaaaaacaaaacgacaatcaacccccacgacccgccgccgacaacgatcgaccctcgaaaaccgcaacaaaaaaacccacacgtttcctaactacctcgaccccaataaccgccttttcgacctcaactacgcaacgccaaccgccgcaaccaccgccatcttaaaatctcattataataaaaaaaaaaaaacgaaaatactacaaaaaaaacaacgcgcgacgaaacatacgccgtctcctcgacaacgaccgcgcgaaaacgaaaactcgcccgaacgaaaaccgcaatacgaactaaactaaaatcatataacccgccgaaatctataatatcgcttctaactctttaaaccgaaaaaaaattacaccaacgaatccgcccccatccgcccaaaaactatatatcccaaaataccaactaaacctcgcgttctaaacgcctaccgaacacaaataaaaaactacaaatcccaacataccgtacgcttccgacgctaatcgcgaaacgtaaaaccctaaacctatacgaaaatacattaatccctcaacccgtaaaaaaaaaacgaaaacgctatacgattttccgtaaaaatatcaactccgacccgtaccgaaaaaaa

SEQ ID NO: 15 - DNA, 692 bp, Artificial Sequence
  chemically treated genomic DNA (Homo sapiens) CpG-island No: 15
cgcgtcgttttaggttgttaagggttggggacgcgtaggtattatttttataagaagtagttttttttgttaaaggtagagcgatagttagtttttacgattcgtcgtcggtagcggtcggttttcggagatcgtagtagagaggtttatacgttttttggttgtttcggttttagtggtcgttttttcgattttagttacgtagcgttaatcgtcgtagttatcgttattttaggattttattgtggtgggagaagaggggcgggggtattgtagagggggtaacgcgcggcgggatatgcgtcgttttttcggtaacggtcgcgcgggggcgagaattcgttcgggcgggagtcgtaatgcgagttagattggagttatgtgattcgtcggagtttgtggtgtcgtttttggttttttaagtcgaaaagagattatattaacgaattcgtttttattcgtttaggaattatgtattttagaatgttaattagatttcgcgttttaaacgtttgtcgggtataagtggaggattataaattttagtatgtcgtgcgttttcggcgttgatcgcggagcgtggggttttaggtttatgcggaagtgtattgattttttagttcgtggagaaagagcggaggcgttgtgcggtttttcgtgggggtgttagtttcggttcgtgtcggaagaag

SEQ ID NO: 16 - DNA, 692 bp, Artificial Sequence
  chemically treated genomic DNA (Homo sapiens) CpG-island No: 16
cttcttccgacacgaaccgaaactaacacccccacgaaaaaccgcacaacgcctccgctctttctccacgaactaaaaaatcaatacacttccgcataaacctaaaaccccacgctccgcgatcaacgccgaaaacgcacgacatactaaaatttataatcctccacttatacccgacaaacgtttaaaacgcgaaatctaattaacattctaaaatacataattcctaaacgaataaaaacgaattcgttaatataatctcttttcgacttaaaaaaccaaaaacgacaccacaaactccgacgaatcacataactccaatctaactcgcattacgactcccgcccgaacgaattctcgcccccgcgcgaccgttaccgaaaaaacgacgcatatcccgccgcgcgttaccccctctacaatacccccgcccctcttctcccaccacaataaaatcctaaaataacgataactacgacgattaacgctacgtaactaaaatcgaaaaaacgaccactaaaaccgaaacaaccaaaaaacgtataaacctctctactacgatctccgaaaaccgaccgctaccgacgacgaatcgtaaaaactaactatcgctctacctttaacaaaaaaaactacttcttataaaaataatacctacgcgtccccaacccttaacaacctaaaacgacgcg

SEQ ID NO: 17 - DNA, 758 bp, Artificial Sequence
  chemically treated genomic DNA (Homo sapiens) CpG-island No: 17
ttcgttagttcgttttgtatttatatttttgtgtacgaaattatagattttcgtaaagaagttgtttagtacgaggtgttttttgtattcgttcgcgtcgttatatttgcgtttttattcgcgttcgtatttgtacgtttttttttgcgtttcggtttaagtttatttatcggcggcgcgtgttgcgcgacggtatagttgacggcggtagttaggaggattaaggcgacgtaatttcggttcggtatcgttttagtagttaacgttatttttcggattttagtagaggtaaagaagagtcggttgggtcgggggtaggttacgtttttttcgtcgcgtgattcgcgatttgggatcgtattattttaggtagtagggggaacgttcggaggaggcgggattgggaggagaggacggggttttttagtgttacgaaaagggtggcgtagagaaagagagagagttttataggttatttgtagaaggagagtcgcgatcgtttttggcgcgtggcgtgatttattttttttttttatcgcgggtaatagtcggatcgagtcggagtttcgtttcgtaggtggggtcgggagttttattcgtggcgtttcgatggggcgtttttagtaggcgggtgtagtttgtttcgcgtatttaggcgttttcggtatttacgaaacggatttaaagagttttaatattaatgtaatattttattttgatttatttttgttttttgagaaaagcggttcgaaatgagt

SEQ ID NO: 18 - DNA, 758 bp, Artificial Sequence
  chemically treated genomic DNA (Homo sapiens) CpG-island No: 18
actcatttcgaaccgcttttctcaaaaaacaaaaataaatcaaaataaaatattacattaatattaaaactctttaaatccgtttcgtaaataccgaaaacgcctaaatacgcgaaacaaactacacccgcctactaaaaacgccccatcgaaacgccacgaataaaactcccgaccccacctacgaaacgaaactccgactcgatccgactattacccgcgataaaaaaaaaaaataaatcacgccacgcgccaaaaacgatcgcgactctccttctacaaataacctataaaactctctctctttctctacgccacccttttcgtaacactaaaaaaccccgtcctctcctcccaatcccgcctcctccgaacgttccccctactacctaaaataatacgatcccaaatcgcgaatcacgcgacgaaaaaaacgtaacctacccccgacccaaccgactcttctttacctctactaaaatccgaaaaataacgttaactactaaaacgataccgaaccgaaattacgtcgccttaatcctcctaactaccgccgtcaactataccgtcgcgcaacacgcgccgccgataaataaacttaaaccgaaacgcaaaaaaaaacgtacaaatacgaacgcgaataaaaacgcaaatataacgacgcgaacgaatacaaaaaacacctcgtactaaacaacttctttacgaaaatctataatttcgtacacaaaaatataaatacaaaacgaactaacgaa

SEQ ID NO: 19 - DNA, 758 bp, Artificial Sequence
  chemically treated genomic DNA (Homo sapiens) CpG-island No: 19
atttatttcgggtcgttttttttagagggtaaagatgggttagggtgggatgttatattagtgttgagattttttggattcgtttcgtgggtatcgaggacgtttgggtacgcgggataggttgtattcgtttgttagaggcgttttatcgaggcgttacgggtgaagttttcggttttatttacggggcggggtttcggttcggttcgattattgttcgcggtgggggagggggatggattacgttacgcgttaaaggcgatcgcgattttttttttgtaggtagtttgtaaggttttttttttttttttacgttatttttttcgtggtattgaaaagtttcgttttttttttttagtttcgtttttttcgagcgttttttttattgtttggaatggtgcggttttaggtcgcgggttacgcggcggagggggcgtggtttgttttcggtttagtcggtttttttttgtttttgttggagttcggggagtggcgttggttgttagagcgatgtcgggtcggagttgcgtcgttttagtttttttggttgtcgtcgttagttgtgtcgtcgcgtagtacgcgtcgtcggtgagtgagtttgagtcgaggcgtagagaggggcgtgtaggtgcgggcgcggatggaggcgtaggtgtggcggcgcgagcgggtataaggaatatttcgtgttgggtagtttttttacgggggtttgtggtttcgtgtataggggtgtgggtgtagagcgggttggcgaa

SEQ ID NO: 20 - DNA, 758 bp, Artificial Sequence
  chemically treated genomic DNA (Homo sapiens) CpG-island No: 20
ttcgccaacccgctctacacccacacccctatacacgaaaccacaaacccccgtaaaaaaactacccaacacgaaatattccttatacccgctcgcgccgccacacctacgcctccatccgcgcccgcacctacacgcccctctctacgcctcgactcaaactcactcaccgacgacgcgtactacgcgacgacacaactaacgacgacaaccaaaaaaactaaaacgacgcaactccgacccgacatcgctctaacaaccaacgccactccccgaactccaacaaaaacaaaaaaaaaccgactaaaccgaaaacaaaccacgccccctccgccgcgtaacccgcgacctaaaaccgcaccattccaaacaataaaaaaaacgctcgaaaaaaacgaaactaaaaaaaaaaaacgaaacttttcaataccacgaaaaaaataacgtaaaaaaaaaaaaaaaaccttacaaactacctacaaaaaaaaaatcgcgatcgcctttaacgcgtaacgtaatccatccccctcccccaccgcgaacaataatcgaaccgaaccgaaaccccgccccgtaaataaaaccgaaaacttcacccgtaacgcctcgataaaacgcctctaacaaacgaatacaacctatcccgcgtacccaaacgtcctcgatacccacgaaacgaatccaaaaaatctcaacactaatataacatcccaccctaacccatctttaccctctaaaaaaaacgacccgaaataaat

SEQ ID NO: 21 - DNA, 728 bp, Artificial Sequence
  chemically treated genomic DNA (Homo sapiens) CpG-island No: 21
aagaaagtcgaggcgtcgaggtttttaaagttggtagtttcgggtggcggtgtagggcgaaggggggcggggggaatcgtcggatatgcggttttggattttggtgttgtatttggggttgttgagcgtcgcgttgggttgcgggttggtcgagcgttttcgtcgggttcggagagattcgcgggtcggtcgattttcgcgtttcgtcgtcgggttcggttatttgttttattcgggcgtgttcgacggcggtcgcgtttcgtcgtcgtcgtcgtcgtcgtcgggcggtgtttgggaagtcgtgcgcgtttttcggcggcggcgtagtagcgggaggcgaggggcgttatcgaggagtcgagttcgtcgagtcggatatattttagcgggcgaggcgagtagttgcgttttcgggtcgatttcgagttgtttcgggacgcgtttacgttgtaagtgtggttgcgagcggaggggggttagaggttttcggtagtgattataggtaggtgagggcgtttcggcgggcgttgtatcgtttttgcggttttagaggttcgcgggtgtttgggcgcgggtggcgggcgggtcgggggtttgcgggcgtgtttgtgcgagaggtgtttcgcgagcggcgtagagatatcgggcgagttgagagttttattttgttttatcggtggaatgggtatattcggaaggcgtagttgttttatttttgggaggaattt

SEQ ID NO: 22 - DNA, 728 bp, Artificial Sequence
  chemically treated genomic DNA (Homo sapiens) CpG-island No: 22
aaattcctcccaaaaataaaacaactacgccttccgaatatacccattccaccgataaaacaaaataaaactctcaactcgcccgatatctctacgccgctcgcgaaacacctctcgcacaaacacgcccgcaaacccccgacccgcccgccacccgcgcccaaacacccgcgaacctctaaaaccgcaaaaacgatacaacgcccgccgaaacgccctcacctacctataatcactaccgaaaacctctaacccccctccgctcgcaaccacacttacaacgtaaacgcgtcccgaaacaactcgaaatcgacccgaaaacgcaactactcgcctcgcccgctaaaatatatccgactcgacgaactcgactcctcgataacgcccctcgcctcccgctactacgccgccgccgaaaaacgcgcacgacttcccaaacaccgcccgacgacgacgacgacgacgacgaaacgcgaccgccgtcgaacacgcccgaataaaacaaataaccgaacccgacgacgaaacgcgaaaatcgaccgacccgcgaatctctccgaacccgacgaaaacgctcgaccaacccgcaacccaacgcgacgctcaacaaccccaaatacaacaccaaaatccaaaaccgcatatccgacgattccccccgccccccttcgccctacaccgccacccgaaactaccaactttaaaaacctcgacgcctcgactttctt

SEQ ID NO: 23 - DNA, 728 bp, Artificial Sequence
  chemically treated genomic DNA (Homo sapiens) CpG-island No: 23
aggttttttttagggatggagtagttacgtttttcgagtgtgtttattttatcgatggagtaaagtgaggtttttagttcgttcgatgtttttgcgtcgttcgcggggtatttttcgtatagatacgttcgtaagttttcgattcgttcgttattcgcgtttagatattcgcgagtttttggggtcgtagggacggtgtagcgttcgtcgaggcgtttttatttatttgtgattattgtcggagatttttggttttttttcgttcgtagttatatttgtagcgtgaacgcgtttcggggtagttcgaggtcggttcggaggcgtagttgttcgtttcgttcgttgaaatatattcggttcggcgggttcggtttttcggtggcgtttttcgtttttcgttgttgcgtcgtcgtcgggggacgcgtacggttttttaggtatcgttcggcggcggcggcggcggcggcgaagcgcggtcgtcgtcgggtacgttcgggtggggtaggtggtcgggttcggcggcggggcgcgggggtcggtcggttcgcgggttttttcgggttcggcggggacgttcggttagttcgtagtttagcgcggcgtttagtagttttaggtgtagtattaaaatttagagtcgtatgttcgacggtttttttcgttttttttcgttttgtatcgttattcggagttgttagttttgggagtttcggcgtttcgattttttt

SEQ ID NO: 24 - DNA, 728 bp, Artificial Sequence
  chemically treated genomic DNA (Homo sapiens) CpG-island No: 24
aaaaaaatcgaaacgccgaaactcccaaaactaacaactccgaataacgatacaaaacgaaaaaaaacgaaaaaaaccgtcgaacatacgactctaaattttaatactacacctaaaactactaaacgccgcgctaaactacgaactaaccgaacgtccccgccgaacccgaaaaaacccgcgaaccgaccgacccccgcgccccgccgccgaacccgaccacctaccccacccgaacgtacccgacgacgaccgcgcttcgccgccgccgccgccgccgccgaacgatacctaaaaaaccgtacgcgtcccccgacgacgacgcaacaacgaaaaacgaaaaacgccaccgaaaaaccgaacccgccgaaccgaatatatttcaacgaacgaaacgaacaactacgcctccgaaccgacctcgaactaccccgaaacgcgttcacgctacaaatataactacgaacgaaaaaaaaccaaaaatctccgacaataatcacaaataaataaaaacgcctcgacgaacgctacaccgtccctacgaccccaaaaactcgcgaatatctaaacgcgaataacgaacgaatcgaaaacttacgaacgtatctatacgaaaaataccccgcgaacgacgcaaaaacatcgaacgaactaaaaacctcactttactccatcgataaaataaacacactcgaaaaacgtaactactccatccctaaaaaaaacct

SEQ ID NO: 25 - DNA, 579 bp, Artificial Sequence
  chemically treated genomic DNA (Homo sapiens) CpG-island No: 25
cgggtatttcggttttcgatggtgttttagaggcgtcgtttttgttgggggcgtggttattttgttagttcgggcgtaggggttcgaatcgggtgtatattggtcggtttttttgttaggatcgtttttcgagtgtaagacgggcgggttgttgagggcgtttcgcgggtttggtttgggtcggggaatttcgggacggcgtcgtagtagggttacgaatttttcggtttttgttttttaaattatttttaggtataggtaatcgcggagagtcgggcgtaacgtagacgcgtttcgttgtttggttttgatttcgtttgatcgtttttaaatttgggaggatcgacgtttttgcgcgataggttcggtaacgtttttttttcgttttcgcgatttttagtttgtttacgcgttgtagggtataggtgggaaggggcggcgggtgtttttgcgtttgcgcggaatttagcgcgcgtttcgttttacgtatcggttttgaggagggttttttttcgttttttttttttttttttttttttttttcgtttatttggggtcgagtttggtaggcgcgtaggt

SEQ ID NO: 26 - DNA, 579 bp, Artificial Sequence
  chemically treated genomic DNA (Homo sapiens) CpG-island No: 26
acctacgcgcctaccaaactcgaccccaaataaacgaaaaaaaaaaaaaaaaaaaaaaaaaaaacgaaaaaaaaccctcctcaaaaccgatacgtaaaacgaaacgcgcgctaaattccgcgcaaacgcaaaaacacccgccgccccttcccacctataccctacaacgcgtaaacaaactaaaaatcgcgaaaacgaaaaaaaaacgttaccgaacctatcgcgcaaaaacgtcgatcctcccaaatttaaaaacgatcaaacgaaatcaaaaccaaacaacgaaacgcgtctacgttacgcccgactctccgcgattacctatacctaaaaataatttaaaaaacaaaaaccgaaaaattcgtaaccctactacgacgccgtcccgaaattccccgacccaaaccaaacccgcgaaacgccctcaacaacccgcccgtcttacactcgaaaaacgatcctaacaaaaaaaccgaccaatatacacccgattcgaacccctacgcccgaactaacaaaataaccacgcccccaacaaaaacgacgcctctaaaacaccatcgaaaaccgaaatacccg

SEQ ID NO: 27 - DNA, 579 bp, Artificial Sequence
  chemically treated genomic DNA (Homo sapiens) CpG-island No: 27
gtttgcgcgtttattaggttcgattttaggtgagcggaggagaagagggagggaggagagggggcggggagagattttttttaaagtcggtgcgtggggcggagcgcgcgttgggtttcgcgtaggcgtagagatattcgtcgtttttttttatttgtgttttgtagcgcgtggataggttaggggtcgcgggagcgggagggaggcgttgtcgggtttgtcgcgtaaggacgtcggtttttttaggtttgagggcggttaggcggggttaaggttaggtagcggggcgcgtttgcgttgcgttcgatttttcgcggttatttgtgtttagaggtgatttgaagggtaggggtcgagagattcgtagttttgttgcggcgtcgtttcggagtttttcggtttagattagattcgcggggcgtttttagtagttcgttcgttttgtattcggagagcggttttggtaggaaggtcggttagtgtgtattcggttcgggtttttgcgttcgggttggtaagatggttacgtttttagtagagacggcgtttttaggatattatcggggatcgaggtattcg

SEQ ID NO: 28 - DNA, 579 bp, Artificial Sequence
  chemically treated genomic DNA (Homo sapiens) CpG-island No: 28
cgaatacctcgatccccgataatatcctaaaaacgccgtctctactaaaaacgtaaccatcttaccaacccgaacgcaaaaacccgaaccgaatacacactaaccgaccttcctaccaaaaccgctctccgaatacaaaacgaacgaactactaaaaacgccccgcgaatctaatctaaaccgaaaaactccgaaacgacgccgcaacaaaactacgaatctctcgacccctacccttcaaatcacctctaaacacaaataaccgcgaaaaatcgaacgcaacgcaaacgcgccccgctacctaaccttaaccccgcctaaccgccctcaaacctaaaaaaaccgacgtccttacgcgacaaacccgacaacgcctccctcccgctcccgcgacccctaacctatccacgcgctacaaaacacaaataaaaaaaaacgacgaatatctctacgcctacgcgaaacccaacgcgcgctccgccccacgcaccgactttaaaaaaaatctctccccgccccctctcctccctccctcttctcctccgctcacctaaaatcgaacctaataaacgcgcaaac

SEQ ID NO: 29 - DNA, 519 bp, Artificial Sequence
  chemically treated genomic DNA (Homo sapiens) CpG-island No: 29
gcgttaaatttaggttgcggtttttggcgtagtttcggtttcgtttgattttagtttttatttcgttgtttttggtgttttatcgttcgcggttgtttggggatttgttcggtgattagtgacgtaaaagagattaaggtttttattggacggcgaagttcggtaggagttaatttcggggttggttcgggagaaatttcggcgaagggtttcgaatagtcgggagattacggggcggggacgagttgtcgcgttggttgttcgtgtaggagcgggattcggaatagatcgtcgtgagagaggaggggcgtcggtcgggattcgcggttcggagttcgggatcggtgagtagggggtgtatatgagatatatagcgaagtaatagtttcgtacgtttatcgggtttggggcgatttaacgtagtcgtcgggttcgggtttaaaacggggttaggttttcgggcgggtttaggagggggttaagttcgttgcgttttttttgttagttagattttttttg

SEQ ID NO: 30 - DNA, 519 bp, Artificial Sequence
  chemically treated genomic DNA (Homo sapiens) CpG-island No: 30
caaaaaaaatctaactaacaaaaaaaacgcaacgaacttaaccccctcctaaacccgcccgaaaacctaaccccgttttaaacccgaacccgacgactacgttaaatcgccccaaacccgataaacgtacgaaactattacttcgctatatatctcatatacaccccctactcaccgatcccgaactccgaaccgcgaatcccgaccgacgcccctcctctctcacgacgatctattccgaatcccgctcctacacgaacaaccaacgcgacaactcgtccccgccccgtaatctcccgactattcgaaacccttcgccgaaatttctcccgaaccaaccccgaaattaactcctaccgaacttcgccgtccaataaaaaccttaatctcttttacgtcactaatcaccgaacaaatccccaaacaaccgcgaacgataaaacaccaaaaacaacgaaataaaaactaaaatcaaacgaaaccgaaactacgccaaaaaccgcaacctaaatttaacgc

SEQ ID NO: 31 - DNA, 519 bp, Artificial Sequence
  chemically treated genomic DNA (Homo sapiens) CpG-island No: 31
taggagggatttggttggtagggaggacgtagcgaatttgatttttttttgagttcgttcgggggtttggtttcgttttgaattcgggttcggcggttgcgttgggtcgttttaaattcggtgagcgtacgagattgttgtttcgttgtatgttttatgtgtattttttatttatcggtttcgagtttcgggtcgcgaatttcggtcggcgtttttttttttttacggcggtttgtttcgggtttcgtttttgtacgagtaattagcgcgatagttcgttttcgtttcgtaatttttcggttattcggggtttttcgtcgagatttttttcggattagtttcgggattggtttttgtcgaatttcgtcgtttaatgggaattttagttttttttacgttattgattatcgggtaaatttttagatagtcgcgggcggtggggtattaggggtagcgaaatggaaattgaaattaggcgggatcgaggttgcgttaagagtcgtagtttgagtttggcgt

SEQ ID NO: 32 - DNA, 519 bp, Artificial Sequence
  chemically treated genomic DNA (Homo sapiens) CpG-island No: 32
acgccaaactcaaactacgactcttaacgcaacctcgatcccgcctaatttcaatttccatttcgctacccctaataccccaccgcccgcgactatctaaaaatttacccgataatcaataacgtaaaaaaaactaaaattcccattaaacgacgaaattcgacaaaaaccaatcccgaaactaatccgaaaaaaatctcgacgaaaaaccccgaataaccgaaaaattacgaaacgaaaacgaactatcgcgctaattactcgtacaaaaacgaaacccgaaacaaaccgccgtaaaaaaaaaaaaacgccgaccgaaattcgcgacccgaaactcgaaaccgataaataaaaaatacacataaaacatacaacgaaacaacaatctcgtacgctcaccgaatttaaaacgacccaacgcaaccgccgaacccgaattcaaaacgaaaccaaacccccgaacgaactcaaaaaaaaatcaaattcgctacgtcctccctaccaaccaaatccctccta

SEQ ID NO: 33 - DNA, 534 bp, Artificial Sequence
  chemically treated genomic DNA (Homo sapiens) CpG-island No: 33
tatacgttatcgcgttcgtttggggtaggttagggaagggacgcgaggtagtcgtgttttcgtattttgtgagcggtagcgttttgggtttcgttgattttgtgttattttagtgattttcgttttagtttttgacggggttatattcggggtgtaaattaggatttttattgaaggcgcgcgattttgagaggtttttttttggttttttagttgtgagtttttttgcgggcggcggagttcgtttttattagaatcgtttagaggtcggcgttgtttttttggggtgacggagtagttggaagcgttttcggattttggaattagtgggcggttcgtgggaggggttgaggcgtagttttttgtttattcggtttcgaatttatcgcggtgttgttttaagcgagttagattttagatcgcgttttagttcggattcggaatttttgtttcgcgggtttgtatttttatagcggtaggtgtgagtgtcgcgtagttggagattagaagtttgaaggtagttcggtttttttt

SEQ ID NO: 34 - DNA, 534 bp, Artificial Sequence
  chemically treated genomic DNA (Homo sapiens) CpG-island No: 34
aaaaaaaaccgaactaccttcaaacttctaatctccaactacgcgacactcacacctaccgctataaaaatacaaacccgcgaaacaaaaattccgaatccgaactaaaacgcgatctaaaatctaactcgcttaaaacaacaccgcgataaattcgaaaccgaataaacaaaaaactacgcctcaacccctcccacgaaccgcccactaattccaaaatccgaaaacgcttccaactactccgtcaccccaaaaaaacaacgccgacctctaaacgattctaataaaaacgaactccgccgcccgcaaaaaaactcacaactaaaaaaccaaaaaaaaacctctcaaaatcgcgcgccttcaataaaaatcctaatttacaccccgaatataaccccgtcaaaaactaaaacgaaaatcactaaaataacacaaaatcaacgaaacccaaaacgctaccgctcacaaaatacgaaaacacgactacctcgcgtcccttccctaacctaccccaaacgaacgcgataacgtata

SEQ ID NO: 35 - DNA, 534 bp, Artificial Sequence
  chemically treated genomic DNA (Homo sapiens) CpG-island No: 35
ggggagggtcgagttgtttttaggtttttggtttttagttgcgcggtatttatatttgtcgttgtgaaaatgtagattcgcggggtaggaatttcgagttcgggttggagcgcgatttggaatttgattcgtttgaaatagtatcgcggtggattcggagtcgggtgagtagggaattgcgttttagttttttttacgggtcgtttattgattttaggattcgaaaacgtttttagttgtttcgttattttaggaaggtagcgtcggtttttgggcggttttggtggaaacgggtttcgtcgttcgtaggaaaatttataattaagggattaggaaaaagttttttagggtcgcgcgtttttagtgaggattttaatttatatttcgagtgtggtttcgttaaagattagagcgaaggttattgaaatgatataagattagcgaggtttagggcgttgtcgtttatagaatgcggagatacggttgtttcgcgttttttttttgatttgttttaggcggacgcggtgacgtgtg

SEQ ID NO: 36 - DNA, 534 bp, Artificial Sequence
  chemically treated genomic DNA (Homo sapiens) CpG-island No: 36
cacacgtcaccgcgtccgcctaaaacaaatcaaaaaaaaaacgcgaaacaaccgtatctccgcattctataaacgacaacgccctaaacctcgctaatcttatatcatttcaataaccttcgctctaatctttaacgaaaccacactcgaaatataaattaaaatcctcactaaaaacgcgcgaccctaaaaaactttttcctaatcccttaattataaattttcctacgaacgacgaaacccgtttccaccaaaaccgcccaaaaaccgacgctaccttcctaaaataacgaaacaactaaaaacgttttcgaatcctaaaatcaataaacgacccgtaaaaaaaactaaaacgcaattccctactcacccgactccgaatccaccgcgatactatttcaaacgaatcaaattccaaatcgcgctccaacccgaactcgaaattcctaccccgcgaatctacattttcacaacgacaaatataaataccgcgcaactaaaaaccaaaaacctaaaaacaactcgaccctcccc

SEQ ID NO: 37 - DNA, 602 bp, Artificial Sequence
  chemically treated genomic DNA (Homo sapiens) CpG-island No: 37
ttttttttcgttttttaggtatttgcggagttattttacgtacgtgttatttaggtaggtttttaattgtttcgttttatgggtcgttttttatttgcgtttggtgatttgagtcgttatgttcgtcgcggtttaagagcgtaggttttcgtttagggcgatgtaatttttgtcgtcgtaggcgttttgtcggtattcgcggaggaagcgttcgttcgattttacgtcgtagttatatattatttggatggtgtgagaatttggtttcgatttcgcggttagtttagtttttcgagtttcgtttagtttcgattaattcggggggatttttggtttaaattgaaaatgaaatcgggtaaaggcgtttgggtttttttcggggtaagggtttcggggtttcgcggtttcggggtggatttcggattcggagattgtgggcgatttggttcgttcgtgggggatgaggggttttgatttgcgttttcggtcggggttatttatcggtttcgttttggttgtagtagtcgcgtagggtttttaggtttattcggttagtttgtgattgggtttttatatttcgtgttttttggttttaatatttt

SEQ ID NO: 38 - DNA, 602 bp, Artificial Sequence
  chemically treated genomic DNA (Homo sapiens) CpG-island No: 38
aaaatattaaaaccaaaaaacacgaaatataaaaacccaatcacaaactaaccgaataaacctaaaaaccctacgcgactactacaaccaaaacgaaaccgataaataaccccgaccgaaaacgcaaatcaaaacccctcatcccccacgaacgaaccaaatcgcccacaatctccgaatccgaaatccaccccgaaaccgcgaaaccccgaaacccttaccccgaaaaaaacccaaacgcctttacccgatttcattttcaatttaaaccaaaaatccccccgaattaatcgaaactaaacgaaactcgaaaaactaaactaaccgcgaaatcgaaaccaaattctcacaccatccaaataatatataactacgacgtaaaatcgaacgaacgcttcctccgcgaataccgacaaaacgcctacgacgacaaaaattacatcgccctaaacgaaaacctacgctcttaaaccgcgacgaacataacgactcaaatcaccaaacgcaaataaaaaacgacccataaaacgaaacaattaaaaacctacctaaataacacgtacgtaaaataactccgcaaatacctaaaaaacgaaaaaaaa

SEQ ID NO: 39 - DNA, 602 bp, Artificial Sequence
  chemically treated genomic DNA (Homo sapiens) CpG-island No: 39
ggagtattgggattaggagatacggaatgtgaaggtttagttatagattgatcgagtggatttggggattttgcgcggttattataattagagcgaggtcggtgagtgatttcggtcgggggcgtaggttaggattttttattttttacggacgggttaggtcgtttatagttttcgggttcgagatttatttcgaagtcgcgggatttcgagatttttgtttcgggagaggtttaggcgtttttattcggttttatttttagtttaggttaaaaattttttcgggttggtcggggttgggcggggttcgggggattgggttgatcgcggggtcggggttaggtttttatattatttagataatgtatggttgcgacgtggggtcggacgggcgtttttttcgcgggtatcggtaggacgtttacgacggtaaggattatatcgttttgaacgaggatttgcgtttttggatcgcggcggatatggcggtttagattattaagcgtaagtgggaggcggtttatgaggcggagtagttgagagtttatttggatggtacgtgcgtggagtggtttcgtagatatttggagaacgggaaggag

SEQ ID NO: 40 - DNA, 602 bp, Artificial Sequence
  chemically treated genomic DNA (Homo sapiens) CpG-island No: 40
ctccttcccgttctccaaatatctacgaaaccactccacgcacgtaccatccaaataaactctcaactactccgcctcataaaccgcctcccacttacgcttaataatctaaaccgccatatccgccgcgatccaaaaacgcaaatcctcgttcaaaacgatataatccttaccgtcgtaaacgtcctaccgatacccgcgaaaaaaacgcccgtccgaccccacgtcgcaaccatacattatctaaataatataaaaacctaaccccgaccccgcgatcaacccaatcccccgaaccccgcccaaccccgaccaacccgaaaaaatttttaacctaaactaaaaataaaaccgaataaaaacgcctaaacctctcccgaaacaaaaatctcgaaatcccgcgacttcgaaataaatctcgaacccgaaaactataaacgacctaacccgtccgtaaaaaataaaaaatcctaacctacgcccccgaccgaaatcactcaccgacctcgctctaattataataaccgcgcaaaatccccaaatccactcgatcaatctataactaaaccttcacattccgtatctcctaatcccaatactcc

SEQ ID NO: 41 - DNA, 726 bp, Artificial Sequence
  chemically treated genomic DNA (Homo sapiens) CpG-island No: 41
atgttcgtcgcggtttaggagcgtaggttttagtttcgggttatgtaatttttgttatcgttggcgtgttgtttatattcgcggaggaggcgtttttttagttttaagtcgtagttatatattatttggagggtgttagattttggtttcgttttcgcggttagtttcgtttatcgagtttcgttttcgtttcgattaattcgcggggattttggtttaaacggaaaatgaaatttggtaaaggcgtttgggtttttttcgggtcgaggatttggcgggtttcgtagtttcggggtggattttggagtcggagattcgcgggggggattcgggacgttcgtgggggatgaggaggggtcgtgattttcgttttaggtcggggttatttatcggtttagttttggtggtagtagcggcgcggtatgggtaggtttatttttgttagtttgtgcgcgggtttgatgtttcgtgtgtttcggttttaatatttcggttttttttgttttaattacggcgattgcggttatattttcggagtcgtcgcgtcgttgtcgaatcgtacgaattgcgtgtcgtttacgtagtttattgcgatgtatcggggtttttcgcgattcggtcgggatacggcggtgttgaaatattttatggagtgggtatttgggggcgaggaggggttgagattcgttcgatttttttttttgcgttgtttttcgggttttgcgt

SEQ ID NO: 42 - DNA, 726 bp, Artificial Sequence
  chemically treated genomic DNA (Homo sapiens) CpG-island No: 42
acgcaaaacccgaaaaacaacgcaaaaaaaaaaatcgaacgaatctcaacccctcctcgcccccaaatacccactccataaaatatttcaacaccgccgtatcccgaccgaatcgcgaaaaaccccgatacatcgcaataaactacgtaaacgacacgcaattcgtacgattcgacaacgacgcgacgactccgaaaatataaccgcaatcgccgtaattaaaacaaaaaaaaccgaaatattaaaaccgaaacacacgaaacatcaaacccgcgcacaaactaacaaaaataaacctacccataccgcgccgctactaccaccaaaactaaaccgataaataaccccgacctaaaacgaaaatcacgacccctcctcatcccccacgaacgtcccgaatcccccccgcgaatctccgactccaaaatccaccccgaaactacgaaacccgccaaatcctcgacccgaaaaaaacccaaacgcctttaccaaatttcattttccgtttaaaccaaaatccccgcgaattaatcgaaacgaaaacgaaactcgataaacgaaactaaccgcgaaaacgaaaccaaaatctaacaccctccaaataatatataactacgacttaaaactaaaaaaacgcctcctccgcgaatataaacaacacgccaacgataacaaaaattacataacccgaaactaaaacctacgctcctaaaccgcgacgaacat

SEQ ID NO: 43 - DNA, 726 bp, Artificial Sequence
  chemically treated genomic DNA (Homo sapiens) CpG-island No: 43
gcgtaggattcggggagtagcgtaaggaggagggtcggacgggttttagttttttttcgtttttaggtatttattttataaggtattttagtatcgtcgtgtttcggtcgggtcgcggggagtttcggtatatcgtagtgggttacgtggacgatacgtagttcgtgcggttcgatagcgacgcggcgatttcgaggatgtagtcgtagtcgtcgtggttggagtaggagggatcggagtattgggatcggagtatacggaatattaggttcgcgtatagattgataagagtgaatttgtttatgtcgcgtcgttattattattagagttaggtcggtgaatgatttcggtttggggcgaaggttacgatttttttttattttttacggacgtttcgggtttttttcgcgagttttcggttttaagatttatttcgaggttgcgggattcgttagattttcgattcgggagaggtttaggcgtttttattaggttttatttttcgtttaggttaaaattttcgcgggttggtcggggcgggggcggggttcggtgggcggggttgatcgcgggggcggggttagggtttaatattttttagataatgtatggttgcgatttggggttggaagggcgtttttttcgcgggtatgaatagtacgttaacgatggtaaggattatatagttcggaattaggatttgcgtttttggatcgcggcggatat

SEQ ID NO: 44 - DNA, 726 bp, Artificial Sequence
  chemically treated genomic DNA (Homo sapiens) CpG-island No: 44
atatccgccgcgatccaaaaacgcaaatcctaattccgaactatataatccttaccatcgttaacgtactattcatacccgcgaaaaaaacgcccttccaaccccaaatcgcaaccatacattatctaaaaaatattaaaccctaaccccgcccccgcgatcaaccccgcccaccgaaccccgcccccgccccgaccaacccgcgaaaattttaacctaaacgaaaaataaaacctaataaaaacgcctaaacctctcccgaatcgaaaatctaacgaatcccgcaacctcgaaataaatcttaaaaccgaaaactcgcgaaaaaaacccgaaacgtccgtaaaaaataaaaaaaaatcgtaaccttcgccccaaaccgaaatcattcaccgacctaactctaataataataacgacgcgacataaacaaattcactcttatcaatctatacgcgaacctaatattccgtatactccgatcccaatactccgatccctcctactccaaccacgacgactacgactacatcctcgaaatcgccgcgtcgctatcgaaccgcacgaactacgtatcgtccacgtaacccactacgatataccgaaactccccgcgacccgaccgaaacacgacgatactaaaataccttataaaataaatacctaaaaacgaaaaaaaactaaaacccgtccgaccctcctccttacgctactccccgaatcctacgc

SEQ ID NO: 45 - DNA, 677 bp, Artificial Sequence
  chemically treated genomic DNA (Homo sapiens) CpG-island No: 45
agttcggtcgtttgttcgtttgtcgtttgtcgcgttcgttcggtttcgttcgttcggttcgatcgtcgcgtcgcgcgtatggggcgcgttttcgggggggcggtcgagggtcgttgagcgtcgggttcgttttcgtcgatgcgtttagtcgttcgcgtcgggggttttaggtcgcgtcgggttcggggttgagtcgtttttcgcgttcggtatgttcggttcggttcgtcgttcgtcgtcgtttagggttcgagttcgcgcggcgtatatttagttcggcggcgtcgcgtagtcgagggagttcgtttgttgcgagttaggcgcggggcgttaaggttatcggttcgacggggcgtacgcgcggttatggaggttaaggttcgttcgagtcggcgttcgcgcgcgtagcgggatcgtggtcggcgtcgggaggtcgttcgcgacgttcgcgtttagagttcgtcgtcgggcgacgagttcgagtttagtttcggtaaggagaacgcgggttttcgcggcgcgttttttcgaggcgtcgttttcgcgtttcgtatcgcgcgtttttcgcgtcgtcgtcgtcgcgagtttagttcgtaggaggaggaggttatcgacggtttcgttatcgttagttttagtattttggaggttttggagaaggatatggttttgaagtt

SEQ ID NO: 46 - DNA, 677 bp, Artificial Sequence
  chemically treated genomic DNA (Homo sapiens) CpG-island No: 46
aacttcaaaaccatatccttctccaaaacctccaaaatactaaaactaacgataacgaaaccgtcgataacctcctcctcctacgaactaaactcgcgacgacgacgacgcgaaaaacgcgcgatacgaaacgcgaaaacgacgcctcgaaaaaacgcgccgcgaaaacccgcgttctccttaccgaaactaaactcgaactcgtcgcccgacgacgaactctaaacgcgaacgtcgcgaacgacctcccgacgccgaccacgatcccgctacgcgcgcgaacgccgactcgaacgaaccttaacctccataaccgcgcgtacgccccgtcgaaccgataaccttaacgccccgcgcctaactcgcaacaaacgaactccctcgactacgcgacgccgccgaactaaatatacgccgcgcgaactcgaaccctaaacgacgacgaacgacgaaccgaaccgaacataccgaacgcgaaaaacgactcaaccccgaacccgacgcgacctaaaacccccgacgcgaacgactaaacgcatcgacgaaaacgaacccgacgctcaacgaccctcgaccgcccccccgaaaacgcgccccatacgcgcgacgcgacgatcgaaccgaacgaacgaaaccgaacgaacgcgacaaacgacaaacgaacaaacgaccgaact

SEQ ID NO: 47 - DNA, 677 bp, Artificial Sequence
  chemically treated genomic DNA (Homo sapiens) CpG-island No: 47
ggttttagggttatatttttttttagggtttttagggtgttgaagttggcgatggcgaagtcgtcgatgattttttttttttgcgagttggattcgcggcggcggcggcgcgggggacgcgcggtgcggggcgcgggggcggcgtttcgggggggcgcgtcgcggaggttcgcgttttttttgtcggggttgggttcgggttcgtcgttcgacgacggattttgggcgcgggcgtcgcgggcggtttttcggcgtcggttacggtttcgttgcgcgcgcgagcgtcggttcgggcggattttggtttttatggtcgcgcgtgcgtttcgtcgggtcggtgattttgacgtttcgcgtttggttcgtagtaggcgggttttttcggttacgcggcgtcgtcgggttgagtgtgcgtcgcgcgggttcgggttttgggcggcggcgggcggcgggtcgggtcgggtatgtcgggcgcggggggcggtttagtttcgggttcggcgcggtttgggattttcggcgcgggcggttgggcgtatcggcgggggcgggttcggcgtttagcggttttcggtcgttttttcgggggcgcgttttatgcgcgcggcgcggcgatcgggtcgagcgggcggggtcgggcgggcgcggtaggcggtaggcgggtaggcggtcgggtt

SEQ ID NO: 48 - DNA, 677 bp, Artificial Sequence
  chemically treated genomic DNA (Homo sapiens) CpG-island No: 48
aacccgaccgcctacccgcctaccgcctaccgcgcccgcccgaccccgcccgctcgacccgatcgccgcgccgcgcgcataaaacgcgcccccgaaaaaacgaccgaaaaccgctaaacgccgaacccgcccccgccgatacgcccaaccgcccgcgccgaaaatcccaaaccgcgccgaacccgaaactaaaccgccccccgcgcccgacatacccgacccgacccgccgcccgccgccgcccaaaacccgaacccgcgcgacgcacactcaacccgacgacgccgcgtaaccgaaaaaacccgcctactacgaaccaaacgcgaaacgtcaaaatcaccgacccgacgaaacgcacgcgcgaccataaaaaccaaaatccgcccgaaccgacgctcgcgcgcgcaacgaaaccgtaaccgacgccgaaaaaccgcccgcgacgcccgcgcccaaaatccgtcgtcgaacgacgaacccgaacccaaccccgacaaaaaaaacgcgaacctccgcgacgcgcccccccgaaacgccgcccccgcgccccgcaccgcgcgtcccccgcgccgccgccgccgcgaatccaactcgcaaaaaaaaaaaatcatcgacgacttcgccatcgccaacttcaacaccctaaaaaccctaaaaaaaaatataaccctaaaacc

SEQ ID NO: 49 - DNA, 693 bp, Artificial Sequence
  chemically treated genomic DNA (Homo sapiens) CpG-island No: 49
ttttatttcgttttagtttcgtttcggatttattcgcgcggcgtagttttcgagtagttttttttttaagtagtgttagtttgtgcggcggatttcgggattttttgggtttttcggtaggagtcgacgttgttgtatttgtttgatagttaagaagtcggggttaggaggggcgcggtttttgcgcgcgggtagcgtttatttttttttcggaattttcgggttcgaatttcgcgtcgagcgagttcgttttcgtgtcgttttcgattggttagtttatttgttttttttcgcgttattggatagcgttttaagatttttcgttttttattttttttgattagtttataagttttttcgggttgtcgtagtgaggaggagtcgtttgggcgcggagatgtttcgacgtatttagtgggtttaaatttagacgttattgcgtttgcgtatatttttttttttttttttaatagagtgaaataggattttagggcgttcgttttgcgtaggcgcggttaggggtagaggcggggtcgggagcgaggcgtagggggtgtggttaaagcgtagtagggggttttcgcggttggtaagggacgttcgggaagagtcggttgggggcgggaaggggttgagcgggggttttgggagggtttaaggggtttaaaggggaagggggtataggggttaggt

SEQ ID NO: 50 - DNA, 693 bp, Artificial Sequence
  chemically treated genomic DNA (Homo sapiens) CpG-island No: 50
acctaacccctatacccccttcccctttaaaccccttaaaccctcccaaaacccccgctcaaccccttcccgcccccaaccgactcttcccgaacgtcccttaccaaccgcgaaaaccccctactacgctttaaccacaccccctacgcctcgctcccgaccccgcctctacccctaaccgcgcctacgcaaaacgaacgccctaaaatcctatttcactctattaaaaaaaaaaaaaaaaatatacgcaaacgcaataacgtctaaatttaaacccactaaatacgtcgaaacatctccgcgcccaaacgactcctcctcactacgacaacccgaaaaaacttataaactaatcaaaaaaaataaaaaacgaaaaatcttaaaacgctatccaataacgcgaaaaaaaacaaataaactaaccaatcgaaaacgacacgaaaacgaactcgctcgacgcgaaattcgaacccgaaaattccgaaaaaaaaataaacgctacccgcgcgcaaaaaccgcgcccctcctaaccccgacttcttaactatcaaacaaatacaacaacgtcgactcctaccgaaaaacccaaaaaatcccgaaatccgccgcacaaactaacactacttaaaaaaaaaactactcgaaaactacgccgcgcgaataaatccgaaacgaaactaaaacgaaataaaa

SEQ ID NO: 51 - DNA, 693 bp, Artificial Sequence
  chemically treated genomic DNA (Homo sapiens) CpG-island No: 51
atttggtttttgtattttttttttttttggattttttgaatttttttaggattttcgtttagttttttttcgtttttaatcgatttttttcgaacgttttttattaatcgcgagagttttttattgcgttttggttatattttttacgtttcgttttcggtttcgtttttgtttttgatcgcgtttgcgtaaggcgggcgttttaaagttttattttattttgttgggaggagggggaaaggtgtacgtaggcgtagtggcgtttaaatttgggtttattaaatgcgtcggagtattttcgcgtttaggcggtttttttttattgcggtaattcgggaaaatttgtgaattaattagaaaaagtggaaggcgggagattttggggcgttgtttaatggcgcggaagagaataaatgagttggttaatcgggaacggtacgggggcgggttcgttcggcgcgaagttcgggttcgggaatttcgaaggaggggtaggcgttgttcgcgcgtagaggtcgcgttttttttggtttcggttttttggttgttaaatagatgtagtaacgtcggtttttgtcgaggagtttaaggggtttcgggattcgtcgtataggttggtattgtttgaagaggaggttattcggagattgcgtcgcgcgggtagattcgaaacggggttggggcggagtggga

SEQ ID NO: 52 - DNA, 693 bp, Artificial Sequence
  chemically treated genomic DNA (Homo sapiens) CpG-island No: 52
tcccactccgccccaaccccgtttcgaatctacccgcgcgacgcaatctccgaataacctcctcttcaaacaataccaacctatacgacgaatcccgaaaccccttaaactcctcgacaaaaaccgacgttactacatctatttaacaaccaaaaaaccgaaaccaaaaaaaacgcgacctctacgcgcgaacaacgcctacccctccttcgaaattcccgaacccgaacttcgcgccgaacgaacccgcccccgtaccgttcccgattaaccaactcatttattctcttccgcgccattaaacaacgccccaaaatctcccgccttccactttttctaattaattcacaaattttcccgaattaccgcaataaaaaaaaaccgcctaaacgcgaaaatactccgacgcatttaataaacccaaatttaaacgccactacgcctacgtacacctttccccctcctcccaacaaaataaaataaaactttaaaacgcccgccttacgcaaacgcgatcaaaaacaaaaacgaaaccgaaaacgaaacgtaaaaaatataaccaaaacgcaataaaaaactctcgcgattaataaaaaacgttcgaaaaaaatcgattaaaaacgaaaaaaaactaaacgaaaatcctaaaaaaattcaaaaaatccaaaaaaaaaaaaaatacaaaaaccaaat

SEQ ID NO: 53 - DNA, 575 bp, Artificial Sequence
  chemically treated genomic DNA (Homo sapiens) CpG-island No: 53
  misc_feature (347)..(347): n is either a, c, g or t
  misc_feature (363)..(364): n is either a, c, g or t
  misc_feature (436)..(436): n is either a, c, g or t
cggattcggaggagtaggaggcgaggttcgtcggagttttgaattttcgttgttttgtcgcgcggtgatttcgcgtttcggcgtcgttcgattcgtggttgtttcgagacgattggtgggggcgcggcggcggcggcggcggttgttgggggtggggagacgcgcggcgaggagacgagcgaggttagcgagtttgagggaggatcgcgagtcgttgtcgtcgttatgttcgaagattcgagcgttttgttttggtttattaatagggacgattacgagttgtaggaggtgatcggtgagagtaggcgttgcggaggggggagrcgcggcgttgggaggcggggranacgggaacgtgggganncgcgggagttcggggagcgtagtttttataggaattcgtggggcgtttgtggggttgggggtttgtaggatntttgtgtcgaggagcgcgtgtgagacgggaagggggttttgaggcgcgcgtttgtgaggtggcgtggggtggggtgaggtttgagggggtttaggagagatttgtgtataggatttttaaatgtgtggataggagcggt

SEQ ID NO: 54 - DNA, 575 bp, Artificial Sequence
  chemically treated genomic DNA (Homo sapiens) CpG-island No: 54
  misc_feature (140)..(140): n is either a, c, g or t
  misc_feature (212)..(213): n is either a, c, g or t
  misc_feature (229)..(229): n is either a, c, g or t
accgctcctatccacacatttaaaaatcctatacacaaatctctcctaaaccccctcaaacctcaccccaccccacgccacctcacaaacgcgcgcctcaaaacccccttcccgtctcacacgcgctcctcgacacaaanatcctacaaacccccaaccccacaaacgccccacgaattcctataaaaactacgctccccgaactcccgcgnntccccacgttcccgtntyccccgcctcccaacgccgcgyctcccccctccgcaacgcctactctcaccgatcacctcctacaactcgtaatcgtccctattaataaaccaaaacaaaacgctcgaatcttcgaacataacgacgacaacgactcgcgatcctccctcaaactcgctaacctcgctcgtctcctcgccgcgcgtctccccacccccaacaaccgccgccgccgccgccgcgcccccaccaatcgtctcgaaacaaccacgaatcgaacgacgccgaaacgcgaaatcaccgcgcgacaaaacaacgaaaattcaaaactccgacgaacctcgcctcctactcctccgaatccg

SEQ ID NO: 55 - DNA, 575 bp, Artificial Sequence
  chemically treated genomic DNA (Homo sapiens) CpG-island No: 55
  misc_feature (140)..(140): n is either a, c, g or t
  misc_feature (212)..(213): n is either a, c, g or t
  misc_feature (229)..(229): n is either a, c, g or t
gtcgtttttgtttatatatttgagaattttgtatataaattttttttgagtttttttaagttttattttattttacgttattttataggcgcgcgttttaaaatttttttttcgttttatacgcgtttttcgatataagngttttataagtttttagttttataagcgttttacgaatttttatgagggttgcgtttttcgagttttcgcgnntttttacgttttcgtntytttcgttttttagcgtcgcgyttttttttttcgtagcgtttgtttttatcgattattttttgtagttcgtaatcgtttttgttgatggattagggtagggcgttcgagttttcggatatgacggcggtagcggttcgcggtttttttttaaattcgttgatttcgttcgttttttcgtcgcgcgtttttttatttttaatagtcgtcgtcgtcgtcgtcgcgtttttattaatcgtttcggaatagttacgggtcggacggcgtcggggcgcggggttatcgcgcggtagagtagcgggggtttagagtttcggcggatttcgttttttgttttttcgagttcg

SEQ ID NO: 56 - DNA, 575 bp, Artificial Sequence
  chemically treated genomic DNA (Homo sapiens) CpG-island No: 56
  misc_feature (347)..(347): n is either a, c, g or t
  misc_feature (363)..(364): n is either a, c, g or t
  misc_feature (436)..(436): n is either a, c, g or t
cgaactcgaaaaaacaaaaaacgaaatccgccgaaactctaaacccccgctactctaccgcgcgataaccccgcgccccgacgccgtccgacccgtaactattccgaaacgattaataaaaacgcgacgacgacgacgacgactattaaaaataaaaaaacgcgcgacgaaaaaacgaacgaaatcaacgaatttaaaaaaaaaccgcgaaccgctaccgccgtcatatccgaaaactcgaacgccctaccctaatccatcaacaaaaacgattacgaactacaaaaaataatcgataaaaacaaacgctacgaaaaaaaaaarcgcgacgctaaaaaacgaaaranacgaaaacgtaaaaanncgcgaaaactcgaaaaacgcaaccctcataaaaattcgtaaaacgcttataaaactaaaaacttataaaacncttatatcgaaaaacgcgtataaaacgaaaaaaaaattttaaaacgcgcgcctataaaataacgtaaaataaaataaaacttaaaaaaactcaaaaaaaatttatatacaaaattctcaaatatataaacaaaaacgac

SEQ ID NO: 57 - DNA, 1127 bp, Artificial Sequence
  chemically treated genomic DNA (Homo sapiens) CpG-island No: 57
ggtgttgtcgtagtgtttttcgtttcgtttcggtttcgcgtatttgtttaggttatgatgagtttcggcggcgcggacgcgttgttgggcgtttcgttcgcgtcgttgtatggcggcggtagtttttattacgcgttagttcgaaagggtggcgtaggcgggacgcgtttcgtcgttggtttttttagcggtttttattcgtggatacggacgttcgtgagtttcgtgttcgtttcgtttagtcgttttcgtggcgtaggcgtcgttttaagtatcgattcgttggatacgttgagtaacgggtcggagggttgtatggtggcggtggttattttacgtagtgagaaggagtagttgtaggcgttgaacgatcgtttcgtcgggtatatcgataaggtgcggtagttggaggcgtataatcgtagtttggagggcgaggttgcggcgttgcggtagtagtaggcgggtcgtttcgttatgggcgagttgtacgagcgcgaggttcgcgagatgcgcggcgcggtgttgcgtttgggcgcggcgcgcggttagttacgtttggagtaggagtatttgttcgaggatatcgcgtacgtgcgttagcgtttagacgacgaggttcggtagcgagaggaggtcgaggcggcggttcgcgcgttggcgcgtttcgcgtaggaggtcgaggcggcgcgcgtggatttgtagaagaaggcgtaggcgttgtaggaggagtgcggttatttgcggcgttattattaggaagaggtgggcgagttgttcggttagatttagggtttcggcgtcgcgtaggcgtagatgtaggtcgagacgcgcgacgttttgaagtgcgacgtgacgtcggcgttgcgcgagattcgcgcgtagtttgaaggttacgcggtgtagagtacgttgtagttcgaggagtggtttcgaggtacgtaggcgcgcgggtggggggaggggcgtttttgttgatttcgtagcgaatttttgggttgcgtgatttaagggggcgttgtcggattgcgcgtggagtggcgcgttgtttattttttttttgtaaagtgtatgtttttagttaaatcgtagttttattttgggttttttgtgggacgttttaattt

SEQ ID NO: 58 - DNA, 1127 bp, Artificial Sequence
  chemically treated genomic DNA (Homo sapiens) CpG-island No: 58
aaattaaaacgtcccacaaaaaacccaaaataaaactacgatttaactaaaaacatacactttacaaaaaaaaaataaacaacgcgccactccacgcgcaatccgacaacgcccccttaaatcacgcaacccaaaaattcgctacgaaatcaacaaaaacgcccctccccccacccgcgcgcctacgtacctcgaaaccactcctcgaactacaacgtactctacaccgcgtaaccttcaaactacgcgcgaatctcgcgcaacgccgacgtcacgtcgcacttcaaaacgtcgcgcgtctcgacctacatctacgcctacgcgacgccgaaaccctaaatctaaccgaacaactcgcccacctcttcctaataataacgccgcaaataaccgcactcctcctacaacgcctacgccttcttctacaaatccacgcgcgccgcctcgacctcctacgcgaaacgcgccaacgcgcgaaccgccgcctcgacctcctctcgctaccgaacctcgtcgtctaaacgctaacgcacgtacgcgatatcctcgaacaaatactcctactccaaacgtaactaaccgcgcgccgcgcccaaacgcaacaccgcgccgcgcatctcgcgaacctcgcgctcgtacaactcgcccataacgaaacgacccgcctactactaccgcaacgccgcaacctcgccctccaaactacgattatacgcctccaactaccgcaccttatcgatatacccgacgaaacgatcgttcaacgcctacaactactccttctcactacgtaaaataaccaccgccaccatacaaccctccgacccgttactcaacgtatccaacgaatcgatacttaaaacgacgcctacgccacgaaaacgactaaacgaaacgaacacgaaactcacgaacgtccgtatccacgaataaaaaccgctaaaaaaaccaacgacgaaacgcgtcccgcctacgccaccctttcgaactaacgcgtaataaaaactaccgccgccatacaacgacgcgaacgaaacgcccaacaacgcgtccgcgccgccgaaactcatcataacctaaacaaatacgcgaaaccgaaacgaaacgaaaaacactacgacaacacc

SEQ ID NO: 59 - DNA, 1127 bp, Artificial Sequence
  chemically treated genomic DNA (Homo sapiens) CpG-island No: 59
gagttggggcgttttataagagatttagagtaaaattgcgatttaattaggggtatgtattttgtagagggaaggtgagtagcgcgttattttacgcgtagttcggtagcgtttttttgggttacgtagtttaaaagttcgttgcggggttagtaggggcgtttttttttttattcgcgcgtttgcgtatttcggaattatttttcggattgtagcgtgttttgtatcgcgtggtttttaagttgcgcgcgaatttcgcgtagcgtcgacgttacgtcgtattttagggcgtcgcgcgtttcggtttgtatttgcgtttgcgcggcgtcggagttttggatttggtcgagtagttcgtttatttttttttggtggtggcgtcgtaggtagtcgtattttttttgtagcgtttgcgtttttttttgtaggtttacgcgcgtcgtttcggttttttgcgcgaagcgcgttagcgcgcgggtcgtcgtttcggttttttttcgttgtcgggtttcgtcgtttaggcgttggcgtacgtgcgcgatgttttcgagtaggtgtttttgttttaggcgtagttgatcgcgcgtcgcgtttaggcgtagtatcgcgtcgcgtatttcgcggatttcgcgttcgtatagttcgtttatagcggagcggttcgtttgttgttgtcgtagcgtcgtagtttcgttttttaggttgcggttgtgcgtttttagttgtcgtattttgtcgatgtattcggcgaagcggtcgtttagcgtttgtagttgtttttttttattgcgtgaggtggttatcgttattatgtagtttttcggttcgttgtttagcgtgtttagcgagtcggtgtttgaggcggcgtttgcgttacggaagcggttgggcgaggcggatacggagtttacggacgttcgtgtttacgagtggaagtcgttggaggagttagcggcggagcgcgtttcgtttgcgttattttttcgggttagcgcgtagtggaggttgtcgtcgttatgtagcggcgcgaacggggcgtttagtagcgcgttcgcgtcgtcgaagtttattatggtttgagtaggtgcgcgaggtcgggacggggcgggaggtattgcggtagtatt

SEQ ID NO: 60 - DNA, 1127 bp, Artificial Sequence
  chemically treated genomic DNA (Homo sapiens) CpG-island No: 60
aatactaccgcaatacctcccgccccgtcccgacctcgcgcacctactcaaaccataataaacttcgacgacgcgaacgcgctactaaacgccccgttcgcgccgctacataacgacgacaacctccactacgcgctaacccgaaaaaataacgcaaacgaaacgcgctccgccgctaactcctccaacgacttccactcgtaaacacgaacgtccgtaaactccgtatccgcctcgcccaaccgcttccgtaacgcaaacgccgcctcaaacaccgactcgctaaacacgctaaacaacgaaccgaaaaactacataataacgataaccacctcacgcaataaaaaaaaacaactacaaacgctaaacgaccgcttcgccgaatacatcgacaaaatacgacaactaaaaacgcacaaccgcaacctaaaaaacgaaactacgacgctacgacaacaacaaacgaaccgctccgctataaacgaactatacgaacgcgaaatccgcgaaatacgcgacgcgatactacgcctaaacgcgacgcgcgatcaactacgcctaaaacaaaaacacctactcgaaaacatcgcgcacgtacgccaacgcctaaacgacgaaacccgacaacgaaaaaaaaccgaaacgacgacccgcgcgctaacgcgcttcgcgcaaaaaaccgaaacgacgcgcgtaaacctacaaaaaaaaacgcaaacgctacaaaaaaaatacgactacctacgacgccaccaccaaaaaaaaataaacgaactactcgaccaaatccaaaactccgacgccgcgcaaacgcaaatacaaaccgaaacgcgcgacgccctaaaatacgacgtaacgtcgacgctacgcgaaattcgcgcgcaacttaaaaaccacgcgatacaaaacacgctacaatccgaaaaataattccgaaatacgcaaacgcgcgaataaaaaaaaaaacgcccctactaaccccgcaacgaacttttaaactacgtaacccaaaaaaacgctaccgaactacgcgtaaaataacgcgctactcaccttccctctacaaaatacatacccctaattaaatcgcaattttactctaaatctcttataaaacgccccaactc

SEQ ID NO: 61 - DNA, 954 bp, Artificial Sequence
  chemically treated genomic DNA (Homo sapiens) CpG-island No: 61
agggttgaaacgtaagtattttaggacgtatatatatttttttatttcggagtatagttaggcgttcgaggtttttacgcggatacgtacgtgtgtatcgagtacgtatattttttatattgttatacgtttttgttcgtttttcgagtcgttattttcggattttcggggttcgagtcggggttagcgacgtcgtcgtcgcggatgtttaagtcgtagacggcgtcgtcgagtagtatcgcgggtcggtagaggcgcggttcgttcgtgggtcggtggcgttcggggtagttatcgaataggaattggcggatgatggtcgttttgtttacgttcggggcgtttagaacggttattcgtaggttattttttatggtcggtcggcgttgtcgtttttcgcgttggaaagttttatgggtcggcgtcgtatcgtgcgtttttaggtcgtgcgtttcgcgcgttttgttcggtgcgttacggtttcgtcgcgtttttcgtcgtttttcggagtatcgagatcggagagggtaggttcgaggtaggagttggcggcgggagggtagatagatagtcgagtgggtagataggtggcgggcgcgcgagcggttcgggcgggtgtcgaagttcgagagagagtagagtcggagcggcgtttagatatcgttttcgtttcgtagcgttaatttaggcgtcggcggacgcgcgaggcgtcgaagttcgtttttttcgcggcgcgggtttcgtagcggtgcggggcgcggggggtagcgttgtttttcggagtttttgtgtttttatttttttttcgttttcgcgtttggagtcgtcgttttagtcgtcggcgcgagcgagcggggtttttcggaggcggcgatgaggtaatcgttcgttttttttatttttttttatcgtttaggacgttttttttaggaagggtcgtaggaaggtgattgg

SEQ ID NO: 62 - DNA, 954 bp, Artificial Sequence
  chemically treated genomic DNA (Homo sapiens) CpG-island No: 62
ccaatcaccttcctacgacccttcctaaaaaaaacgtcctaaacgataaaaaaaaataaaaaaaacgaacgattacctcatcgccgcctccgaaaaaccccgctcgctcgcgccgacgactaaaacgacgactccaaacgcgaaaacgaaaaaaaaataaaaacacaaaaactccgaaaaacaacgctaccccccgcgccccgcaccgctacgaaacccgcgccgcgaaaaaaacgaacttcgacgcctcgcgcgtccgccgacgcctaaattaacgctacgaaacgaaaacgatatctaaacgccgctccgactctactctctctcgaacttcgacacccgcccgaaccgctcgcgcgcccgccacctatctacccactcgactatctatctaccctcccgccgccaactcctacctcgaacctaccctctccgatctcgatactccgaaaaacgacgaaaaacgcgacgaaaccgtaacgcaccgaacaaaacgcgcgaaacgcacgacctaaaaacgcacgatacgacgccgacccataaaactttccaacgcgaaaaacgacaacgccgaccgaccataaaaaataacctacgaataaccgttctaaacgccccgaacgtaaacaaaacgaccatcatccgccaattcctattcgataactaccccgaacgccaccgacccacgaacgaaccgcgcctctaccgacccgcgatactactcgacgacgccgtctacgacttaaacatccgcgacgacgacgtcgctaaccccgactcgaaccccgaaaatccgaaaataacgactcgaaaaacgaacaaaaacgtataacaatataaaaaatatacgtactcgatacacacgtacgtatccgcgtaaaaacctcgaacgcctaactatactccgaaataaaaaaatatatatacgtcctaaaatacttacgtttcaaccct

SEQ ID NO: 63 - DNA, 954 bp, Artificial Sequence
  chemically treated genomic DNA (Homo sapiens) CpG-island No: 63
ttagttatttttttgcgattttttttgggaggggcgttttgggcggtgggggaaggtgggaggggcgggcggttattttatcgtcgttttcgggaggtttcgttcgttcgcgtcggcggttggggcggcgattttaggcgcggaagcgagagaaggatagaggtatagaggtttcgggaggtagcgttgtttttcgcgtttcgtatcgttgcgggattcgcgtcgcgagaggggcggatttcggcgtttcgcgcgttcgtcggcgtttgggttggcgttgcggggcggaggcggtgtttgagcgtcgtttcggttttgttttttttcgagtttcggtattcgttcgagtcgttcgcgcgttcgttatttgtttgtttattcggttgtttgtttgttttttcgtcgttagtttttgtttcgggtttgtttttttcggtttcggtgtttcgaggggcgacgagaagcgcgacggggtcgtggcgtatcgggtagggcgcgcggggcgtacggtttgggggcgtacggtgcggcgtcggtttatgaggttttttagcgcggggagcgatagcgtcggtcggttatggggggtagtttgcgggtggtcgttttaggcgtttcgggcgtgggtaagacggttattattcgttagtttttgttcggtgattatttcgagcgttatcggtttacggacgggtcgcgtttttatcgattcgcggtgttgttcgacggcgtcgtttacgatttgagtattcgcgacggcgacgtcgttggtttcggttcgagtttcgggggttcggaggtagcggttcgaggagcgggtaggggcgtgtgatagtgtgaggggtgtgcgtgttcggtgtatacgtgcgtgttcgcgtggaggtttcgggcgtttggttgtgtttcgggatggagggatgtgtgtgcgttttgggatatttgcgttttagtttt

SEQ ID NO: 64 - DNA, 954 bp, Artificial Sequence
  chemically treated genomic DNA (Homo sapiens) CpG-island No: 64
aaaactaaaacgcaaatatcccaaaacgcacacacatccctccatcccgaaacacaaccaaacgcccgaaacctccacgcgaacacgcacgtatacaccgaacacgcacacccctcacactatcacacgcccctacccgctcctcgaaccgctacctccgaacccccgaaactcgaaccgaaaccaacgacgtcgccgtcgcgaatactcaaatcgtaaacgacgccgtcgaacaacaccgcgaatcgataaaaacgcgacccgtccgtaaaccgataacgctcgaaataatcaccgaacaaaaactaacgaataataaccgtcttacccacgcccgaaacgcctaaaacgaccacccgcaaactaccccccataaccgaccgacgctatcgctccccgcgctaaaaaacctcataaaccgacgccgcaccgtacgcccccaaaccgtacgccccgcgcgccctacccgatacgccacgaccccgtcgcgcttctcgtcgcccctcgaaacaccgaaaccgaaaaaaacaaacccgaaacaaaaactaacgacgaaaaaacaaacaaacaaccgaataaacaaacaaataacgaacgcgcgaacgactcgaacgaataccgaaactcgaaaaaaaacaaaaccgaaacgacgctcaaacaccgcctccgccccgcaacgccaacccaaacgccgacgaacgcgcgaaacgccgaaatccgcccctctcgcgacgcgaatcccgcaacgatacgaaacgcgaaaaacaacgctacctcccgaaacctctatacctctatccttctctcgcttccgcgcctaaaatcgccgccccaaccgccgacgcgaacgaacgaaacctcccgaaaacgacgataaaataaccgcccgcccctcccaccttcccccaccgcccaaaacgcccctcccaaaaaaaatcgcaaaaaaataactaa

SEQ ID NO: 65 - DNA, 574 bp, Artificial Sequence
  chemically treated genomic DNA (Homo sapiens) CpG-island No: 65
gtcggcggttaagtgggcgcgaatgaatgaacgaatttttagttttttttttttttttggttggggacgtcgttcgcgtttttgtagcgtcgcgttttttttatgatttttgatttcgtaaattttttatttaggatttttgatttttcgttttatttttttttttggttcgttcgggttttcgtttttttattcgtaggttttaatagttttcggcgtttcggttcggttcggtttggtattaaaatgttcgcggtttttatttttcgttttttcggtgcgttcgggttgtcggcggttcggagtttcgcggttgttatttgtcgggcggaagtgagttgttcgcgcgcgggtattttcggtggacgtaaggtttgaaggcggggttaagggtataattttggcgggggtggtgttcgtggggcggggtaagaaaaggggaagagtttaacggtattaatttttcggtagtcgcggcgttgttatgttgtagtttttcgtagagtttttgggaaattatttcgttagttaatttagcgtgagggggtcgggtaaggtcgtagggagtttgaag

SEQ ID NO: 66 - DNA, 574 bp, Artificial Sequence
  chemically treated genomic DNA (Homo sapiens) CpG-island No: 66
cttcaaactccctacgaccttacccgaccccctcacgctaaattaactaacgaaataatttcccaaaaactctacgaaaaactacaacataacaacgccgcgactaccgaaaaattaataccgttaaactcttccccttttcttaccccgccccacgaacaccacccccgccaaaattatacccttaaccccgccttcaaaccttacgtccaccgaaaatacccgcgcgcgaacaactcacttccgcccgacaaataacaaccgcgaaactccgaaccgccgacaacccgaacgcaccgaaaaaacgaaaaataaaaaccgcgaacattttaataccaaaccgaaccgaaccgaaacgccgaaaactattaaaacctacgaataaaaaaacgaaaacccgaacgaaccaaaaaaaaaaataaaacgaaaaatcaaaaatcctaaataaaaaatttacgaaatcaaaaatcataaaaaaaacgcgacgctacaaaaacgcgaacgacgtccccaaccaaaaaaaaaaaaaaaactaaaaattcgttcattcattcgcgcccacttaaccgccgac

SEQ ID NO: 67 - DNA, 574 bp, Artificial Sequence
  chemically treated genomic DNA (Homo sapiens) CpG-island No: 67
ttttaaattttttacgattttgttcggtttttttacgttgaattggttagcgggatggttttttaagggttttgcgggagattgtagtatagtagcgtcgcggttgtcgaggggttaatatcgttgggttttttttttttttttgtttcgttttacgggtattattttcgttagggttgtatttttgatttcgtttttaggttttgcgtttatcggaagtattcgcgcgcgggtagtttattttcgttcggtaggtgatagtcgcggggtttcgagtcgtcggtagttcggacgtatcgggagagcgagaggtggaggtcgcggatattttggtgttaagtcgaatcgagtcggggcgtcgggagttattgggatttgcgggtgaggaagcggggattcgggcgagttaggagaagaagtggggcgaggggttaggggttttaggtgaggggtttgcggggttagaggttatgaagaggacgcggcgttgtaggggcgcgagcgacgtttttagttagaggaggaggaagggttgagggttcgtttatttattcgcgtttatttggtcgtcggt

SEQ ID NO: 68 - DNA, 574 bp, Artificial Sequence
  chemically treated genomic DNA (Homo sapiens) CpG-island No: 68
accgacgaccaaataaacgcgaataaataaacgaaccctcaacccttcctcctcctctaactaaaaacgtcgctcgcgcccctacaacgccgcgtcctcttcataacctctaaccccgcaaacccctcacctaaaacccctaacccctcgccccacttcttctcctaactcgcccgaatccccgcttcctcacccgcaaatcccaataactcccgacgccccgactcgattcgacttaacaccaaaatatccgcgacctccacctctcgctctcccgatacgtccgaactaccgacgactcgaaaccccgcgactatcacctaccgaacgaaaataaactacccgcgcgcgaatacttccgataaacgcaaaacctaaaaacgaaatcaaaaatacaaccctaacgaaaataatacccgtaaaacgaaacaaaaaaaaaaaaaaaacccaacgatattaacccctcgacaaccgcgacgctactatactacaatctcccgcaaaacccttaaaaaaccatcccgctaaccaattcaacgtaaaaaaaccgaacaaaatcgtaaaaaatttaaaa

SEQ ID NO: 69 - DNA, 864 bp, Artificial Sequence
  chemically treated genomic DNA (Homo sapiens) CpG-island No: 69
gggtgcggatcggagaggtgagtgggtgcgtttgtttagcggttcgttcggtgtggtcgtgttcggttcgcgtggggatgggggtgtttttttcgttgggtaattatattagcgtaatcggggcgtcggcgcggtttacgttagcggcgttgtttcggcggcgggggttgggcgtggcggtgatgttgggcgtggtggtcgcgttgggcgtggtggtcgcgttgtcgtttttattcgggtaggcgtgttggagaaggatgtcggcgtatagatggtttttagtttggcgggcgtagaatagcgtcgtgcggatttgggcgttacgggtcgttacgttcgcgtcgtattagagggcggaaacggtcgcgtgatcgagcgtttttagggcgtttatattcggcgtcgttttttttatatggttaagtttattttcggggtttttttgggaatttcgggttttttcgcgttaggcgtttttcgagatgaagttttaaagatttttttttttttttttagtttacgtatttatagtagtagttgcgtgatgacgacgtgggcgagttcggtcgttaggtggagtggggagcgtagttgtgggttttttacgttggtgtcgagcggttcgtgtcgcgtatgggttaaaagtaggagaacggtagttacgttttgggtttgtacggcggtttatagttggcggtttagcggttttttcgaggtgtttagcggcgttaggaatagtagttgttcgtatttggcgcgaatttacgattcgcgtttttttttgtaagattagggattaacggaaaaggttttagggatttttagttaggatttttgtttttatttacgggatcgttttaggtt

SEQ ID NO: 70 - DNA, 864 bp, Artificial Sequence
  chemically treated genomic DNA (Homo sapiens) CpG-island No: 70
aacctaaaacgatcccgtaaataaaaacaaaaatcctaactaaaaatccctaaaaccttttccgttaatccctaatcttacaaaaaaaaacgcgaatcgtaaattcgcgccaaatacgaacaactactattcctaacgccgctaaacacctcgaaaaaaccgctaaaccgccaactataaaccgccgtacaaacccaaaacgtaactaccgttctcctacttttaacccatacgcgacacgaaccgctcgacaccaacgtaaaaaacccacaactacgctccccactccacctaacgaccgaactcgcccacgtcgtcatcacgcaactactactataaatacgtaaactaaaaaaaaaaaaaaaaatctttaaaacttcatctcgaaaaacgcctaacgcgaaaaaacccgaaattcccaaaaaaaccccgaaaataaacttaaccatataaaaaaaacgacgccgaatataaacgccctaaaaacgctcgatcacgcgaccgtttccgccctctaatacgacgcgaacgtaacgacccgtaacgcccaaatccgcacgacgctattctacgcccgccaaactaaaaaccatctatacgccgacatccttctccaacacgcctacccgaataaaaacgacaacgcgaccaccacgcccaacgcgaccaccacgcccaacatcaccgccacgcccaacccccgccgccgaaacaacgccgctaacgtaaaccgcgccgacgccccgattacgctaatataattacccaacgaaaaaaacacccccatccccacgcgaaccgaacacgaccacaccgaacgaaccgctaaacaaacgcacccactcacctctccgatccgcaccc

SEQ ID NO: 71 - DNA, 864 bp, Artificial Sequence
  chemically treated genomic DNA (Homo sapiens) CpG-island No: 71
aatttgagacggtttcgtgggtaggggtagaagttttggttgggggtttttagagtttttttcgttgatttttggttttgtagggaggagcgcgagtcgtggattcgcgttaagtacgagtagttattgtttttggcgtcgttgagtatttcggaggagtcgttgggtcgttagttgtgggtcgtcgtgtaggtttaggacgtggttatcgtttttttgtttttggtttatgcgcgatacgggtcgttcgatattagcgtagaggatttatagttgcgttttttattttatttggcggtcgagttcgtttacgtcgttattacgtaattgttgttgtgggtacgtgagttggggggaggaaagggggtttttgaggttttatttcggaaaacgtttggcgcgggaaagttcgaaatttttagagggatttcggaagtaggtttggttatgtgggggaggcggcgtcgggtgtgggcgttttggggacgttcggttacgcggtcgttttcgttttttagtacggcgcggacgtggcggttcgtgacgtttaggttcgtacggcgttgttttacgttcgttaggttggaagttatttgtgcgtcgatatttttttttagtacgtttgttcgggtgagggcggtagcgcggttattacgtttagcgcggttattacgtttagtattatcgttacgtttagttttcgtcgtcggagtagcgtcgttagcgtgggtcgcgtcgacgtttcggttgcgttggtatagttgtttagcgggagagatatttttatttttacgcgggtcgggtacgattatatcgggcggatcgttggatagacgtatttatttattttttcgattcgtattt

SEQ ID NO: 72 - DNA, 864 bp, Artificial Sequence
  chemically treated genomic DNA (Homo sapiens) CpG-island No: 72
aaatacgaatcgaaaaaataaataaatacgtctatccaacgatccgcccgatataatcgtacccgacccgcgtaaaaataaaaatatctctcccgctaaacaactataccaacgcaaccgaaacgtcgacgcgacccacgctaacgacgctactccgacgacgaaaactaaacgtaacgataatactaaacgtaataaccgcgctaaacgtaataaccgcgctaccgccctcacccgaacaaacgtactaaaaaaaaatatcgacgcacaaataacttccaacctaacgaacgtaaaacaacgccgtacgaacctaaacgtcacgaaccgccacgtccgcgccgtactaaaaaacgaaaacgaccgcgtaaccgaacgtccccaaaacgcccacacccgacgccgcctcccccacataaccaaacctacttccgaaatccctctaaaaatttcgaactttcccgcgccaaacgttttccgaaataaaacctcaaaaaccccctttcctccccccaactcacgtacccacaacaacaattacgtaataacgacgtaaacgaactcgaccgccaaataaaataaaaaacgcaactataaatcctctacgctaatatcgaacgacccgtatcgcgcataaaccaaaaacaaaaaaacgataaccacgtcctaaacctacacgacgacccacaactaacgacccaacgactcctccgaaatactcaacgacgccaaaaacaataactactcgtacttaacgcgaatccacgactcgcgctcctccctacaaaaccaaaaatcaacgaaaaaaactctaaaaacccccaaccaaaacttctacccctacccacgaaaccgtctcaaatt

SEQ ID NO: 73 - DNA, 896 bp, Artificial Sequence
  chemically treated genomic DNA (Homo sapiens) CpG-island No: 73
tttttttcgtttcgtttttttttttattttttattcgtttttcggcgttcgtttcgttcgttcgttatttcgggggggttttcgtcgtcgtcgtcgtcggaaggagtcgttatttgttatcgtcgagcgtacgggtcgagttaagtttgatttcggagtcggagggggattgggatcgagagaacggcgatggggggcggtttcgtcgtaggaggattcgggcgcgtaatttcgggggttcggttcgttttagatttagattcgcggggtgcggtattttgagttttttttttcgttttttgttttggttatggtcgtttatttcgtcgttttcgggtcgttagttcgttcggtttcgtaagtatcggagtttcggcggtggtagtagtgaacggttgtcgtaggtttcgaagatttcggttcggttcggttttttagcgcgcgtttttttttcggttttgttttttttttttttttcgtcgttagcgagttttttttgtacgttgtttttcgttttcggtgttcggacgatgtttaagtttcggtttcgtatgtttttgaacgagttgaagttgttggtgttgataggcggggggcggtttcgggtcgagtcgtaatttcgggggggtcggggaggcggttgcggttgggcgtttttcgttggttgttttattcgggacggcgacggcgacgaggaggagtattacgggtcggagtcgcgggttcggggtttggtcggcgataaggagtcgcgggtcggatttttgtcgtcgttcgcgtcgtcgttgtcgttttcgggcgcgttggacgttttgtcgtttagtagtagtttggatagcggatttcgaattttttagtgtcggatttgtttttagggttcggagtaggttaggttt

SEQ ID NO: 74 - DNA, 896 bp, Artificial Sequence
  chemically treated genomic DNA (Homo sapiens) CpG-island No: 74
aaacctaacctactccgaaccctaaaaacaaatccgacactaaaaaattcgaaatccgctatccaaactactactaaacgacaaaacgtccaacgcgcccgaaaacgacaacgacgacgcgaacgacgacaaaaatccgacccgcgactccttatcgccgaccaaaccccgaacccgcgactccgacccgtaatactcctcctcgtcgccgtcgccgtcccgaataaaacaaccaacgaaaaacgcccaaccgcaaccgcctccccgacccccccgaaattacgactcgacccgaaaccgccccccgcctatcaacaccaacaacttcaactcgttcaaaaacatacgaaaccgaaacttaaacatcgtccgaacaccgaaaacgaaaaacaacgtacaaaaaaaactcgctaacgacgaaaaaaaaaaaaaaaacaaaaccgaaaaaaaaacgcgcgctaaaaaaccgaaccgaaccgaaatcttcgaaacctacgacaaccgttcactactaccaccgccgaaactccgatacttacgaaaccgaacgaactaacgacccgaaaacgacgaaataaacgaccataaccaaaacaaaaaacgaaaaaaaaaactcaaaataccgcaccccgcgaatctaaatctaaaacgaaccgaacccccgaaattacgcgcccgaatcctcctacgacgaaaccgccccccatcgccgttctctcgatcccaatccccctccgactccgaaatcaaacttaactcgacccgtacgctcgacgataacaaataacgactccttccgacgacgacgacgacgaaaacccccccgaaataacgaacgaacgaaacgaacgccgaaaaacgaataaaaaataaaaaaaaaaacgaaacgaaaaaaa

SEQ ID NO: 75 - DNA, 896 bp, Artificial Sequence
  chemically treated genomic DNA (Homo sapiens) CpG-island No: 75
aggtttgatttgtttcgggttttggaagtagattcggtattgaggggttcggagttcgttgtttaggttattgttgagcgatagggcgtttagcgcgttcgggggcggtagcggcggcgcgggcggcggtaggggttcggttcgcggttttttgtcgtcggttaggtttcgggttcgcggtttcgattcgtagtattttttttcgtcgtcgtcgtcgtttcgggtggagtaattagcgaagggcgtttagtcgtagtcgttttttcggttttttcggggttgcggttcggttcggggtcgtttttcgtttgttagtattagtagttttagttcgtttagaaatatgcggagtcgagatttgagtatcgttcggatatcgggggcggggggtagcgtgtaaggggggttcgttagcggcggggggaggggagaggataaggtcgggaagggggcgcgcgttagagagtcgagtcgggtcggggttttcggggtttgcgatagtcgtttattgttgttatcgtcggggtttcggtgtttgcggggtcgagcgggttggcggttcgggggcggcggggtgggcggttatggttagggtagggggcggggaggggggtttagggtgtcgtatttcgcgggtttgggtttggagcgggtcgggttttcggggttacgcgttcgggtttttttgcggcggggtcgttttttatcgtcgttttttcggttttagttttttttcggtttcgggattaggtttggttcggttcgtgcgttcggcggtggtaaatggcggtttttttcggcggcggcggcggcggagattttttcggagtggcgggcgggcggggcgggcgtcggggagcgggtgaaggatggagggaggggcggggcggggaggg

SEQ ID NO: 76 - DNA, 896 bp, Artificial Sequence
  chemically treated genomic DNA (Homo sapiens) CpG-island No: 76
ccctccccgccccgcccctccctccatccttcacccgctccccgacgcccgccccgcccgcccgccactccgaaaaaatctccgccgccgccgccgccgaaaaaaaccgccatttaccaccgccgaacgcacgaaccgaaccaaacctaatcccgaaaccgaaaaaaaactaaaaccgaaaaaacgacgataaaaaacgaccccgccgcaaaaaaacccgaacgcgtaaccccgaaaacccgacccgctccaaacccaaacccgcgaaatacgacaccctaaacccccctccccgccccctaccctaaccataaccgcccaccccgccgcccccgaaccgccaacccgctcgaccccgcaaacaccgaaaccccgacgataacaacaataaacgactatcgcaaaccccgaaaaccccgacccgactcgactctctaacgcgcgcccccttcccgaccttatcctctcccctccccccgccgctaacgaaccccccttacacgctaccccccgcccccgatatccgaacgatactcaaatctcgactccgcatatttctaaacgaactaaaactactaatactaacaaacgaaaaacgaccccgaaccgaaccgcaaccccgaaaaaaccgaaaaaacgactacgactaaacgcccttcgctaattactccacccgaaacgacgacgacgacgaaaaaaaatactacgaatcgaaaccgcgaacccgaaacctaaccgacgacaaaaaaccgcgaaccgaacccctaccgccgcccgcgccgccgctaccgcccccgaacgcgctaaacgccctatcgctcaacaataacctaaacaacgaactccgaacccctcaataccgaatctacttccaaaacccgaaacaaatcaaacct

SEQ ID NO: 77 - DNA, 598 bp, Artificial Sequence
  chemically treated genomic DNA (Homo sapiens) CpG-island No: 77
ttattttgaagtatgggaatcgcgttgtttcggtcgcgaggatttgggcgtacgtgacggggcgggcgggcgttcgattcgggtagggcgtagttagcggcggtcgtttatgtttaggttacggcggtggcgtttggtgtggttgggcgggcgaggcgggcgttgagaagttcgggaggttttcggggaggcgattgcgtgtttaggcgggtatttttgttagtttcgcgttgcggtcgcgatttcggacgtttcggttggttttttgcgagttgtacgcgcggttttagtttggtttcgagcgtagggcgcgcgttggcggggagggcgcgcgttcgagtttggcggggagcgcgcgttatcggttcgcgcgcgtagtcgtcgggggatgtcgggagcggtttggggagttgtttttggtgttgacggttcgttcgttttcgttcgggacgcgcgattttttggaggtttgggggtgtttttattttggtcggcgttttgcggtgtttttttcgtttttcgtttgttttcggggcgtttcggtttttataacgttgggatttggagttaggtcgaagttgttgtttattcgtagtag

SEQ ID NO: 78 - DNA, 598 bp, Artificial Sequence
  chemically treated genomic DNA (Homo sapiens) CpG-island No: 78
ctactacgaataaacaacaacttcgacctaactccaaatcccaacgttataaaaaccgaaacgccccgaaaacaaacgaaaaacgaaaaaaacaccgcaaaacgccgaccaaaataaaaacacccccaaacctccaaaaaatcgcgcgtcccgaacgaaaacgaacgaaccgtcaacaccaaaaacaactccccaaaccgctcccgacatcccccgacgactacgcgcgcgaaccgataacgcgcgctccccgccaaactcgaacgcgcgccctccccgccaacgcgcgccctacgctcgaaaccaaactaaaaccgcgcgtacaactcgcaaaaaaccaaccgaaacgtccgaaatcgcgaccgcaacgcgaaactaacaaaaatacccgcctaaacacgcaatcgcctccccgaaaacctcccgaacttctcaacgcccgcctcgcccgcccaaccacaccaaacgccaccgccgtaacctaaacataaacgaccgccgctaactacgccctacccgaatcgaacgcccgcccgccccgtcacgtacgcccaaatcctcgcgaccgaaacaacgcgattcccatacttcaaaataa

SEQ ID NO: 79 - DNA, 598 bp, Artificial Sequence
  chemically treated genomic DNA (Homo sapiens) CpG-island No: 79
ttattgcggataagtagtagtttcggtttgattttagattttaacgttgtggaagtcggaacgtttcgagaataggcggagagcggagggagtatcgtagggcgtcggttagggtgggggtatttttaggtttttaggaggtcgcgcgtttcgggcgagagcggacgagtcgttagtattagggatagttttttaggtcgttttcggtatttttcgacgattgcgcgcgcgggtcggtgacgcgcgtttttcgttaggttcgggcgcgcgtttttttcgttagcgcgcgttttgcgttcgggattaggttggagtcgcgcgtgtagttcgtagggagttagtcggggcgttcggagtcgcggtcgtagcgcggagttggtaggggtgttcgtttgggtacgtagtcgttttttcgggggtttttcgggttttttagcgttcgtttcgttcgtttagttatattaggcgttatcgtcgtggtttgggtatgagcggtcgtcgttagttgcgttttgttcgggtcggacgttcgttcgtttcgttacgtgcgtttaagttttcgcggtcggggtagcgcggtttttatgttttaaggtaa

SEQ ID NO: 80 - DNA, 598 bp, Artificial Sequence
  chemically treated genomic DNA (Homo sapiens) CpG-island No: 80
ttaccttaaaacataaaaaccgcgctaccccgaccgcgaaaacttaaacgcacgtaacgaaacgaacgaacgtccgacccgaacaaaacgcaactaacgacgaccgctcatacccaaaccacgacgataacgcctaatataactaaacgaacgaaacgaacgctaaaaaacccgaaaaacccccgaaaaaacgactacgtacccaaacgaacacccctaccaactccgcgctacgaccgcgactccgaacgccccgactaactccctacgaactacacgcgcgactccaacctaatcccgaacgcaaaacgcgcgctaacgaaaaaaacgcgcgcccgaacctaacgaaaaacgcgcgtcaccgacccgcgcgcgcaatcgtcgaaaaataccgaaaacgacctaaaaaactatccctaatactaacgactcgtccgctctcgcccgaaacgcgcgacctcctaaaaacctaaaaatacccccaccctaaccgacgccctacgatactccctccgctctccgcctattctcgaaacgttccgacttccacaacgttaaaatctaaaatcaaaccgaaactactacttatccgcaataa

SEQ ID NO: 81 - DNA, 931 bp, Artificial Sequence
  chemically treated genomic DNA (Homo sapiens) CpG-island No: 81
gaagttggcgtttttgttggaagggcgtttttcgcggagtatttcgatgtaagattcggtgcgcgagggtcgcggtatttcgttttcgtcgtagatcgcgtcgtttttttcgttcgcgttttattatttcgattcggggtcgttttcggttttttcgtcgtcgttttcgtcgggtcgcgtttacgatacggtgcgttttagttttaagttcggtttggaggcgcgtttgggcgcgggcgttgtcggtttgtacgagtcgggcgcggttttcggttcgttgtcgtatttcgagcggtagaagcgcgcgcgttttatgattattttgtaggattcggcgttcgagtcgggcgacgtttttcgattttcgttcgcggttatttcgttcgagcgatttaagcgtcggtcgcggtcgttcggtttcgatagtttttacgttaatttgggcgtttttagcgttagttttttcgtttcgtttaagtcgtagcgtcgtaagagttttttggtgaagtagttgtaggtggaggacgcgtaggagcgcgcggttttggtcgtgggtagtttcggtttcggcggcggtagtttcgttcgcgagtttttttcgatttatcgcggttcgcgttcgggtggtttcgattacggcgcgggcgatggttcggggttcgcgttcggcggttcgggttcggttaaggatcggcggttggaggagcggcgtcgttttattgtgtttttgttcgtgggggttatcgagggtagcgttttcggcgcggatttgttatttttatagttttttcgttttatcgacgagcgttttttggggatcggttttatcgtcggtcgcgatttgttgttgtttttttcggtgtttgttttgaagtcgttggttagcggttcgagtttggggttttcgggttttatttttatttatttattt

SEQ ID NO: 82 - DNA, 931 bp, Artificial Sequence
  chemically treated genomic DNA (Homo sapiens) CpG-island No: 82
aaataaataaataaaaataaaacccgaaaaccccaaactcgaaccgctaaccaacgacttcaaaacaaacaccgaaaaaaacaacaacaaatcgcgaccgacgataaaaccgatccccaaaaaacgctcgtcgataaaacgaaaaaactataaaaataacaaatccgcgccgaaaacgctaccctcgataacccccacgaacaaaaacacaataaaacgacgccgctcctccaaccgccgatccttaaccgaacccgaaccgccgaacgcgaaccccgaaccatcgcccgcgccgtaatcgaaaccacccgaacgcgaaccgcgataaatcgaaaaaaactcgcgaacgaaactaccgccgccgaaaccgaaactacccacgaccaaaaccgcgcgctcctacgcgtcctccacctacaactacttcaccaaaaaactcttacgacgctacgacttaaacgaaacgaaaaaactaacgctaaaaacgcccaaattaacgtaaaaactatcgaaaccgaacgaccgcgaccgacgcttaaatcgctcgaacgaaataaccgcgaacgaaaatcgaaaaacgtcgcccgactcgaacgccgaatcctacaaaataatcataaaacgcgcgcgcttctaccgctcgaaatacgacaacgaaccgaaaaccgcgcccgactcgtacaaaccgacaacgcccgcgcccaaacgcgcctccaaaccgaacttaaaactaaaacgcaccgtatcgtaaacgcgacccgacgaaaacgacgacgaaaaaaccgaaaacgaccccgaatcgaaataataaaacgcgaacgaaaaaaacgacgcgatctacgacgaaaacgaaataccgcgaccctcgcgcaccgaatcttacatcgaaatactccgcgaaaaacgcccttccaacaaaaacgccaacttc

SEQ ID NO: 83 - DNA, 931 bp, Artificial Sequence
  chemically treated genomic DNA (Homo sapiens) CpG-island No: 83
gagtgggtggatgaaggtggaattcgagggttttaggttcgggtcgttgattaacggttttagggtagatatcggggagggtagtagtaggtcgcggtcggcggtggggtcggtttttaggaggcgttcgtcgatggagcgggagggttgtagggatggtagattcgcgtcgggggcgttgttttcgatggtttttacggataggaatatagtggagcggcgtcgtttttttagtcgtcggtttttggtcgggttcgggtcgtcgaacgcgagtttcgggttatcgttcgcgtcgtagtcgaggttattcgggcgcggatcgcggtgggtcggggagggttcgcgggcgaagttgtcgtcgtcgggatcggggttgtttacggttagggtcgcgcgtttttgcgcgttttttatttgtagttgttttattagggggtttttgcggcgttgcggtttggacggagcgaagaggttggcgttgaaggcgtttaggttggcgtaggggttgtcggggtcgggcggtcgcggtcggcgtttgggtcgttcgggcggggtggtcgcgggcgggggtcgaggggcgtcgttcgattcgggcgtcgagttttgtaggatgattatggagcgcgcgcgtttttgtcgttcgggatacggtagcgggtcgagggtcgcgttcggttcgtataggtcggtagcgttcgcgtttaggcgcgtttttaggtcgggtttgaagttggagcgtatcgtgtcgtaggcgcggttcggcgggggcggcggcgagaaggtcgggggcggtttcgagtcgaagtagtagggcgcgggcgggggaggcggcgcggtttgcggcgggggcgggatgtcgcgattttcgcgtatcgggttttgtatcgaggtgtttcgcgggaagcgtttttttagtagggacgttagtttt

SEQ ID NO: 84 - DNA, 931 bp, Artificial Sequence
  chemically treated genomic DNA (Homo sapiens) CpG-island No: 84
aaaactaacgtccctactaaaaaaacgcttcccgcgaaacacctcgatacaaaacccgatacgcgaaaatcgcgacatcccgcccccgccgcaaaccgcgccgcctcccccgcccgcgccctactacttcgactcgaaaccgcccccgaccttctcgccgccgcccccgccgaaccgcgcctacgacacgatacgctccaacttcaaacccgacctaaaaacgcgcctaaacgcgaacgctaccgacctatacgaaccgaacgcgaccctcgacccgctaccgtatcccgaacgacaaaaacgcgcgcgctccataatcatcctacaaaactcgacgcccgaatcgaacgacgcccctcgacccccgcccgcgaccaccccgcccgaacgacccaaacgccgaccgcgaccgcccgaccccgacaacccctacgccaacctaaacgccttcaacgccaacctcttcgctccgtccaaaccgcaacgccgcaaaaaccccctaataaaacaactacaaataaaaaacgcgcaaaaacgcgcgaccctaaccgtaaacaaccccgatcccgacgacgacaacttcgcccgcgaaccctccccgacccaccgcgatccgcgcccgaataacctcgactacgacgcgaacgataacccgaaactcgcgttcgacgacccgaacccgaccaaaaaccgacgactaaaaaaacgacgccgctccactatattcctatccgtaaaaaccatcgaaaacaacgcccccgacgcgaatctaccatccctacaaccctcccgctccatcgacgaacgcctcctaaaaaccgaccccaccgccgaccgcgacctactactaccctccccgatatctaccctaaaaccgttaatcaacgacccgaacctaaaaccctcgaattccaccttcatccacccactc

SEQ ID NO: 85 - DNA, 759 bp, Artificial Sequence
  chemically treated genomic DNA (Homo sapiens) CpG-island No: 85
gggggttcgggcggcggggtttcgtattcggtgaggtttagtggtcgttatttcgtggcgagacgcgtttcgagttcggtgaagttcgcgtcgttggagcgggtggaggggttgggggcgggcgcggggggcgtagggcggtttttcggttttacgttttttattatttttaagtcgtttagtttttttatttcgtacgagtttaaggaggtgcgtttcgtggtgcgtagcgtgagcgcgcgtagtcgttttttttcgtcgtcgtcgttgttttcgttcgcgttcggtttcggtttcggcgttttcggtttacgtcgatttttttagtagaagtcgttgtagttttggagtaagttcgacgtgggcgattggttggagagtatttatttaggcgagtatcgcgatcgtttcgaggattatgagatagaaggcgcgtatttattcgcgtttattaaggacgatttcgtggagttgggcgttacgcgcgtgggttatcgtatgaatatcgagcgcgcgtttaggtagttggacggtagttgacgttttatttttattttcgtttcggtcgtgttttgtcggtagggttttttatttttatttcgggtcgcgggttcggtttgttttttacgacggcgttcgggttaggaatgttgtatgaatcgttttgtttgttgttgttcggagattcgttttgtatattgtttagtgtttttatcggtcgtttagtttatttagcgtatagttaggaagggcgtggat

SEQ ID NO: 86 - DNA, 759 bp, Artificial Sequence
  chemically treated genomic DNA (Homo sapiens) CpG-island No: 86
atccacgcccttcctaactatacgctaaataaactaaacgaccgataaaaacactaaacaatatacaaaacgaatctccgaacaacaacaaacaaaacgattcatacaacattcctaacccgaacgccgtcgtaaaaaacaaaccgaacccgcgacccgaaataaaaataaaaaaccctaccgacaaaacacgaccgaaacgaaaataaaaataaaacgtcaactaccgtccaactacctaaacgcgcgctcgatattcatacgataacccacgcgcgtaacgcccaactccacgaaatcgtccttaataaacgcgaataaatacgcgccttctatctcataatcctcgaaacgatcgcgatactcgcctaaataaatactctccaaccaatcgcccacgtcgaacttactccaaaactacaacgacttctactaaaaaaatcgacgtaaaccgaaaacgccgaaaccgaaaccgaacgcgaacgaaaacaacgacgacgacgaaaaaaaacgactacgcgcgctcacgctacgcaccacgaaacgcacctccttaaactcgtacgaaataaaaaaactaaacgacttaaaaataataaaaaacgtaaaaccgaaaaaccgccctacgccccccgcgcccgcccccaacccctccacccgctccaacgacgcgaacttcaccgaactcgaaacgcgtctcgccacgaaataacgaccactaaacctcaccgaatacgaaaccccgccgcccgaaccccc

SEQ ID NO: 87 - DNA, 759 bp, Artificial Sequence
  chemically treated genomic DNA (Homo sapiens) CpG-island No: 87
gtttacgttttttttgattgtgcgttgggtgggttgggcggtcggtgagggtattaagtaatgtatagggcgagttttcgagtaatagtaaataggacgatttatgtaatatttttggttcgggcgtcgtcgtaaggggtaggtcgagttcgcggttcggggtgggggtggggggttttgtcggtagggtacggtcggggcgggagtgggggtggggcgttagttgtcgtttagttgtttgagcgcgcgttcgatgtttatgcggtggtttacgcgcgtgacgtttagttttacgaagtcgtttttggtaagcgcgggtaggtgcgcgttttttattttatggttttcgaagcggtcgcggtgttcgtttaggtggatgttttttagttagtcgtttacgtcgaatttgttttagagttgtagcggtttttgttggaagggtcggcgtgggtcgggggcgtcggggtcggggtcggacgcgggcgagggtagcggcgacggcgagggggagcgattgcgcgcgtttacgttgcgtattacgaagcgtatttttttgggttcgtgcgggatggagaggttggacgatttgaggatggtggggggcgtgaggtcgaagggtcgttttgcgtttttcgcgttcgtttttagtttttttattcgttttagcgacgcgggttttatcgggttcggggcgcgtttcgttacggggtagcggttattgggttttatcgagtacgaggtttcgtcgttcgggttttt

SEQ ID NO: 88 - DNA, 759 bp, Artificial Sequence
  chemically treated genomic DNA (Homo sapiens) CpG-island No: 88
aaaaacccgaacgacgaaacctcgtactcgataaaacccaataaccgctaccccgtaacgaaacgcgccccgaacccgataaaacccgcgtcgctaaaacgaataaaaaaactaaaaacgaacgcgaaaaacgcaaaacgacccttcgacctcacgccccccaccatcctcaaatcgtccaacctctccatcccgcacgaacccaaaaaaatacgcttcgtaatacgcaacgtaaacgcgcgcaatcgctccccctcgccgtcgccgctaccctcgcccgcgtccgaccccgaccccgacgcccccgacccacgccgacccttccaacaaaaaccgctacaactctaaaacaaattcgacgtaaacgactaactaaaaaacatccacctaaacgaacaccgcgaccgcttcgaaaaccataaaataaaaaacgcgcacctacccgcgcttaccaaaaacgacttcgtaaaactaaacgtcacgcgcgtaaaccaccgcataaacatcgaacgcgcgctcaaacaactaaacgacaactaacgccccacccccactcccgccccgaccgtaccctaccgacaaaaccccccacccccaccccgaaccgcgaactcgacctaccccttacgacgacgcccgaaccaaaaatattacataaatcgtcctatttactattactcgaaaactcgccctatacattacttaataccctcaccgaccgcccaacccacccaacgcacaatcaaaaaaaacgtaaac

SEQ ID NO: 89 - DNA, 644 bp, Artificial Sequence
  chemically treated genomic DNA (Homo sapiens) CpG-island No: 89
tttcgcgacgcgttcgtattttgcggttagagcggttttgagttcggttgcgttcgcgttaggcgtttttttttagaagtaatttaggcgcgttcgttggtttttgagcgttaggaaaagttcggagttaacgatcggtcgttcggttattgtacggggttttaagtcgtagaaggacgacgggagggtaatgaagttgagtttaggttttttaggaaggagagagtgcgtcggagtagcgtgggaaagaagggaagagtgtcgttaagtttacggttaacggtggattattcgggtcgttgcgcgtttgggggttgcggaatgcgcgaggagaataagggtatgtttagtgggggcggtagcgatgagggtttggttagcgtcgcggcgcggggattagtggagaaggtgcgatagtttttggaagtcggcgcggattttaacggagttaatcgtttcgggaggcgcgcgatttaggtagttggggttttagggtttcgtcggtagggggcgcgcgaacgcggggcgcggtttcggcggatcggggttggaatttagatcgtcgatgtagatttgtataggagttttcgttggtcggaggtgtgtattttacgcgtaaaataggtttttatttagtaaaaatt

SEQ ID NO: 90 - DNA, 644 bp, Artificial Sequence
  chemically treated genomic DNA (Homo sapiens) CpG-island No: 90
aatttttactaaataaaaacctattttacgcgtaaaatacacacctccgaccaacgaaaactcctatacaaatctacatcgacgatctaaattccaaccccgatccgccgaaaccgcgccccgcgttcgcgcgccccctaccgacgaaaccctaaaaccccaactacctaaatcgcgcgcctcccgaaacgattaactccgttaaaatccgcgccgacttccaaaaactatcgcaccttctccactaatccccgcgccgcgacgctaaccaaaccctcatcgctaccgcccccactaaacatacccttattctcctcgcgcattccgcaacccccaaacgcgcaacgacccgaataatccaccgttaaccgtaaacttaacgacactcttcccttctttcccacgctactccgacgcactctctccttcctaaaaaacctaaactcaacttcattaccctcccgtcgtccttctacgacttaaaaccccgtacaataaccgaacgaccgatcgttaactccgaacttttcctaacgctcaaaaaccaacgaacgcgcctaaattacttctaaaaaaaaacgcctaacgcgaacgcaaccgaactcaaaaccgctctaaccgcaaaatacgaacgcgtcgcgaaa

SEQ ID NO: 91 - DNA, 644 bp, Artificial Sequence
  chemically treated genomic DNA (Homo sapiens) CpG-island No: 91
gatttttgttgggtaaaagtttgttttacgcgtggaatgtatattttcggttaacggagatttttgtataaatttatatcggcgatttaggttttagtttcgattcgtcgaggtcgcgtttcgcgttcgcgcgttttttgtcggcgaggttttggggttttagttatttggatcgcgcgtttttcgaaacggttgatttcgttgggattcgcgtcggtttttaggagttgtcgtattttttttattagttttcgcgtcgcggcgttggttagatttttatcgttgtcgtttttattgggtatgtttttgtttttttcgcgtatttcgtagtttttagacgcgtagcggttcggataatttatcgttggtcgtaaatttaacgatatttttttttttttttttacgttgtttcggcgtatttttttttttttaggagatttgggtttagttttattattttttcgtcgtttttttgcggtttggggtttcgtgtagtggtcgagcggtcggtcgttagtttcgggttttttttggcgtttaagaattagcgggcgcgtttggattgtttttgggaaaaagcgtttagcgcggacgtagtcgagtttaaagtcgttttggtcgtagggtgcggacgcgtcgcggag

SEQ ID NO: 92 - DNA, 644 bp, Artificial Sequence
  chemically treated genomic DNA (Homo sapiens) CpG-island No: 92
ctccgcgacgcgtccgcaccctacgaccaaaacgactttaaactcgactacgtccgcgctaaacgctttttcccaaaaacaatccaaacgcgcccgctaattcttaaacgccaaaaaaaacccgaaactaacgaccgaccgctcgaccactacacgaaaccccaaaccgcaaaaaaacgacgaaaaaataataaaactaaacccaaatctcctaaaaaaaaaaaaatacgccgaaacaacgtaaaaaaaaaaaaaaaaatatcgttaaatttacgaccaacgataaattatccgaaccgctacgcgtctaaaaactacgaaatacgcgaaaaaaacaaaaacatacccaataaaaacgacaacgataaaaatctaaccaacgccgcgacgcgaaaactaataaaaaaaatacgacaactcctaaaaaccgacgcgaatcccaacgaaatcaaccgtttcgaaaaacgcgcgatccaaataactaaaaccccaaaacctcgccgacaaaaaacgcgcgaacgcgaaacgcgacctcgacgaatcgaaactaaaacctaaatcgccgatataaatttatacaaaaatctccgttaaccgaaaatatacattccacgcgtaaaacaaacttttacccaacaaaaatc

SEQ ID NO: 93 - DNA, 704 bp, Artificial Sequence
  chemically treated genomic DNA (Homo sapiens) CpG-island No: 93
tcgcgggagcgcggttgtttttggtagggtcgtgttaggtgacggatgtagttagggggcgagttgtttggagttgcgttttaggcgttcggtttttgggtcgttatcgcggggcgttcgcgttgagggtgggaagatggtggtgggggtgggggcgtatatagggcgggaaagtggcggtaggcgggagggagaggaacgcgggttttgagtcgttcgcgcgcgcgtttttttacgggcgttttcggtagtttttttcgcgtgcgtagggtttagagtcgtttcgagattttggaggttcgggtgggagtgggggtggggtgggggtgggggtgaaggtggggggcgggcgcgtttagggaaggcgggtgcgcgtttgcggggcggagatgggtagggggcggtgcgtgggttttagtttgtagttaagggggtaggagtggcgttgtttatttttggtgttaaagggcggcgtagcggttgtcgagttcggttttggaggcggcgagaatatggtgcgtaggtttttggtgatttttcggattcggcgcgcgtgcggttcgtcgcgagtgagggttttcgtggtttatatttcgcggtttacgggggagtgggtagcgttaggggcgttcgtcgttgtggttttcgtgttgatgttattgaggagttagcgtttagggtagtagtcgttttttagaagatta

SEQ ID NO: 94 - DNA, 704 bp, Artificial Sequence
  chemically treated genomic DNA (Homo sapiens) CpG-island No: 94
taatcttctaaaaaacgactactaccctaaacgctaactcctcaataacatcaacacgaaaaccacaacgacgaacgcccctaacgctacccactcccccgtaaaccgcgaaatataaaccacgaaaaccctcactcgcgacgaaccgcacgcgcgccgaatccgaaaaatcaccaaaaacctacgcaccatattctcgccgcctccaaaaccgaactcgacaaccgctacgccgccctttaacaccaaaaataaacaacgccactcctacccccttaactacaaactaaaacccacgcaccgccccctacccatctccgccccgcaaacgcgcacccgccttccctaaacgcgcccgccccccaccttcacccccacccccaccccacccccactcccacccgaacctccaaaatctcgaaacgactctaaaccctacgcacgcgaaaaaaactaccgaaaacgcccgtaaaaaaacgcgcgcgcgaacgactcaaaacccgcgttcctctccctcccgcctaccgccactttcccgccctatatacgcccccacccccaccaccatcttcccaccctcaacgcgaacgccccgcgataacgacccaaaaaccgaacgcctaaaacgcaactccaaacaactcgccccctaactacatccgtcacctaacacgaccctaccaaaaacaaccgcgctcccgcga

SEQ ID NO: 95 - DNA, 704 bp, Artificial Sequence
  chemically treated genomic DNA (Homo sapiens) CpG-island No: 95
tggttttttaggaagcggttgttgttttagacgttggttttttagtagtattagtacgagggttatagcggcgggcgtttttggcgttgtttattttttcgtgagtcgcgggatgtgaattacgaaaatttttattcgcggcgggtcgtacgcgcgtcgaattcggagggttattaagaatttgcgtattatgttttcgtcgtttttagggtcgagttcggtagtcgttgcgtcgttttttggtattagaggtgagtagcgttatttttgtttttttaattgtagattgggatttacgtatcgttttttgtttattttcgtttcgtaggcgcgtattcgttttttttgagcgcgttcgttttttatttttatttttatttttattttatttttatttttattcggatttttaagatttcggaacggttttgagttttgcgtacgcgggaagggttgtcggaggcgttcgtagggaggcgcgcgcgcgggcggtttagggttcgcgtttttttttttttcgtttatcgttattttttcgttttgtgtgcgtttttatttttattattatttttttatttttagcgcgggcgtttcgcggtgacggtttaggggtcggacgtttggaacgtaattttaggtagttcgttttttagttatattcgttatttgatacggttttattaggaatagtcgcgttttcgcgg

SEQ ID NO: 96 - DNA, 704 bp, Artificial Sequence
  chemically treated genomic DNA (Homo sapiens) CpG-island No: 96
ccgcgaaaacgcgactattcctaataaaaccgtatcaaataacgaatataactaaaaaacgaactacctaaaattacgttccaaacgtccgacccctaaaccgtcaccgcgaaacgcccgcgctaaaaataaaaaaataataataaaaataaaaacgcacacaaaacgaaaaaataacgataaacgaaaaaaaaaaaaacgcgaaccctaaaccgcccgcgcgcgcgcctccctacgaacgcctccgacaacccttcccgcgtacgcaaaactcaaaaccgttccgaaatcttaaaaatccgaataaaaataaaaataaaataaaaataaaaataaaaataaaaaacgaacgcgctcaaaaaaaacgaatacgcgcctacgaaacgaaaataaacaaaaaacgatacgtaaatcccaatctacaattaaaaaaacaaaaataacgctactcacctctaataccaaaaaacgacgcaacgactaccgaactcgaccctaaaaacgacgaaaacataatacgcaaattcttaataaccctccgaattcgacgcgcgtacgacccgccgcgaataaaaattttcgtaattcacatcccgcgactcacgaaaaaataaacaacgccaaaaacgcccgccgctataaccctcgtactaatactactaaaaaaccaacgtctaaaacaacaaccgcttcctaaaaaacca

SEQ ID NO: 97 - DNA, 674 bp, Artificial Sequence
  chemically treated genomic DNA (Homo sapiens) CpG-island No: 97
gtcggcgcggtttcgggagggcggttggaaaagtttatagttgagcgcgttttggaggttgtggttgagggcgtagagtacgcgttgtttggcggtttatacgggcgcggtcgggtttaggcgtaggtatttttgtagcggagcgggttcgtgagtttaggtttcgggagcgcggattcgtttcgtcggttttatgcggggtgtcgagtttcgggttttcgtcgaaggagttcggggttcgggtgtcggcgttcgggatttcgcgttttcgcgaatcgcggtcgaagtttcgttttaggggtcgggtttttcggggtttcgttttggcgatggggagggtttcggcggaggcggcgggggaggggtgagtattcgtgggtcgggggtttcgggcgtcgggcgcgttcggcgggggtgggggaaggtttggggggttgtgacggggttgggggggggagttttaggtttcggtgcggggggagtggttgagcggtaagggcgggtattcgcggattatcggggcgggtgcggcggaggaaggggtttcggagttggggtgggggtcgcgtcggggtacgaagattaaggtagggcgagaaggggaaagaaaaataattaattttcggaggtggcggttttttttttttattttatcgatttttagtttcgggttt

SEQ ID NO: 98 - DNA, 674 bp, Artificial Sequence
  chemically treated genomic DNA (Homo sapiens) CpG-island No: 98
aaacccgaaactaaaaatcgataaaataaaaaaaaaaaaccgccacctccgaaaattaattatttttctttccccttctcgccctaccttaatcttcgtaccccgacgcgacccccaccccaactccgaaaccccttcctccgccgcacccgccccgataatccgcgaatacccgcccttaccgctcaaccactccccccgcaccgaaacctaaaactcccccccccaaccccgtcacaaccccccaaaccttcccccacccccgccgaacgcgcccgacgcccgaaacccccgacccacgaatactcacccctcccccgccgcctccgccgaaaccctccccatcgccaaaacgaaaccccgaaaaacccgacccctaaaacgaaacttcgaccgcgattcgcgaaaacgcgaaatcccgaacgccgacacccgaaccccgaactccttcgacgaaaacccgaaactcgacaccccgcataaaaccgacgaaacgaatccgcgctcccgaaacctaaactcacgaacccgctccgctacaaaaatacctacgcctaaacccgaccgcgcccgtataaaccgccaaacaacgcgtactctacgccctcaaccacaacctccaaaacgcgctcaactataaacttttccaaccgccctcccgaaaccgcgccgac

SEQ ID NO: 99 - DNA, 674 bp, Artificial Sequence
  chemically treated genomic DNA (Homo sapiens) CpG-island No: 99
aggttcgaagttgggggtcggtggagtgggggggagaagtcgttattttcggaaattaattgtttttttttttttttttcgttttattttggttttcgtgtttcgacgcggtttttattttagtttcgggattttttttttcgtcgtattcgtttcggtggttcgcggatgttcgtttttgtcgtttagttatttttttcgtatcgaggtttaggatttttttttttaatttcgttatagttttttagatttttttttattttcgtcgggcgcgttcggcgttcgggattttcggtttacggatatttatttttttttcgtcgttttcgtcgggattttttttatcgttagggcggggtttcgggaagttcggtttttggggcggggtttcggtcgcggttcgcggaggcgcggggtttcgggcgtcggtattcgagtttcggattttttcggcgggggttcggggttcggtatttcgtatggggtcggcggggcgggttcgcgttttcgggatttgagtttacgagttcgtttcgttgtagaagtgtttgcgtttggattcggtcgcgttcgtgtgggtcgttaagtagcgcgtgttttgcgtttttaattatagtttttaggacgcgtttaattatgggtttttttagtcgttttttcggggtcgcgtcggt

SEQ ID NO: 100 - DNA, 674 bp, Artificial Sequence
  chemically treated genomic DNA (Homo sapiens) CpG-island No: 100
accgacgcgaccccgaaaaaacgactaaaaaaacccataattaaacgcgtcctaaaaactataattaaaaacgcaaaacacgcgctacttaacgacccacacgaacgcgaccgaatccaaacgcaaacacttctacaacgaaacgaactcgtaaactcaaatcccgaaaacgcgaacccgccccgccgaccccatacgaaataccgaaccccgaacccccgccgaaaaaatccgaaactcgaataccgacgcccgaaaccccgcgcctccgcgaaccgcgaccgaaaccccgccccaaaaaccgaacttcccgaaaccccgccctaacgataaaaaaaatcccgacgaaaacgacgaaaaaaaaataaatatccgtaaaccgaaaatcccgaacgccgaacgcgcccgacgaaaataaaaaaaaatctaaaaaactataacgaaattaaaaaaaaaaatcctaaacctcgatacgaaaaaaataactaaacgacaaaaacgaacatccgcgaaccaccgaaacgaatacgacgaaaaaaaaaatcccgaaactaaaataaaaaccgcgtcgaaacacgaaaaccaaaataaaacgaaaaaaaaaaaaaaaaacaattaatttccgaaaataacgacttctcccccccactccaccgacccccaacttcgaacct

SEQ ID NO: 101 - DNA, 1489 bp, Artificial Sequence
  chemically treated genomic DNA (Homo sapiens) CpG-island No: 101
tttcgcgttgaggataaagttcgttttcgtcggttttttggtttgggtatcgggtatcgggcgttaggggcgagataggtaggatttgcgcgcgtttcgattcgattttagatttcgattcgatttcgggttcggtttttcgcgatttttgcgcgtatttattattgtggttgatttaggtcggttttaggagttttattgttcggtcgtcgtcgtcgtcgggttgaggcgagcgtcgggttttttagcgcgttcgggttatggagttatcgtcgtcgttttttttcgcgttattcgtttttcggtcgtcgttcgtttcgcgtttttagggtcgtcgcgttatcgtcggttcgcgttttttttcgtcgttatagtcgttattcgcgttcggtcgtcgtcgtcgttattatagtcgtattttttgcgtcgtttttttttaggcggttttcgggtaacgtcggaagttacggcgcgtatttgttaaatcgtttcggcgggaaatcgttttttacgcggattgggtcgtttcggttttttcgttggtaggggtttcgggtcgggttcgggcgcgggcgttttagaaagggcggttcgtttggacggcggatagcgagcggggtttgtagttgtaattcgggtcgttcgtagaggtaggcggggtttaggtggcgtggatcgttcgttattagttttgtttcgttagtttgagttcgatttattaattagttttcgttatttattaatacgcgttattgggtattttgcgagcgtcgggtttcgcgtcggcgtcggaatgcgattcgggtttcggattcgaacgaatgcgggggacgagttaattttggtgggggaggttggggcggacgcgtttattagaagatcggggtcgtttgtttagatatgaatatttggattcggaggagtagagggacgttttttcggtcgtttcggttgtattgcggagtcgaggttcgcgcgagggcgtagatcgattaatcggttagggtttgattggttagattgtgttcgttgtagaggcgcgtttttagtatagggcggggacggaagggaggatttcgagtcgcgtgaaacgtaaggttttcgtgtgtgcgtagttgatattttaggcggggttgcgtcgggggcggggataggcgcgttttagtttacgtagtcggaacgtttgagcgttgggcgtttggtttgtcggattttagtagggggtatcgcgggtcggattgtggaggggcgtacgttcggaagcggcgagggtagttatgacggttttcgtgttgcgaagtatttcgttagttttgcgttcgattagcgggtgagtgcggacgttggtcggatagcggagtgtttagggcgcgtgcggggttttcgcgattgttcgttaggattcgtttgtgttttttgttcgttttttagtttacgaatattttagggatgagttatttggtcgtgatttttatgtatgaaaatttga

SEQ ID NO: 102 - DNA, 1489 bp, Artificial Sequence
  chemically treated genomic DNA (Homo sapiens) CpG-island No: 102
tcaaattttcatacataaaaatcacgaccaaataactcatccctaaaatattcgtaaactaaaaaacgaacaaaaaacacaaacgaatcctaacgaacaatcgcgaaaaccccgcacgcgccctaaacactccgctatccgaccaacgtccgcactcacccgctaatcgaacgcaaaactaacgaaatacttcgcaacacgaaaaccgtcataactaccctcgccgcttccgaacgtacgcccctccacaatccgacccgcgataccccctactaaaatccgacaaaccaaacgcccaacgctcaaacgttccgactacgtaaactaaaacgcgcctatccccgcccccgacgcaaccccgcctaaaatatcaactacgcacacacgaaaaccttacgtttcacgcgactcgaaatcctcccttccgtccccgccctatactaaaaacgcgcctctacaacgaacacaatctaaccaatcaaaccctaaccgattaatcgatctacgccctcgcgcgaacctcgactccgcaatacaaccgaaacgaccgaaaaaacgtccctctactcctccgaatccaaatattcatatctaaacaaacgaccccgatcttctaataaacgcgtccgccccaacctcccccaccaaaattaactcgtcccccgcattcgttcgaatccgaaacccgaatcgcattccgacgccgacgcgaaacccgacgctcgcaaaatacccaataacgcgtattaataaataacgaaaactaattaataaatcgaactcaaactaacgaaacaaaactaataacgaacgatccacgccacctaaaccccgcctacctctacgaacgacccgaattacaactacaaaccccgctcgctatccgccgtccaaacgaaccgccctttctaaaacgcccgcgcccgaacccgacccgaaacccctaccaacgaaaaaaccgaaacgacccaatccgcgtaaaaaacgatttcccgccgaaacgatttaacaaatacgcgccgtaacttccgacgttacccgaaaaccgcctaaaaaaaaacgacgcaaaaaatacgactataataacgacgacgacgaccgaacgcgaataacgactataacgacgaaaaaaaacgcgaaccgacgataacgcgacgaccctaaaaacgcgaaacgaacgacgaccgaaaaacgaataacgcgaaaaaaaacgacgacgataactccataacccgaacgcgctaaaaaacccgacgctcgcctcaacccgacgacgacgacgaccgaacaataaaactcctaaaaccgacctaaatcaaccacaataataaatacgcgcaaaaatcgcgaaaaaccgaacccgaaatcgaatcgaaatctaaaatcgaatcgaaacgcgcgcaaatcctacctatctcgcccctaacgcccgatacccgatacccaaaccaaaaaaccgacgaaaacgaactttatcctcaacgcgaaa

SEQ ID NO: 103 - DNA, 1489 bp, Artificial Sequence
  chemically treated genomic DNA (Homo sapiens) CpG-island No: 103
ttagatttttatgtataagagttacgattagatggtttatttttgagatattcgtggattgggaggcgagtagggagtataggcgagttttggcggatagtcgcgaagatttcgtacgcgttttgggtatttcgttattcggttagcgttcgtatttattcgttagtcgggcgtagggttagcgagatatttcgtagtacggaggtcgttatggttattttcgtcgttttcgggcgtgcgtttttttatagttcggttcgcggtgttttttgttgaggttcggtagattaggcgtttagcgtttaggcgtttcggttgcgtgggttgggacgcgtttgttttcgttttcgacgtagtttcgtttagggtgttagttgcgtatatacgagggttttgcgttttacgcggttcggggttttttttttcgttttcgttttgtgttgggagcgcgtttttgtagcgggtatagtttagttagttaggttttagtcggttggtcggtttgcgttttcgcgcgggtttcggtttcgtagtgtagtcggagcggtcgagggggcgtttttttgttttttcgagtttaaatgtttatgtttaggtaaacggtttcgattttttaataaacgcgttcgttttagttttttttattagggttggttcgtttttcgtattcgttcgagttcgaagttcggatcgtatttcggcgtcggcgcggagttcggcgttcgtaagatgtttaatagcgcgtgttgatgaatgacggaagttagttaataagtcggatttagattggcgaggtagagttggtgacgggcggtttacgttatttgggtttcgtttgtttttgcgggcggttcgggttgtaattgtaggtttcgttcgttgttcgtcgtttaggcgaatcgttttttttggggcgttcgcgttcgggttcgattcgaagtttttgttagcggaggagtcggggcggtttagttcgcgtggggagcggtttttcgtcggggcgatttggtaggtgcgcgtcgtgattttcggcgttgttcgggagtcgtttgaggaggagcggcgtaggggatgcggttgtggtggcggcggcggcggtcgagcgcgggtggcggttgtggcggcggaggggggcgcgggtcggcgatggcgcggcggttttgagggcgcggggcgggcggcggtcggagggcgggtggcgcgggaggaagcggcggcggtggttttatggttcgggcgcgttgagggattcggcgttcgttttagttcggcggcggcggcggtcgaataatgaagtttttgaagtcgatttgggttaattataatggtgagtgcgcgtaggggtcgcgggaggtcgagttcggagtcgggtcggggtttggagtcgagtcggggcgcgcgtaagttttgtttgtttcgtttttgacgttcggtattcggtgtttaagttaagaagtcggcgggagcggattttgtttttagcgcggag

SEQ ID NO: 104 - DNA, 1489 bp, Artificial Sequence
  chemically treated genomic DNA (Homo sapiens) CpG-island No: 104
ctccgcgctaaaaacaaaatccgctcccgccgacttcttaacttaaacaccgaataccgaacgtcaaaaacgaaacaaacaaaacttacgcgcgccccgactcgactccaaaccccgacccgactccgaactcgacctcccgcgacccctacgcgcactcaccattataattaacccaaatcgacttcaaaaacttcattattcgaccgccgccgccgccgaactaaaacgaacgccgaatccctcaacgcgcccgaaccataaaaccaccgccgccgcttcctcccgcgccacccgccctccgaccgccgcccgccccgcgccctcaaaaccgccgcgccatcgccgacccgcgcccccctccgccgccacaaccgccacccgcgctcgaccgccgccgccgccaccacaaccgcatcccctacgccgctcctcctcaaacgactcccgaacaacgccgaaaatcacgacgcgcacctaccaaatcgccccgacgaaaaaccgctccccacgcgaactaaaccgccccgactcctccgctaacaaaaacttcgaatcgaacccgaacgcgaacgccccaaaaaaaacgattcgcctaaacgacgaacaacgaacgaaacctacaattacaacccgaaccgcccgcaaaaacaaacgaaacccaaataacgtaaaccgcccgtcaccaactctacctcgccaatctaaatccgacttattaactaacttccgtcattcatcaacacgcgctattaaacatcttacgaacgccgaactccgcgccgacgccgaaatacgatccgaacttcgaactcgaacgaatacgaaaaacgaaccaaccctaataaaaaaaactaaaacgaacgcgtttattaaaaaatcgaaaccgtttacctaaacataaacatttaaactcgaaaaaacaaaaaaacgccccctcgaccgctccgactacactacgaaaccgaaacccgcgcgaaaacgcaaaccgaccaaccgactaaaacctaactaactaaactatacccgctacaaaaacgcgctcccaacacaaaacgaaaacgaaaaaaaaaaccccgaaccgcgtaaaacgcaaaaccctcgtatatacgcaactaacaccctaaacgaaactacgtcgaaaacgaaaacaaacgcgtcccaacccacgcaaccgaaacgcctaaacgctaaacgcctaatctaccgaacctcaacaaaaaacaccgcgaaccgaactataaaaaaacgcacgcccgaaaacgacgaaaataaccataacgacctccgtactacgaaatatctcgctaaccctacgcccgactaacgaataaatacgaacgctaaccgaataacgaaatacccaaaacgcgtacgaaatcttcgcgactatccgccaaaactcgcctatactccctactcgcctcccaatccacgaatatctcaaaaataaaccatctaatcgtaactcttatacataaaaatctaa

SEQ ID NO: 105 - DNA, 524 bp, Artificial Sequence
  chemically treated genomic DNA (Homo sapiens) CpG-island No: 105
taggtcgcggggtatggggcgtggaggggtggggaaagttgggtttcgtaaggcgtttcgaagcgtcgtttcgttttttttcggcgtatttgggtttcggcgtttcggcgttttttttagtcgcggtagttggttaggtcgcgttgttattgttcgtaggtcggtcgttcgtcgtggacgtagtagtggtgtaggaagtgtttggcgttgcggtagagtttttattcggcgcggtaggtttcgtaggggcgcggcggttgcggcgagaggcggcgtttgagcggggttcggcggtcgcgttttacgtttcgagttagtttcgtttttttttttcggaagatttcggtggttttcggtttcgatttagtatatttatttgttagtcgttgtcgttcgttatgtttgggcgatcggcgcgttaagttcgttttttagttcgttagttaatgaaaaatgaagaaaacggtatttcgtgatcgattgatagaagaattaatgagtatcgatatatttaattacgtttt

SEQ ID NO: 106 - DNA, 524 bp, Artificial Sequence
  chemically treated genomic DNA (Homo sapiens) CpG-island No: 106
aaaacgtaattaaatatatcgatactcattaattcttctatcaatcgatcacgaaataccgttttcttcatttttcattaactaacgaactaaaaaacgaacttaacgcgccgatcgcccaaacataacgaacgacaacgactaacaaataaatatactaaatcgaaaccgaaaaccaccgaaatcttccgaaaaaaaaaaacgaaactaactcgaaacgtaaaacgcgaccgccgaaccccgctcaaacgccgcctctcgccgcaaccgccgcgcccctacgaaacctaccgcgccgaataaaaactctaccgcaacgccaaacacttcctacaccactactacgtccacgacgaacgaccgacctacgaacaataacaacgcgacctaaccaactaccgcgactaaaaaaaacgccgaaacgccgaaacccaaatacgccgaaaaaaaacgaaacgacgcttcgaaacgccttacgaaacccaactttccccacccctccacgccccataccccgcgaccta

SEQ ID NO: 107 - DNA, 524 bp, Artificial Sequence
  chemically treated genomic DNA (Homo sapiens) CpG-island No: 107
aagacgtgattgaatgtgtcggtgtttattagtttttttgttagtcgattacgaggtgtcgttttttttattttttattggttggcggattgaggggcgggtttggcgcgtcggtcgtttagatatggcggacggtagcggttggtaggtgagtgtgttgggtcggagtcgggaattatcggggtttttcggagggagggaacgggattggttcggggcgtagggcgcggtcgtcgggtttcgtttaggcgtcgtttttcgtcgtagtcgtcgcgtttttgcgaggtttatcgcgtcgagtggaagttttgtcgtagcgttaggtattttttatattattattacgtttacggcgagcggtcggtttgcgaatagtggtagcgcgatttggttagttgtcgcgattgggaggagcgtcggaacgtcgaggtttaggtgcgtcgggagggagcggggcggcgtttcggagcgttttgcggggtttagttttttttatttttttacgttttatgtttcgcgattta

SEQ ID NO: 108 - DNA, 524 bp, Artificial Sequence
  chemically treated genomic DNA (Homo sapiens) CpG-island No: 108
taaatcgcgaaacataaaacgtaaaaaaataaaaaaaactaaaccccgcaaaacgctccgaaacgccgccccgctccctcccgacgcacctaaacctcgacgttccgacgctcctcccaatcgcgacaactaaccaaatcgcgctaccactattcgcaaaccgaccgctcgccgtaaacgtaataataatataaaaaatacctaacgctacgacaaaacttccactcgacgcgataaacctcgcaaaaacgcgacgactacgacgaaaaacgacgcctaaacgaaacccgacgaccgcgccctacgccccgaaccaatcccgttccctccctccgaaaaaccccgataattcccgactccgacccaacacactcacctaccaaccgctaccgtccgccatatctaaacgaccgacgcgccaaacccgcccctcaatccgccaaccaataaaaaataaaaaaaacgacacctcgtaatcgactaacaaaaaaactaataaacaccgacacattcaatcacgtctt

SEQ ID NO: 109 - DNA, 945 bp, Artificial Sequence
  chemically treated genomic DNA (Homo sapiens) CpG-island No: 109
ggtcgtcgtttttttaggaatgcgcggttttgtttagggttcggtgggttgagtattttttgttgttcggtttacgtttttcggttagtcgcgtcgtttacgttttaatttgggttcgcgttttttagttttcgtttaggttcgcgttttttagttttcgtttaggtaggcgtttgcgtttaggtgagggtttcgttcgtcgtcgtttttcgcgttttgcgcgttcgcggttcgagtttcgttcgagtcgggcggagcggagcgcgcggagtttagattcgttgtcgggtcggggttgggtcggagcggcggcgtttggatgtcggttcggggttgggtcggagattggcgttcgtttcgaagcgattttcggttttcgattcgtttcgtttgatttttatgatgaagagggcgtttattggaggtgagtgtttacgcggcgttagagtttagtaggcggcggggcgtagagcggggtggttcgttttttttcggagtcgtagggttcgtttagggtttttaaggttggggaagcgtagtcgggcggtcgggagggttatcgtagtgtcgcgttaggttggggttaagggcgtttcggtttcgggagggcggagtcggaggtagtaggaaaagttgtcgtttttcgggtaagttgacggcgatggcggggtcgggggtggcggttcgggggttttcgaggttgggttaggttcggggtgggggtcgcgggttggaaggacggggttcggtttcggcgtcgcggttacgaaggggttaatgagcgggtttttttgtagaaacgcgggtatcgagagtaggtggaggtatcgggtcgttttcgttttcgtttcgcggattgggtttagaatttttcgtttttttgaggttaggttttagggggattaatgggggcgttggcggtagtagagggcgtgggggataagg

SEQ ID NO: 110 - DNA, 945 bp, Artificial Sequence
  chemically treated genomic DNA (Homo sapiens) CpG-island No: 110
ccttatcccccacgccctctactaccgccaacgcccccattaatccccctaaaacctaacctcaaaaaaacgaaaaattctaaacccaatccgcgaaacgaaaacgaaaacgacccgatacctccacctactctcgatacccgcgtttctacaaaaaaacccgctcattaaccccttcgtaaccgcgacgccgaaaccgaaccccgtccttccaacccgcgacccccaccccgaacctaacccaacctcgaaaacccccgaaccgccacccccgaccccgccatcgccgtcaacttacccgaaaaacgacaacttttcctactacctccgactccgccctcccgaaaccgaaacgcccttaaccccaacctaacgcgacactacgataaccctcccgaccgcccgactacgcttccccaaccttaaaaaccctaaacgaaccctacgactccgaaaaaaaacgaaccaccccgctctacgccccgccgcctactaaactctaacgccgcgtaaacactcacctccaataaacgccctcttcatcataaaaatcaaacgaaacgaatcgaaaaccgaaaatcgcttcgaaacgaacgccaatctccgacccaaccccgaaccgacatccaaacgccgccgctccgacccaaccccgacccgacaacgaatctaaactccgcgcgctccgctccgcccgactcgaacgaaactcgaaccgcgaacgcgcaaaacgcgaaaaacgacgacgaacgaaaccctcacctaaacgcaaacgcctacctaaacgaaaactaaaaaacgcgaacctaaacgaaaactaaaaaacgcgaacccaaattaaaacgtaaacgacgcgactaaccgaaaaacgtaaaccgaacaacaaaaaatactcaacccaccgaaccctaaacaaaaccgcgcattcctaaaaaaacgacgacc

SEQ ID NO: 111 - DNA, 945 bp, Artificial Sequence
  chemically treated genomic DNA (Homo sapiens) CpG-island No: 111
ttttgttttttacgttttttattgtcgttaacgtttttattgatttttttgaggtttgattttagaaaaacgggaggttttgagtttagttcgcgaggcgggggcggaggcggttcgatatttttatttattttcggtattcgcgtttttgtaaaaaaattcgtttattaattttttcgtggtcgcggcgtcgaggtcggatttcgtttttttagttcgcggtttttatttcggatttggtttagtttcggggattttcgggtcgttattttcggtttcgttatcgtcgttaatttattcgggaagcggtaattttttttgttgttttcggtttcgttttttcggggtcggggcgtttttggttttagtttggcgcggtattgcggtggttttttcggtcgttcggttacgtttttttagttttggaagttttggacgggttttgcggtttcgaggaggggcgaattatttcgttttgcgtttcgtcgtttgttgggttttggcgtcgcgtggatatttatttttagtggacgttttttttattataggggttaggcggagcgggtcggggatcgaaagtcgtttcggggcgggcgttagttttcggtttagtttcgggtcggtatttaggcgtcgtcgtttcggtttagtttcggttcggtagcgggtttaggtttcgcgcgtttcgtttcgttcggttcgggcggggttcgggtcgcgggcgcgtagggcgcgggaggcggcggcgggcggggtttttatttgggcgtaggcgtttgtttgggcgggggttggggggcgcgagtttgggcgggggttggggggcgcgggtttaagttggggcgtgagcggcgcggttggtcggggagcgtaggtcgggtagtaggaggtgtttagtttatcgggttttagataaagtcgcgtatttttgaagaggcggcggtt

SEQ ID NO: 112 - DNA, 945 bp, Artificial Sequence
  chemically treated genomic DNA (Homo sapiens) CpG-island No: 112
aaccgccgcctcttcaaaaatacgcgactttatctaaaacccgataaactaaacacctcctactacccgacctacgctccccgaccaaccgcgccgctcacgccccaacttaaacccgcgccccccaacccccgcccaaactcgcgccccccaacccccgcccaaacaaacgcctacgcccaaataaaaaccccgcccgccgccgcctcccgcgccctacgcgcccgcgacccgaaccccgcccgaaccgaacgaaacgaaacgcgcgaaacctaaacccgctaccgaaccgaaactaaaccgaaacgacgacgcctaaataccgacccgaaactaaaccgaaaactaacgcccgccccgaaacgactttcgatccccgacccgctccgcctaacccctataataaaaaaaacgtccactaaaaataaatatccacgcgacgccaaaacccaacaaacgacgaaacgcaaaacgaaataattcgcccctcctcgaaaccgcaaaacccgtccaaaacttccaaaactaaaaaaacgtaaccgaacgaccgaaaaaaccaccgcaataccgcgccaaactaaaaccaaaaacgccccgaccccgaaaaaacgaaaccgaaaacaacaaaaaaaattaccgcttcccgaataaattaacgacgataacgaaaccgaaaataacgacccgaaaatccccgaaactaaaccaaatccgaaataaaaaccgcgaactaaaaaaacgaaatccgacctcgacgccgcgaccacgaaaaaattaataaacgaatttttttacaaaaacgcgaataccgaaaataaataaaaatatcgaaccgcctccgcccccgcctcgcgaactaaactcaaaacctcccgtttttctaaaatcaaacctcaaaaaaatcaataaaaacgttaacgacaataaaaaacgtaaaaaacaaaa

SEQ ID NO: 113 - DNA, 842 bp, Artificial Sequence
  chemically treated genomic DNA (Homo sapiens) CpG-island No: 113
cgcgtatagaaaaggaaattttatttcgtttgttaagggtagggtcgggttagtggtaggagaaggttagttgcgggcgtaggtaggagcggatttaggagtcgcgtcggggcgtagagtcggacgtttcgaggagtttgcgcgtcgcgttattcggcggaagtcgcggtttatgcggggttttttaggtttatttaacgtttcgtaggcgtggttggtaggaggggttcggtcgtgtttagcgtttttagacgtagttttttttgtcgtagtcgtcggtggtcgtgggtcgtcgcggcgttgagtattttacggggaagttgaggtcgggacggtcggtgtagatttaggcgtcgtagtataagaggtagtcgtttattatgagtagcgcggtggtcgtttagtcgatgtatagcgttgcgtttagttcgtatttttgcgatacgggtatagacgggtcgtaaaattcgcggacgataatgttggcgaattagtagagtggtacgagcgttagtagttcgtaaaataggtagagtacgtttttcgtgagggttatacgcgttttggtcgggttcggggttacgtaggtggtgtattgcgcgttcgttagggttacgaagagcgtaacgaacgttagtagtacggcgtttacggtgagcgttcgcgtcgtttgtatttcggtgtttagagttagtatcgagtcgtatattttgtattgtatgtgttcggtgttttgtattacgtacgatatttatagttttttttaggtggtttgcgtcgttacgatgttgtggtttaggaaggcggttatttgttatatgggtagttcgtacgttaggatt

SEQ ID NO: 114 - DNA, 842 bp, Artificial Sequence
  chemically treated genomic DNA (Homo sapiens) CpG-island No: 114
aatcctaacgtacgaactacccatataacaaataaccgccttcctaaaccacaacatcgtaacgacgcaaaccacctaaaaaaaactataaatatcgtacgtaatacaaaacaccgaacacatacaatacaaaatatacgactcgatactaactctaaacaccgaaatacaaacgacgcgaacgctcaccgtaaacgccgtactactaacgttcgttacgctcttcgtaaccctaacgaacgcgcaatacaccacctacgtaaccccgaacccgaccaaaacgcgtataaccctcacgaaaaacgtactctacctattttacgaactactaacgctcgtaccactctactaattcgccaacattatcgtccgcgaattttacgacccgtctatacccgtatcgcaaaaatacgaactaaacgcaacgctatacatcgactaaacgaccaccgcgctactcataataaacgactacctcttatactacgacgcctaaatctacaccgaccgtcccgacctcaacttccccgtaaaatactcaacgccgcgacgacccacgaccaccgacgactacgacaaaaaaaactacgtctaaaaacgctaaacacgaccgaacccctcctaccaaccacgcctacgaaacgttaaataaacctaaaaaaccccgcataaaccgcgacttccgccgaataacgcgacgcgcaaactcctcgaaacgtccgactctacgccccgacgcgactcctaaatccgctcctacctacgcccgcaactaaccttctcctaccactaacccgaccctacccttaacaaacgaaataaaatttccttttctatacgcg

SEQ ID NO: 115 - DNA, 842 bp, Artificial Sequence
  chemically treated genomic DNA (Homo sapiens) CpG-island No: 115
gattttggcgtgcgggttgtttatgtggtaggtgatcgtttttttggattataatatcgtgacggcgtagattatttggaaggggttgtggatgtcgtgcgtggtgtagagtatcgggtatatgtagtgtaaagtgtacgattcggtgttggttttgagtatcgaggtgtaggcggcgcgggcgtttatcgtgagcgtcgtgttgttggcgttcgttgcgtttttcgtgattttggcgggcgcgtagtgtattatttgcgtggtttcgggttcggttaaggcgcgtgtggtttttacgggaggcgtgttttatttgttttgcgggttgttggcgttcgtgttattttgttggttcgttaatattgtcgttcgcgagttttacgattcgtttgtgttcgtgtcgtagaagtacgagttgggcgtagcgttgtatatcggttgggcggttatcgcgttgtttatggtaggcggttgttttttgtgttgcggcgtttgggtttgtatcggtcgtttcgattttagttttttcgtgaagtatttagcgtcgcggcggtttacggttatcggcgattacgataagaagaattacgtttgagggcgttgggtacggtcgggttttttttgttagttacgtttgcgaggcgttggataagtttggggagtttcgtatggatcgcggttttcgtcgggtagcgcggcgcgtaggtttttcggaacgttcggttttgcgtttcgacgcggtttttggattcgtttttgtttgcgttcgtagttgatttttttttgttattagttcggttttgtttttaatagacggaatgaagtttttttttttgtgcgcg

SEQ ID NO: 116 - DNA, 842 bp, Artificial Sequence
  chemically treated genomic DNA (Homo sapiens) CpG-island No: 116
cgcgcacaaaaaaaaaaacttcattccgtctattaaaaacaaaaccgaactaataacaaaaaaaaatcaactacgaacgcaaacaaaaacgaatccaaaaaccgcgtcgaaacgcaaaaccgaacgttccgaaaaacctacgcgccgcgctacccgacgaaaaccgcgatccatacgaaactccccaaacttatccaacgcctcgcaaacgtaactaacaaaaaaaacccgaccgtacccaacgccctcaaacgtaattcttcttatcgtaatcgccgataaccgtaaaccgccgcgacgctaaatacttcacgaaaaaactaaaatcgaaacgaccgatacaaacccaaacgccgcaacacaaaaaacaaccgcctaccataaacaacgcgataaccgcccaaccgatatacaacgctacgcccaactcgtacttctacgacacgaacacaaacgaatcgtaaaactcgcgaacgacaatattaacgaaccaacaaaataacacgaacgccaacaacccgcaaaacaaataaaacacgcctcccgtaaaaaccacacgcgccttaaccgaacccgaaaccacgcaaataatacactacgcgcccgccaaaatcacgaaaaacgcaacgaacgccaacaacacgacgctcacgataaacgcccgcgccgcctacacctcgatactcaaaaccaacaccgaatcgtacactttacactacatatacccgatactctacaccacgcacgacatccacaaccccttccaaataatctacgccgtcacgatattataatccaaaaaaacgatcacctaccacataaacaacccgcacgccaaaatc

SEQ ID NO: 117 - DNA, 649 bp, Artificial Sequence
  chemically treated genomic DNA (Homo sapiens) CpG-island No: 117
cgagtttataaggtttacggtaataagaagtttatttatttgaggttacgcgaatcgttcgcgaagagggttttgggattcgtagttatagatcgtgggacgggtttttttttgagggcgagagtttaggcgttatttagaaagtggagaacgagatcggtcgtcgtgaggttaggtaaggagcgggcgcggtttttcgagattgcgagaacggtttaaatgtttttaggtgtttttataaattttcggcgcggatcgagaaattgaggttcgtagatcgaaggtattgcgatttaggttggggtttcgagtgtttttttgcggattagaagtcgggaaaagacgtaggggcgtagttttaggttcgcgtgtacggagtttaagtcggtcgttcgggttttcgtttttatattgatttttttgtcggagtcgggaacgtttgtttttaggagcgtcgcgtagcgtttagagatcgattatatcgcgtagttacgtttttagcgtgcgcgcggtcgtcgtgtacgattcggcgtatgttttcggtacgttttacgcgttttttttatttaggtcgcgtttgcgttgtatgtcgtgtggtcgttatttcgtaggttttttcggtttttgttggcgcggtagtgtcgcgcgg

SEQ ID NO: 118 - DNA, 649 bp, Artificial Sequence
  chemically treated genomic DNA (Homo sapiens) CpG-island No: 118
ccgcgcgacactaccgcgccaacaaaaaccgaaaaaacctacgaaataacgaccacacgacatacaacgcaaacgcgacctaaataaaaaaaacgcgtaaaacgtaccgaaaacatacgccgaatcgtacacgacgaccgcgcgcacgctaaaaacgtaactacgcgatataatcgatctctaaacgctacgcgacgctcctaaaaacaaacgttcccgactccgacaaaaaaatcaatataaaaacgaaaacccgaacgaccgacttaaactccgtacacgcgaacctaaaactacgcccctacgtcttttcccgacttctaatccgcaaaaaaacactcgaaaccccaacctaaatcgcaataccttcgatctacgaacctcaatttctcgatccgcgccgaaaatttataaaaacacctaaaaacatttaaaccgttctcgcaatctcgaaaaaccgcgcccgctccttacctaacctcacgacgaccgatctcgttctccactttctaaataacgcctaaactctcgccctcaaaaaaaaacccgtcccacgatctataactacgaatcccaaaaccctcttcgcgaacgattcgcgtaacctcaaataaataaacttcttattaccgtaaaccttataaactcg

SEQ ID NO: 119 - DNA, 649 bp, Artificial Sequence
  chemically treated genomic DNA (Homo sapiens) CpG-island No: 119
tcgcgcggtattgtcgcgttagtagggatcgggagagtttgcgaggtagcggttatacggtatatagcgtaggcgcggtttggatgggaggagcgcgtggagcgtgtcgggagtatgcgtcgggtcgtatacggcggtcgcgcgtacgttgggggcgtggttgcgcgatgtaatcggtttttggacgttgcgcggcgtttttaggagtaggcgttttcgatttcggtaagagggttagtgtggaggcgggagttcgggcggtcggtttgaatttcgtgtacgcgggtttggagttgcgtttttgcgttttttttcgatttttgattcgtagaggggtattcggagttttagtttgggtcgtagtgttttcggtttgcgggttttagtttttcggttcgcgtcgggggtttgtgggggtatttggagatatttgggtcgttttcgtagtttcgggaagtcgcgttcgttttttgtttggttttacggcggtcgatttcgttttttattttttaggtggcgtttggattttcgtttttagagggaggttcgttttacggtttgtggttacggattttaggatttttttcgcgggcgattcgcgtagttttaggtgggtgggttttttgttgtcgtgggttttgtgagttcg

SEQ ID NO: 120 - DNA, 649 bp, Artificial Sequence
  chemically treated genomic DNA (Homo sapiens) CpG-island No: 120
cgaactcacaaaacccacgacaacaaaaaacccacccacctaaaactacgcgaatcgcccgcgaaaaaaatcctaaaatccgtaaccacaaaccgtaaaacgaacctccctctaaaaacgaaaatccaaacgccacctaaaaaataaaaaacgaaatcgaccgccgtaaaaccaaacaaaaaacgaacgcgacttcccgaaactacgaaaacgacccaaatatctccaaatacccccacaaacccccgacgcgaaccgaaaaactaaaacccgcaaaccgaaaacactacgacccaaactaaaactccgaatacccctctacgaatcaaaaatcgaaaaaaaacgcaaaaacgcaactccaaacccgcgtacacgaaattcaaaccgaccgcccgaactcccgcctccacactaaccctcttaccgaaatcgaaaacgcctactcctaaaaacgccgcgcaacgtccaaaaaccgattacatcgcgcaaccacgcccccaacgtacgcgcgaccgccgtatacgacccgacgcatactcccgacacgctccacgcgctcctcccatccaaaccgcgcctacgctatataccgtataaccgctacctcgcaaactctcccgatccctactaacgcgacaataccgcgcga

SEQ ID NO: 121 - DNA, 746 bp, Artificial Sequence
  chemically treated genomic DNA (Homo sapiens) CpG-island No: 121
agcgggcgcggtttttcgagattgcgagaacggtttaaatgtttttaggtgtttttataaattttcggcgcggatcgagaaattgaggttcgtagatcgaaggtattgcgatttaggttggggtttcgagtgtttttttgcggattagaagtcgggaaaagacgtaggggcgtagttttaggttcgcgtgtacggagtttaagtcggtcgttcgggttttcgtttttatattgatttttttgtcggagtcgggaacgtttgtttttaggagcgtcgcgtagcgtttagagatcgattatatcgcgtagttacgtttttagcgtgcgcgcggtcgtcgtgtacgattcggcgtatgttttcggtacgttttacgcgttttttttatttaggtcgcgtttgcgttgtatgtcgtgtggtcgttatttcgtaggttttttcggtttttgttggcgcggtagtgtcgcgcggtgggtgatgggagagcgcgtttatttttacgtcgcgttaagtgttacgggattaggtggggtcgcgtgtataggcgcgagacggtcgggttaaagttgttttttatgatttttagcggacggtgttcggcggttttttagattcgggaaatttgtattcggttgtggcgtagatcgaggggtcgatgttgttttagttcgtcgttattgttttggcgttagttagatattggggtgttgttgggcgtcgagagggttgttgcggggtcgggttaagtt

SEQ ID NO: 122 - DNA, 746 bp, Artificial Sequence
  chemically treated genomic DNA (Homo sapiens) CpG-island No: 122
aacttaacccgaccccgcaacaaccctctcgacgcccaacaacaccccaatatctaactaacgccaaaacaataacgacgaactaaaacaacatcgacccctcgatctacgccacaaccgaatacaaatttcccgaatctaaaaaaccgccgaacaccgtccgctaaaaatcataaaaaacaactttaacccgaccgtctcgcgcctatacacgcgaccccacctaatcccgtaacacttaacgcgacgtaaaaataaacgcgctctcccatcacccaccgcgcgacactaccgcgccaacaaaaaccgaaaaaacctacgaaataacgaccacacgacatacaacgcaaacgcgacctaaataaaaaaaacgcgtaaaacgtaccgaaaacatacgccgaatcgtacacgacgaccgcgcgcacgctaaaaacgtaactacgcgatataatcgatctctaaacgctacgcgacgctcctaaaaacaaacgttcccgactccgacaaaaaaatcaatataaaaacgaaaacccgaacgaccgacttaaactccgtacacgcgaacctaaaactacgcccctacgtcttttcccgacttctaatccgcaaaaaaacactcgaaaccccaacctaaatcgcaataccttcgatctacgaacctcaatttctcgatccgcgccgaaaatttataaaaacacctaaaaacatttaaaccgttctcgcaatctcgaaaaaccgcgcccgct

SEQ ID NO: 123 - DNA, 746 bp, Artificial Sequence
  chemically treated genomic DNA (Homo sapiens) CpG-island No: 123
ggtttagttcggtttcgtagtagttttttcgacgtttagtagtattttagtgtttggttgacgttagggtagtaacggcgggttgaagtagtatcggtttttcggtttacgttatagtcgggtgtagatttttcggatttgagggatcgtcgggtatcgttcgttggggattatgaggggtagttttggttcgatcgtttcgcgtttgtatacgcggttttatttgatttcgtggtatttggcgcggcgtgggaatgggcgcgtttttttattatttatcgcgcggtattgtcgcgttagtagggatcgggagagtttgcgaggtagcggttatacggtatatagcgtaggcgcggtttggatgggaggagcgcgtggagcgtgtcgggagtatgcgtcgggtcgtatacggcggtcgcgcgtacgttgggggcgtggttgcgcgatgtaatcggtttttggacgttgcgcggcgtttttaggagtaggcgttttcgatttcggtaagagggttagtgtggaggcgggagttcgggcggtcggtttgaatttcgtgtacgcgggtttggagttgcgtttttgcgttttttttcgatttttgattcgtagaggggtattcggagttttagtttgggtcgtagtgttttcggtttgcgggttttagtttttcggttcgcgtcgggggtttgtgggggtatttggagatatttgggtcgttttcgtagtttcgggaagtcgcgttcgtt

SEQ ID NO: 124 - DNA, 746 bp, Artificial Sequence
  chemically treated genomic DNA (Homo sapiens) CpG-island No: 124
aacgaacgcgacttcccgaaactacgaaaacgacccaaatatctccaaatacccccacaaacccccgacgcgaaccgaaaaactaaaacccgcaaaccgaaaacactacgacccaaactaaaactccgaatacccctctacgaatcaaaaatcgaaaaaaaacgcaaaaacgcaactccaaacccgcgtacacgaaattcaaaccgaccgcccgaactcccgcctccacactaaccctcttaccgaaatcgaaaacgcctactcctaaaaacgccgcgcaacgtccaaaaaccgattacatcgcgcaaccacgcccccaacgtacgcgcgaccgccgtatacgacccgacgcatactcccgacacgctccacgcgctcctcccatccaaaccgcgcctacgctatataccgtataaccgctacctcgcaaactctcccgatccctactaacgcgacaataccgcgcgataaataataaaaaaacgcgcccattcccacgccgcgccaaataccacgaaatcaaataaaaccgcgtatacaaacgcgaaacgatcgaaccaaaactacccctcataatccccaacgaacgatacccgacgatccctcaaatccgaaaaatctacacccgactataacgtaaaccgaaaaaccgatactacttcaacccgccgttactaccctaacgtcaaccaaacactaaaatactactaaacgtcgaaaaaactactacgaaaccgaactaaacc

SEQ ID NO: 125 - DNA, 539 bp, Artificial Sequence
  chemically treated genomic DNA (Homo sapiens) CpG-island No: 125
ttatcgcgcgggtgtggaggtgcggtcggtagggggagcgaggaggaagggaatcgcggtcgggttaggtgagggagggaggaatatttgtcgcgggtcgtgttgaggcgttgcgttcgcgtgcggaattcgcgtgtgtcgggttagggttattcgacgggcgcgtttttttcgggttgcgggagggtacgacgggtggggtggcggtaggtgaagaggagtgtgggcgggtggcggggtggcggggcggcggagcgcggcggggcggtgttttaggcgggagggagggtcggaggagttttattttgttgcgcgatggaggcggtggaggcggcggtttcggttggaggttgggacggtttcgcgtttcgagggttttcgggtttttttagtcgagggtttttggagggttttagcgttgagtaacggggttcgggggttcgaaattaagcgagtgagtataggtagtcggtggggtagggtcggttaatagagtcggttgggtggggttttttattttttttcgtcgtttttttggt

SEQ ID NO: 126 - DNA, 539 bp, Artificial Sequence
  chemically treated genomic DNA (Homo sapiens) CpG-island No: 126
accaaaaaaacgacgaaaaaaaataaaaaaccccacccaaccgactctattaaccgaccctaccccaccgactacctatactcactcgcttaatttcgaacccccgaaccccgttactcaacgctaaaaccctccaaaaaccctcgactaaaaaaacccgaaaaccctcgaaacgcgaaaccgtcccaacctccaaccgaaaccgccgcctccaccgcctccatcgcgcaacaaaataaaactcctccgaccctccctcccgcctaaaacaccgccccgccgcgctccgccgccccgccaccccgccacccgcccacactcctcttcacctaccgccaccccacccgtcgtaccctcccgcaacccgaaaaaaacgcgcccgtcgaataaccctaacccgacacacgcgaattccgcacgcgaacgcaacgcctcaacacgacccgcgacaaatattcctccctccctcacctaacccgaccgcgattcccttcctcctcgctccccctaccgaccgcacctccacacccgcgcgataa

SEQ ID NO: 127 - DNA, 539 bp, Artificial Sequence
  chemically treated genomic DNA (Homo sapiens) CpG-island No: 127
attagaagggcgacgggaagaggtgaggggttttatttagtcggttttgttggtcgattttattttatcggttgtttatatttattcgtttgatttcggattttcggatttcgttgtttaacgttgggattttttaggagttttcggttaaaggggttcggaagttttcgaagcgcgaggtcgttttagtttttagtcggagtcgtcgtttttatcgtttttatcgcgtagtaggatagggttttttcgattttttttttcgtttagggtatcgtttcgtcgcgtttcgtcgtttcgttatttcgttattcgtttatatttttttttatttgtcgttattttattcgtcgtgttttttcgtagttcggagggagcgcgttcgtcggatggttttagttcggtatacgcgggtttcgtacgcgaacgtagcgttttagtacggttcgcggtaagtgttttttttttttttatttggttcggtcgcggtttttttttttttcgttttttttgtcggtcgtatttttatattcgcgcgatag

SEQ ID NO: 128 - DNA, 539 bp, Artificial Sequence
  chemically treated genomic DNA (Homo sapiens) CpG-island No: 128
ctatcgcgcgaatataaaaatacgaccgacaaaaaaaacgaaaaaaaaaaaaaccgcgaccgaaccaaataaaaaaaaaaaaaacacttaccgcgaaccgtactaaaacgctacgttcgcgtacgaaacccgcgtataccgaactaaaaccatccgacgaacgcgctccctccgaactacgaaaaaacacgacgaataaaataacgacaaataaaaaaaaatataaacgaataacgaaataacgaaacgacgaaacgcgacgaaacgataccctaaacgaaaaaaaaaatcgaaaaaaccctatcctactacgcgataaaaacgataaaaacgacgactccgactaaaaactaaaacgacctcgcgcttcgaaaacttccgaacccctttaaccgaaaactcctaaaaaatcccaacgttaaacaacgaaatccgaaaatccgaaatcaaacgaataaatataaacaaccgataaaataaaatcgaccaacaaaaccgactaaataaaacccctcacctcttcccgtcgcccttctaat

SEQ ID NO: 129 - DNA, 1171 bp, Artificial Sequence
  chemically treated genomic DNA (Homo sapiens) CpG-island No: 129
tcggtgagtcggttcgggcggtcggggggtttcgggtcgagcgagtcgcggcgggcgggttgggggtcggggagggggaaggggcgggggaggggcgagggtcgggggagggatttagtttattgttttcgcgcgggggtgggggggtttcgggcggggcggggcggggcgttttttcggggtcggtttgcggtgtggggttgtacggttcggggcgtacgtagcgcggcgttcgttattcggttcgcggcgcggggtagcgtttagtttggtggcgggggcggcggcggcggttcgcgggttatgattttcgtcgtgtttagttcgtggtttacgtagttttcgtatttttgcgacgttgtagtttttacggttagtagtttgagtagtttgggggtcgcggggggtttttcgggcgtcgcgtcgttcggcgtcgattcgtacggttcgcgcgagttttcgtcgtcgtcgtcgcgttacgattcgtgcgtcgtcgtcgttttcggcgtttcgggttcgtcgtcgtcgtcgtacgtttattcgtttgcgtcggtcgtcggggtcgttattagcgtcgtcgtcgagttcgagggtttcggggttagttgcgcggtcgtagttaaggcgtcggtgaagaagaacgcgaaggtggtcggtgtgagcgtgtagttagagatgaaggcgttgtgggacgagtttaattagttgggtatcgagatgatcgttattaaggtcggtaggttagggcgtttttttttacgtcgcgattttttttacgtgttgtcgttagggttgcgggttttcgtttgattcgcgcgagcggggtcgaaagtcgggtcgggggcgcggtttggttatttgcgggtttttttgggtttcgttgtttttttcgttgttcgtcgtttcggtttcggcgatagtcgttcggcgttttttttttaatatttatttttcgtcggggcgggaggagacggcgcgggtcgtacgggaacggcgaggagtttcgcgggattcgttcgttcgtttcgtagttttaggacgtcgcgcggtttagaaatcggttcggtttggggcgtattcggttgggggtaggtagcggcgtttagggggttttatcgttcggtcgatttttagtaaattttattttaagaaaattttggtttagttttgg

SEQ ID NO: 130 - DNA, 1171 bp, Artificial Sequence
  chemically treated genomic DNA (Homo sapiens) CpG-island No: 130
ccaaaactaaaccaaaattttcttaaaataaaatttactaaaaatcgaccgaacgataaaaccccctaaacgccgctacctacccccaaccgaatacgccccaaaccgaaccgatttctaaaccgcgcgacgtcctaaaactacgaaacgaacgaacgaatcccgcgaaactcctcgccgttcccgtacgacccgcgccgtctcctcccgccccgacgaaaaataaatattaaaaaaaaaacgccgaacgactatcgccgaaaccgaaacgacgaacaacgaaaaaaacaacgaaacccaaaaaaacccgcaaataaccaaaccgcgcccccgacccgactttcgaccccgctcgcgcgaatcaaacgaaaacccgcaaccctaacgacaacacgtaaaaaaaatcgcgacgtaaaaaaaaacgccctaacctaccgaccttaataacgatcatctcgatacccaactaattaaactcgtcccacaacgccttcatctctaactacacgctcacaccgaccaccttcgcgttcttcttcaccgacgccttaactacgaccgcgcaactaaccccgaaaccctcgaactcgacgacgacgctaataacgaccccgacgaccgacgcaaacgaataaacgtacgacgacgacgacgaacccgaaacgccgaaaacgacgacgacgcacgaatcgtaacgcgacgacgacgacgaaaactcgcgcgaaccgtacgaatcgacgccgaacgacgcgacgcccgaaaaaccccccgcgacccccaaactactcaaactactaaccgtaaaaactacaacgtcgcaaaaatacgaaaactacgtaaaccacgaactaaacacgacgaaaatcataacccgcgaaccgccgccgccgcccccgccaccaaactaaacgctaccccgcgccgcgaaccgaataacgaacgccgcgctacgtacgccccgaaccgtacaaccccacaccgcaaaccgaccccgaaaaaacgccccgccccgccccgcccgaaacccccccacccccgcgcgaaaacaataaactaaatccctcccccgaccctcgcccctcccccgccccttccccctccccgacccccaacccgcccgccgcgactcgctcgacccgaaaccccccgaccgcccgaaccgactcaccga

SEQ ID NO: 131 - DNA, 1171 bp, Artificial Sequence
  chemically treated genomic DNA (Homo sapiens) CpG-island No: 131
ttagaattgaattagagtttttttgaggtgggatttattaggagtcggtcgggcggtgaggttttttggacgtcgttgtttgtttttagtcgggtgcgttttaagtcgggtcggtttttgggtcgcgcggcgttttggggttgcggggcgggcgggcgagtttcgcggggtttttcgtcgttttcgtgcggttcgcgtcgttttttttcgtttcggcggaggataggtgttaggaggggagcgtcgggcggttgtcgtcggagtcgggacggcgaatagcgaaggaggtagcggggtttagaggggttcgtaggtggttaggtcgcgttttcgattcggttttcggtttcgttcgcgcggattaggcggaggttcgtagttttggcggtagtacgtggggagggtcgcggcgtggggaggggcgttttgatttgtcggttttggtgacgattatttcggtgtttagttggttgaattcgttttatagcgtttttatttttagttgtacgtttatatcggttattttcgcgtttttttttatcggcgttttggttgcggtcgcgtagttggtttcggggttttcgggttcggcggcggcgttggtggcggtttcggcggtcggcgtaaacgggtaggcgtgcggcggcggcggcgggttcggggcgtcgggggcggcggcggcgtacgggtcgtagcgcggcggcggcggcgggggttcgcgcgggtcgtacgggtcggcgtcgggcgacgcggcgttcgggaagtttttcgcggtttttaggttgtttaggttgttggtcgtgaaggttgtaacgtcgtagaaatgcgagagttgcgtgagttacgggttggatacggcggagattatgattcgcgggtcgtcgtcgtcgttttcgttattaagttgagcgttgtttcgcgtcgcgggtcgagtggcgggcgtcgcgttgcgtgcgtttcgggtcgtgtagttttatatcgtaggtcggtttcgaggaggcgtttcgtttcgtttcgttcggggtttttttattttcgcgcggagataatggattagatttttttttcggttttcgtttttttttcgtttttttttttttttcggtttttagttcgttcgtcgcggttcgttcggttcggggtttttcgatcgttcggatcggtttatcgg

SEQ ID NO: 132 - DNA, 1171 bp, Artificial Sequence
  chemically treated genomic DNA (Homo sapiens) CpG-island No: 132
ccgataaaccgatccgaacgatcgaaaaaccccgaaccgaacgaaccgcgacgaacgaactaaaaaccgaaaaaaaaaaaaaaacgaaaaaaaaacgaaaaccgaaaaaaaaatctaatccattatctccgcgcgaaaataaaaaaaccccgaacgaaacgaaacgaaacgcctcctcgaaaccgacctacgatataaaactacacgacccgaaacgcacgcaacgcgacgcccgccactcgacccgcgacgcgaaacaacgctcaacttaataacgaaaacgacgacgacgacccgcgaatcataatctccgccgtatccaacccgtaactcacgcaactctcgcatttctacgacgttacaaccttcacgaccaacaacctaaacaacctaaaaaccgcgaaaaacttcccgaacgccgcgtcgcccgacgccgacccgtacgacccgcgcgaacccccgccgccgccgccgcgctacgacccgtacgccgccgccgcccccgacgccccgaacccgccgccgccgccgcacgcctacccgtttacgccgaccgccgaaaccgccaccaacgccgccgccgaacccgaaaaccccgaaaccaactacgcgaccgcaaccaaaacgccgataaaaaaaaacgcgaaaataaccgatataaacgtacaactaaaaataaaaacgctataaaacgaattcaaccaactaaacaccgaaataatcgtcaccaaaaccgacaaatcaaaacgcccctccccacgccgcgaccctccccacgtactaccgccaaaactacgaacctccgcctaatccgcgcgaacgaaaccgaaaaccgaatcgaaaacgcgacctaaccacctacgaacccctctaaaccccgctacctccttcgctattcgccgtcccgactccgacgacaaccgcccgacgctcccctcctaacacctatcctccgccgaaacgaaaaaaaacgacgcgaaccgcacgaaaacgacgaaaaaccccgcgaaactcgcccgcccgccccgcaaccccaaaacgccgcgcgacccaaaaaccgacccgacttaaaacgcacccgactaaaaacaaacaacgacgtccaaaaaacctcaccgcccgaccgactcctaataaatcccacctcaaaaaaactctaattcaattctaa

SEQ ID NO: 133 - DNA, 567 bp, Artificial Sequence
  chemically treated genomic DNA (Homo sapiens) CpG-island No: 133
gtgagcgtcgggcgtttggcgtaggcgtcgttttgattcgtttttcgttcgtaggtttcggaattatcggttcggcgtattgtcgtttatgagcgttttcgcgcgttcgcggaatttcgtggttttttcgacgtagtttagcggtacggagaaaggtagggtcggggtcgtgggattcgggtttcggttttgtgcgcgttttatttcgggtcggcggtttcgttcgatttcgtttgcgttttcggggcgttttaggttttcgcgtcggttgtataacggtcgcggcggcgggtaagcgcgtattcgttcgttcggttcgacggttgcgtttcgttcgtcgtcgtcgtcgttcgtagaggggcgcgggtttcggggagggttcggggcgtcggcgatttggggtttcgggtacgttggtatcgattggtcggggaatatcgagggcggttaagagtttttttttcgttagggtttcgtatggggcgtcggagtttttcggcggtttcggtcggtcgcgtttatttttcggtttttttcgtagacgcggttgaggttcggcgagaattt

SEQ ID NO: 134 - DNA, 567 bp, Artificial Sequence
  chemically treated genomic DNA (Homo sapiens) CpG-island No: 134
aaattctcgccgaacctcaaccgcgtctacgaaaaaaaccgaaaaataaacgcgaccgaccgaaaccgccgaaaaactccgacgccccatacgaaaccctaacgaaaaaaaaactcttaaccgccctcgatattccccgaccaatcgataccaacgtacccgaaaccccaaatcgccgacgccccgaaccctccccgaaacccgcgcccctctacgaacgacgacgacgacgaacgaaacgcaaccgtcgaaccgaacgaacgaatacgcgcttacccgccgccgcgaccgttatacaaccgacgcgaaaacctaaaacgccccgaaaacgcaaacgaaatcgaacgaaaccgccgacccgaaataaaacgcgcacaaaaccgaaacccgaatcccacgaccccgaccctacctttctccgtaccgctaaactacgtcgaaaaaaccacgaaattccgcgaacgcgcgaaaacgctcataaacgacaatacgccgaaccgataattccgaaacctacgaacgaaaaacgaatcaaaacgacgcctacgccaaacgcccgacgctcac

SEQ ID NO: 135 - DNA, 567 bp, Artificial Sequence
  chemically treated genomic DNA (Homo sapiens) CpG-island No: 135
gaattttcgtcgggttttagtcgcgtttgcggagagggtcgaggagtgagcgcggtcggtcggggtcgtcgaggagtttcgacgttttatgcgaggttttggcggagagaaggtttttggtcgttttcggtgtttttcgattagtcggtgttagcgtgttcgagattttaagtcgtcggcgtttcgagtttttttcggggttcgcgtttttttgcgggcggcggcggcggcgggcggggcgtagtcgtcgggtcgggcgggcgagtgcgcgtttgttcgtcgtcgcggtcgttgtgtaatcggcgcgaaagtttggagcgtttcgggggcgtaggcgaggtcgggcgaggtcgtcggttcggggtagagcgcgtatagggtcggaattcggattttacgatttcggttttattttttttcgtgtcgttgggttgcgtcggggaagttacggggtttcgcgagcgcgcgaaggcgtttatgagcggtagtgcgtcgggtcggtggtttcggggtttgcgggcgggaggcggattagggcggcgtttgcgttaggcgttcggcgtttat

SEQ ID NO: 136 - DNA, 567 bp, Artificial Sequence
  chemically treated genomic DNA (Homo sapiens) CpG-island No: 136
ataaacgccgaacgcctaacgcaaacgccgccctaatccgcctcccgcccgcaaaccccgaaaccaccgacccgacgcactaccgctcataaacgccttcgcgcgctcgcgaaaccccgtaacttccccgacgcaacccaacgacacgaaaaaaaataaaaccgaaatcgtaaaatccgaattccgaccctatacgcgctctaccccgaaccgacgacctcgcccgacctcgcctacgcccccgaaacgctccaaactttcgcgccgattacacaacgaccgcgacgacgaacaaacgcgcactcgcccgcccgacccgacgactacgccccgcccgccgccgccgccgcccgcaaaaaaacgcgaaccccgaaaaaaactcgaaacgccgacgacttaaaatctcgaacacgctaacaccgactaatcgaaaaacaccgaaaacgaccaaaaaccttctctccgccaaaacctcgcataaaacgtcgaaactcctcgacgaccccgaccgaccgcgctcactcctcgaccctctccgcaaacgcgactaaaacccgacgaaaattc

SEQ ID NO: 137 - DNA, 860 bp, Artificial Sequence
  chemically treated genomic DNA (Homo sapiens) CpG-island No: 137
ttatcggacggatggttcgaggatcggtatggattcgggttttagcgagggcggggggagcgtaaggttgggtttgggttgcggtatcggggaggtggcggggaggaggtcggtaggaatagtcgtgtagggcgggggcggcgcgggtttggtcgggtgatttcgggcgcggttagggttgtaggaggcgagggcgtcgtttcgaggtcgtggtttcgggtttatggtgggggatttgggttttcgttttttcgggtcgttttgggtcgcgcgtgggcgcggcgggcgtcgattggttgtcgggcgcgcgggcggagcgggcggcggcggcggcggcgcggaggggtcgtttatttcgtagttcggtttcggttttcgtcgtttgtcgtcgcgtttcgttcgcgagttcgtttcgtacgtttttcgtcggcggttattatgagtataggtttgcggtataagagtaagttggcgattttaggtgagtttagcgtttgttcgcgtgttcgcgcgcgtttttgttttcgtcgttcgcgcgttttttatcgtgttttttcgtttttttttcgttcgtcggttcggattcgttcggaatcggattcggattcgatttcgatttcgatttcgtagaggataagtaggtacgtgcgtagcgtcgttttttcgtcgggagattcggtcggttgttatttattgtgatattagcgttttgggcgtttaggcgcgatttcgttttcgtcggtttttatttagttttgtcgcgattatcgattgttagtcgggtagtgtcgtcgcgtttggggttttagaggagaggagtgggggttttggttttcggattcgtatagtagggattttgt

SEQ ID NO: 138 - DNA, 860 bp, Artificial Sequence
  chemically treated genomic DNA (Homo sapiens) CpG-island No: 138
acaaaatccctactatacgaatccgaaaaccaaaacccccactcctctcctctaaaaccccaaacgcgacgacactacccgactaacaatcgataatcgcgacaaaactaaataaaaaccgacgaaaacgaaatcgcgcctaaacgcccaaaacgctaatatcacaataaataacaaccgaccgaatctcccgacgaaaaaacgacgctacgcacgtacctacttatcctctacgaaatcgaaatcgaaatcgaatccgaatccgattccgaacgaatccgaaccgacgaacgaaaaaaaaacgaaaaaacacgataaaaaacgcgcgaacgacgaaaacaaaaacgcgcgcgaacacgcgaacaaacgctaaactcacctaaaatcgccaacttactcttataccgcaaacctatactcataataaccgccgacgaaaaacgtacgaaacgaactcgcgaacgaaacgcgacgacaaacgacgaaaaccgaaaccgaactacgaaataaacgacccctccgcgccgccgccgccgccgcccgctccgcccgcgcgcccgacaaccaatcgacgcccgccgcgcccacgcgcgacccaaaacgacccgaaaaaacgaaaacccaaatcccccaccataaacccgaaaccacgacctcgaaacgacgccctcgcctcctacaaccctaaccgcgcccgaaatcacccgaccaaacccgcgccgcccccgccctacacgactattcctaccgacctcctccccgccacctccccgataccgcaacccaaacccaaccttacgctccccccgccctcgctaaaacccgaatccataccgatcctcgaaccatccgtccgataa

SEQ ID NO: 139 - DNA, 860 bp, Artificial Sequence
  chemically treated genomic DNA (Homo sapiens) CpG-island No: 139
gtagggtttttgttgtgcgggttcggggattagggtttttattttttttttttgaagttttaggcgcggcggtattgttcggttgataatcggtgatcgcgatagggttgggtgagggtcggcgggggcggggtcgcgtttgggcgtttaaggcgttagtgttataatgggtgatagtcggtcgggtttttcggcgggggagcggcgttgcgtacgtatttgtttgttttttgcggggtcggggtcggggtcgagttcgggttcggtttcgagcgggttcgggtcggcgggcgggggagagacggagagatacggtgagaggcgcgcgggcggcggggataaaggcgcgcgcgggtacgcgggtaggcgttgggtttatttggggtcgttagtttgtttttgtatcgtaggtttgtgtttatggtggtcgtcggcgggggacgtgcggggcgggttcgcgggcggggcgcgacgataagcggcggaggtcgaggtcgggttgcggggtgagcggttttttcgcgtcgtcgtcgtcgtcgttcgtttcgttcgcgcgttcggtagttaatcggcgttcgtcgcgtttacgcgcgatttagggcggttcgggggggcggggatttaggttttttattatggattcgagattacggtttcggggcgacgttttcgttttttatagttttggtcgcgttcggggttattcgattagattcgcgtcgttttcgttttgtacggttgtttttgtcggtttttttttcgttattttttcggtgtcgtagtttaggtttagttttacgtttttttcgttttcgttgggattcgggtttatgtcggttttcggattattcgttcggtgg

SEQ ID NO: 140 - DNA, 860 bp, Artificial Sequence
  chemically treated genomic DNA (Homo sapiens) CpG-island No: 140
ccaccgaacgaataatccgaaaaccgacataaacccgaatcccaacgaaaacgaaaaaaacgtaaaactaaacctaaactacgacaccgaaaaaataacgaaaaaaaaaccgacaaaaacaaccgtacaaaacgaaaacgacgcgaatctaatcgaataaccccgaacgcgaccaaaactataaaaaacgaaaacgtcgccccgaaaccgtaatctcgaatccataataaaaaacctaaatccccgcccccccgaaccgccctaaatcgcgcgtaaacgcgacgaacgccgattaactaccgaacgcgcgaacgaaacgaacgacgacgacgacgacgcgaaaaaaccgctcaccccgcaacccgacctcgacctccgccgcttatcgtcgcgccccgcccgcgaacccgccccgcacgtcccccgccgacgaccaccataaacacaaacctacgatacaaaaacaaactaacgaccccaaataaacccaacgcctacccgcgtacccgcgcgcgcctttatccccgccgcccgcgcgcctctcaccgtatctctccgtctctcccccgcccgccgacccgaacccgctcgaaaccgaacccgaactcgaccccgaccccgaccccgcaaaaaacaaacaaatacgtacgcaacgccgctcccccgccgaaaaacccgaccgactatcacccattataacactaacgccttaaacgcccaaacgcgaccccgcccccgccgaccctcacccaaccctatcgcgatcaccgattatcaaccgaacaataccgccgcgcctaaaacttcaaaaaaaaaaaataaaaaccctaatccccgaacccgcacaacaaaaaccctac

SEQ ID NO: 141 - DNA, 1449 bp, Artificial Sequence
  chemically treated genomic DNA (Homo sapiens) CpG-island No: 141
gtatatatttaatgtatgtatatacgtatatatatacgtatatacgtatgtatatacgcgtatatacgtaggtattatatatatatatattatatatatatattcgtacggacgcgtatatataaacgcgcgtacgtacgtacgtacgtacgggggaggttagttttaagtagggttggggaggggtgtagggcgcggcgtgtttgtgggtatttggggcgtcgagacgtcgtcgggaggttttcgggtaagtttgcgagaagacggcgggttttgaattgggcgggtattcgcgttgttgcgcgtgggtttcgggagcggttttcggcgttttttggcgggcggaagtcgcgtagtattttttgggggcgggacgcgcggtggttatcgattttcggttcgtttcggttcgcgtgtaggattcggtcgtttttttttgttgttttggagttcggattgaggtttcgggggcgcggtagggttttcggtttacgcgagttatggttcgatcgcgtttcggtttagttttgtttttcgtagtcgttttcgggtggtttcgttcgcggtttaatttttaggcgatcgtttttcggcgacggcgggcggggtcgtttttgtcgtttttcgtcgcgcgtttcgcgggcgtttgcgacgtttcgtttttggttcgggtgcgggagcggggtttgttcggattgcgacgtcgttatagtttggggttagttcgtttagttagggggatggttcggtcggtttcgggggtcgacgatttttcgggtaggcgacgtgttttgtttaggttttatttttcgcgttcgtaaaacggggtggataacgtagtttaaggtagagtcgcgttaaggtttttcgttgtcgtcgggttttggcggtttgatcgggtttggggttcgagcgtgttttcgggtttgggggggtcgtcgcgatggattcgttggtagcgttttaggatcgtttggtggagtagttgttgtcgtcgcggatttaggtttagaggcggtttaaggtgcgtgtgtggagagggcggaacgtgggtttgtgatttcgcgggtttcgggattcggtatggggttttcgttttcgcgcgttacggttcgttagcgtttaggtttagttttttttttcgtagcggtttcgtaggttcgcggttttacggtggggcgacgtgttttgtttaggttttattttacgcgattttaaaacgcggcggagaatgcggtcgtgggatttttttaggggttttaagggtttgcgggggttgggcgtttgggcgcgcgggcgggggaggttcggcgtcgcggtttataaataggcgttgtttcgttatcgtcgttgtcgtcgttttcgcggttggattcgggttaggtggggtttttcgttttttggtatttttcggaggggtgagtgtcgaggtttttagttttttcggtt

SEQ ID NO: 142 - DNA, 1449 bp, Artificial Sequence
  chemically treated genomic DNA (Homo sapiens) CpG-island No: 142
aaccgaaaaaactaaaaacctcgacactcacccctccgaaaaataccaaaaaacgaaaaaccccacctaacccgaatccaaccgcgaaaacgacgacaacgacgataacgaaacaacgcctatttataaaccgcgacgccgaacctcccccgcccgcgcgcccaaacgcccaacccccgcaaacccttaaaacccctaaaaaaatcccacgaccgcattctccgccgcgttttaaaatcgcgtaaaataaaacctaaacaaaacacgtcgccccaccgtaaaaccgcgaacctacgaaaccgctacgaaaaaaaaaactaaacctaaacgctaacgaaccgtaacgcgcgaaaacgaaaaccccataccgaatcccgaaacccgcgaaatcacaaacccacgttccgccctctccacacacgcaccttaaaccgcctctaaacctaaatccgcgacgacaacaactactccaccaaacgatcctaaaacgctaccaacgaatccatcgcgacgacccccccaaacccgaaaacacgctcgaaccccaaacccgatcaaaccgccaaaacccgacgacaacgaaaaaccttaacgcgactctaccttaaactacgttatccaccccgttttacgaacgcgaaaaataaaacctaaacaaaacacgtcgcctacccgaaaaatcgtcgacccccgaaaccgaccgaaccatccccctaactaaacgaactaaccccaaactataacgacgtcgcaatccgaacaaaccccgctcccgcacccgaaccaaaaacgaaacgtcgcaaacgcccgcgaaacgcgcgacgaaaaacgacaaaaacgaccccgcccgccgtcgccgaaaaacgatcgcctaaaaattaaaccgcgaacgaaaccacccgaaaacgactacgaaaaacaaaactaaaccgaaacgcgatcgaaccataactcgcgtaaaccgaaaaccctaccgcgcccccgaaacctcaatccgaactccaaaacaacaaaaaaaaacgaccgaatcctacacgcgaaccgaaacgaaccgaaaatcgataaccaccgcgcgtcccgcccccaaaaaatactacgcgacttccgcccgccaaaaaacgccgaaaaccgctcccgaaacccacgcgcaacaacgcgaatacccgcccaattcaaaacccgccgtcttctcgcaaacttacccgaaaacctcccgacgacgtctcgacgccccaaatacccacaaacacgccgcgccctacacccctccccaaccctacttaaaactaacctcccccgtacgtacgtacgtacgtacgcgcgtttatatatacgcgtccgtacgaatatatatatataatatatatatatataatacctacgtatatacgcgtatatacatacgtatatacgtatatatatacgtatatacatacattaaatatatac

SEQ ID NO: 143 - DNA, 1449 bp, Artificial Sequence
  chemically treated genomic DNA (Homo sapiens) CpG-island No: 143
agtcggagaagttgggggtttcgatatttattttttcggagagtgttagggggcgggaggttttatttggttcggatttagtcgcgggggcggcggtagcggcggtggcggagtagcgtttatttatagatcgcggcgtcgagtttttttcgttcgcgcgtttaggcgtttagttttcgtagatttttggggtttttggaggggttttacggtcgtatttttcgtcgcgttttggagtcgcgtgaggtgaggtttggatagggtacgtcgttttatcgtggggtcgcggatttgcgaggtcgttgcggagggaagggttgagtttaggcgttggcgggtcgtggcgcgcggggacggggattttatgtcgagtttcggagttcgcggggttatagatttacgtttcgttttttttatatacgtattttgagtcgtttttgggtttgggttcgcggcgatagtagttgttttattaggcggttttggggcgttgttagcgagtttatcgcggcgatttttttaggttcgggggtacgttcggattttaggttcggttaggtcgttagagttcggcgatagcgagggattttggcgcggttttgttttaggttgcgttgtttatttcgttttgcggacgcgggaagtgaggtttggatagggtacgtcgtttattcgggggatcgtcgattttcgaggtcgatcgagttatttttttgattgggcgaattggttttaagttgtggcggcgtcgtagttcgggtaggtttcgttttcgtattcgagttagaggcggggcgtcgtaggcgttcgcggagcgcgcggcggggggcggtagagacggtttcgttcgtcgtcgtcgggaaacggtcgtttggaaattgggtcgcgggcggagttattcgaaagcggttgcggagggtagggttgagtcgaggcgcggtcgggttatggttcgcgtggatcgggagttttgtcgcgttttcggggttttagttcgggttttaggatagtaggaggggacgatcgggttttgtacgcgggtcggggcgggtcgggagtcggtagttatcgcgcgtttcgtttttaagaggtgttgcgcggttttcgttcgttagagggcgtcggaggtcgttttcgggatttacgcgtaatagcgcgggtattcgtttagtttagggttcgtcgttttttcgtagatttgttcgaaaatttttcggcggcgtttcgacgttttaagtgtttatagatacgtcgcgttttgtatttttttttagttttgtttggggttgatttttttcgtgcgtgcgtgcgtgcgtgcgcgcgtttgtgtgtgcgcgttcgtgcgggtgtgtgtgtgtaatgtgtgtgtgtgtaatgtttgcgtgtgtgcgcgtgtatatatgcgtgtatgcgtgtgtgtgtacgtgtgtgtatgtattgggtatgtgt

SEQ ID NO: 144 - DNA, 1449 bp, Artificial Sequence
  chemically treated genomic DNA (Homo sapiens) CpG-island No: 144
acacatacccaatacatacacacacgtacacacacacgcatacacgcatatatacacgcgcacacacgcaaacattacacacacacacattacacacacacacccgcacgaacgcgcacacacaaacgcgcgcacgcacgcacgcacgcacgaaaaaaatcaaccccaaacaaaactaaaaaaaaatacaaaacgcgacgtatctataaacacttaaaacgtcgaaacgccgccgaaaaattttcgaacaaatctacgaaaaaacgacgaaccctaaactaaacgaatacccgcgctattacgcgtaaatcccgaaaacgacctccgacgccctctaacgaacgaaaaccgcgcaacacctcttaaaaacgaaacgcgcgataactaccgactcccgacccgccccgacccgcgtacaaaacccgatcgtcccctcctactatcctaaaacccgaactaaaaccccgaaaacgcgacaaaactcccgatccacgcgaaccataacccgaccgcgcctcgactcaaccctaccctccgcaaccgctttcgaataactccgcccgcgacccaatttccaaacgaccgtttcccgacgacgacgaacgaaaccgtctctaccgccccccgccgcgcgctccgcgaacgcctacgacgccccgcctctaactcgaatacgaaaacgaaacctacccgaactacgacgccgccacaacttaaaaccaattcgcccaatcaaaaaaataactcgatcgacctcgaaaatcgacgatcccccgaataaacgacgtaccctatccaaacctcacttcccgcgtccgcaaaacgaaataaacaacgcaacctaaaacaaaaccgcgccaaaatccctcgctatcgccgaactctaacgacctaaccgaacctaaaatccgaacgtacccccgaacctaaaaaaatcgccgcgataaactcgctaacaacgccccaaaaccgcctaataaaacaactactatcgccgcgaacccaaacccaaaaacgactcaaaatacgtatataaaaaaaacgaaacgtaaatctataaccccgcgaactccgaaactcgacataaaatccccgtccccgcgcgccacgacccgccaacgcctaaactcaacccttccctccgcaacgacctcgcaaatccgcgaccccacgataaaacgacgtaccctatccaaacctcacctcacgcgactccaaaacgcgacgaaaaatacgaccgtaaaacccctccaaaaaccccaaaaatctacgaaaactaaacgcctaaacgcgcgaacgaaaaaaactcgacgccgcgatctataaataaacgctactccgccaccgccgctaccgccgcccccgcgactaaatccgaaccaaataaaacctcccgccccctaacactctccgaaaaaataaatatcgaaacccccaacttctccgact

SEQ ID NO: 145 - DNA, 883 bp, Artificial Sequence
  chemically treated genomic DNA (Homo sapiens) CpG-island No: 145
tatcgggacgtcgggtattaggggttggatggagtcgggtcggtagtttgggtatttagagatgtcgtttaggtgttcgtcgatcgttcggtttattgcggcgttttttttgtagggtcgcgcggggcgttgagtttattgtttttgttgttggtttcgtcgagtcgttcggtcgtaggttgttcggcgttttgtagttgcgcggggacgttcgtggattgcgggcgtcgcgggttgatttgggtttcgttgtcgatcgttttttttgtcgatataatcgagttggtgttgatcggtaataatttgacggcgttgtcgtcggggttgttggacgcgttgttcgcgttgcgtatcgtatatttgggcgttaatttttggcgttgcgattgtcgttttgtgtcgttgcgcgtttggttggtcggtcgtttcgagcgtgcgttttatcgcgatttgcgttgcgtggcgtttttagcgttgcgcggtcgtttgttgttttatttggtcgaggacgagttgcgcgtcgtttgcgttttcggttcgttttgttggggggcgttggcggcgtagtttgcgttgttgggttttgggttgttgtacgcgttgttgttggtgttgttgttgtgtcgtttgcggaggttgcgggttcgggttcgcgttcgcgtcgtagttcggttgtcgttgatcgattcgttggtggtcgagcgagtcggaatcgacgagttttgaggagagaatcggtgcgttttgaggagagaatcggcgttgggtaatacgggtttgtaaattcgataggattttgttcgaggggttttcgcgttaatttggatcggttttcgtttttttcgttgtttaattttttagatttattttatttgtaggttta

SEQ ID NO: 146 - DNA, 883 bp, Artificial Sequence
  chemically treated genomic DNA (Homo sapiens) CpG-island No: 146
taaacctacaaataaaataaatctaaaaaattaaacaacgaaaaaaacgaaaaccgatccaaattaacgcgaaaacccctcgaacaaaatcctatcgaatttacaaacccgtattacccaacgccgattctctcctcaaaacgcaccgattctctcctcaaaactcgtcgattccgactcgctcgaccaccaacgaatcgatcaacgacaaccgaactacgacgcgaacgcgaacccgaacccgcaacctccgcaaacgacacaacaacaacaccaacaacaacgcgtacaacaacccaaaacccaacaacgcaaactacgccgccaacgccccccaacaaaacgaaccgaaaacgcaaacgacgcgcaactcgtcctcgaccaaataaaacaacaaacgaccgcgcaacgctaaaaacgccacgcaacgcaaatcgcgataaaacgcacgctcgaaacgaccgaccaaccaaacgcgcaacgacacaaaacgacaatcgcaacgccaaaaattaacgcccaaatatacgatacgcaacgcgaacaacgcgtccaacaaccccgacgacaacgccgtcaaattattaccgatcaacaccaactcgattatatcgacaaaaaaaacgatcgacaacgaaacccaaatcaacccgcgacgcccgcaatccacgaacgtccccgcgcaactacaaaacgccgaacaacctacgaccgaacgactcgacgaaaccaacaacaaaaacaataaactcaacgccccgcgcgaccctacaaaaaaaacgccgcaataaaccgaacgatcgacgaacacctaaacgacatctctaaatacccaaactaccgacccgactccatccaacccctaatacccgacgtcccgata

SEQ ID NO: 147 - DNA, 883 bp, Artificial Sequence
  chemically treated genomic DNA (Homo sapiens) CpG-island No: 147
tgggtttgtaggtggggtgggtttgagagattgggtagcggaggaggcggggatcggtttaggttggcgcgagggtttttcgggtagggttttgtcgagtttgtaggttcgtgttgtttagcgtcggttttttttttaggacgtatcggttttttttttaggattcgtcggtttcggttcgttcggttattagcgggtcggttagcgatagtcgggttgcggcgcgagcgcgggttcgggttcgtagttttcgtaggcggtatagtagtagtattagtagtaacgcgtgtagtagtttaaggtttagtagcgtaagttgcgtcgttagcgttttttagtagagcgggtcgggagcgtaagcggcgcgtagttcgttttcggttagatagggtagtaggcggtcgcgtagcgttgggggcgttacgtaacgtaggtcgcggtagggcgtacgttcggggcggtcggttagttaggcgcgtagcggtataaggcggtagtcgtagcgttaggggttggcgtttaggtgtgcggtgcgtagcgcgggtagcgcgtttagtagtttcggcggtagcgtcgttaggttgttgtcggttagtattagttcggttgtgtcgatagggaaggcggtcggtagcgaggtttaagttagttcgcggcgttcgtagtttacgagcgttttcgcgtagttatagggcgtcgggtaatttgcggtcgggcggttcggcggggttagtagtaggagtagtaagtttagcgtttcgcgcggttttgtaagggaagcgtcgtagtaagtcgagcggtcggcgggtatttgggcgatatttttgagtatttagattgtcggttcggttttatttagtttttgatgttcggcgtttcggta

SEQ ID NO: 148 - DNA, 883 bp, Artificial Sequence
  chemically treated genomic DNA (Homo sapiens) CpG-island No: 148
taccgaaacgccgaacatcaaaaactaaataaaaccgaaccgacaatctaaatactcaaaaatatcgcccaaatacccgccgaccgctcgacttactacgacgcttcccttacaaaaccgcgcgaaacgctaaacttactactcctactactaaccccgccgaaccgcccgaccgcaaattacccgacgccctataactacgcgaaaacgctcgtaaactacgaacgccgcgaactaacttaaacctcgctaccgaccgccttccctatcgacacaaccgaactaatactaaccgacaacaacctaacgacgctaccgccgaaactactaaacgcgctacccgcgctacgcaccgcacacctaaacgccaacccctaacgctacgactaccgccttataccgctacgcgcctaactaaccgaccgccccgaacgtacgccctaccgcgacctacgttacgtaacgcccccaacgctacgcgaccgcctactaccctatctaaccgaaaacgaactacgcgccgcttacgctcccgacccgctctactaaaaaacgctaacgacgcaacttacgctactaaaccttaaactactacacgcgttactactaatactactactataccgcctacgaaaactacgaacccgaacccgcgctcgcgccgcaacccgactatcgctaaccgacccgctaataaccgaacgaaccgaaaccgacgaatcctaaaaaaaaaaccgatacgtcctaaaaaaaaaaccgacgctaaacaacacgaacctacaaactcgacaaaaccctacccgaaaaaccctcgcgccaacctaaaccgatccccgcctcctccgctacccaatctctcaaacccaccccacctacaaaccca

SEQ ID NO: 149 - DNA, 2671 bp, Artificial Sequence
  chemically treated genomic DNA (Homo sapiens) CpG-island No: 149
gggcgttgtgggggcggtgaggacgttgtaggggcggtgaggacgttgtgggggcggtgaaggcgttgtggggatggtgaggacgttattcggggcggtgaggacgttgtggacggtgagaacgttgtggggatattgaggatgttgtgaggacgttgtgggggtagtgaggacgttgtggatcgtgaggacgttgtggggatggcgaagattttgtgggggcggtgaggattttgtggacggtgaggacgttgttggggtagtgaggacgttgtggatcgtgaggattttgtgggggcggtgaggattttgtggacgcggtgaggacgttgtgggggcggtgaggacgttgtggatagtgaggaggttgtggagataatggggacgttgtagataggacgttgtggaggcggtgagggcgttgtgggggcggtgaggacgttgtggatattgacgacgttggaggtaataatgaggatattggggataatgagtatattgtgggggcggtgagaacgttgtggatattgaggacgttgtgggggcggtgagggcgttgtggacgcggtgaggacgttgtgggggcggtgaggacgttgtggggatcgtgaggacgttgtcggggcggtgaggacgttgtggacgcggtgaggacgttgtggggacggtgaggacgttgtggggatcgtgaggacgttgtcggggtcgtgaggacgttgtggacgcggcgagggagttgttagggcggtgaggacgttgtggacgcggtgaggacgttgtggacgcggcgagggagttgtcggggcggtgaggacgttgtggacgcggtgagggcgttgtggggacggtgaggacgttgtggacgttgtcggggtagtgaggacgttgcggacgttgaggacgttgtgggggcgatgaggacgttgtcggggcggtgaggacgttgtcggggcggtgaggacgttgtggacgcggtgaggacgttgtggggacggtgaggacgttgtggggatcgtgaggacgttgtcggggtcgtgaggacgttgtcggggcggtgaggacgttgtcgggacggtgagggcgttgtggacgcggtgagggcgttgtgggggcggtgaggacgttgtggacgcgatgaggacgttgtggacgttgtgaggacgttgtgggggcggtgaggacgttgtggacgcggtgaggacgttgtggacgtcgtgaggacgttgtggggacggtgaggacgttgtggacgcggtgaggacgttgtggacgcggcgagggagttgttagggcggtgaggacgttgtggacgcggtgaggacgttgtggacgcggcgagggagttgtcggggcggtgaggacgttgtggacgcggtgaggatattgtggggacggtgaggacgttgtggacgcggtgaggacgttgtggacgtcgtgaggacgttgtgggggcggtgaggacgttgtcggggcggtgaggacgttgtgggggcggtgagggcgttgtggacgcggcgagggcgttgtcggggcggtgaggacgttgtggacgtcgtgaggacgttgtgggggcggtgaggacgttgtcggggcggtgaggacgttgtcggggcggtgagggcgttgtgggggcggtgaggacgttgtcggggcggtgagggcgttgcggacgttgaggacgttgtggacgtagtgaggatattgtggggatagtgaggacgttgtggacgtcgtgaggacgttgtcggggtggtgaggacgttgtgggggcggtgaggacgttgtcggggttgtgagggcgttgtggacgcggtgagggcgttgtggacgcggtgaggacgttgtgggggcggtgaggacgttgcggatattaaggacgttgtggacgcggtgacgatattgtggggacggtgaggacgttgtggacgtcgtgaggacgttgtcggggcggtgaggacgttgtcggggaggtgaggacgttgtgggggcggtgaggacgttgtgggggcggtgagggcgttgcggacgttgaggacgttgtggacgcggtgaggatattgtggggatagtgaggacgttgtggacgtcgtgaggatattgtcggggtggtgaggacgttgtggacgcggtgaggacgttgtcggggttgtgaggacgttgtgggggcggtgaggacgttgtgggggcggtgaggacgttgtcggggcggtgaggacgttttcggggcggtgagggcgttgtggattcgatgagggcgttgtgggggcggtgaggacgttgtggacgcggtgagggcgttgtaggggcgatgaggaggttgtggacgtcgtgaggacgttgtggacgcggtgaggacgttgtgggggcggtgaggacgttgtgggggcggtgaagatgttgtggacgcggtgagggcgttgtgggggcggtgaggacgttgtagatgttgacgttgtggatgttgtgggggtggcgagggttttttggacgcggtgaggacgttgtgggggcggtgaggacgttgtagatgttgacgttgtggatgttgtgggggtggcgagggtttcgtggacgcggtgagtacgttgtggatagtgagggtgttgtggggatagtgaggatgttttggggggtagtgagggcgttgcgcggatagtgagggtgttgtggg

SEQ ID NO: 150 - DNA, 2671 bp, Artificial Sequence
  chemically treated genomic DNA (Homo sapiens) CpG-island No: 150
cccacaacaccctcactatccgcgcaacgccctcactaccccccaaaacatcctcactatccccacaacaccctcactatccacaacgtactcaccgcgtccacgaaaccctcgccacccccacaacatccacaacgtcaacatctacaacgtcctcaccgcccccacaacgtcctcaccgcgtccaaaaaaccctcgccacccccacaacatccacaacgtcaacatctacaacgtcctcaccgcccccacaacgccctcaccgcgtccacaacatcttcaccgcccccacaacgtcctcaccgcccccacaacgtcctcaccgcgtccacaacgtcctcacgacgtccacaacctcctcatcgcccctacaacgccctcaccgcgtccacaacgtcctcaccgcccccacaacgccctcatcgaatccacaacgccctcaccgccccgaaaacgtcctcaccgccccgacaacgtcctcaccgcccccacaacgtcctcaccgcccccacaacgtcctcacaaccccgacaacgtcctcaccgcgtccacaacgtcctcaccaccccgacaatatcctcacgacgtccacaacgtcctcactatccccacaatatcctcaccgcgtccacaacgtcctcaacgtccgcaacgccctcaccgcccccacaacgtcctcaccgcccccacaacgtcctcacctccccgacaacgtcctcaccgccccgacaacgtcctcacgacgtccacaacgtcctcaccgtccccacaatatcgtcaccgcgtccacaacgtccttaatatccgcaacgtcctcaccgcccccacaacgtcctcaccgcgtccacaacgccctcaccgcgtccacaacgccctcacaaccccgacaacgtcctcaccgcccccacaacgtcctcaccaccccgacaacgtcctcacgacgtccacaacgtcctcactatccccacaatatcctcactacgtccacaacgtcctcaacgtccgcaacgccctcaccgccccgacaacgtcctcaccgcccccacaacgccctcaccgccccgacaacgtcctcaccgccccgacaacgtcctcaccgcccccacaacgtcctcacgacgtccacaacgtcctcaccgccccgacaacgccctcgccgcgtccacaacgccctcaccgcccccacaacgtcctcaccgccccgacaacgtcctcaccgcccccacaacgtcctcacgacgtccacaacgtcctcaccgcgtccacaacgtcctcaccgtccccacaatatcctcaccgcgtccacaacgtcctcaccgccccgacaactccctcgccgcgtccacaacgtcctcaccgcgtccacaacgtcctcaccgccctaacaactccctcgccgcgtccacaacgtcctcaccgcgtccacaacgtcctcaccgtccccacaacgtcctcacgacgtccacaacgtcctcaccgcgtccacaacgtcctcaccgcccccacaacgtcctcacaacgtccacaacgtcctcatcgcgtccacaacgtcctcaccgcccccacaacgccctcaccgcgtccacaacgccctcaccgtcccgacaacgtcctcaccgccccgacaacgtcctcacgaccccgacaacgtcctcacgatccccacaacgtcctcaccgtccccacaacgtcctcaccgcgtccacaacgtcctcaccgccccgacaacgtcctcaccgccccgacaacgtcctcatcgcccccacaacgtcctcaacgtccgcaacgtcctcactaccccgacaacgtccacaacgtcctcaccgtccccacaacgccctcaccgcgtccacaacgtcctcaccgccccgacaactccctcgccgcgtccacaacgtcctcaccgcgtccacaacgtcctcaccgccctaacaactccctcgccgcgtccacaacgtcctcacgaccccgacaacgtcctcacgatccccacaacgtcctcaccgtccccacaacgtcctcaccgcgtccacaacgtcctcaccgccccgacaacgtcctcacgatccccacaacgtcctcaccgcccccacaacgtcctcaccgcgtccacaacgccctcaccgcccccacaacgtcctcaatatccacaacgttctcaccgcccccacaatatactcattatccccaatatcctcattattacctccaacgtcgtcaatatccacaacgtcctcaccgcccccacaacgccctcaccgcctccacaacgtcctatctacaacgtccccattatctccacaacctcctcactatccacaacgtcctcaccgcccccacaacgtcctcaccgcgtccacaaaatcctcaccgcccccacaaaatcctcacgatccacaacgtcctcactaccccaacaacgtcctcaccgtccacaaaatcctcaccgcccccacaaaatcttcgccatccccacaacgtcctcacgatccacaacgtcctcactacccccacaacgtcctcacaacatcctcaatatccccacaacgttctcaccgtccacaacgtcctcaccgccccgaataacgtcctcaccatccccacaacgccttcaccgcccccacaacgtcctcaccgcccctacaacgtcctcaccgcccccacaacgccc

SEQ ID NO: 151 - DNA, 2671 bp, Artificial Sequence
  chemically treated genomic DNA (Homo sapiens) CpG-island No: 151
tttatagtatttttattgttcgcgtagcgtttttattgttttttagagtatttttattgtttttatagtatttttattgtttatagcgtatttatcgcgtttacggagttttcgttatttttatagtatttatagcgttaatatttgtagcgtttttatcgtttttatagcgtttttatcgcgtttaaagagttttcgttatttttatagtatttatagcgttaatatttgtagcgtttttatcgtttttatagcgtttttatcgcgtttatagtatttttatcgtttttatagcgtttttatcgtttttatagcgtttttatcgcgtttatagcgtttttacggcgtttatagtttttttatcgtttttatagcgtttttatcgcgtttatagcgtttttatcgtttttatagcgtttttatcgggtttatagcgtttttatcgtttcgagagcgtttttatcgtttcgatagcgtttttatcgtttttatagcgtttttatcgtttttatagcgtttttatagtttcgatagcgtttttatcgcgtttatagcgtttttattatttcgatagtgtttttacggcgtttatagcgtttttattgtttttatagtgtttttatcgcgtttatagcgtttttaacgttcgtagcgtttttatcgtttttatagcgtttttatcgtttttatagcgtttttattttttcgatagcgtttttatcgtttcgatagcgtttttacggcgtttatagcgtttttatcgtttttatagtgtcgttatcgcgtttatagcgtttttaatgttcgtagcgtttttatcgtttttatagcgtttttatcgcgtttatagcgtttttatcgcgtttatagcgtttttatagtttcgatagcgtttttatcgtttttatagcgtttttattatttcgatagcgtttttacggcgtttatagcgtttttattgtttttatagtgtttttattgcgtttatagcgtttttaacgttcgtagcgtttttatcgtttcgatagcgtttttatcgtttttatagcgtttttatcgtttcgatagcgtttttatcgtttcgatagcgtttttatcgtttttatagcgtttttacggcgtttatagcgtttttatcgtttcgatagcgttttcgtcgcgtttatagcgtttttatcgtttttatagcgtttttatcgtttcgatagcgtttttatcgtttttatagcgtttttacggcgtttatagcgtttttatcgcgtttatagcgtttttatcgtttttatagtgtttttatcgcgtttatagcgtttttatcgtttcgatagttttttcgtcgcgtttatagcgtttttatcgcgtttatagcgtttttatcgttttgatagttttttcgtcgcgtttatagcgtttttatcgcgtttatagcgtttttatcgtttttatagcgtttttacggcgtttatagcgtttttatcgcgtttatagcgtttttatcgtttttatagcgtttttatagcgtttatagcgtttttatcgcgtttatagcgtttttatcgtttttatagcgtttttatcgcgtttatagcgtttttatcgtttcgatagcgtttttatcgtttcgatagcgtttttacggtttcgatagcgtttttacggtttttatagcgtttttatcgtttttatagcgtttttatcgcgtttatagcgtttttatcgtttcgatagcgtttttatcgtttcgatagcgtttttatcgtttttatagcgtttttaacgttcgtagcgtttttattgtttcgatagcgtttatagcgtttttatcgtttttatagcgtttttatcgcgtttatagcgtttttatcgtttcgatagttttttcgtcgcgtttatagcgtttttatcgcgtttatagcgtttttatcgttttgatagttttttcgtcgcgtttatagcgtttttacggtttcgatagcgtttttacggtttttatagcgtttttatcgtttttatagcgtttttatcgcgtttatagcgtttttatcgtttcgatagcgtttttacggtttttatagcgtttttatcgtttttatagcgtttttatcgcgtttatagcgtttttatcgtttttatagcgtttttagtgtttatagcgtttttatcgtttttatagtgtatttattgtttttaatgtttttattgttatttttagcgtcgttagtgtttatagcgtttttatcgtttttatagcgtttttatcgtttttatagcgttttgtttatagcgtttttattgtttttatagtttttttattgtttatagcgtttttatcgtttttatagcgtttttatcgcgtttatagagtttttatcgtttttatagagtttttacggtttatagcgtttttattgttttaatagcgtttttatcgtttatagagtttttatcgtttttatagagttttcgttatttttatagcgtttttacggtttatagcgtttttattgtttttatagcgtttttatagtatttttagtgtttttatagcgtttttatcgtttatagcgtttttatcgtttcggatagcgtttttattatttttatagcgtttttatcgtttttatagcgtttttatcgtttttatagcgtttttatcgtttttatagcgttt

SEQ ID NO: 152 - DNA, 2671 bp, Artificial Sequence
  chemically treated genomic DNA (Homo sapiens) CpG-island No: 152
aaacgctataaaaacgataaaaacgctataaaaacgataaaaacgctataaaaacgataaaaacgctataaaaataataaaaacgctatccgaaacgataaaaacgctataaacgataaaaacgctataaaaacactaaaaatactataaaaacgctataaaaacaataaaaacgctataaaccgtaaaaacgctataaaaataacgaaaactctataaaaacgataaaaactctataaacgataaaaacgctattaaaacaataaaaacgctataaaccgtaaaaactctataaaaacgataaaaactctataaacgcgataaaaacgctataaaaacgataaaaacgctataaacaataaaaaaactataaaaacaataaaaacgctataaacaaaacgctataaaaacgataaaaacgctataaaaacgataaaaacgctataaacactaacgacgctaaaaataacaataaaaacattaaaaacaataaatacactataaaaacgataaaaacgctataaacactaaaaacgctataaaaacgataaaaacgctataaacgcgataaaaacgctataaaaacgataaaaacgctataaaaaccgtaaaaacgctatcgaaacgataaaaacgctataaacgcgataaaaacgctataaaaacgataaaaacgctataaaaaccgtaaaaacgctatcgaaaccgtaaaaacgctataaacgcgacgaaaaaactatcaaaacgataaaaacgctataaacgcgataaaaacgctataaacgcgacgaaaaaactatcgaaacgataaaaacgctataaacgcgataaaaacgctataaaaacgataaaaacgctataaacgctatcgaaacaataaaaacgctacgaacgttaaaaacgctataaaaacgataaaaacgctatcgaaacgataaaaacgctatcgaaacgataaaaacgctataaacgcgataaaaacgctataaaaacgataaaaacgctataaaaaccgtaaaaacgctatcgaaaccgtaaaaacgctatcgaaacgataaaaacgctatcgaaacgataaaaacgctataaacgcgataaaaacgctataaaaacgataaaaacgctataaacgcgataaaaacgctataaacgctataaaaacgctataaaaacgataaaaacgctataaacgcgataaaaacgctataaacgccgtaaaaacgctataaaaacgataaaaacgctataaacgcgataaaaacgctataaacgcgacgaaaaaactatcaaaacgataaaaacgctataaacgcgataaaaacgctataaacgcgacgaaaaaactatcgaaacgataaaaacgctataaacgcgataaaaacactataaaaacgataaaaacgctataaacgcgataaaaacgctataaacgccgtaaaaacgctataaaaacgataaaaacgctatcgaaacgataaaaacgctataaaaacgataaaaacgctataaacgcgacgaaaacgctatcgaaacgataaaaacgctataaacgccgtaaaaacgctataaaaacgataaaaacgctatcgaaacgataaaaacgctatcgaaacgataaaaacgctataaaaacgataaaaacgctatcgaaacgataaaaacgctacgaacgttaaaaacgctataaacgcaataaaaacactataaaaacaataaaaacgctataaacgccgtaaaaacgctatcgaaataataaaaacgctataaaaacgataaaaacgctatcgaaactataaaaacgctataaacgcgataaaaacgctataaacgcgataaaaacgctataaaaacgataaaaacgctacgaacattaaaaacgctataaacgcgataacgacactataaaaacgataaaaacgctataaacgccgtaaaaacgctatcgaaacgataaaaacgctatcgaaaaaataaaaacgctataaaaacgataaaaacgctataaaaacgataaaaacgctacgaacgttaaaaacgctataaacgcgataaaaacactataaaaacaataaaaacgctataaacgccgtaaaaacactatcgaaataataaaaacgctataaacgcgataaaaacgctatcgaaactataaaaacgctataaaaacgataaaaacgctataaaaacgataaaaacgctatcgaaacgataaaaacgctctcgaaacgataaaaacgctataaacccgataaaaacgctataaaaacgataaaaacgctataaacgcgataaaaacgctataaaaacgataaaaaaactataaacgccgtaaaaacgctataaacgcgataaaaacgctataaaaacgataaaaacgctataaaaacgataaaaatactataaacgcgataaaaacgctataaaaacgataaaaacgctacaaatattaacgctataaatactataaaaataacgaaaactctttaaacgcgataaaaacgctataaaaacgataaaaacgctacaaatattaacgctataaatactataaaaataacgaaaactccgtaaacgcgataaatacgctataaacaataaaaatactataaaaacaataaaaatactctaaaaaacaataaaaacgctacgcgaacaataaaaatactataaa

SEQ ID NO: 153 - DNA, 833 bp, Artificial Sequence
  chemically treated genomic DNA (Homo sapiens) CpG-island No: 153
agtcgtttcgcgggttttttttacggtgcgtcgtttgggttttagcggtcgttaggttgtagtttggggttttcggttatttcgggcgttggcggcggtggaggtagtagggcggatggcggagttcggtcgttcgtgggtttaggcgcgtagtgcgtatagagttagcgaggtgttgcggcgcggtacgggtcgtcggcgggattcggggtcgtaatttaatgggtcgggttaggaagacgttcgagtttcgggtcggatggttcgtttgcgcggttagtttcgggtcgaagcggtttcgcggttcgaggtgtcgcggttgttgaagttggtggagcgtgcgggggtcggggcggtcgggcgcgggcgagaggatcggcgcgtatagtcgcgggtttcgtgtgttcggtatgcggggagtttcgcggcggggttatttattcggcgggggttttggaggtgagcgagcggcggttgtaggagggtttggcggtagtgcgcgaggagttgggcgtcgggattgaggcgttgcgcgcggagtttcgagcggagttggatgttttgcgcgcgttgttgtcgtcgtcgtcgttttcgtttgttcgtcgcgagtttcgcgtcgtttttcgcgtcgcgtttcgcggttcgattttgtcgcggacgttcggtatcgtgagcgttttggtcgtcgtttttaggttcgtagacgacgtttcggacggtttagtagaatgcggagcgtatcgagtttcggttaggaagaattataagaagatgttagtgtcgtttggggtttcgtaaggtggcggggattgagggcggtcgtataagggtag

SEQ ID NO: 154 - DNA, 833 bp, Artificial Sequence
  chemically treated genomic DNA (Homo sapiens) CpG-island No: 154
ctacccttatacgaccgccctcaatccccgccaccttacgaaaccccaaacgacactaacatcttcttataattcttcctaaccgaaactcgatacgctccgcattctactaaaccgtccgaaacgtcgtctacgaacctaaaaacgacgaccaaaacgctcacgataccgaacgtccgcgacaaaatcgaaccgcgaaacgcgacgcgaaaaacgacgcgaaactcgcgacgaacaaacgaaaacgacgacgacgacaacaacgcgcgcaaaacatccaactccgctcgaaactccgcgcgcaacgcctcaatcccgacgcccaactcctcgcgcactaccgccaaaccctcctacaaccgccgctcgctcacctccaaaacccccgccgaataaataaccccgccgcgaaactccccgcataccgaacacacgaaacccgcgactatacgcgccgatcctctcgcccgcgcccgaccgccccgacccccgcacgctccaccaacttcaacaaccgcgacacctcgaaccgcgaaaccgcttcgacccgaaactaaccgcgcaaacgaaccatccgacccgaaactcgaacgtcttcctaacccgacccattaaattacgaccccgaatcccgccgacgacccgtaccgcgccgcaacacctcgctaactctatacgcactacgcgcctaaacccacgaacgaccgaactccgccatccgccctactacctccaccgccgccaacgcccgaaataaccgaaaaccccaaactacaacctaacgaccgctaaaacccaaacgacgcaccgtaaaaaaaacccgcgaaacgact

SEQ ID NO: 155 - DNA, 833 bp, Artificial Sequence
  chemically treated genomic DNA (Homo sapiens) CpG-island No: 155
ttgtttttgtgcggtcgtttttagttttcgttattttgcggggttttaggcggtattggtatttttttgtggttttttttggtcggggttcggtgcgtttcgtattttgttgggtcgttcggggcgtcgtttgcgggtttggaggcggcgattagggcgtttacggtgtcgagcgttcgcggtagggtcgggtcgcggggcgcggcgcgggggacggcgcggggttcgcggcgggtaggcggggacggcggcggcggtagtagcgcgcgtagggtatttagtttcgttcgaagtttcgcgcgtagcgttttaatttcggcgtttagtttttcgcgtattgtcgttaggtttttttgtagtcgtcgttcgtttatttttaggattttcgtcgggtaggtggtttcgtcgcggggtttttcgtatatcgagtatacggagttcgcggttgtgcgcgtcggttttttcgttcgcgttcggtcgtttcggttttcgtacgttttattagttttagtagtcgcggtatttcggatcgcgaagtcgtttcggttcggagttggtcgcgtaggcgagttattcggttcggggttcgggcgtttttttggttcggtttattggattgcggtttcggatttcgtcggcggttcgtgtcgcgtcgtagtatttcgttggttttgtacgtattacgcgtttgggtttacgggcggtcgggtttcgttattcgttttgttgtttttatcgtcgttagcgttcgggatggtcgggagttttaggttgtagtttagcgatcgttggggtttaggcgacgtatcgtggagggggttcgcgggacggtt

SEQ ID NO: 156 - DNA, 833 bp, Artificial Sequence
  chemically treated genomic DNA (Homo sapiens) CpG-island No: 156
aaccgtcccgcgaaccccctccacgatacgtcgcctaaaccccaacgatcgctaaactacaacctaaaactcccgaccatcccgaacgctaacgacgataaaaacaacaaaacgaataacgaaacccgaccgcccgtaaacccaaacgcgtaatacgtacaaaaccaacgaaatactacgacgcgacacgaaccgccgacgaaatccgaaaccgcaatccaataaaccgaaccaaaaaaacgcccgaaccccgaaccgaataactcgcctacgcgaccaactccgaaccgaaacgacttcgcgatccgaaataccgcgactactaaaactaataaaacgtacgaaaaccgaaacgaccgaacgcgaacgaaaaaaccgacgcgcacaaccgcgaactccgtatactcgatatacgaaaaaccccgcgacgaaaccacctacccgacgaaaatcctaaaaataaacgaacgacgactacaaaaaaacctaacgacaatacgcgaaaaactaaacgccgaaattaaaacgctacgcgcgaaacttcgaacgaaactaaataccctacgcgcgctactaccgccgccgccgtccccgcctacccgccgcgaaccccgcgccgtcccccgcgccgcgccccgcgacccgaccctaccgcgaacgctcgacaccgtaaacgccctaatcgccgcctccaaacccgcaaacgacgccccgaacgacccaacaaaatacgaaacgcaccgaaccccgaccaaaaaaaaccacaaaaaaataccaataccgcctaaaaccccgcaaaataacgaaaactaaaaacgaccgcacaaaaacaa

SEQ ID NO: 157 - DNA, 818 bp, Artificial Sequence
  chemically treated genomic DNA (Homo sapiens) CpG-island No: 157
tttgcgtgttcgttttcggcgtatttcgcgttttttgttttcggtatttttcgcgtttttcgagtttttcgcgtttttttgttttcggtattttcggtgtttttcgttttcggcgtttttcgcggtcgtcgtttttagtttagcgagtttcgtttgggtagcgattgttagcgcgatcgcggtttgggcgtttggtttttttcgcgcggtcgcgttattgggtcgcgcgcggcggatatacgcgttacgcgtcgtcgattggcggttttcgtagcgcgttttgcggtttttttaatgcggggcggtcgcgcgcggggattggtcgtacgtcgcgaaggttcgtttttcgttcgttcggcgcggtaggcgggtgtcggcgatcggagagtttggataggttttttagatggttgcggcggtcggtcggtgaggttttttcggttgtggtttggttgcgggcggtttgggtagttcgcgggcgttttaggtaggtgcggggcgcgaggggcgttcgcgggcggttgggcgggcgtcgcggtttgcgcgagggcgcgtttttttttttcgttttttttcgggatcgaggtcgcgggcggggcgggggcgcggagttcggtttttgtgaggtaatatggtcgcgggcggtggagagcgcggggtggggacgttttcggggttggggggcgggtttcgggtttaggcgttgtcgattttcgtcgttgttcgttcgggtaaagaggtttttttttcggagggttcgaagtttagtatcgtttttaggcgggaaaggtgtggatagggttagtgttcgtttggga

SEQ ID NO: 158 - DNA, 818 bp, Artificial Sequence
  chemically treated genomic DNA (Homo sapiens) CpG-island No: 158
tcccaaacgaacactaaccctatccacacctttcccgcctaaaaacgatactaaacttcgaaccctccgaaaaaaaaacctctttacccgaacgaacaacgacgaaaatcgacaacgcctaaacccgaaacccgccccccaaccccgaaaacgtccccaccccgcgctctccaccgcccgcgaccatattacctcacaaaaaccgaactccgcgcccccgccccgcccgcgacctcgatcccgaaaaaaaacgaaaaaaaaaaacgcgccctcgcgcaaaccgcgacgcccgcccaaccgcccgcgaacgcccctcgcgccccgcacctacctaaaacgcccgcgaactacccaaaccgcccgcaaccaaaccacaaccgaaaaaacctcaccgaccgaccgccgcaaccatctaaaaaacctatccaaactctccgatcgccgacacccgcctaccgcgccgaacgaacgaaaaacgaaccttcgcgacgtacgaccaatccccgcgcgcgaccgccccgcattaaaaaaaccgcaaaacgcgctacgaaaaccgccaatcgacgacgcgtaacgcgtatatccgccgcgcgcgacccaataacgcgaccgcgcgaaaaaaaccaaacgcccaaaccgcgatcgcgctaacaatcgctacccaaacgaaactcgctaaactaaaaacgacgaccgcgaaaaacgccgaaaacgaaaaacaccgaaaataccgaaaacaaaaaaacgcgaaaaactcgaaaaacgcgaaaaataccgaaaacaaaaaacgcgaaatacgccgaaaacgaacacgcaaa

SEQ ID NO: 159 - DNA, 818 bp, Artificial Sequence
  chemically treated genomic DNA (Homo sapiens) CpG-island No: 159
ttttaggcgagtattggttttgtttatatttttttcgtttgaaggcgatgttaggtttcgggtttttcgggagaggagtttttttattcgggcggatagcgacgagagtcggtaacgtttgggttcggggttcgttttttagtttcggaggcgtttttatttcgcgttttttatcgttcgcggttatgttgttttataaaggtcgggtttcgcgttttcgtttcgttcgcggtttcggtttcggagggaggcgggagggaagggcgcgttttcgcgtaggtcgcggcgttcgtttaatcgttcgcgggcgtttttcgcgtttcgtatttatttgaggcgttcgcgggttgtttaagtcgttcgtagttaaattatagtcgggaaagttttatcgatcgatcgtcgtagttatttggaaagtttgtttaggtttttcggtcgtcggtattcgtttgtcgcgtcgggcgagcggagggcgggttttcgcggcgtgcggttaattttcgcgcgcggtcgtttcgtattgggggagtcgtagagcgcgttgcggaggtcgttaatcggcggcgcgtagcgcgtgtgttcgtcgcgcgcggtttaatagcgcggtcgcgcgggagggattaggcgtttaggtcgcggtcgcgttaatagtcgttgtttaggcggggttcgttggattgagggcggcggtcgcgaggagcgtcgggaacgggaagtatcgggaatgtcgggagtaggggagcgcgggaagttcggggagcgcggggaatgtcgggaatagggagcgcggagtacgtcgggagcggatacgtaga

SEQ ID NO: 160 - DNA, 818 bp, Artificial Sequence
  chemically treated genomic DNA (Homo sapiens) CpG-island No: 160
tctacgtatccgctcccgacgtactccgcgctccctattcccgacattccccgcgctccccgaacttcccgcgctcccctactcccgacattcccgatacttcccgttcccgacgctcctcgcgaccgccgccctcaatccaacgaaccccgcctaaacaacgactattaacgcgaccgcgacctaaacgcctaatccctcccgcgcgaccgcgctattaaaccgcgcgcgacgaacacacgcgctacgcgccgccgattaacgacctccgcaacgcgctctacgactcccccaatacgaaacgaccgcgcgcgaaaattaaccgcacgccgcgaaaacccgccctccgctcgcccgacgcgacaaacgaataccgacgaccgaaaaacctaaacaaactttccaaataactacgacgatcgatcgataaaactttcccgactataatttaactacgaacgacttaaacaacccgcgaacgcctcaaataaatacgaaacgcgaaaaacgcccgcgaacgattaaacgaacgccgcgacctacgcgaaaacgcgcccttccctcccgcctccctccgaaaccgaaaccgcgaacgaaacgaaaacgcgaaacccgacctttataaaacaacataaccgcgaacgataaaaaacgcgaaataaaaacgcctccgaaactaaaaaacgaaccccgaacccaaacgttaccgactctcgtcgctatccgcccgaataaaaaaactcctctcccgaaaaacccgaaacctaacatcgccttcaaacgaaaaaaatataaacaaaaccaatactcgcctaaaa

SEQ ID NO: 161 - DNA, 852 bp, Artificial Sequence
  chemically treated genomic DNA (Homo sapiens) CpG-island No: 161
cgtcgttattttcggtttcgtttaggcggggcgggattcgaatttgcgatgtttaggttcgggttttaggtttggggttgtatcgttcgttcgttaggggttcgcgtcggtcgttcgtttcgttagttatttttagttcgttagcgcgtgcggcggaggtcgagcgtttttatgattttggtttttggtaacgttatcgttacgcgtcggatttaatttttaattattttagttagttttagaggcgcgcgtggtcgggacggaagtgcgcgcgggtgtcgtcgggagtgcgcgtttttttggttgacgggcgggtcgggtatgcgtcgcgggcgttttggcgggaagcgcggggcgggtcggataatgagagtgttcgttttttgagttaataaagttgtattggttttgaatcgcggcgcgtttttcgtcgttggggttaggggtcgaggttcgggtcgtggggcggagggaagagcgggcgggcgggaggcgtcggcgttagacgcggagggaaggagttacgagtagtcgtcgagaggtcgcggagttagcgacgatcgatttagtcgagtcgtcgtcgtcgtcgcgtttttatggcggtcgttaaggtgtcgtcgggtttaagcggggatagggtgggcgggcggggtcggggtcgttattagcggttacgtgggcggttcgcgtcgtcgttattaattttcgtcggtttgtaggttcggtcgtttgttgggtttcggtggcgcggagtcggggcgcgtggggtttgggggttcgaggtttgcggagttggggcgtttgggggtgtaggttttgtagaggtttgggggttgtagggttttcgcgtga

SEQ ID NO: 162 - DNA, 852 bp, Artificial Sequence
  chemically treated genomic DNA (Homo sapiens) CpG-island No: 162
tcacgcgaaaaccctacaacccccaaacctctacaaaacctacacccccaaacgccccaactccgcaaacctcgaacccccaaaccccacgcgccccgactccgcgccaccgaaacccaacaaacgaccgaacctacaaaccgacgaaaattaataacgacgacgcgaaccgcccacgtaaccgctaataacgaccccgaccccgcccgcccaccctatccccgcttaaacccgacgacaccttaacgaccgccataaaaacgcgacgacgacgacgactcgactaaatcgatcgtcgctaactccgcgacctctcgacgactactcgtaactccttccctccgcgtctaacgccgacgcctcccgcccgcccgctcttccctccgccccacgacccgaacctcgacccctaaccccaacgacgaaaaacgcgccgcgattcaaaaccaatacaactttattaactcaaaaaacgaacactctcattatccgacccgccccgcgcttcccgccaaaacgcccgcgacgcatacccgacccgcccgtcaaccaaaaaaacgcgcactcccgacgacacccgcgcgcacttccgtcccgaccacgcgcgcctctaaaactaactaaaataattaaaaattaaatccgacgcgtaacgataacgttaccaaaaaccaaaatcataaaaacgctcgacctccgccgcacgcgctaacgaactaaaaataactaacgaaacgaacgaccgacgcgaacccctaacgaacgaacgatacaaccccaaacctaaaacccgaacctaaacatcgcaaattcgaatcccgccccgcctaaacgaaaccgaaaataacgacg

SEQ ID NO: 163 - DNA, 852 bp, Artificial Sequence
  chemically treated genomic DNA (Homo sapiens) CpG-island No: 163
ttacgcgggggttttgtagtttttaggtttttgtagagtttgtatttttaaacgttttaatttcgtaggtttcgagtttttaaattttacgcgtttcgatttcgcgttatcgaggtttagtagacggtcgagtttgtaggtcggcggaggttggtggcggcggcgcgggtcgtttacgtggtcgttgataacggtttcggtttcgttcgtttattttgttttcgtttgggttcggcggtattttggcggtcgttatgggggcgcggcggcggcggcggttcggttgggtcggtcgtcgttggtttcgcggtttttcggcggttattcgtagtttttttttttcgcgtttggcgtcggcgtttttcgttcgttcgttttttttttcgttttacgattcgaatttcgatttttgattttagcggcgggaaacgcgtcgcgatttaaaattagtatagttttattggtttaggaggcggatatttttattgttcggttcgtttcgcgtttttcgttaaaacgttcgcggcgtatgttcggttcgttcgttagttagaggagcgcgtattttcggcgatattcgcgcgtattttcgtttcggttacgcgcgtttttagagttggttaaagtggttgggggttggattcggcgcgtgacgatgacgttgttagaagttaggattatagagacgttcggttttcgtcgtacgcgttggcggattaagagtggttggcgaagcgagcggtcggcgcgggtttttggcgggcgggcggtatagttttaagtttgagattcggatttgagtatcgtaggttcgagtttcgtttcgtttgggcgaagtcgggggtggcggcg

SEQ ID NO: 164 - DNA, 852 bp, Artificial Sequence
  chemically treated genomic DNA (Homo sapiens) CpG-island No: 164
cgccgccacccccgacttcgcccaaacgaaacgaaactcgaacctacgatactcaaatccgaatctcaaacttaaaactataccgcccgcccgccaaaaacccgcgccgaccgctcgcttcgccaaccactcttaatccgccaacgcgtacgacgaaaaccgaacgtctctataatcctaacttctaacaacgtcatcgtcacgcgccgaatccaacccccaaccactttaaccaactctaaaaacgcgcgtaaccgaaacgaaaatacgcgcgaatatcgccgaaaatacgcgctcctctaactaacgaacgaaccgaacatacgccgcgaacgttttaacgaaaaacgcgaaacgaaccgaacaataaaaatatccgcctcctaaaccaataaaactatactaattttaaatcgcgacgcgtttcccgccgctaaaatcaaaaatcgaaattcgaatcgtaaaacgaaaaaaaaaacgaacgaacgaaaaacgccgacgccaaacgcgaaaaaaaaaaactacgaataaccgccgaaaaaccgcgaaaccaacgacgaccgacccaaccgaaccgccgccgccgccgcgcccccataacgaccgccaaaataccgccgaacccaaacgaaaacaaaataaacgaacgaaaccgaaaccgttatcaacgaccacgtaaacgacccgcgccgccgccaccaacctccgccgacctacaaactcgaccgtctactaaacctcgataacgcgaaatcgaaacgcgtaaaatttaaaaactcgaaacctacgaaattaaaacgtttaaaaatacaaactctacaaaaacctaaaaactacaaaacccccgcgtaa

SEQ ID NO: 165 - DNA, 718 bp, Artificial Sequence
  chemically treated genomic DNA (Homo sapiens) CpG-island No: 165
tggttttcgtcgtggtgtttattattcgggtcgtaggggtgcgtgggtgttcggttttcgagagtcgcgggcgttcgtcgggttggggttttcgaggtcgcggggttttgtttttttcgaaggtttcgcgaatcggtggcggttttcgggttttattaattcgtttcgttcggtttcgtttcgtcgcggtttttagcgttcggtttattttaaggggcgcgttgatataagagcgtagtagtcgtcgtcgttcgtggggtgggatttttttcgtcgtcgtcgtcgtcgtcgtcgcgggttttgcgtcgcgtttagttcgttcgttcgatttcggttcgatttcggtcggttttgttcgttcggtttcggggagggatgcggcggcgcggcgtttaggatgtttcgtagtttcgggacgcgttttaaattcgttaagtatatttcggtggttacggtcgtcgcgttgttggtcggttttagtattttttttttcgtgtttacgtgagtcggcgtcgcgtttgggggtacgcgggtagcgatgggtagggttcgtatagttcgggtacgggggtagcggtcgcgggggttggcggggtttcgggtagtgggcgggcggggcgtcggttgtaggcgatggtagtttttttttattcgttggggttgggggagttgaagcggtgtgtcggcgtttcgggtatcggggtgagttttttgtgtg

SEQ ID NO: 166 - DNA, 718 bp, Artificial Sequence
  chemically treated genomic DNA (Homo sapiens) CpG-island No: 166
cacacaaaaaactcaccccgatacccgaaacgccgacacaccgcttcaactcccccaaccccaacgaataaaaaaaaactaccatcgcctacaaccgacgccccgcccgcccactacccgaaaccccgccaacccccgcgaccgctacccccgtacccgaactatacgaaccctacccatcgctacccgcgtacccccaaacgcgacgccgactcacgtaaacacgaaaaaaaaaatactaaaaccgaccaacaacgcgacgaccgtaaccaccgaaatatacttaacgaatttaaaacgcgtcccgaaactacgaaacatcctaaacgccgcgccgccgcatccctccccgaaaccgaacgaacaaaaccgaccgaaatcgaaccgaaatcgaacgaacgaactaaacgcgacgcaaaacccgcgacgacgacgacgacgacgacgaaaaaaatcccaccccacgaacgacgacgactactacgctcttatatcaacgcgccccttaaaataaaccgaacgctaaaaaccgcgacgaaacgaaaccgaacgaaacgaattaataaaacccgaaaaccgccaccgattcgcgaaaccttcgaaaaaaacaaaaccccgcgacctcgaaaaccccaacccgacgaacgcccgcgactctcgaaaaccgaacacccacgcacccctacgacccgaataataaacaccacgacgaaaacca

SEQ ID NO: 167 - DNA, 718 bp, Artificial Sequence
  chemically treated genomic DNA (Homo sapiens) CpG-island No: 167
tatataagggatttatttcggtgttcgggacgtcggtatatcgttttaatttttttagttttagcgggtggagagggattgttatcgtttgtagtcggcgtttcgttcgtttattgttcggggtttcgttagttttcgcgatcgttgttttcgtgttcgggttgtgcgggttttgtttatcgttgttcgcgtgtttttagacgcggcgtcgatttacgtgaatacgaagaagagggtgttggagtcgattagtagcgcggcggtcgtggttatcgggatgtatttggcgggtttgaggcgcgtttcggggttgcggggtattttgggcgtcgcgtcgtcgtattttttttcggggtcgggcgggtagggtcggtcggggtcgggtcggggtcgggcgggcgggttggacgcggcgtaggattcgcggcggcggcggcggcggcggcggaggaaattttattttacgggcggcggcggttgttgcgtttttatgttagcgcgttttttaaggtggatcgggcgttgggggtcgcggcggggcgggatcgggcggggcgagttgatggggttcggggatcgttatcggttcgcgggattttcggagggggtaggatttcgcggtttcggggattttagttcggcgggcgttcgcggttttcgggggtcgggtatttacgtatttttgcggttcgggtggtgggtattacggcgaaggtta

SEQ ID NO: 168 - DNA, 718 bp, Artificial Sequence
  chemically treated genomic DNA (Homo sapiens) CpG-island No: 168
taaccttcgccgtaatacccaccacccgaaccgcaaaaatacgtaaatacccgacccccgaaaaccgcgaacgcccgccgaactaaaatccccgaaaccgcgaaatcctaccccctccgaaaatcccgcgaaccgataacgatccccgaaccccatcaactcgccccgcccgatcccgccccgccgcgacccccaacgcccgatccaccttaaaaaacgcgctaacataaaaacgcaacaaccgccgccgcccgtaaaataaaatttcctccgccgccgccgccgccgccgccgcgaatcctacgccgcgtccaacccgcccgcccgaccccgacccgaccccgaccgaccctacccgcccgaccccgaaaaaaaatacgacgacgcgacgcccaaaataccccgcaaccccgaaacgcgcctcaaacccgccaaatacatcccgataaccacgaccgccgcgctactaatcgactccaacaccctcttcttcgtattcacgtaaatcgacgccgcgtctaaaaacacgcgaacaacgataaacaaaacccgcacaacccgaacacgaaaacaacgatcgcgaaaactaacgaaaccccgaacaataaacgaacgaaacgccgactacaaacgataacaatccctctccacccgctaaaactaaaaaaattaaaacgatataccgacgtcccgaacaccgaaataaatcccttatata

SEQ ID NO: 169 - DNA, 647 bp, Artificial Sequence
  chemically treated genomic DNA (Homo sapiens) CpG-island No: 169
tcgcgtttcgttttttttggttcgttcgggtttagggcgtcgtttgtagttgcgcgcggtcgtttttagatggaatttttttattaacgtaaggttcggtcggagtagttattcgggagttgggcggcgaggggttatttttttttatttcggcgggtgtaggatcggggggtttgggtagtaattagtggggaggagcgttggattgtgtacgtcgagttcggtaggttttcgtatgcggtatgcgaagggaatttcgaggtttttttgtagaattcgagtacggttttttcggagttttttgtttcgcgtttgcggttttttgaattattttaataaaatgatcgtttcggtagttatttatgtttttttttgcgtagtgttcgtagcggatcgcgttgtgtggtatttcgagttttggggattttgttgtacgcgttttttagattttcgggggcggggagtggggagataatcgttagagtcgcggggcgggataaatggcggaatcgtcgcgcggcgttaggtaaattttgtaagggaatcgcgcggtttgtcggttttattttaagtattttcgaaaagaaagtatgtggcgggatatttgttatttattatgtgttattttcggtgacgttttttggagt

SEQ ID NO: 170 - DNA, 647 bp, Artificial Sequence
  chemically treated genomic DNA (Homo sapiens) CpG-island No: 170
actccaaaaaacgtcaccgaaaataacacataataaataacaaatatcccgccacatactttcttttcgaaaatacttaaaataaaaccgacaaaccgcgcgattcccttacaaaatttacctaacgccgcgcgacgattccgccatttatcccgccccgcgactctaacgattatctccccactccccgcccccgaaaatctaaaaaacgcgtacaacaaaatccccaaaactcgaaataccacacaacgcgatccgctacgaacactacgcaaaaaaaaacataaataactaccgaaacgatcattttattaaaataattcaaaaaaccgcaaacgcgaaacaaaaaactccgaaaaaaccgtactcgaattctacaaaaaaacctcgaaattcccttcgcataccgcatacgaaaacctaccgaactcgacgtacacaatccaacgctcctccccactaattactacccaaaccccccgatcctacacccgccgaaataaaaaaaaataacccctcgccgcccaactcccgaataactactccgaccgaaccttacgttaataaaaaaattccatctaaaaacgaccgcgcgcaactacaaacgacgccctaaacccgaacgaaccaaaaaaaacgaaacgcga

SEQ ID NO: 171 - DNA, 647 bp, Artificial Sequence
  chemically treated genomic DNA (Homo sapiens) CpG-island No: 171
gttttagaaagcgttatcgagaataatatatggtagatgataagtgtttcgttatatgtttttttttcgggaatgtttaaagtagagtcggtaagtcgcgcggtttttttgtaaagtttgtttggcgtcgcgcggcggtttcgttatttgtttcgtttcgcggttttggcgattgtttttttatttttcgttttcgagggtttgagggacgcgtgtaatagagtttttagggttcgaggtattatatagcgcggttcgttgcgggtattgcgtaggaaggggtatgggtggttatcgggacggttattttattgagatgatttaaggagtcgtagacgcggggtaggaaatttcgggggagtcgtgttcgggttttgtagggaaatttcgggatttttttcgtatgtcgtatgcggaaatttgtcgggttcgacgtgtatagtttagcgtttttttttattagttattgtttaggtttttcgattttgtattcgtcggaatgagagaaagtagtttttcgtcgtttagttttcgggtagttgtttcggtcgggttttgcgttggtgagaaagttttatttagaggcggtcgcgcgtaattgtaggcggcgttttaggttcgggcgagttagggagagcggggcgcgg

SEQ ID NO: 172 - DNA, 647 bp, Artificial Sequence
  chemically treated genomic DNA (Homo sapiens) CpG-island No: 172
ccgcgccccgctctccctaactcgcccgaacctaaaacgccgcctacaattacgcgcgaccgcctctaaataaaactttctcaccaacgcaaaacccgaccgaaacaactacccgaaaactaaacgacgaaaaactactttctctcattccgacgaatacaaaatcgaaaaacctaaacaataactaataaaaaaaaacgctaaactatacacgtcgaacccgacaaatttccgcatacgacatacgaaaaaaatcccgaaatttccctacaaaacccgaacacgactcccccgaaatttcctaccccgcgtctacgactccttaaatcatctcaataaaataaccgtcccgataaccacccataccccttcctacgcaatacccgcaacgaaccgcgctatataatacctcgaaccctaaaaactctattacacgcgtccctcaaaccctcgaaaacgaaaaataaaaaaacaatcgccaaaaccgcgaaacgaaacaaataacgaaaccgccgcgcgacgccaaacaaactttacaaaaaaaccgcgcgacttaccgactctactttaaacattcccgaaaaaaaaacatataacgaaacacttatcatctaccatatattattctcgataacgctttctaaaac

SEQ ID NO: 173 - DNA, 513 bp, Artificial Sequence
  chemically treated genomic DNA (Homo sapiens) CpG-island No: 173
acgggaagggggtaggcgcgttcggcgttttgattgggcgtgcggcggtaggattttaaagcgttttgtttcggatcgtttgttttgggtgatttttcggatttgttttggtggaattcggatttgtttcgtcgagatgacgaggtattttcgtttcgcgaatttaataggagggatttttgaagttagcggttttcgggatgagtcggggtaattttcgttttttgagcgtgggttggatggatgtttaattaggatttagggaggatgggggtcgcgggggaagtcgggcgtttcggggttttcgatatttatattttcgtacggcgtacgttttgtttcgagtttgcgtttttcgagttagtacggcgagtttgggattttcgtgttttttttttgtggttttcgagaaacgtcggagtttcgtgttttgttgggggttggggggatggagaaaaggtttcggggattttgtttaaaaagtaaaggtaaacgtattttaatagtttttcg

SEQ ID NO: 174 - DNA, 513 bp, Artificial Sequence
  chemically treated genomic DNA (Homo sapiens) CpG-island No: 174
cgaaaaactattaaaatacgtttacctttactttttaaacaaaatccccgaaaccttttctccatccccccaacccccaacaaaacacgaaactccgacgtttctcgaaaaccacaaaaaaaaaacacgaaaatcccaaactcgccgtactaactcgaaaaacgcaaactcgaaacaaaacgtacgccgtacgaaaatataaatatcgaaaaccccgaaacgcccgacttcccccgcgacccccatcctccctaaatcctaattaaacatccatccaacccacgctcaaaaaacgaaaattaccccgactcatcccgaaaaccgctaacttcaaaaatccctcctattaaattcgcgaaacgaaaatacctcgtcatctcgacgaaacaaatccgaattccaccaaaacaaatccgaaaaatcacccaaaacaaacgatccgaaacaaaacgctttaaaatcctaccgccgcacgcccaatcaaaacgccgaacgcgcctacccccttcccgt

SEQ ID NO: 175 - DNA, 513 bp, Artificial Sequence
  chemically treated genomic DNA (Homo sapiens) CpG-island No: 175
cgaggagttgttggggtgcgtttgtttttgttttttaaataagattttcgagattttttttttatttttttaatttttagtaggatacggaatttcggcgtttttcgaaagttataaaagaggggtacggaaattttaagttcgtcgtgttaattcggagaacgtaaattcgaggtagagcgtgcgtcgtgcggggatgtgggtgtcgaggatttcgaagcgttcggtttttttcgcgatttttattttttttagattttggttagatatttatttagtttacgtttagagggcgggggttatttcgatttatttcggaagtcgttaattttagaaattttttttgttaggttcgcgaaacgaaggtatttcgttatttcggcggggtaagttcggattttattagggtaggttcgggaggttatttagggtagacgattcgaggtagagcgttttaaaattttgtcgtcgtacgtttagttagagcgtcgagcgcgtttgtttttttttcgt

SEQ ID NO: 176 - DNA, 513 bp, Artificial Sequence
  chemically treated genomic DNA (Homo sapiens) CpG-island No: 176
acgaaaaaaaaacaaacgcgctcgacgctctaactaaacgtacgacgacaaaattttaaaacgctctacctcgaatcgtctaccctaaataacctcccgaacctaccctaataaaatccgaacttaccccgccgaaataacgaaataccttcgtttcgcgaacctaacaaaaaaaatttctaaaattaacgacttccgaaataaatcgaaataacccccgccctctaaacgtaaactaaataaatatctaaccaaaatctaaaaaaaataaaaatcgcgaaaaaaaccgaacgcttcgaaatcctcgacacccacatccccgcacgacgcacgctctacctcgaatttacgttctccgaattaacacgacgaacttaaaatttccgtacccctcttttataactttcgaaaaacgccgaaattccgtatcctactaaaaattaaaaaaataaaaaaaaaatctcgaaaatcttatttaaaaaacaaaaacaaacgcaccccaacaactcctcg

SEQ ID NO: 177 - DNA, 673 bp, Artificial Sequence
  chemically treated genomic DNA (Homo sapiens) CpG-island No: 177
tggcgtcgggtatcgatagagcggttttttttttcgtttttcggagttttcgcgtttcgtagttcgagtttttatcgagtacgattcgttcgtataattttcgtaggtttcgggcgagcggttgttgtttttttagcgggtcggaggattggaggtttcgttcggtatcgtcggtgtcggttttcgagtcgaggacgtagaggggttgcgaggcggtaggcgtcgggggttggagtcgagggtcggggaaaggcgcggtttttttgttcggtagcgggtgcgttgcgttcggcgcgtagtttcgcggttacgttcgtcgtttgtcgtttttgtttttcgtcgttgggtgtttgagttcgtcggagttttcgcgtatcgttgtaggcgcgggagggtagcgagacgaggggttgggtcgttttaaggtttcggttttttgttttcgcgttgaggtgtttcgcgagtttttttcggatttgagggaggggggcgtacgcgggtcggggggttacgtcgggcgagtaggttaaggcgttttcgttgcgtttttagagttcggaatggggggaggggggcgcgggggtagttttggggggtttgcgtatttttttttcgattagcgggggggttttgcgtggggcgtttcgagggtttcggtttttttttttgtgtt

SEQ ID NO: 178 - DNA, 673 bp, Artificial Sequence
  chemically treated genomic DNA (Homo sapiens) CpG-island No: 178
aacacaaaaaaaaaaaccgaaaccctcgaaacgccccacgcaaaacccccccgctaatcgaaaaaaaaatacgcaaaccccccaaaactacccccgcgcccccctccccccattccgaactctaaaaacgcaacgaaaacgccttaacctactcgcccgacgtaaccccccgacccgcgtacgcccccctccctcaaatccgaaaaaaactcgcgaaacacctcaacgcgaaaacaaaaaaccgaaaccttaaaacgacccaacccctcgtctcgctaccctcccgcgcctacaacgatacgcgaaaactccgacgaactcaaacacccaacgacgaaaaacaaaaacgacaaacgacgaacgtaaccgcgaaactacgcgccgaacgcaacgcacccgctaccgaacaaaaaaaccgcgcctttccccgaccctcgactccaacccccgacgcctaccgcctcgcaacccctctacgtcctcgactcgaaaaccgacaccgacgataccgaacgaaacctccaatcctccgacccgctaaaaaaacaacaaccgctcgcccgaaacctacgaaaattatacgaacgaatcgtactcgataaaaactcgaactacgaaacgcgaaaactccgaaaaacgaaaaaaaaaaccgctctatcgatacccgacgcca

SEQ ID NO: 179 - DNA, 673 bp, Artificial Sequence
  chemically treated genomic DNA (Homo sapiens) CpG-island No: 179
gatatagagaggggagtcgagattttcggaacgttttacgtagagttttttcgttagtcgggagaggggtgcgtagattttttagagttgttttcgcgtttttttttttttatttcgggttttgagagcgtagcgggaacgttttagtttgttcgttcggcgtggtttttcgattcgcgtacgttttttttttttaggttcgagagggattcgcgaagtattttagcgcggaggtagggaatcggagttttggagcgatttaatttttcgtttcgttgttttttcgcgtttgtaacggtgcgcggagatttcggcgaatttagatatttaacggcggagaatagaagcggtaggcggcggacgtggtcgcgaagttgcgcgtcgaacgtagcgtattcgttgtcgagtagaggagtcgcgttttttttcgattttcggttttagttttcggcgtttgtcgtttcgtagtttttttgcgttttcggttcgggggtcggtatcggcgatgtcgagcggagtttttagtttttcgattcgttgaagaagtagtagtcgttcgttcggagtttacggggattgtgcgagcggatcgtgttcggtggaggttcgggttgcggggcgcggggatttcggggggcggggggagggatcgttttgtcggtgttcggcgtta

SEQ ID NO: 180 - DNA, 673 bp, Artificial Sequence
  chemically treated genomic DNA (Homo sapiens) CpG-island No: 180
taacgccgaacaccgacaaaacgatccctccccccgccccccgaaatccccgcgccccgcaacccgaacctccaccgaacacgatccgctcgcacaatccccgtaaactccgaacgaacgactactacttcttcaacgaatcgaaaaactaaaaactccgctcgacatcgccgataccgacccccgaaccgaaaacgcaaaaaaactacgaaacgacaaacgccgaaaactaaaaccgaaaatcgaaaaaaaacgcgactcctctactcgacaacgaatacgctacgttcgacgcgcaacttcgcgaccacgtccgccgcctaccgcttctattctccgccgttaaatatctaaattcgccgaaatctccgcgcaccgttacaaacgcgaaaaaacaacgaaacgaaaaattaaatcgctccaaaactccgattccctacctccgcgctaaaatacttcgcgaatccctctcgaacctaaaaaaaaaaaacgtacgcgaatcgaaaaaccacgccgaacgaacaaactaaaacgttcccgctacgctctcaaaacccgaaataaaaaaaaaaaaacgcgaaaacaactctaaaaaatctacgcacccctctcccgactaacgaaaaaactctacgtaaaacgttccgaaaatctcgactcccctctctatatc

SEQ ID NO: 181 - DNA, 506 bp, Artificial Sequence
  chemically treated genomic DNA (Homo sapiens) CpG-island No: 181
cgggggaggggaagagggcggtcggggttgcgagcgcgtaaggttggaatatgagtcgggtttgatcgcgaggcggaggtaagagttatcgttttttttttttttttttcgagtgaggcggcgtagcggtcggagagggatggggggcgtttatttagtttgagtttcgtcgcgggcgttttcggtttacgtagcgtttttcgcgggtcgttagtgcgtattttcggttatattagttttcgtttggcgggtgtattcgggtcggcgaggaaggggtaatcgttcgggtgggtggggcgggttgggtatttgaggttattagttcggttgtagaggtaggggcggcggaggcggaattgcggagttgttgggtttatcgatttttatttttagcgagagaagtaatcgtaagttttagtttcgcggtatagatgtgtttgaggttgtttttatttatttgtggtttcgagtttagagttatttattttatattttttcggatttat

SEQ ID NO: 182 - DNA, 506 bp, Artificial Sequence
  chemically treated genomic DNA (Homo sapiens) CpG-island No: 182
ataaatccgaaaaaatataaaataaataactctaaactcgaaaccacaaataaataaaaacaacctcaaacacatctataccgcgaaactaaaacttacgattacttctctcgctaaaaataaaaatcgataaacccaacaactccgcaattccgcctccgccgcccctacctctacaaccgaactaataacctcaaatacccaacccgccccacccacccgaacgattaccccttcctcgccgacccgaatacacccgccaaacgaaaactaatataaccgaaaatacgcactaacgacccgcgaaaaacgctacgtaaaccgaaaacgcccgcgacgaaactcaaactaaataaacgccccccatccctctccgaccgctacgccgcctcactcgaaaaaaaaaaaaaaaaaacgataactcttacctccgcctcgcgatcaaacccgactcatattccaaccttacgcgctcgcaaccccgaccgccctcttcccctcccccg

SEQ ID NO: 183 - DNA, 506 bp, Artificial Sequence
  chemically treated genomic DNA (Homo sapiens) CpG-island No: 183
gtagattcgggagggtgtgaagtaggtagttttgaattcggagttataaatgggtagaggtagttttaaatatatttgtatcgcgaagttgagatttacggttatttttttcgttgagggtaagggtcggtggatttagtaatttcgtagtttcgttttcgtcgtttttgtttttatagtcgagttggtgattttaggtatttagttcgttttatttattcggacggttgtttttttttcgtcggttcgggtgtattcgttaggcggaggttgatgtggtcgagggtgcgtattggcggttcgcgggaagcgttgcgtgagtcgaaggcgttcgcggcgaggtttagattgggtgggcgttttttattttttttcggtcgttgcgtcgttttattcgggggaggggaagagggggcggtggtttttgttttcgtttcgcggttaagttcggtttatgttttagttttgcgcgttcgtagtttcggtcgttttttttttttttttcg

SEQ ID NO: 184 - DNA, 506 bp, Artificial Sequence
  chemically treated genomic DNA (Homo sapiens) CpG-island No: 184
cgaaaaaaaaaaaaaaaacgaccgaaactacgaacgcgcaaaactaaaacataaaccgaacttaaccgcgaaacgaaaacaaaaaccaccgccccctcttcccctcccccgaataaaacgacgcaacgaccgaaaaaaaataaaaaacgcccacccaatctaaacctcgccgcgaacgccttcgactcacgcaacgcttcccgcgaaccgccaatacgcaccctcgaccacatcaacctccgcctaacgaatacacccgaaccgacgaaaaaaaaacaaccgtccgaataaataaaacgaactaaatacctaaaatcaccaactcgactataaaaacaaaaacgacgaaaacgaaactacgaaattactaaatccaccgacccttaccctcaacgaaaaaaataaccgtaaatctcaacttcgcgatacaaatatatttaaaactacctctacccatttataactccgaattcaaaactacctacttcacaccctcccgaatctac

SEQ ID NO: 185 - DNA, 836 bp, Artificial Sequence
  chemically treated genomic DNA (Homo sapiens) CpG-island No: 185
ttttttacggattcgtatttttttttcgaaaagaaaatagaaagacgtataaatttttttgtagtttaaattttttatataggtttatcgttttattcggaaacgtagtttcgggtgcgtagcgtagggcgaaggtttggtcggtagcgcgggcggttgcggtttcgtcgtttcgggcgggcgcgcggaaacggagcgtagagcgcggcgggtatcgtcgggtttcgggattacggaggtgtcgttttcgtcggttgttggtttacgtcgcgttttttcgttacgtacgtgcgttggggtttttttggcggagatttcgtttttataattaagtgcgtttaatttatttaatttttagggcgggtcggcgggcgggcggaaggaaggaaggtaggtcgggcggtcgcggggatagtttggcgtgggaggcggttgcgggttttatttggcgtagttttcgttgattacgcgggggaattcggattcgggttcgacgcgtttttaaagagttttcgtcggcgttgacgcggaagcgttatagtttattacgttttttcgcgggtcgagacgattgcggcggcggtttacggcgtttttcgcgttgtgtggttaggcgggaggcgcgcgggcggaggtagttgataggaggaatcgttcggtagtagttgtcgtcgttattatcgaaggagtcggaatcggagcgggtaggatttgaggtttttttcgtcggggtaacggttgtcgtcgtaattcgggttttattagcgtcgttttatttgtaacggttttttaggttttaggagaggggcggagaaaaatgggggttttttttaatt

SEQ ID NO: 186 - DNA, 836 bp, Artificial Sequence
  chemically treated genomic DNA (Homo sapiens) CpG-island No: 186
aattaaaaaaaacccccatttttctccgcccctctcctaaaacctaaaaaaccgttacaaataaaacgacgctaataaaacccgaattacgacgacaaccgttaccccgacgaaaaaaacctcaaatcctacccgctccgattccgactccttcgataataacgacgacaactactaccgaacgattcctcctatcaactacctccgcccgcgcgcctcccgcctaaccacacaacgcgaaaaacgccgtaaaccgccgccgcaatcgtctcgacccgcgaaaaaacgtaataaactataacgcttccgcgtcaacgccgacgaaaactctttaaaaacgcgtcgaacccgaatccgaattcccccgcgtaatcaacgaaaactacgccaaataaaacccgcaaccgcctcccacgccaaactatccccgcgaccgcccgacctaccttccttccttccgcccgcccgccgacccgccctaaaaattaaataaattaaacgcacttaattataaaaacgaaatctccgccaaaaaaaccccaacgcacgtacgtaacgaaaaaacgcgacgtaaaccaacaaccgacgaaaacgacacctccgtaatcccgaaacccgacgatacccgccgcgctctacgctccgtttccgcgcgcccgcccgaaacgacgaaaccgcaaccgcccgcgctaccgaccaaaccttcgccctacgctacgcacccgaaactacgtttccgaataaaacgataaacctatataaaaaatttaaactacaaaaaaatttatacgtctttctattttcttttcgaaaaaaaaatacgaatccgtaaaaaa

SEQ ID NO: 187 - DNA, 836 bp, Artificial Sequence
  chemically treated genomic DNA (Homo sapiens) CpG-island No: 187
ggttgggggagatttttattttttttcgttttttttttaaagtttgagggatcgttgtaggtggagcggcgttggtgggattcgggttgcggcggtagtcgttgtttcggcgagggaagttttaggttttgttcgtttcggtttcggttttttcggtggtggcggcggtagttgttgtcgggcggttttttttgttaattgttttcgttcgcgcgtttttcgtttagttatatagcgcggaggacgtcgtgagtcgtcgtcgtagtcgtttcggttcgcggagggacgtggtgagttgtggcgttttcgcgttagcgtcggcggggattttttgggagcgcgtcgggttcgagttcgggttttttcgcgtggttagcggaggttgcgttaggtggggttcgtagtcgttttttacgttaggttgttttcgcggtcgttcggtttgtttttttttttttcgttcgttcgtcggttcgttttaagagttgagtaagttgggcgtatttggttgtggggacggggttttcgttagggagattttaacgtacgtgcgtagcgggagggcgcggcgtgggttagtagtcggcgggagcggtattttcgtagtttcggagttcggcggtgttcgtcgcgttttgcgtttcgttttcgcgcgttcgttcgggacggcgaggtcgtagtcgttcgcgttgtcggttaggttttcgttttgcgttgcgtattcgaggttgcgttttcgggtagggcgatgaatttgtgtggggagtttgggttgtaggagggtttgtgcgtttttttgtttttttttcgagagggaggtgcgggttcgtggaggg

SEQ ID NO: 188 - DNA, 836 bp, Artificial Sequence
  chemically treated genomic DNA (Homo sapiens) CpG-island No: 188
ccctccacgaacccgcacctccctctcgaaaaaaaaacaaaaaaacgcacaaaccctcctacaacccaaactccccacacaaattcatcgccctacccgaaaacgcaacctcgaatacgcaacgcaaaacgaaaacctaaccgacaacgcgaacgactacgacctcgccgtcccgaacgaacgcgcgaaaacgaaacgcaaaacgcgacgaacaccgccgaactccgaaactacgaaaataccgctcccgccgactactaacccacgccgcgccctcccgctacgcacgtacgttaaaatctccctaacgaaaaccccgtccccacaaccaaatacgcccaacttactcaactcttaaaacgaaccgacgaacgaacgaaaaaaaaaaaaacaaaccgaacgaccgcgaaaacaacctaacgtaaaaaacgactacgaaccccacctaacgcaacctccgctaaccacgcgaaaaaacccgaactcgaacccgacgcgctcccaaaaaatccccgccgacgctaacgcgaaaacgccacaactcaccacgtccctccgcgaaccgaaacgactacgacgacgactcacgacgtcctccgcgctatataactaaacgaaaaacgcgcgaacgaaaacaattaacaaaaaaaaccgcccgacaacaactaccgccgccaccaccgaaaaaaccgaaaccgaaacgaacaaaacctaaaacttccctcgccgaaacaacgactaccgccgcaacccgaatcccaccaacgccgctccacctacaacgatccctcaaactttaaaaaaaaaacgaaaaaaaataaaaatctcccccaacc

SEQ ID NO: 189 - DNA, 762 bp, Artificial Sequence
  chemically treated genomic DNA (Homo sapiens) CpG-island No: 189
tcgcggcggcgttagtcgttattgagggatcgattttataaaggtcgtttcgcgaggggtgcgtagtattcggtagagggcgtttcgacgggttgggttgtgcgtttgcgtagtgtgggtcgttttcgattttttgtttcggtcggtttcgtttcggtttcgtattttcgtttcgtttttagtcgtcgttttgtttcgtagtagttagtttcgtgttcggtagtatgtttagttgggttagtaaggatgttcgtcgtaagaaggagtcggagtttttttagacggtggtcgaggggttgcggtagttgtacgcgtagaagttgttatttttggaggagtattatcgtttttacgagttttattcgttcgcgttggaggacgttgatttcgataataagtttatggtgtttttcgtggggtagtatagtacgggtaagattatttttattcgatatttgatcgagtaggatttttcggggatgcgtatcgggttcgagtttattatcgatttttttatcgtcgttatgtacggttttattgagggcgtggtgtcgggtaacgcgttcgtggtggattcgcggcgtttttttcgtaagtttaacgcgtttggtaacgttttttttaataggtatttatttattattttagggggcggggggcgcgttcggggtatattttttattcggagtttgattttttcgtggttgtcgtttcgtcgttttttgttttcgaggttttagtgagatttttagtgattatttt

SEQ ID NO: 190 - DNA, 762 bp, Artificial Sequence
  chemically treated genomic DNA (Homo sapiens) CpG-island No: 190
aaaataatcactaaaaatctcactaaaacctcgaaaacaaaaaacgacgaaacgacaaccacgaaaaaatcaaactccgaataaaaaatataccccgaacgcgccccccgccccctaaaataataaataaatacctattaaaaaaaacgttaccaaacgcgttaaacttacgaaaaaaacgccgcgaatccaccacgaacgcgttacccgacaccacgccctcaataaaaccgtacataacgacgataaaaaaatcgataataaactcgaacccgatacgcatccccgaaaaatcctactcgatcaaatatcgaataaaaataatcttacccgtactatactaccccacgaaaaacaccataaacttattatcgaaatcaacgtcctccaacgcgaacgaataaaactcgtaaaaacgataatactcctccaaaaataacaacttctacgcgtacaactaccgcaacccctcgaccaccgtctaaaaaaactccgactccttcttacgacgaacatccttactaacccaactaaacatactaccgaacacgaaactaactactacgaaacaaaacgacgactaaaaacgaaacgaaaatacgaaaccgaaacgaaaccgaccgaaacaaaaaatcgaaaacgacccacactacgcaaacgcacaacccaacccgtcgaaacgccctctaccgaatactacgcacccctcgcgaaacgacctttataaaatcgatccctcaataacgactaacgccgccgcga

SEQ ID NO: 191 - DNA, 762 bp, Artificial Sequence
  chemically treated genomic DNA (Homo sapiens) CpG-island No: 191
ggagtggttattgagggttttattggggtttcggagataaaggacggcggggcgatagttacgggagggttaggtttcgagtgaggggtgtgtttcggacgcgtttttcgttttttggagtgatgggtgggtatttgttgaggaaagcgttgttaaacgcgttgagtttgcggaaggggcgtcgcgggtttattacgagcgcgttgttcggtattacgtttttagtggggtcgtgtatgacggcgatgaaggagtcggtggtgggttcgggttcgatgcgtattttcgggaagttttgttcgattaggtgtcggatgaaggtggttttgttcgtgttgtattgttttacgaggagtattataggtttgttgtcgaagttagcgttttttagcgcgggcgagtggaattcgtggaagcggtagtgtttttttaggggtagtagtttttgcgcgtatagttgtcgtagtttttcggttatcgtttggaagagtttcggtttttttttgcggcgggtatttttgttgatttagttgaatatattgtcggatacggggttggttgttgcggggtagagcggcggttgagagcggggcgagggtgcggagtcgaggcggggtcggtcggggtagggaatcgggagcgatttatattgcgtaggcgtatagtttagttcgtcgaagcgttttttgtcgaatgttgcgtatttttcgcggagcggtttttatagggtcggttttttagtggcggttagcgtcgtcgcgg

SEQ ID NO: 192 - DNA, 762 bp, Artificial Sequence
  chemically treated genomic DNA (Homo sapiens) CpG-island No: 192
ccgcgacgacgctaaccgccactaaaaaaccgaccctataaaaaccgctccgcgaaaaatacgcaacattcgacaaaaaacgcttcgacgaactaaactatacgcctacgcaatataaatcgctcccgattccctaccccgaccgaccccgcctcgactccgcaccctcgccccgctctcaaccgccgctctaccccgcaacaaccaaccccgtatccgacaatatattcaactaaatcaacaaaaatacccgccgcaaaaaaaaaccgaaactcttccaaacgataaccgaaaaactacgacaactatacgcgcaaaaactactacccctaaaaaaacactaccgcttccacgaattccactcgcccgcgctaaaaaacgctaacttcgacaacaaacctataatactcctcgtaaaacaatacaacacgaacaaaaccaccttcatccgacacctaatcgaacaaaacttcccgaaaatacgcatcgaacccgaacccaccaccgactccttcatcgccgtcatacacgaccccactaaaaacgtaataccgaacaacgcgctcgtaataaacccgcgacgccccttccgcaaactcaacgcgtttaacaacgctttcctcaacaaatacccacccatcactccaaaaaacgaaaaacgcgtccgaaacacacccctcactcgaaacctaaccctcccgtaactatcgccccgccgtcctttatctccgaaaccccaataaaaccctcaataaccactcc

SEQ ID NO: 193 - DNA, 743 bp, Artificial Sequence
  chemically treated genomic DNA (Homo sapiens) CpG-island No: 193
ttttacgttagttttttagtagaacgggagagggtcgtgaagacgtaggcgggggtttaaagaaatagcgagcgggttgttcggcggcgggtcgtatatttattttatttagttatttcggatttaatgcggaacggtcggacggattggcgaaagcggtcgttcggttttaggttcggagggttggggcggattttatttcggaggcggggcgatattggtattagaggtgcgtattgttagggttcgttagcgttggtttagaagtcgtttcgtatttttcgttcgtttgggttatagtagttcgggtcggttttttcggtttacgtcggttagagggttacgttgagttcggttttattacgatattttaattaaagttgtttgtcgataacggcgttttcgtgttcgttggaagtgacgttagcgaggcgtcgtaggtttcgtttttagtgggtttaaggtaggcggggttaagtcggtcggtgggtgggcgcggtttgttgagaacgtagtggggtcgcgagcggtaaaaaataggtttgggaaaggcgaagttagtaaagtcgaagatattagagtggtatcggttttgtgagagcgtttaagtttgatttcgggttacgtttagcgagcgatagagtaacgtcgtattgtatttttattaaatatttaggtgaacgacgtatttaacgatttgggagtttaggatttatggtttttaaaaggtaataattaagatt

SEQ ID NO: 194 - DNA, 743 bp, Artificial Sequence
  chemically treated genomic DNA (Homo sapiens) CpG-island No: 194
aatcttaattattaccttttaaaaaccataaatcctaaactcccaaatcgttaaatacgtcgttcacctaaatatttaataaaaatacaatacgacgttactctatcgctcgctaaacgtaacccgaaatcaaacttaaacgctctcacaaaaccgataccactctaatatcttcgactttactaacttcgcctttcccaaacctattttttaccgctcgcgaccccactacgttctcaacaaaccgcgcccacccaccgaccgacttaaccccgcctaccttaaacccactaaaaacgaaacctacgacgcctcgctaacgtcacttccaacgaacacgaaaacgccgttatcgacaaacaactttaattaaaatatcgtaataaaaccgaactcaacgtaaccctctaaccgacgtaaaccgaaaaaaccgacccgaactactataacccaaacgaacgaaaaatacgaaacgacttctaaaccaacgctaacgaaccctaacaatacgcacctctaataccaatatcgccccgcctccgaaataaaatccgccccaaccctccgaacctaaaaccgaacgaccgctttcgccaatccgtccgaccgttccgcattaaatccgaaataactaaataaaataaatatacgacccgccgccgaacaacccgctcgctatttctttaaacccccgcctacgtcttcacgaccctctcccgttctactaaaaaactaacgtaaaa

SEQ ID NO: 195 - DNA, 743 bp, Artificial Sequence
  chemically treated genomic DNA (Homo sapiens) CpG-island No: 195
agttttaattgttgttttttagggattatgggttttgagtttttaaatcgttggatgcgtcgtttatttgggtgtttggtaagaatgtagtgcgacgttgttttgtcgttcgttgagcgtagttcgaggttaagtttgggcgtttttataaaatcggtgttattttggtgttttcgattttgttggtttcgttttttttaagtttgttttttgtcgttcgcggttttattgcgtttttaataggtcgcgtttatttatcggtcgatttggtttcgtttattttgggtttattgggggcggagtttgcggcgtttcgttgacgttatttttagcggatacggaagcgtcgttgtcggtaggtagttttagttaggatgtcgtgatgggatcgagtttagcgtaattttttggtcgacgtgggtcgagggggtcggttcgggttgttgtggtttagacgagcggagagtgcggagcggtttttgggttagcgttaacgagttttggtagtgcgtatttttggtgttagtgtcgtttcgttttcggggtagaattcgttttagtttttcgggtttgggatcgggcggtcgttttcgttagttcgttcggtcgtttcgtattaggttcgggataattaggtggagtaggtgtgcggttcgtcgtcggatagttcgttcgttgtttttttaagttttcgtttgcgtttttacggttttttttcgttttgttggaaagttgacgtgggg

SEQ ID NO: 196 - DNA, 743 bp, Artificial Sequence
  chemically treated genomic DNA (Homo sapiens) CpG-island No: 196
ccccacgtcaactttccaacaaaacgaaaaaaaaccgtaaaaacgcaaacgaaaacttaaaaaaacaacgaacgaactatccgacgacgaaccgcacacctactccacctaattatcccgaacctaatacgaaacgaccgaacgaactaacgaaaacgaccgcccgatcccaaacccgaaaaactaaaacgaattctaccccgaaaacgaaacgacactaacaccaaaaatacgcactaccaaaactcgttaacgctaacccaaaaaccgctccgcactctccgctcgtctaaaccacaacaacccgaaccgaccccctcgacccacgtcgaccaaaaaattacgctaaactcgatcccatcacgacatcctaactaaaactacctaccgacaacgacgcttccgtatccgctaaaaataacgtcaacgaaacgccgcaaactccgcccccaataaacccaaaataaacgaaaccaaatcgaccgataaataaacgcgacctattaaaaacgcaataaaaccgcgaacgacaaaaaacaaacttaaaaaaaacgaaaccaacaaaatcgaaaacaccaaaataacaccgattttataaaaacgcccaaacttaacctcgaactacgctcaacgaacgacaaaacaacgtcgcactacattcttaccaaacacccaaataaacgacgcatccaacgatttaaaaactcaaaacccataatccctaaaaaacaacaattaaaact

SEQ ID NO: 197 - DNA, 663 bp, Artificial Sequence
  chemically treated genomic DNA (Homo sapiens) CpG-island No: 197
agcgatgaattttttttttagtcgcgttcgggttgtcggttcggcggttataggtttggtaggcgcgttagagatttagattcgtttttaagtaagggtcgtacgggatttaggttagtagcggtaattcgcggagttttagtttttttaggagttagagtcgggggaggcggggtcgagagtcgggggcggggttcggacgggggcgggttcgcggtgacgtcgggagggtagcgacgcgcggaggcggcggcggagtttttttttgttgttgttgcgttttattttttcgcggtcggttagttttagttcgtatttcgcgtcggtgttcgcgttttttttcgggtttcgttatgggttttatcgtgttcgcgtttttttcgcggattttcgggaagaagtagatgcggatttttatgggtgaggtagatcgagcgcgcggttcggatcggggcgtcggtttcggcgtagttttttcgttttcgcgtttttttagtttcgtttatttgggtttttggtttcgagttatttattttataacgtttcggggtttttgttttcgggcgggtttcggtttgtatcgtcgatttcggggtttgatattcggagttgcgggtttgggtggggtgaagtttttttcgttttagttcggttggtaagaag

SEQ ID NO: 198 - DNA, 663 bp, Artificial Sequence
  chemically treated genomic DNA (Homo sapiens) CpG-island No: 198
cttcttaccaaccgaactaaaacgaaaaaaacttcaccccacccaaacccgcaactccgaatatcaaaccccgaaatcgacgatacaaaccgaaacccgcccgaaaacaaaaaccccgaaacgttataaaataaataactcgaaaccaaaaacccaaataaacgaaactaaaaaaacgcgaaaacgaaaaaactacgccgaaaccgacgccccgatccgaaccgcgcgctcgatctacctcacccataaaaatccgcatctacttcttcccgaaaatccgcgaaaaaaacgcgaacacgataaaacccataacgaaacccgaaaaaaaacgcgaacaccgacgcgaaatacgaactaaaactaaccgaccgcgaaaaaataaaacgcaacaacaacaaaaaaaaactccgccgccgcctccgcgcgtcgctaccctcccgacgtcaccgcgaacccgcccccgtccgaaccccgcccccgactctcgaccccgcctcccccgactctaactcctaaaaaaactaaaactccgcgaattaccgctactaacctaaatcccgtacgacccttacttaaaaacgaatctaaatctctaacgcgcctaccaaacctataaccgccgaaccgacaacccgaacgcgactaaaaaaaaaattcatcgct

SEQ ID NO: 199 - DNA, 663 bp, Artificial Sequence
  chemically treated genomic DNA (Homo sapiens) CpG-island No: 199
ttttttattagtcgggttggggcggagggagttttattttatttaggttcgtagtttcgggtgttaggtttcggggtcggcgatgtagatcgggattcgttcgagagtagaggtttcggggcgttatgaggtgggtgattcggggttagagatttaggtgagcggggttggagggacgcgggggcggaagggttgcgtcggggtcggcgtttcggttcgggtcgcgcgttcgatttgttttatttatgagaattcgtatttgttttttttcgaagattcgcgaaaagagcgcggatacggtgaggtttatggcggggttcggggaggggcgcgggtatcgacgcggggtgcgggttggaattggtcggtcgcggggggatggggcgtagtagtagtaggaggaggtttcgtcgtcgttttcgcgcgtcgttgttttttcgacgttatcgcgggttcgttttcgttcgggtttcgttttcggttttcggtttcgtttttttcggttttggtttttaggggagttgaagtttcgcgagttgtcgttgttggtttgggtttcgtgcggtttttatttgggaacgggtttaggtttttaacgcgtttgttaggtttgtggtcgtcgaatcggtagttcgagcgcggttgaggaaaggatttatcgtt

SEQ ID NO: 200 - DNA, 663 bp, Artificial Sequence
  chemically treated genomic DNA (Homo sapiens) CpG-island No: 200
aacgataaatcctttcctcaaccgcgctcgaactaccgattcgacgaccacaaacctaacaaacgcgttaaaaacctaaacccgttcccaaataaaaaccgcacgaaacccaaaccaacaacgacaactcgcgaaacttcaactcccctaaaaaccaaaaccgaaaaaaacgaaaccgaaaaccgaaaacgaaacccgaacgaaaacgaacccgcgataacgtcgaaaaaacaacgacgcgcgaaaacgacgacgaaacctcctcctactactactacgccccatccccccgcgaccgaccaattccaacccgcaccccgcgtcgatacccgcgcccctccccgaaccccgccataaacctcaccgtatccgcgctcttttcgcgaatcttcgaaaaaaaacaaatacgaattctcataaataaaacaaatcgaacgcgcgacccgaaccgaaacgccgaccccgacgcaacccttccgcccccgcgtccctccaaccccgctcacctaaatctctaaccccgaatcacccacctcataacgccccgaaacctctactctcgaacgaatcccgatctacatcgccgaccccgaaacctaacacccgaaactacgaacctaaataaaataaaactccctccgccccaacccgactaataaaaaa

SEQ ID NO: 201 - DNA, 631 bp, Artificial Sequence
  chemically treated genomic DNA (Homo sapiens) CpG-island No: 201
taggcgagatttggagtttgtttcgcggaaagtcgtttttatgggtgacgacgtatggtaacgcgtttaagggaacgtcggcgagtcgattattgtgtttttaaagtcgttttgaaatgaggatagaagttcgggggagtcgggggcgtagagtaaaggtacgatttgattggttcgcggtcgcgtaacgatgggcgggacggggtagaagtgtgggcgagttggggcgttatcgcgcgtcgggtagttttttttacgttttggcgggtgcgtaggtttttaaattgggcggagtaagggaagtgatgtgtggttttcggaagaacgcgcgtaaatttttatttataagtaacgagtcgtcgtggttaaataaggtttttttacgatattaatcgcgtggcgggtgtggtattgtcgaattcgaggaatgagaaaggaggttcggtagaaagttcggattagttgtcggtcgttttcggcgtagtttagggcggggagggattgatttttcggaatatttcggggtaaagatttcgtataatagcgaaatcgttgagggattgttgtgtggcgaggttttggagatagataggtttatatatttttttttttcgtgagggttatcgatttg

SEQ ID NO: 202 - DNA, 631 bp, Artificial Sequence
  chemically treated genomic DNA (Homo sapiens) CpG-island No: 202
caaatcgataaccctcacgaaaaaaaaaaatatataaacctatctatctccaaaacctcgccacacaacaatccctcaacgatttcgctattatacgaaatctttaccccgaaatattccgaaaaatcaatccctccccgccctaaactacgccgaaaacgaccgacaactaatccgaactttctaccgaacctcctttctcattcctcgaattcgacaataccacacccgccacgcgattaatatcgtaaaaaaaccttatttaaccacgacgactcgttacttataaataaaaatttacgcgcgttcttccgaaaaccacacatcacttcccttactccgcccaatttaaaaacctacgcacccgccaaaacgtaaaaaaaactacccgacgcgcgataacgccccaactcgcccacacttctaccccgtcccgcccatcgttacgcgaccgcgaaccaatcaaatcgtacctttactctacgcccccgactcccccgaacttctatcctcatttcaaaacgactttaaaaacacaataatcgactcgccgacgttcccttaaacgcgttaccatacgtcgtcacccataaaaacgactttccgcgaaacaaactccaaatctcgccta

SEQ ID NO: 203 - DNA, 631 bp, Artificial Sequence
  chemically treated genomic DNA (Homo sapiens) CpG-island No: 203
taggtcggtgatttttacgaggaaagggagtgtgtgggtttgtttgtttttaaggtttcgttatataatagttttttagcggtttcgttgttatgcgaggtttttatttcgggatgtttcggggagttaattttttttcgttttaggttacgtcgggaacggtcggtagttgattcgaattttttgtcgggtttttttttttatttttcgggttcggtagtgttatattcgttacgcgattggtatcgtaggagggttttgtttgattacggcgattcgttatttatgggtgaggatttacgcgcgttttttcggaggttatatattattttttttgtttcgtttagtttagagatttgcgtattcgttagggcgtgagagagattattcggcgcgcggtgacgttttagttcgtttatatttttgtttcgtttcgtttatcgttgcgcggtcgcgggttaattagatcgtgtttttattttacgttttcggttttttcgaatttttgtttttattttagggcgattttgggaatataatagtcgattcgtcgacgtttttttagacgcgttgttatacgtcgttatttatagaaacggtttttcgcggggtagattttaagtttcgtttg

SEQ ID NO: 204 - DNA, 631 bp, Artificial Sequence
  chemically treated genomic DNA (Homo sapiens) CpG-island No: 204
caaacgaaacttaaaatctaccccgcgaaaaaccgtttctataaataacgacgtataacaacgcgtctaaaaaaacgtcgacgaatcgactattatattcccaaaatcgccctaaaataaaaacaaaaattcgaaaaaaccgaaaacgtaaaataaaaacacgatctaattaacccgcgaccgcgcaacgataaacgaaacgaaacaaaaatataaacgaactaaaacgtcaccgcgcgccgaataatctctctcacgccctaacgaatacgcaaatctctaaactaaacgaaacaaaaaaaataatatataacctccgaaaaaacgcgcgtaaatcctcacccataaataacgaatcgccgtaatcaaacaaaaccctcctacgataccaatcgcgtaacgaatataacactaccgaacccgaaaaataaaaaaaaaaacccgacaaaaaattcgaatcaactaccgaccgttcccgacgtaacctaaaacgaaaaaaaattaactccccgaaacatcccgaaataaaaacctcgcataacaacgaaaccgctaaaaaactattatataacgaaaccttaaaaacaaacaaacccacacactccctttcctcgtaaaaatcaccgaccta

SEQ ID NO: 205 - DNA, 706 bp, Artificial Sequence
  chemically treated genomic DNA (Homo sapiens) CpG-island No: 205
gtaataggaggaggtaggagagcgggtgattaggaagaatgacgcgacgtggtgaggacggagagagatcgggcgatgtatagtgcggagtatgaagatggagtaggagagtgtagtaggagggacgggagtgtaggtagtgaggacgagattataaggagataggagaacgagcgagtagaatacgacggagcgagtagaagagggtagttgcgggagaatagaggagagagagggacgagacgaaagagtatattaggagggacgagagggagagggttggaaggatgacgaggtgtggagaagcgagaggtagagtagaaggtagtcggagtggtagggtgcgaggcgggaatgataggagaagagagggacgaggagaaggaggtaggaagaggtatggaaggagaaagtgcgagagaggtaatggacggacgaaagcgatataagcgcgggagacgggagagcggcgagaggttacggtcgtatgagagagataggacgttagtgggtagacgtaaaaacgggtacggaggagaagaacgaggaagaagggacggaggaagcgattggagcggagatgggtgagacggcggaagagaaagagggaaaacgaggtaagtggtaggaaagaggggaggtagtagaaacgaatagtagaggtggaaagagggaagaggaagcggagaggagggtaaggaagaag

SEQ ID NO: 206 - DNA, 706 bp, Artificial Sequence
  chemically treated genomic DNA (Homo sapiens) CpG-island No: 206
cttcttccttaccctcctctccgcttcctcttccctctttccacctctactattcgtttctactacctcccctctttcctaccacttacctcgttttccctctttctcttccgccgtctcacccatctccgctccaatcgcttcctccgtcccttcttcctcgttcttctcctccgtacccgtttttacgtctacccactaacgtcctatctctctcatacgaccgtaacctctcgccgctctcccgtctcccgcgcttatatcgctttcgtccgtccattacctctctcgcactttctccttccatacctcttcctacctccttctcctcgtccctctcttctcctatcattcccgcctcgcaccctaccactccgactaccttctactctacctctcgcttctccacacctcgtcatccttccaaccctctccctctcgtccctcctaatatactctttcgtctcgtccctctctctcctctattctcccgcaactaccctcttctactcgctccgtcgtattctactcgctcgttctcctatctccttataatctcgtcctcactacctacactcccgtccctcctactacactctcctactccatcttcatactccgcactatacatcgcccgatctctctccgtcctcaccacgtcgcgtcattcttcctaatcacccgctctcctacctcctcctattac

SEQ ID NO: 207 - DNA, 706 bp, Artificial Sequence
  chemically treated genomic DNA (Homo sapiens) CpG-island No: 207
ttttttttttgttttttttttcgtttttttttttttttttttatttttgttgttcgtttttgttgtttttttttttttttgttatttgtttcgttttttttttttttttttcgtcgttttatttattttcgttttagtcgtttttttcgttttttttttttcgtttttttttttcgtattcgtttttgcgtttgtttattggcgttttattttttttatacggtcgtggtttttcgtcgttttttcgtttttcgcgtttgtatcgttttcgttcgtttattatttttttcgtattttttttttttatgtttttttttgttttttttttttcgtttttttttttttttgttattttcgtttcgtattttgttatttcggttgttttttattttgtttttcgtttttttatatttcgttatttttttagttttttttttttcgttttttttaatatattttttcgtttcgttttttttttttttttattttttcgtagttatttttttttgttcgtttcgtcgtattttgttcgttcgtttttttatttttttgtggtttcgtttttattatttgtattttcgttttttttgttatatttttttgttttatttttatatttcgtattatgtatcgttcggttttttttcgtttttattacgtcgcgttattttttttagttattcgtttttttatttttttttgttat

SEQ ID NO: 208 - DNA, 706 bp, Artificial Sequence
  chemically treated genomic DNA (Homo sapiens) CpG-island No: 208
ataacaaaaaaaaataaaaaaacgaataactaaaaaaaataacgcgacgtaataaaaacgaaaaaaaaccgaacgatacataatacgaaatataaaaataaaacaaaaaaatataacaaaaaaaacgaaaatacaaataataaaaacgaaaccacaaaaaaataaaaaaacgaacgaacaaaatacgacgaaacgaacaaaaaaaaataactacgaaaaaataaaaaaaaaaaaaaaacgaaacgaaaaaatatattaaaaaaaacgaaaaaaaaaaaactaaaaaaataacgaaatataaaaaaacgaaaaacaaaataaaaaacaaccgaaataacaaaatacgaaacgaaaataacaaaaaaaaaaaaaaacgaaaaaaaaaaaacaaaaaaaaacataaaaaaaaaaaatacgaaaaaaataataaacgaacgaaaacgatacaaacgcgaaaaacgaaaaaacgacgaaaaaccacgaccgtataaaaaaaataaaacgccaataaacaaacgcaaaaacgaatacgaaaaaaaaaaacgaaaaaaaaaaaacgaaaaaaacgactaaaacgaaaataaataaaacgacgaaaaaaaaaaaaaaaaaacgaaacaaataacaaaaaaaaaaaaaaacaacaaaaacgaacaacaaaaataaaaaaaaaaaaaaaaaaacgaaaaaaaaaacaaaaaaaaaa

SEQ ID NO: 209 - DNA, 1052 bp, Artificial Sequence
  chemically treated genomic DNA (Homo sapiens) CpG-island No: 209
ttttgcgcgtttttatttgtgatttatttagtttacgattcgttcggttttcgttcgttttcgttttcgttttcgtcgtcgtcgtcgtcgtcgtcgtcgttatcgttcgggtgtatttggatgttgagtttgcgttcgtaggtcggtttcgtgttttgtattacgttgtcgagtatcgttattacgtcgggcgtcggttttacgaagtaggcggtgcgcgtagttcggatggcggttcgtacgtcggcgaagcggaaggcgtagagtgcggtcggagtagcgcgggtcgcgggggatttttggggtcgttcgaagatagtaaagagtcgttttcgggttgggaagatcgatattaggcggttgtagaggtcgtcgcggttcgcgtcgttcgcgtattgtaagtttaattggatgtaggattcggtgagttttttggcgtcgtcgtcggcgtcgtggggtaggtagatgcgcgttagtaggtttcgcgtttggttttttttgtcgttcgcgcgcgtttcgttgttgagcgttaggtacgcgtaggattgtgtattcggcggcgggtcggacgggtgtaggaaggcgtttacgaagtttagtttgtgttgttttttggcgttttgtttgattttgaggatgttgtcgtcggaggggttgaggtcgaaggtgaagagtttggttaggtcgtcgcgcgtgtttagggagcggatggcgatttcgggcgtgttttcgaagcggtggttttttaggttgcggttgcgcgggaagaaggagttgtcgtaatcggtgtacgtggcgtttacgagtaggcggttgtttttcgcgttcgcggcgggaggtagaattagttttacggtggacgcgttcgggtggttggtcgttacgtttagtatgttggggaatatcgtgacgggttcggcgggcggcgcggcgggcgggaagcgtacggttacggtcgagatgttgtttcggcgtcgtagttggtagaagttttggtagatggattcgtatacgattattaggttttggtcggggtttagttgtaggatttt

SEQ ID NO: 210 - DNA, 1052 bp, Artificial Sequence
  chemically treated genomic DNA (Homo sapiens) CpG-island No: 210
aaaatcctacaactaaaccccgaccaaaacctaataatcgtatacgaatccatctaccaaaacttctaccaactacgacgccgaaacaacatctcgaccgtaaccgtacgcttcccgcccgccgcgccgcccgccgaacccgtcacgatattccccaacatactaaacgtaacgaccaaccacccgaacgcgtccaccgtaaaactaattctacctcccgccgcgaacgcgaaaaacaaccgcctactcgtaaacgccacgtacaccgattacgacaactccttcttcccgcgcaaccgcaacctaaaaaaccaccgcttcgaaaacacgcccgaaatcgccatccgctccctaaacacgcgcgacgacctaaccaaactcttcaccttcgacctcaacccctccgacgacaacatcctcaaaatcaaacaaaacgccaaaaaacaacacaaactaaacttcgtaaacgccttcctacacccgtccgacccgccgccgaatacacaatcctacgcgtacctaacgctcaacaacgaaacgcgcgcgaacgacaaaaaaaaccaaacgcgaaacctactaacgcgcatctacctaccccacgacgccgacgacgacgccaaaaaactcaccgaatcctacatccaattaaacttacaatacgcgaacgacgcgaaccgcgacgacctctacaaccgcctaatatcgatcttcccaacccgaaaacgactctttactatcttcgaacgaccccaaaaatcccccgcgacccgcgctactccgaccgcactctacgccttccgcttcgccgacgtacgaaccgccatccgaactacgcgcaccgcctacttcgtaaaaccgacgcccgacgtaataacgatactcgacaacgtaatacaaaacacgaaaccgacctacgaacgcaaactcaacatccaaatacacccgaacgataacgacgacgacgacgacgacgacgacgaaaacgaaaacgaaaacgaacgaaaaccgaacgaatcgtaaactaaataaatcacaaataaaaacgcgcaaaa

SEQ ID NO: 211 - DNA, 1052 bp, Artificial Sequence
  chemically treated genomic DNA (Homo sapiens) CpG-island No: 211
aagattttgtagttggatttcggttagggtttggtagtcgtgtgcgggtttatttattagggtttttgttagttgcggcgtcggggtaatatttcggtcgtggtcgtgcgtttttcgttcgtcgcgtcgttcgtcgagttcgttacggtgttttttagtatgttgaacgtggcggttaattattcgaacgcgtttatcgtggggttagttttgtttttcgtcgcgggcgcggggggtagtcgtttgttcgtgggcgttacgtatatcggttacggtagtttttttttttcgcgtaatcgtagtttggaggattatcgtttcgagaatacgttcgagatcgttattcgttttttggatacgcgcggcgatttggttaagttttttattttcgattttaattttttcgacgataatatttttaagattaagtagggcgttaaggagtagtataagttgggtttcgtgagcgtttttttgtattcgttcgattcgtcgtcgggtgtatagttttacgcgtatttggcgtttaatagcgaggcgcgcgcgggcgataaggagagttaggcgcggagtttgttggcgcgtatttgtttgttttacggcgtcggcggcgacgttaagaagtttatcgagttttatatttagttgggtttgtagtgcgcgggcggcgcgggtcgcggcgatttttatagtcgtttggtgtcggtttttttagttcgggagcggttttttgttgttttcgagcggttttaggggtttttcgcggttcgcgttgtttcggtcgtattttgcgtttttcgtttcgtcgacgtgcgagtcgttattcgagttgcgcgtatcgtttgtttcgtggaatcggcgttcgacgtggtggcggtgttcgatagcgtggtgtagggtacgggatcggtttgcgagcgtaagtttaatatttaggtatattcgggcggtggcggcggcggcggcggcggcggcggcgggggcgggggcgggggcgggcgggaatcgagcgggtcgtgagttgagtgggttataggtgggagcgcgtagag

SEQ ID NO: 212 - DNA, 1052 bp, Artificial Sequence
  chemically treated genomic DNA (Homo sapiens) CpG-island No: 212
ctctacgcgctcccacctataacccactcaactcacgacccgctcgattcccgcccgcccccgcccccgcccccgccgccgccgccgccgccgccgccgccaccgcccgaatatacctaaatattaaacttacgctcgcaaaccgatcccgtaccctacaccacgctatcgaacaccgccaccacgtcgaacgccgattccacgaaacaaacgatacgcgcaactcgaataacgactcgcacgtcgacgaaacgaaaaacgcaaaatacgaccgaaacaacgcgaaccgcgaaaaacccctaaaaccgctcgaaaacaacaaaaaaccgctcccgaactaaaaaaaccgacaccaaacgactataaaaatcgccgcgacccgcgccgcccgcgcactacaaacccaactaaatataaaactcgataaacttcttaacgtcgccgccgacgccgtaaaacaaacaaatacgcgccaacaaactccgcgcctaactctccttatcgcccgcgcgcgcctcgctattaaacgccaaatacgcgtaaaactatacacccgacgacgaatcgaacgaatacaaaaaaacgctcacgaaacccaacttatactactccttaacgccctacttaatcttaaaaatattatcgtcgaaaaaattaaaatcgaaaataaaaaacttaaccaaatcgccgcgcgtatccaaaaaacgaataacgatctcgaacgtattctcgaaacgataatcctccaaactacgattacgcgaaaaaaaaaaactaccgtaaccgatatacgtaacgcccacgaacaaacgactaccccccgcgcccgcgacgaaaaacaaaactaaccccacgataaacgcgttcgaataattaaccgccacgttcaacatactaaaaaacaccgtaacgaactcgacgaacgacgcgacgaacgaaaaacgcacgaccacgaccgaaatattaccccgacgccgcaactaacaaaaaccctaataaataaacccgcacacgactaccaaaccctaaccgaaatccaactacaaaatctt

SEQ ID NO: 213 - DNA, 1151 bp, Artificial Sequence
  chemically treated genomic DNA (Homo sapiens) CpG-island No: 213
  misc_feature (391)..(391): n is either a, c, g or t
tgttcgtgaggcgtcgcgggtgttcgtacgaggtttgcggtagttgcggagcgtgatatagcgggttgtcgggtatcgggtttacggtcgtttcggtttttaggtttaggttggcgttcgatagttgatagaggcggttgacggtcgttaggtatacggttttcgtcgcgtcgtttagggcgaagttgttggtgggcgtgggcgaggggaatcgacgttggatttttagggcgtcggttcgcgtcgtttttaggagtagtagtaatagtagcggtatcgggtatcgcggcggcgtttggaacggcggggggttggtagcggcgtcgggtcgttaaagggtgcgtcgttcgcggcgcgaagagttattcgggcgtgcgcgggttgcgcggtncggttattgtatgggacgagcgtcggtcgggagtcgggagttcggagcgggcgagaggcggggggcgggttcgggtcgcgaggcgttttttgttcgcgttagtcgttttcggtttcggcgttcgggttcggtttagtttcgtcgcgtagttcgggggcggggcgggggcggggcgggggcggtttcgttgcggatacgtttttatttttcgtttcggtttcgttcgttttcgggattttcgtttgtttttggtcgttttgggttacgtttcgtcgttcgcgggtttcgtcgttcgcgttttttaggattcgttcgcggttttagggttttttttcgtagtcgtcgtcgtcgtcgttcgtttttttcgttttttttttttatttggtcgtttggtttgtttcgttcgcgtttgttttttttttttcgtttttttttttatttcgtttttttttttttttgcgtttttcggtttttgcgttttttcgtttttgtttttattttaaatttcgcgcgtgtggcgttttttcgggttttgtttttgttttttttttttttttcgatttcgtttcgttttttagtttttggtagtttcgttttcggttttttttagttttttttttttttttgtttcgttttttcgtttttgacgttcgtttttttttttcgtggttttttttgtttttttttcggatttttcgtttttttttcggtttttttgagtttttttttttttttttttttgttttttcgaattttgtgt

SEQ ID NO: 214 - DNA, 1151 bp, Artificial Sequence
  chemically treated genomic DNA (Homo sapiens) CpG-island No: 214
  misc_feature (761)..(761): n is either a, c, g or t
acacaaaattcgaaaaaacaaaaaaaaaaaaaaaaaaaaactcaaaaaaaccgaaaaaaaaacgaaaaatccgaaaaaaaaacaaaaaaaaccacgaaaaaaaaaaacgaacgtcaaaaacgaaaaaacgaaacaaaaaaaaaaaaaaaactaaaaaaaaccgaaaacgaaactaccaaaaactaaaaaacgaaacgaaatcgaaaaaaaaaaaaaaaacaaaaacaaaacccgaaaaaacgccacacgcgcgaaatttaaaataaaaacaaaaacgaaaaaacgcaaaaaccgaaaaacgcaaaaaaaaaaaaaaacgaaataaaaaaaaaaacgaaaaaaaaaaaacaaacgcgaacgaaacaaaccaaacgaccaaataaaaaaaaaaaacgaaaaaaacgaacgacgacgacgacgactacgaaaaaaaaccctaaaaccgcgaacgaatcctaaaaaacgcgaacgacgaaacccgcgaacgacgaaacgtaacccaaaacgaccaaaaacaaacgaaaatcccgaaaacgaacgaaaccgaaacgaaaaataaaaacgtatccgcaacgaaaccgcccccgccccgcccccgccccgcccccgaactacgcgacgaaactaaaccgaacccgaacgccgaaaccgaaaacgactaacgcgaacaaaaaacgcctcgcgacccgaacccgccccccgcctctcgcccgctccgaactcccgactcccgaccgacgctcgtcccatacaataaccgnaccgcgcaacccgcgcacgcccgaataactcttcgcgccgcgaacgacgcaccctttaacgacccgacgccgctaccaaccccccgccgttccaaacgccgccgcgatacccgataccgctactattactactactcctaaaaacgacgcgaaccgacgccctaaaaatccaacgtcgattcccctcgcccacgcccaccaacaacttcgccctaaacgacgcgacgaaaaccgtatacctaacgaccgtcaaccgcctctatcaactatcgaacgccaacctaaacctaaaaaccgaaacgaccgtaaacccgatacccgacaacccgctatatcacgctccgcaactaccgcaaacctcgtacgaacacccgcgacgcctcacgaaca

SEQ ID NO: 215 - DNA, 1151 bp, Artificial Sequence
  chemically treated genomic DNA (Homo sapiens) CpG-island No: 215
  misc_feature (761)..(761): n is either a, c, g or t
atatagggttcgggaaggtagagggagaaggaaaggggagtttagagggatcgagagagggacggagggttcgagggggaggtagagggagttacggagagagggagcgagcgttagggacggaaaaacggagtaggagagagaaggagattagaaagggtcgggggcggggttgttagggattggagagcgaagcggagtcggagggagaaggagaagtagaggtagaattcggagaagcgttatacgcgcggagtttggggtggggatagagacggagagacgtagagatcgagagacgtagagagagggagagacggggtgggggagagggcggaaaagagaaaataggcgcgagcgaggtaggttaagcggttaagtgggaggaaagagcgaggagagcgagcgacggcggcggcggttacggggagggattttggggtcgcgggcgggttttggagggcgcgggcggcgggattcgcggacggcggggcgtggtttagggcggttaggggtaggcgggggtttcgggggcgggcggggtcggggcggggagtgagggcgtgttcgtagcggagtcgttttcgtttcgttttcgtttcgttttcgggttgcgcggcgaggttgagtcgggttcgggcgtcggggtcgggggcggttggcgcgggtaggaagcgtttcgcggttcgggttcgtttttcgtttttcgttcgtttcgggttttcggttttcggtcggcgttcgttttatgtaatagtcgngtcgcgtagttcgcgtacgttcggatggtttttcgcgtcgcgggcggcgtattttttagcggttcggcgtcgttgttagtttttcgtcgttttagacgtcgtcgcggtgttcggtgtcgttgttgttgttgttgtttttgggggcggcgcgggtcggcgttttggagatttagcgtcggtttttttcgtttacgtttattaataatttcgttttggacggcgcggcggggatcgtgtatttggcggtcgttaatcgtttttattagttgtcgggcgttaatttgagtttggaggtcgaggcggtcgtgggttcggtgttcgatagttcgttgtgttacgtttcgtagttgtcgtaggtttcgtgcgagtattcgcggcgttttacggata

SEQ ID NO: 216 - DNA, 1151 bp, Artificial Sequence
  chemically treated genomic DNA (Homo sapiens) CpG-island No: 216
  misc_feature (391)..(391): n is either a, c, g or t
tatccgtaaaacgccgcgaatactcgcacgaaacctacgacaactacgaaacgtaacacaacgaactatcgaacaccgaacccacgaccgcctcgacctccaaactcaaattaacgcccgacaactaataaaaacgattaacgaccgccaaatacacgatccccgccgcgccgtccaaaacgaaattattaataaacgtaaacgaaaaaaaccgacgctaaatctccaaaacgccgacccgcgccgcccccaaaaacaacaacaacaacaacgacaccgaacaccgcgacgacgtctaaaacgacgaaaaactaacaacgacgccgaaccgctaaaaaatacgccgcccgcgacgcgaaaaaccatccgaacgtacgcgaactacgcgacncgactattacataaaacgaacgccgaccgaaaaccgaaaacccgaaacgaacgaaaaacgaaaaacgaacccgaaccgcgaaacgcttcctacccgcgccaaccgcccccgaccccgacgcccgaacccgactcaacctcgccgcgcaacccgaaaacgaaacgaaaacgaaacgaaaacgactccgctacgaacacgccctcactccccgccccgaccccgcccgcccccgaaacccccgcctacccctaaccgccctaaaccacgccccgccgtccgcgaatcccgccgcccgcgccctccaaaacccgcccgcgaccccaaaatccctccccgtaaccgccgccgccgtcgctcgctctcctcgctctttcctcccacttaaccgcttaacctacctcgctcgcgcctattttctcttttccgccctctcccccaccccgtctctccctctctctacgtctctcgatctctacgtctctccgtctctatccccaccccaaactccgcgcgtataacgcttctccgaattctacctctacttctccttctccctccgactccgcttcgctctccaatccctaacaaccccgcccccgaccctttctaatctccttctctctcctactccgtttttccgtccctaacgctcgctccctctctccgtaactccctctacctccccctcgaaccctccgtccctctctcgatccctctaaactcccctttccttctccctctaccttcccgaaccctatat

SEQ ID NO: 217 - DNA, 594 bp, Artificial Sequence
  chemically treated genomic DNA (Homo sapiens) CpG-island No: 217
  misc_feature (338)..(338): n is either a, c, g or t
  misc_feature (468)..(468): n is either a, c, g or t
cgggaggatagggtgacggagagtgaggagagagcggaggtggtgcgttatacggcgaagtgagaaggagtagttgggcgtgtagggtgcgtcgagtgtgcgggacgagagtgaaagaatgaagagcgcgagattttgtattttggttgtttatgtgtagaagagtgggaaggcgagttggggagagatgagagggacgcgttaggatgtcgattgtagaacgttaggtagagggcgtgattttaagaggatggggtgttggagggaaggatttcgaagggaggagcgacgaaagagtgaggcgatggtattttgttaggtgtagagagaatagcganggcgggggggggcggaagaagatcggagaggcgagagaggaggagggcgatagaggcggtcggggagagaagtagggggtggggcgtcgacgggggttcgcggggcgttagggggggggggtacggcggnaaggagcggggtaagggggatagaacggcgggggggaaagggcgaggggggacgggggggggaggagtagtcgagggggcgtaacggttttttttttttttttttttttttttttttaagttttat

SEQ ID NO: 218 - DNA, 594 bp, Artificial Sequence
  chemically treated genomic DNA (Homo sapiens) CpG-island No: 218
  misc_feature (127)..(127): n is either a, c, g or t
  misc_feature (257)..(257): n is either a, c, g or t
ataaaacttaaaaaaaaaaaaaaaaaaaaaaaaaaaaaaccgttacgccccctcgactactcctcccccccccgtcccccctcgccctttcccccccgccgttctatcccccttaccccgctccttnccgccgtaccccccccccctaacgccccgcgaacccccgtcgacgccccaccccctacttctctccccgaccgcctctatcgccctcctcctctctcgcctctccgatcttcttccgcccccccccgccntcgctattctctctacacctaacaaaataccatcgcctcactctttcgtcgctcctcccttcgaaatccttccctccaacaccccatcctcttaaaatcacgccctctacctaacgttctacaatcgacatcctaacgcgtccctctcatctctccccaactcgccttcccactcttctacacataaacaaccaaaatacaaaatctcgcgctcttcattctttcactctcgtcccgcacactcgacgcaccctacacgcccaactactccttctcacttcgccgtataacgcaccacctccgctctctcctcactctccgtcaccctatcctcccg

SEQ ID NO: 219 - DNA, 594 bp, Artificial Sequence
  chemically treated genomic DNA (Homo sapiens) CpG-island No: 219
  misc_feature (127)..(127): n is either a, c, g or t
  misc_feature (257)..(257): n is either a, c, g or t
atagggtttaaggaaaggaagaaaggaggaaaggaaggatcgttgcgttttttcggttgtttttttttttttcgttttttttcgttttttttttttcgtcgttttgttttttttgtttcgttttttntcgtcgtgttttttttttttggcgtttcgcgggttttcgtcggcgttttattttttgttttttttttcgatcgtttttgtcgttttttttttttttcgttttttcggttttttttcgttttttttcgttntcgttgttttttttgtatttggtaaagtgttatcgttttattttttcgtcgttttttttttcggagtttttttttttagtattttatttttttagagttacgttttttatttgacgttttatagtcggtattttagcgcgttttttttatttttttttagttcgtttttttatttttttgtatatgggtagttaggatgtaagatttcgcgttttttatttttttattttcgtttcgtatattcggcgtattttgtacgtttagttgtttttttttatttcgtcgtgtgacgtattattttcgttttttttttatttttcgttattttgttttttcg

SEQ ID NO: 220 - DNA, 594 bp, Artificial Sequence
  chemically treated genomic DNA (Homo sapiens) CpG-island No: 220
  misc_feature (338)..(338): n is either a, c, g or t
  misc_feature (468)..(468): n is either a, c, g or t
cgaaaaaacaaaataacgaaaaataaaaaaaaaacgaaaataatacgtcacacgacgaaataaaaaaaaacaactaaacgtacaaaatacgccgaatatacgaaacgaaaataaaaaaataaaaaacgcgaaatcttacatcctaactacccatatacaaaaaaataaaaaaacgaactaaaaaaaaataaaaaaaacgcgctaaaataccgactataaaacgtcaaataaaaaacgtaactctaaaaaaataaaatactaaaaaaaaaaactccgaaaaaaaaaacgacgaaaaaataaaacgataacactttaccaaatacaaaaaaaacaacganaacgaaaaaaaacgaaaaaaaaccgaaaaaacgaaaaaaaaaaaaaacgacaaaaacgatcgaaaaaaaaaacaaaaaataaaacgccgacgaaaacccgcgaaacgccaaaaaaaaaaaacacgacganaaaaaacgaaacaaaaaaaacaaaacgacgaaaaaaaaaaaacgaaaaaaaacgaaaaaaaaaaaaacaaccgaaaaaacgcaacgatccttcctttcctcctttcttcctttccttaaaccctat

SEQ ID NO: 221 - DNA, 526 bp, Artificial Sequence
  chemically treated genomic DNA (Homo sapiens) CpG-island No: 221
  misc_feature (107)..(107): n is either a, c, g or t
  misc_feature (305)..(305): n is either a, c, g or t
  misc_feature (360)..(360): n is either a, c, g or t
attacggaaaaggcgcgagagagtgcgtaaatcgcgataggcgcgacgtagatagataggttatacggtacgacgacgcgaggggacgattcggtcgaggaagacgngcgttatcgcgggtcggcgaggagcggaagggcgggcgtcgtaggtgcgcgttagggagagtatatatcgataggggcgtagcgacgtggtacgtaagagcgacggcggagcgtaaaggtagtttatttcggagttttagagtcgtcggtcgcggagagcgcgacgggtcgcgcggaattaggagggtcgcgttacgnggcggtagaagatcgtttcgtgtcgtttcgaaaaagagggatttttcgcgaaggngtgggtttcggacgaatcgattttcgttgacgagaaagtgcgggatcgatattaaaagggtaaggatcgtttatattaaaggggggtcgggcgaagtcgatgggttaaatgattttttcggggtttttatttcgggaaaagaattcggatttgagggttgggaagg

SEQ ID NO: 222 - DNA, 526 bp, Artificial Sequence
  chemically treated genomic DNA (Homo sapiens) CpG-island No: 222
  misc_feature (167)..(167): n is either a, c, g or t
  misc_feature (222)..(222): n is either a, c, g or t
  misc_feature (420)..(420): n is either a, c, g or t
ccttcccaaccctcaaatccgaattcttttcccgaaataaaaaccccgaaaaaatcatttaacccatcgacttcgcccgacccccctttaatataaacgatccttacccttttaatatcgatcccgcactttctcgtcaacgaaaatcgattcgtccgaaacccacnccttcgcgaaaaatccctctttttcgaaacgacacgaaacgatcttctaccgccncgtaacgcgaccctcctaattccgcgcgacccgtcgcgctctccgcgaccgacgactctaaaactccgaaataaactacctttacgctccgccgtcgctcttacgtaccacgtcgctacgcccctatcgatatatactctccctaacgcgcacctacgacgcccgcccttccgctcctcgccgacccgcgataacgcncgtcttcctcgaccgaatcgtcccctcgcgtcgtcgtaccgtataacctatctatctacgtcgcgcctatcgcgatttacgcactctctcgcgccttttccgtaat

SEQ ID NO: 223 - DNA, 526 bp, Artificial Sequence
  chemically treated genomic DNA (Homo sapiens) CpG-island No: 223
  misc_feature (167)..(167): n is either a, c, g or t
  misc_feature (222)..(222): n is either a, c, g or t
  misc_feature (420)..(420): n is either a, c, g or t
tttttttaatttttaggttcgggtttttttttcggggtgggggtttcgggggggttatttaatttatcggtttcgttcggtttttttttaatgtaagcggtttttgtttttttgatgtcgatttcgtattttttcgttaacgggaatcggttcgttcggggtttatnttttcgcggggggtttttttttttcggggcgatacggagcggttttttgtcgttncgtggcgcggtttttttgatttcgcgcggttcgtcgcgtttttcgcggtcggcggttttgggatttcggggtggattgtttttgcgtttcgtcgtcgtttttgcgtgttacgtcgttgcgtttttgtcggtgtatgttttttttggcgcgtatttacggcgttcgttttttcgtttttcgtcggttcgcggtggcgtncgtttttttcggtcgggtcgttttttcgcgtcgtcgtgtcgtgtggtttgtttgtttgcgtcgcgtttgtcgcggtttgcgtattttttcgcgtttttttcgtgat

SEQ ID NO: 224 - DNA, 526 bp, Artificial Sequence
  chemically treated genomic DNA (Homo sapiens) CpG-island No: 224
  misc_feature (107)..(107): n is either a, c, g or t
  misc_feature (305)..(305): n is either a, c, g or t
  misc_feature (360)..(360): n is either a, c, g or t
atcacgaaaaaaacgcgaaaaaatacgcaaaccgcgacaaacgcgacgcaaacaaacaaaccacacgacacgacgacgcgaaaaaacgacccgaccgaaaaaaacgnacgccaccgcgaaccgacgaaaaacgaaaaaacgaacgccgtaaatacgcgccaaaaaaaacatacaccgacaaaaacgcaacgacgtaacacgcaaaaacgacgacgaaacgcaaaaacaatccaccccgaaatcccaaaaccgccgaccgcgaaaaacgcgacgaaccgcgcgaaatcaaaaaaaccgcgccacgnaacgacaaaaaaccgctccgtatcgccccgaaaaaaaaaaaccccccgcgaaaanataaaccccgaacgaaccgattcccgttaacgaaaaaatacgaaatcgacatcaaaaaaacaaaaaccgcttacattaaaaaaaaaccgaacgaaaccgataaattaaataacccccccgaaacccccaccccgaaaaaaaaacccgaacctaaaaattaaaaaaa

SEQ ID NO: 225 - DNA, 574 bp, Artificial Sequence
  chemically treated genomic DNA (Homo sapiens) CpG-island No: 225
cggttttagagtttttttttacgttgtcggttatggtttgggtagggtcggagtttaggcgggttcgtcggttcggttcgattgcgagcgagggagagaaataaggcgtgaaggaggggtttttttcggtcgtcgtcgtcgtcgtcgtcgtcgtcgtcgtcgtcgtcgtcggttattcgggcggagggaggagcggtcgtggggaggggagtgggcggcgtcgggagtgcgcgggacgcgtttttttagagcgcgcgagttcggggcgggcggggcgcgtttcggaggcggatcggtttattggtaagttcggggaagcggtcggtcgcggtcggattgggtagcgacgattttcgggttatcggtttcgagtagttcgcgtgtttatagttttcggaaagtcgcggttaggtttttgtgttcgtttttttcgtttttacgtcggggcggggcggggttaggttggggcggggtcggcggaatttttgggtttgcgttttttgttggagaaacggggaaaggagcggcggggggttggggagtaggtttaaggtggagtttgcgtagtagttag

SEQ ID NO: 226 - DNA, 574 bp, Artificial Sequence
  chemically treated genomic DNA (Homo sapiens) CpG-island No: 226
ctaactactacgcaaactccaccttaaacctactccccaaccccccgccgctcctttccccgtttctccaacaaaaaacgcaaacccaaaaattccgccgaccccgccccaacctaaccccgccccgccccgacgtaaaaacgaaaaaaacgaacacaaaaacctaaccgcgactttccgaaaactataaacacgcgaactactcgaaaccgataacccgaaaatcgtcgctacccaatccgaccgcgaccgaccgcttccccgaacttaccaataaaccgatccgcctccgaaacgcgccccgcccgccccgaactcgcgcgctctaaaaaaacgcgtcccgcgcactcccgacgccgcccactcccctccccacgaccgctcctccctccgcccgaataaccgacgacgacgacgacgacgacgacgacgacgacgacgacgaccgaaaaaaacccctccttcacgccttatttctctccctcgctcgcaatcgaaccgaaccgacgaacccgcctaaactccgaccctacccaaaccataaccgacaacgtaaaaaaaaactctaaaaccg

SEQ ID NO: 227 - DNA, 574 bp, Artificial Sequence
  chemically treated genomic DNA (Homo sapiens) CpG-island No: 227
ttggttattgcgtagattttattttggatttattttttaatttttcgtcgttttttttttcgtttttttagtagagggcgtaggtttaaaggtttcgtcgatttcgttttagtttggtttcgtttcgtttcggcgtaggggcggggaagacgggtatagaaatttggtcgcggtttttcgggagttgtgggtacgcgagttgttcgaagtcggtggttcggggatcgtcgttgtttagttcggtcgcggtcggtcgttttttcgagtttattagtaagtcggttcgttttcgggacgcgtttcgttcgtttcgggttcgcgcgttttgaaggggcgcgtttcgcgtattttcggcgtcgtttatttttttttttacggtcgttttttttttcgttcggatagtcggcggcggcggcggcggcggcggcggcggcggcggcggcggtcgggagaggttttttttttacgttttgtttttttttttcgttcgtagtcgagtcgagtcggcggattcgtttgggtttcgattttgtttaggttatggtcggtaacgtgaagaagagttttggggtcg

SEQ ID NO: 228 - DNA, 574 bp, Artificial Sequence
  chemically treated genomic DNA (Homo sapiens) CpG-island No: 228
cgaccccaaaactcttcttcacgttaccgaccataacctaaacaaaatcgaaacccaaacgaatccgccgactcgactcgactacgaacgaaaaaaaaaaacaaaacgtaaaaaaaaaacctctcccgaccgccgccgccgccgccgccgccgccgccgccgccgccgccgactatccgaacgaaaaaaaaaacgaccgtaaaaaaaaaaataaacgacgccgaaaatacgcgaaacgcgccccttcaaaacgcgcgaacccgaaacgaacgaaacgcgtcccgaaaacgaaccgacttactaataaactcgaaaaaacgaccgaccgcgaccgaactaaacaacgacgatccccgaaccaccgacttcgaacaactcgcgtacccacaactcccgaaaaaccgcgaccaaatttctatacccgtcttccccgcccctacgccgaaacgaaacgaaaccaaactaaaacgaaatcgacgaaacctttaaacctacgccctctactaaaaaaacgaaaaaaaaaacgacgaaaaattaaaaaataaatccaaaataaaatctacgcaataaccaa

SEQ ID NO: 229 - DNA, 727 bp, Artificial Sequence
  chemically treated genomic DNA (Homo sapiens) CpG-island No: 229
gcggattacgggaaggcggataggatgatgttttatgttttcggttgcgttttattttttattttttggcgcgacgtttaggtcggtttttttcgtcggtattttcgggttcgcgtgtttcgggttgtttttaaagttaggcgtattattcggatttaaaattaagcgttttacggtagtttaagttttcgttttatttttcgtatgtttagttattttgacgcgttttcgggtcggtgcggggtcgggatgtttagcgttgttacggatcggggacggagagtcggggttttttttatttgtttcgggttgcggtattcgcgtttcggttttcggtttcggcggttcgggtcggggcggggtaggggcggggtaggcgaggtaggagggtcggttttcggttcggaggagacggtaaggatggtgagaggcggttggggtcgcgttttgattttgttgggttgtgtatattcgttttttagagtttggtttcggacgatgtgtttttcgagttcgcggggcgattgcgtttttttattagttattgttcgtcggtttcgtcgtttttaaagggttcgcgtcgttcggtagttcgcggggggcgaggacggtaaaggagagagtagcgtttgcggcgcgggggtcggaggaggtgtaggggtgaatttaggattgggggttgatggtaaagggtcgatttggaggtagtgaggaaaggagagttgga

SEQ ID NO: 230 - DNA, 727 bp, Artificial Sequence
  chemically treated genomic DNA (Homo sapiens) CpG-island No: 230
tccaactctcctttcctcactacctccaaatcgaccctttaccatcaacccccaatcctaaattcacccctacacctcctccgacccccgcgccgcaaacgctactctctcctttaccgtcctcgccccccgcgaactaccgaacgacgcgaaccctttaaaaacgacgaaaccgacgaacaataactaataaaaaaacgcaatcgccccgcgaactcgaaaaacacatcgtccgaaaccaaactctaaaaaacgaatatacacaacccaacaaaatcaaaacgcgaccccaaccgcctctcaccatccttaccgtctcctccgaaccgaaaaccgaccctcctacctcgcctaccccgcccctaccccgccccgacccgaaccgccgaaaccgaaaaccgaaacgcgaataccgcaacccgaaacaaataaaaaaaaccccgactctccgtccccgatccgtaacaacgctaaacatcccgaccccgcaccgacccgaaaacgcgtcaaaataactaaacatacgaaaaataaaacgaaaacttaaactaccgtaaaacgcttaattttaaatccgaataatacgcctaactttaaaaacaacccgaaacacgcgaacccgaaaataccgacgaaaaaaaccgacctaaacgtcgcgccaaaaaataaaaaataaaacgcaaccgaaaacataaaacatcatcctatccgccttcccgtaatccgc

SEQ ID NO: 231 - DNA, 727 bp, Artificial Sequence
  chemically treated genomic DNA (Homo sapiens) CpG-island No: 231
tttagtttttttttttttattgtttttaagtcggttttttgttattaatttttagttttgagtttatttttgtatttttttcggttttcgcgtcgtaagcgttgtttttttttttgtcgttttcgtttttcgcgggttgtcgggcggcgcgggttttttaagaacggcgggatcggcgagtagtagttggtaggagagcgtagtcgtttcgcgggttcggaggatatatcgttcgggattaggttttgggaagcgggtgtgtatagtttagtagagttagggcgcgattttaatcgttttttattatttttgtcgtttttttcgagtcgagggtcggtttttttgtttcgtttgtttcgtttttgtttcgtttcggttcgggtcgtcgggatcgggagtcgggacgcgggtgtcgtagttcgaggtaggtaaggggagtttcggtttttcgttttcggttcgtggtagcgttgagtatttcggtttcgtatcggttcgggggcgcgttaaggtgattaggtatgcgggagatggggcgggggtttgagttgtcgtggggcgtttagttttgagttcgggtggtgcgtttggttttggggatagttcggggtacgcgggttcgggggtgtcggcgggaggggtcggtttgggcgtcgcgttaagggatggggagtgggacgtagtcggaggtatgaagtattattttattcgttttttcgtggttcgt

SEQ ID NO: 232 - DNA, 727 bp, Artificial Sequence
  chemically treated genomic DNA (Homo sapiens) CpG-island No: 232
acgaaccacgaaaaaacgaataaaataatacttcatacctccgactacgtcccactccccatcccttaacgcgacgcccaaaccgacccctcccgccgacacccccgaacccgcgtaccccgaactatccccaaaaccaaacgcaccacccgaactcaaaactaaacgccccacgacaactcaaacccccgccccatctcccgcatacctaatcaccttaacgcgcccccgaaccgatacgaaaccgaaatactcaacgctaccacgaaccgaaaacgaaaaaccgaaactccccttacctacctcgaactacgacacccgcgtcccgactcccgatcccgacgacccgaaccgaaacgaaacaaaaacgaaacaaacgaaacaaaaaaaccgaccctcgactcgaaaaaaacgacaaaaataataaaaaacgattaaaatcgcgccctaactctactaaactatacacacccgcttcccaaaacctaatcccgaacgatatatcctccgaacccgcgaaacgactacgctctcctaccaactactactcgccgatcccgccgttcttaaaaaacccgcgccgcccgacaacccgcgaaaaacgaaaacgacaaaaaaaaaaacaacgcttacgacgcgaaaaccgaaaaaaatacaaaaataaactcaaaactaaaaattaataacaaaaaaccgacttaaaaacaataaaaaaaaaaaaactaaa

SEQ ID NO: 233 - DNA, 691 bp, Artificial Sequence
  chemically treated genomic DNA (Homo sapiens) CpG-island No: 233
gacgtttttttgggcgatcgttacgtcgtttagtagtttgttgagtttttcgtcgttgcggatggttagttgtaggtggcgggggatgattcgcgtttttttgttgtcgcgggtcgtattgttcgttagttttaggattttagcggtgaggtattttagtattgtcgttaggtatattggcgcgtcggcgttaacgcgttcggcgtagtggttttttcgtagtagtcggtgtatacggtttattgggaattggaggtcggcgcgcgacgagcgcgatttggttttggcgcgggttttgtcgttagttttgtcgcggttcgatatgttagcgaggtagatcggtgaagtacgacggtttaaatattagaatagacgttcgtcgtagtgtaattgttgtcgcgcgcgcgtcgcgaggtcgtttttataagtttttaggatatatttttgcgtttttttgattggtttttttttttaatattcgttttcggttggttgcggttaatttttgggtgtcgcggttcggttgagggagcgcgttcgttgattggtcgaatttgaaaattttttgttcggggagaaaaggcgaggaggaggggtagtacgtagattgttaattattcgttgatgtagttaatttttgtaaagcgcgcgagatttaaatattataatcggaaattagaagcggaagatt

SEQ ID NO: 234 - DNA, 691 bp, Artificial Sequence
  chemically treated genomic DNA (Homo sapiens) CpG-island No: 234
aatcttccgcttctaatttccgattataatatttaaatctcgcgcgctttacaaaaattaactacatcaacgaataattaacaatctacgtactacccctcctcctcgccttttctccccgaacaaaaaattttcaaattcgaccaatcaacgaacgcgctccctcaaccgaaccgcgacacccaaaaattaaccgcaaccaaccgaaaacgaatattaaaaaaaaaaaccaatcaaaaaaacgcaaaaatatatcctaaaaacttataaaaacgacctcgcgacgcgcgcgcgacaacaattacactacgacgaacgtctattctaatatttaaaccgtcgtacttcaccgatctacctcgctaacatatcgaaccgcgacaaaactaacgacaaaacccgcgccaaaaccaaatcgcgctcgtcgcgcgccgacctccaattcccaataaaccgtatacaccgactactacgaaaaaaccactacgccgaacgcgttaacgccgacgcgccaatatacctaacgacaatactaaaatacctcaccgctaaaatcctaaaactaacgaacaatacgacccgcgacaacaaaaaaacgcgaatcatcccccgccacctacaactaaccatccgcaacgacgaaaaactcaacaaactactaaacgacgtaacgatcgcccaaaaaaacgtc

SEQ ID NO: 235 - DNA, 691 bp, Artificial Sequence
  chemically treated genomic DNA (Homo sapiens) CpG-island No: 235
ggtttttcgtttttggttttcgattgtagtgtttaaatttcgcgcgttttataaggattggttatattagcggatagttggtagtttgcgtgttatttttttttttcgtttttttttttcgggtaaaaggtttttaaattcgattaattagcgggcgcgtttttttagtcgagtcgcgatatttaagggttaatcgtaattaatcggaggcgggtattggagaaaagagttaattaggagggcgtagaggtgtgttttgggggtttataaaggcggtttcgcggcgcgcgcgcgatagtagttatattgcggcgggcgtttgttttagtgtttgagtcgtcgtgttttatcggtttatttcgttagtatgtcgggtcgcggtaagattggcggtaaggttcgcgttaaggttaagtcgcgttcgtcgcgcgtcggtttttagtttttagtgggtcgtgtatatcggttgttgcggaagggttattacgtcgagcgcgttggcgtcggcgcgttagtgtatttggcggtagtgttggagtattttatcgttgagattttggagttggcgggtaatgcggttcgcgataataagaagacgcgaattatttttcgttatttgtagttggttattcgtaacgacgaggagtttaataagttgttgggcggcgtgacgatcgtttagggaggcgtt

SEQ ID NO: 236 - DNA, 691 bp, Artificial Sequence
  chemically treated genomic DNA (Homo sapiens) CpG-island No: 236
aacgcctccctaaacgatcgtcacgccgcccaacaacttattaaactcctcgtcgttacgaataaccaactacaaataacgaaaaataattcgcgtcttcttattatcgcgaaccgcattacccgccaactccaaaatctcaacgataaaatactccaacactaccgccaaatacactaacgcgccgacgccaacgcgctcgacgtaataacccttccgcaacaaccgatatacacgacccactaaaaactaaaaaccgacgcgcgacgaacgcgacttaaccttaacgcgaaccttaccgccaatcttaccgcgacccgacatactaacgaaataaaccgataaaacacgacgactcaaacactaaaacaaacgcccgccgcaatataactactatcgcgcgcgcgccgcgaaaccgcctttataaacccccaaaacacacctctacgccctcctaattaactcttttctccaatacccgcctccgattaattacgattaacccttaaatatcgcgactcgactaaaaaaacgcgcccgctaattaatcgaatttaaaaaccttttacccgaaaaaaaaaaacgaaaaaaaaaaataacacgcaaactaccaactatccgctaatataaccaatccttataaaacgcgcgaaatttaaacactacaatcgaaaaccaaaaacgaaaaacc

SEQ ID NO: 237 - DNA, 938 bp, Artificial Sequence
  chemically treated genomic DNA (Homo sapiens) CpG-island No: 237
gttgttagttttttcggaaagagttgaaggcgaagagtgacgttaggaggtttcggatttttggtttttcggcggcgttagttcgagtcgttcgtagtcgtagtagcgagcgttatacgtttagttttcgtagggaattcgcgggtttttcggttaaggcgggtttcgggtttcggttttcgcgggttcgcgttagttataagtttcgggtatattgtagtagttaggcgaatatcgtgagtagcgaggcggcgaagaggattagtaaggtcgtttagtttacgtttcgttgtttttagttcggatttatgtttcgcgcgggtttcgatttcggtttcggttggggtttagtcgttgtttcgggggagtatggttcgggcgggtcgcggggaggaggtgggttttttcggggttgggcgcgcggggtcgggggtttttcgcgattgagtgtttaggattagtgggtgttatagggcgaggagaggaggttttcgggggtcgcgatgtcggggtttttgttttcgtggttcgggttttttttagtttggttagtagtcggattcgttagtcgtcggttagtgttcgattttttttatcgcgcgggtttcgtcggattttggaggggattggtttgtagagacgttggggttcgcgggtcggtatcggtttcgggagggttgcgtgcgtagagttgatattgataatatcgtcggcgtttcgtttttattcgtttttaaaggagtcgtattcgcgtcgggcggggttaggatagtttggcgttttttcgttggaggagggcgggagggttagtagcgagcggaggaggtttcggggtggaaaataggcgggatttttgattatttcgttttattttgtaatcgcggtgtttttatatttagtttaaggtaagagtaattttatttatttaagatgttgtt

SEQ ID NO: 238 - DNA, 938 bp, Artificial Sequence
  chemically treated genomic DNA (Homo sapiens) CpG-island No: 238
aacaacatcttaaataaataaaattactcttaccttaaactaaatataaaaacaccgcgattacaaaataaaacgaaataatcaaaaatcccgcctattttccaccccgaaacctcctccgctcgctactaaccctcccgccctcctccaacgaaaaaacgccaaactatcctaaccccgcccgacgcgaatacgactcctttaaaaacgaataaaaacgaaacgccgacgatattatcaatatcaactctacgcacgcaaccctcccgaaaccgataccgacccgcgaaccccaacgtctctacaaaccaatcccctccaaaatccgacgaaacccgcgcgataaaaaaaatcgaacactaaccgacgactaacgaatccgactactaaccaaactaaaaaaaacccgaaccacgaaaacaaaaaccccgacatcgcgacccccgaaaacctcctctcctcgccctataacacccactaatcctaaacactcaatcgcgaaaaacccccgaccccgcgcgcccaaccccgaaaaaacccacctcctccccgcgacccgcccgaaccatactcccccgaaacaacgactaaaccccaaccgaaaccgaaatcgaaacccgcgcgaaacataaatccgaactaaaaacaacgaaacgtaaactaaacgaccttactaatcctcttcgccgcctcgctactcacgatattcgcctaactactacaatatacccgaaacttataactaacgcgaacccgcgaaaaccgaaacccgaaacccgccttaaccgaaaaacccgcgaattccctacgaaaactaaacgtataacgctcgctactacgactacgaacgactcgaactaacgccgccgaaaaaccaaaaatccgaaacctcctaacgtcactcttcgccttcaactctttccgaaaaaactaacaac

SEQ ID NO: 239 - DNA, 938 bp, Artificial Sequence
  chemically treated genomic DNA (Homo sapiens) CpG-island No: 239
ggtagtattttaggtaagtgaagttatttttgttttgagttgagtgtgggagtatcgcgattgtaagatggggcgaggtgattaaagatttcgtttattttttatttcggaatttttttcgttcgttgttagttttttcgtttttttttagcgagggagcgttaggttgttttggtttcgttcggcgcgggtgcggtttttttaagggcgggtgggggcggggcgtcggcggtgttgttagtgttagttttgcgtacgtagttttttcggagtcggtgtcggttcgcgagttttagcgtttttgtagattagttttttttagggttcggcggggttcgcgcggtgggaggagtcgggtattggtcggcgattaacgggttcgattgttgattaagttaggagagattcggattacggagatagagatttcggtatcgcgattttcgaggatttttttttttcgttttgtggtatttattagttttgggtatttagtcgcggagagttttcgatttcgcgcgtttagtttcgggggagtttatttttttttcgcggttcgttcgggttatgttttttcggggtagcggttgagttttagtcgggatcgggatcggagttcgcgcggagtatggattcgggttgggggtagcgggacgtgggttgggcggttttgttgatttttttcgtcgtttcgttgtttacggtgttcgtttggttgttgtaatatgttcggggtttgtggttggcgcgggttcgcggggatcggggttcgggattcgttttagtcggggaattcgcgggttttttgcgggagttgggcgtgtggcgttcgttgttgcggttgcgggcgattcgggttggcgtcgtcgaggagttaggagttcggggttttttggcgttatttttcgtttttaatttttttcgggagaattggtagt

SEQ ID NO: 240 - DNA, 938 bp, Artificial Sequence
  chemically treated genomic DNA (Homo sapiens) CpG-island No: 240
actaccaattctcccgaaaaaaattaaaaacgaaaaataacgccaaaaaaccccgaactcctaactcctcgacgacgccaacccgaatcgcccgcaaccgcaacaacgaacgccacacgcccaactcccgcaaaaaacccgcgaattccccgactaaaacgaatcccgaaccccgatccccgcgaacccgcgccaaccacaaaccccgaacatattacaacaaccaaacgaacaccgtaaacaacgaaacgacgaaaaaaatcaacaaaaccgcccaacccacgtcccgctacccccaacccgaatccatactccgcgcgaactccgatcccgatcccgactaaaactcaaccgctaccccgaaaaaacataacccgaacgaaccgcgaaaaaaaaataaactcccccgaaactaaacgcgcgaaatcgaaaactctccgcgactaaatacccaaaactaataaataccacaaaacgaaaaaaaaaaatcctcgaaaatcgcgataccgaaatctctatctccgtaatccgaatctctcctaacttaatcaacaatcgaacccgttaatcgccgaccaatacccgactcctcccaccgcgcgaaccccgccgaaccctaaaaaaaactaatctacaaaaacgctaaaactcgcgaaccgacaccgactccgaaaaaactacgtacgcaaaactaacactaacaacaccgccgacgccccgcccccacccgcccttaaaaaaaccgcacccgcgccgaacgaaaccaaaacaacctaacgctccctcgctaaaaaaaaacgaaaaaactaacaacgaacgaaaaaaattccgaaataaaaaataaacgaaatctttaatcacctcgccccatcttacaatcgcgatactcccacactcaactcaaaacaaaaataacttcacttacctaaaatactacc

SEQ ID NO: 241 - DNA, 530 bp, Artificial Sequence
  chemically treated genomic DNA (Homo sapiens) CpG-island No: 241
  misc_feature (234)..(234): n is either a, c, g or t
tagggaggggggacgatggcgggacgggtggcgtcggggttttagttttgcgtttgtttcggagtatcgggtttttttcgttgattttttcgttttaggatttcgtaggttcgagtgtttgggttcgttttttttcgcgttcgttgttaggtgttagggtcgcgtaggcgggcggaggtgggtaggaagcgttacgtcgaggagtcgggattttgggagttagcgggagacgtnggtttcgttttaagtcgatttttttgggtcgcggttgacggttttcggaattgggtattcgcgggtaaaggtttagcgggtttgataatttttgcgttatggttgggaggtcgcgttgagcggggggtagggcgggtcgggggaggaggttgtgtaagggtcgcggggagatttcggtcgagaacgagagggacggagttgggcgttgaatggcgggcgttttggtaagtttttttttgcgttttcgaggttattcgaaagtaggagagttgtttgggatttagtttggtggagga

SEQ ID NO: 242 - DNA, 530 bp, Artificial Sequence
  chemically treated genomic DNA (Homo sapiens) CpG-island No: 242
  misc_feature (297)..(297): n is either a, c, g or t
tcctccaccaaactaaatcccaaacaactctcctactttcgaataacctcgaaaacgcaaaaaaaaacttaccaaaacgcccgccattcaacgcccaactccgtccctctcgttctcgaccgaaatctccccgcgacccttacacaacctcctcccccgacccgccctaccccccgctcaacgcgacctcccaaccataacgcaaaaattatcaaacccgctaaacctttacccgcgaatacccaattccgaaaaccgtcaaccgcgacccaaaaaaatcgacttaaaacgaaaccnacgtctcccgctaactcccaaaatcccgactcctcgacgtaacgcttcctacccacctccgcccgcctacgcgaccctaacacctaacaacgaacgcgaaaaaaaacgaacccaaacactcgaacctacgaaatcctaaaacgaaaaaatcaacgaaaaaaacccgatactccgaaacaaacgcaaaactaaaaccccgacgccacccgtcccgccatcgtcccccctcccta

SEQ ID NO: 243 - DNA, 530 bp, Artificial Sequence
  chemically treated genomic DNA (Homo sapiens) CpG-island No: 243
  misc_feature (297)..(297): n is either a, c, g or t
ttttttattaaattgggttttaaatagtttttttattttcgggtggtttcgggaacgtagggggagatttgttagaacgttcgttatttagcgtttagtttcgtttttttcgttttcggtcgggattttttcgcggtttttgtatagttttttttttcggttcgttttgtttttcgtttagcgcggttttttagttatggcgtaagggttattaagttcgttaggtttttattcgcggatgtttagtttcgggagtcgttagtcgcggtttagaggggtcggtttgggacgaaattngcgtttttcgttagtttttagagtttcggtttttcggcgtggcgttttttgtttattttcgttcgtttgcgcggttttggtatttggtagcgggcgcgaaagaggacgagtttaggtattcgggtttgcggggttttgggacgagggggttagcgagaggggttcggtgtttcggagtaggcgtagggttggaatttcggcgttattcgtttcgttatcgttttttttttttg

SEQ ID NO: 244 - DNA, 530 bp, Artificial Sequence
  chemically treated genomic DNA (Homo sapiens) CpG-island No: 244
  misc_feature (234)..(234): n is either a, c, g or t
caaaaaaaaaaaacgataacgaaacgaataacgccgaaattccaaccctacgcctactccgaaacaccgaacccctctcgctaaccccctcgtcccaaaaccccgcaaacccgaatacctaaactcgtcctctttcgcgcccgctaccaaataccaaaaccgcgcaaacgaacgaaaataaacaaaaaacgccacgccgaaaaaccgaaactctaaaaactaacgaaaaacgcnaatttcgtcccaaaccgacccctctaaaccgcgactaacgactcccgaaactaaacatccgcgaataaaaacctaacgaacttaataacccttacgccataactaaaaaaccgcgctaaacgaaaaacaaaacgaaccgaaaaaaaaaactatacaaaaaccgcgaaaaaatcccgaccgaaaacgaaaaaaacgaaactaaacgctaaataacgaacgttctaacaaatctccccctacgttcccgaaaccacccgaaaataaaaaaactatttaaaacccaatttaataaaaaa

SEQ ID NO: 245 - DNA, 940 bp, Artificial Sequence
  chemically treated genomic DNA (Homo sapiens) CpG-island No: 245
tagttgtcggcgcggtgtttagggcggtatttcgttcggttttggtttttttagttttgggttcgatttttattacgtttttgtttcgacgcgaacgcggagttcgagcgcgcgttacgtcgtgtggggtcgaagaggttgttatttatacgcggagtgcgggttcgcgagggtttttattcgattttcgttttcgttagtatttacggattcgcgttttcgtcgcgcgtcgattttggagtattatcgttttcggtatacgagtttcgtacgttttttatttaataggaagttgggtggaagtagcgcggatttacggcgtatcgaacgtattttaatagaattcgacgtagatacgcgtttttaatcggcggagatattggtagggttagaaacgcgcgtagcgggggcgggaggtcggtaagtttttcgtttttgttcgaaatttcgtttcggttcggttcggtttcgtttttttttttgttttttttttttgtacgtacgcgtttcgtttttcgcgcgacgttttttgttgattcggaaacggattattcggagttaaggttcgttcgggtgagtgtttttcgttttttgtggttaaatttagttacgtagttttttttttgcggcgttttttatattcggggtttgttggttttcgcggatgttataggttcggtaatcgtttttttgtcggcggggagtttcgagacgttcggaaatgtttcgaagtttgtcgtttagttgttagatttgcgtttgtgttcggtttcgttattgaagtcgtttttgttcggttttttttttttagttttttttatcgttcgtttattttgtcgcgcgtcgcgttaggtttttattcggtatgtggtttgttttttatcgtttttattttcgttttttttggttttttagggtagttttgggattcggtagacgt

SEQ ID NO: 246 - DNA, 940 bp, Artificial Sequence
  chemically treated genomic DNA (Homo sapiens) CpG-island No: 246
acgtctaccgaatcccaaaactaccctaaaaaaccaaaaaaaacgaaaataaaaacgataaaaaacaaaccacataccgaataaaaacctaacgcgacgcgcgacaaaataaacgaacgataaaaaaaactaaaaaaaaaaaaccgaacaaaaacgacttcaataacgaaaccgaacacaaacgcaaatctaacaactaaacgacaaacttcgaaacatttccgaacgtctcgaaactccccgccgacaaaaaaacgattaccgaacctataacatccgcgaaaaccaacaaaccccgaatataaaaaacgccgcaaaaaaaaaactacgtaactaaatttaaccacaaaaaacgaaaaacactcacccgaacgaaccttaactccgaataatccgtttccgaatcaacaaaaaacgtcgcgcgaaaaacgaaacgcgtacgtacaaaaaaaaaaaacaaaaaaaaaaacgaaaccgaaccgaaccgaaacgaaatttcgaacaaaaacgaaaaacttaccgacctcccgcccccgctacgcgcgtttctaaccctaccaatatctccgccgattaaaaacgcgtatctacgtcgaattctattaaaatacgttcgatacgccgtaaatccgcgctacttccacccaacttcctattaaataaaaaacgtacgaaactcgtataccgaaaacgataatactccaaaatcgacgcgcgacgaaaacgcgaatccgtaaatactaacgaaaacgaaaatcgaataaaaaccctcgcgaacccgcactccgcgtataaataacaacctcttcgaccccacacgacgtaacgcgcgctcgaactccgcgttcgcgtcgaaacaaaaacgtaataaaaatcgaacccaaaactaaaaaaaccaaaaccgaacgaaataccgccctaaacaccgcgccgacaacta

SEQ ID NO: 247 - DNA, 940 bp, Artificial Sequence
  chemically treated genomic DNA (Homo sapiens) CpG-island No: 247
gcgtttgtcgaattttagggttgttttgaggggttaagaggggcgagggtggggacgatggaagataagttatatgtcgaatggggatttgacgcggcgcgcgataggatgggcggacggtgaagagaattagggaggaagggtcggataggggcgattttagtgacggaatcggatatagacgtagatttggtagttgagcgataggtttcggagtattttcgggcgtttcgggatttttcgtcgataggagggcggttgtcgagtttgtgatattcgcggagattagtagatttcgggtgtggaggacgtcgtagggaggggattgcgtggttgggtttggttataaaaagcggagggtatttattcgagcggattttggtttcggataattcgttttcgggttaataaaaaacgtcgcgcgaggggcggggcgcgtacgtgtagggaggggaggtagagaaaaaggcggggtcgggtcgggtcggggcggggtttcgggtaggggcggggagtttatcgatttttcgttttcgttgcgcgcgtttttggttttgttagtgttttcgtcggttgaaagcgcgtgtttgcgtcgggttttgttggagtgcgttcgatgcgtcgtgggttcgcgttgtttttatttaattttttgttaggtaagaggcgtgcgaggttcgtgtgtcgggggcggtgatgttttagagtcggcgcgcggcggggacgcgagttcgtaggtgttggcgggagcgagagtcgggtggggattttcgcgagttcgtatttcgcgtgtgggtagtagttttttcggttttatacggcgtgacgcgcgttcgggtttcgcgttcgcgtcgaggtagaggcgtagtaggggtcgggtttagggttggaggggttaggatcgggcggggtgtcgttttggatatcgcgtcggtagttg

SEQ ID NO: 248 - DNA, 940 bp, Artificial Sequence
  chemically treated genomic DNA (Homo sapiens) CpG-island No: 248
caactaccgacgcgatatccaaaacgacaccccgcccgatcctaacccctccaaccctaaacccgacccctactacgcctctacctcgacgcgaacgcgaaacccgaacgcgcgtcacgccgtataaaaccgaaaaaactactacccacacgcgaaatacgaactcgcgaaaatccccacccgactctcgctcccgccaacacctacgaactcgcgtccccgccgcgcgccgactctaaaacatcaccgcccccgacacacgaacctcgcacgcctcttacctaacaaaaaattaaataaaaacaacgcgaacccacgacgcatcgaacgcactccaacaaaacccgacgcaaacacgcgctttcaaccgacgaaaacactaacaaaaccaaaaacgcgcgcaacgaaaacgaaaaatcgataaactccccgcccctacccgaaaccccgccccgacccgacccgaccccgcctttttctctacctcccctccctacacgtacgcgccccgcccctcgcgcgacgttttttattaacccgaaaacgaattatccgaaaccaaaatccgctcgaataaataccctccgctttttataaccaaacccaaccacgcaatcccctccctacgacgtcctccacacccgaaatctactaatctccgcgaatatcacaaactcgacaaccgccctcctatcgacgaaaaatcccgaaacgcccgaaaatactccgaaacctatcgctcaactaccaaatctacgtctatatccgattccgtcactaaaatcgcccctatccgacccttcctccctaattctcttcaccgtccgcccatcctatcgcgcgccgcgtcaaatccccattcgacatataacttatcttccatcgtccccaccctcgcccctcttaacccctcaaaacaaccctaaaattcgacaaacgc

SEQ ID NO: 249 - DNA, 726 bp, Artificial Sequence
  chemically treated genomic DNA (Homo sapiens) CpG-island No: 249
tcgtttcgatttgtttagttttgtcgcgggtggggaggtttcgacgtatttttcgttcgatcgttttagtttatttattttcgggcgcggtaggtcggggtttagttgcgtgaagttgtgtagtattatcgggtagttgtcggggacgtttatttttaggcgtacggcgttttatacgttgcggtttcgtcgggagttcggaaatagcggttcggcgtcgttagtaggttcggtcgtttcggtttatatgcgttgtattatggaaggttcgtagcgcgggcgcggggtcggttcggcgcgcggcgggggcggcggcgcggttcgcgcggttgggttttgttatcgttgtgagttcgcggttcggttttgttgatgttaggttggggggcggggtcggaggggaagagggtggggtcggggaggggcggaatcggagagttcgagggacgcgtgcgtgcgcgcgttcgcggtttcgttttcgtcgaggttagattcggggcgggatcgggagtttggaggggcggggtttgaataaagagggcggggtcggggaggtcgaggggtgcgcgttggttgggtttttcggaggatcggttgttacgtgtgtcgtggggttttgggtatttcggttaggtatcgtttgcgtgttacgttgttgtagtgcgtgtgttgcgtagggttgaaatgtgtacgtgttgattatgtgtggggaagtcgttttggagt

SEQ ID NO: 250 - DNA, 726 bp, Artificial Sequence
  chemically treated genomic DNA (Homo sapiens) CpG-island No: 250
actccaaaacgacttccccacacataatcaacacgtacacatttcaaccctacgcaacacacgcactacaacaacgtaacacgcaaacgatacctaaccgaaatacccaaaaccccacgacacacgtaacaaccgatcctccgaaaaacccaaccaacgcgcacccctcgacctccccgaccccgccctctttattcaaaccccgcccctccaaactcccgatcccgccccgaatctaacctcgacgaaaacgaaaccgcgaacgcgcgcacgcacgcgtccctcgaactctccgattccgcccctccccgaccccaccctcttcccctccgaccccgccccccaacctaacatcaacaaaaccgaaccgcgaactcacaacgataacaaaacccaaccgcgcgaaccgcgccgccgcccccgccgcgcgccgaaccgaccccgcgcccgcgctacgaaccttccataatacaacgcatataaaccgaaacgaccgaacctactaacgacgccgaaccgctatttccgaactcccgacgaaaccgcaacgtataaaacgccgtacgcctaaaaataaacgtccccgacaactacccgataatactacacaacttcacgcaactaaaccccgacctaccgcgcccgaaaataaataaactaaaacgatcgaacgaaaaatacgtcgaaacctccccacccgcgacaaaactaaacaaatcgaaacga

SEQ ID NO: 251 - DNA, 726 bp, Artificial Sequence
  chemically treated genomic DNA (Homo sapiens) CpG-island No: 251
attttagggcggtttttttatatatgattagtacgtatatattttagttttacgtaatatacgtattgtagtagcgtgatacgtaaacggtgtttaatcggggtatttaaggttttacgatatacgtgatagtcggtttttcgggagatttagttaacgcgtatttttcgattttttcggtttcgttttttttgtttagatttcgtttttttaggttttcggtttcgtttcgggtttgatttcggcgagggcggggtcgcgggcgcgcgtacgtacgcgtttttcggatttttcggtttcgttttttttcggttttatttttttttttttcggtttcgttttttagtttgatattagtagggtcgggtcgcgggtttatagcggtggtaaagtttagtcgcgcgggtcgcgtcgtcgttttcgtcgcgcgtcgggtcggtttcgcgttcgcgttgcgagttttttatggtgtagcgtatgtgggtcgaggcggtcgggtttgttggcggcgtcgagtcgttgttttcgggttttcggcggagtcgtagcgtgtgggacgtcgtgcgtttggaggtgggcgttttcgatagttgttcggtggtgttgtatagttttacgtagttagatttcgatttgtcgcgttcggaggtgggtgagttggggcggtcgggcggggggtgcgtcggagtttttttattcgcggtagagttgggtaggtcggggcga

SEQ ID NO: 252 - DNA, 726 bp, Artificial Sequence
  chemically treated genomic DNA (Homo sapiens) CpG-island No: 252
tcgccccgacctacccaactctaccgcgaataaaaaaactccgacgcaccccccgcccgaccgccccaactcacccacctccgaacgcgacaaatcgaaatctaactacgtaaaactatacaacaccaccgaacaactatcgaaaacgcccacctccaaacgcacgacgtcccacacgctacgactccgccgaaaacccgaaaacaacgactcgacgccgccaacaaacccgaccgcctcgacccacatacgctacaccataaaaaactcgcaacgcgaacgcgaaaccgacccgacgcgcgacgaaaacgacgacgcgacccgcgcgactaaactttaccaccgctataaacccgcgacccgaccctactaatatcaaactaaaaaacgaaaccgaaaaaaaaaaaaataaaaccgaaaaaaaacgaaaccgaaaaatccgaaaaacgcgtacgtacgcgcgcccgcgaccccgccctcgccgaaatcaaacccgaaacgaaaccgaaaacctaaaaaaacgaaatctaaacaaaaaaaacgaaaccgaaaaaatcgaaaaatacgcgttaactaaatctcccgaaaaaccgactatcacgtatatcgtaaaaccttaaataccccgattaaacaccgtttacgtatcacgctactacaatacgtatattacgtaaaactaaaatatatacgtactaatcatatataaaaaaaccgccctaaaat

SEQ ID NO: 253 - DNA, 640 bp, Artificial Sequence
  chemically treated genomic DNA (Homo sapiens) CpG-island No: 253
agatcgttacggcgtcgagggatttcgtttttattaggattcggggatttcggagacgagtttttcgttaggtcgcgttatcgcgtttattttttttgcgggttttaggtatttatagcgcggtcgagtttatttgttcgtcggttttttaggacgtagggtttcggaggttggggcggcggtcggtttgaagtttcgtagttttgggcgtttttatttcggttcggttgtcgggtgtatttcgtattttttgcggtagcggttttttcgcgggtattcggggtcgaggtttgtatttatcggttagcgttcgtaatatttcggttatggtttcgcgtttggtttcggttttcgtttttcgttcggcggttttggggcggggtgagttcgaggcgttttttttcggttcgcgtcgttcgtcgtttcgatttttcgaggtcgaatacgggaggggatagaggggcgcgggaggcggtcgcgggtttttagggatttttgttaggaagggacggcgttttttcgcgcgtatttttaagggattcgcgcgtttttcgtggttttggtattttggggttttgttttcgtatttcgttttggggtcgagcggtttcgggtgtttttgaagtttcgttttcggggg

SEQ ID NO: 254 - DNA, 640 bp, Artificial Sequence
  chemically treated genomic DNA (Homo sapiens) CpG-island No: 254
cccccgaaaacgaaacttcaaaaacacccgaaaccgctcgaccccaaaacgaaatacgaaaacaaaaccccaaaataccaaaaccacgaaaaacgcgcgaatcccttaaaaatacgcgcgaaaaaacgccgtcccttcctaacaaaaatccctaaaaacccgcgaccgcctcccgcgcccctctatcccctcccgtattcgacctcgaaaaatcgaaacgacgaacgacgcgaaccgaaaaaaaacgcctcgaactcaccccgccccaaaaccgccgaacgaaaaacgaaaaccgaaaccaaacgcgaaaccataaccgaaatattacgaacgctaaccgataaatacaaacctcgaccccgaatacccgcgaaaaaaccgctaccgcaaaaaatacgaaatacacccgacaaccgaaccgaaataaaaacgcccaaaactacgaaacttcaaaccgaccgccgccccaacctccgaaaccctacgtcctaaaaaaccgacgaacaaataaactcgaccgcgctataaatacctaaaacccgcaaaaaaaataaacgcgataacgcgacctaacgaaaaactcgtctccgaaatccccgaatcctaataaaaacgaaatccctcgacgccgtaacgatct

SEQ ID NO: 255 - DNA, 640 bp, Artificial Sequence
  chemically treated genomic DNA (Homo sapiens) CpG-island No: 255
ttttcggggacggggttttaggggtattcggagtcgttcggttttagggcgggatgcggggatagggttttaaggtattagggttacgaggggcgcgcgggttttttggggatgcgcgcgaggaggcgtcgtttttttttagtaggggtttttggggattcgcggtcgtttttcgcgtttttttgttttttttcgtgttcggtttcgggaagtcggggcggcgggcggcgcgggtcgggagggggcgtttcgggtttatttcgttttagggtcgtcgggcggaaggcggaggtcgagattagacgcggagttatggtcgaggtgttgcggacgttggtcggtgagtgtaggtttcggtttcgggtgttcgcgagggagtcgttatcgtagggaatgcggggtgtattcgatagtcgggtcggggtgggggcgtttagggttgcgaggttttaggtcggtcgtcgttttagttttcgagattttgcgttttggggagtcggcgggtaggtgggttcggtcgcgttgtgggtgtttgggattcgtagggaggatgggcgcggtggcgcggtttggcggggggttcgttttcggggttttcgggttttggtgagagcggggtttttcgacgtcgtggcggttt

SEQ ID NO: 256 - DNA, 640 bp, Artificial Sequence
  chemically treated genomic DNA (Homo sapiens) CpG-island No: 256
aaaccgccacgacgtcgaaaaaccccgctctcaccaaaacccgaaaaccccgaaaacgaaccccccgccaaaccgcgccaccgcgcccatcctccctacgaatcccaaacacccacaacgcgaccgaacccacctacccgccgactccccaaaacgcaaaatctcgaaaactaaaacgacgaccgacctaaaacctcgcaaccctaaacgcccccaccccgacccgactatcgaatacaccccgcattccctacgataacgactccctcgcgaacacccgaaaccgaaacctacactcaccgaccaacgtccgcaacacctcgaccataactccgcgtctaatctcgacctccgccttccgcccgacgaccctaaaacgaaataaacccgaaacgccccctcccgacccgcgccgcccgccgccccgacttcccgaaaccgaacacgaaaaaaaacaaaaaaacgcgaaaaacgaccgcgaatccccaaaaacccctactaaaaaaaaacgacgcctcctcgcgcgcatccccaaaaaacccgcgcgcccctcgtaaccctaataccttaaaaccctatccccgcatcccgccctaaaaccgaacgactccgaatacccctaaaaccccgtccccgaaaa

SEQ ID NO: 257 - DNA, 1757 bp, Artificial Sequence
  chemically treated genomic DNA (Homo sapiens) CpG-island No: 257
cgtggagttgtacgttattatgtggaagttcgattcggatagtttgtcgaaggtttgttttaggaagttgaatttgaggtaatagcgcgaggtgtagcgtttcgggggacggtcggggtttcggttttcgtttagggtgtttttaaatatttttttggttagcgacgttttttcgtaaacggtgatgcgcgttattcgtcggaatttggcgttcgtttgcgcgtttcgttcgatggtgtaggagtcgcggtagtcgatggtgatgtagttcgagcgtcggttgtcgtttagcgattgggacggcgtgagtagcgggttcgtcgcgttttcggacggattgcggttagttagttttagcgtgggcgacggcgtttcggtagaggcgtttttttgttgttcgggtttcgagtagttaagcggtagtagttcgttatttagcgagttttttttgtgtatttcgcgtcgcgagggcggcggtttcgggtcgggttgttggggcgtttcgaggcggcgtacgagttttggtagttcgaagtattcggtttcgcgttgtagtcggttgcgttcggggaagtagtcgggtagtacgagttgtaagtttcgtaggtaatttaggatgtagcggaagaggaagtcgtttcggtttagaaagaagcggtttttgttgtttcgggttagtttttgcggttgttgttgcgtgaatatgcgttagagtagcgagtcgggtatcgatattatcgtgtagcgtcgggttacgtatatttggttttttacgtttagttttacgatgtcggggaagagcggtggtttcgcggaggacgacgaggagttattgtcgttttcgtcgtcgttttcgttgggtaatttacgtgtgttgttcgttagagttatgatagagaggtggtcgggtcgggatagtggtaggaagtcgcgttgtatttaggagttgtaatcgtttttttcggagtttcggaattcggacgttcgtttagttttgcgtttcgtcgtcgtcgtcgtcgttatcgtcgttatcgttatcgtcgttattttttagagtcgcgcggagtcgagcggtgcgagcgcgtcgttgtgcgtttttttgagttttagtgcgtttcgttcgttttgttcgcgcgttttaggcgagtgtcgggtcgcggttcgcgcgttgtttaagtagagtcgtttgttttggtgtcgtggcgcgtaggaggcgtgggcggcggcggagtttcgtttatcgggcgaggggaggtggggagcggggattcgatttgtattttaaacgcggacgttacgcggggttgttggttttatttcggttcgcgagcgttgggggcgttcggatttttattcgttttttatttattagtttcgtttcgtggtttcgtttaattttttttttttttcgaagaggattcgttcgagatttggcggtttcggaagatagttttttggagggatagttatcgcgtttttttttttttcgttttagttcgtatttaaggattttggaaggaggacgtgaattttcggaagtttgtcgtttcgggagtggaaatgcgtggtcgttttcggttttttcgtttgcggaattgggcgtttttagtagtgtagttgcggtttgttatcgttggttgtcgtgttattgaaagtagagagacgcgaaaaatttggagagacgaaagagtcgttttagttcgagcgtagttagattttgtttaagttgttttgtagttagtttggaaaataaataa

SEQ ID NO: 258 - DNA, 1757 bp, Artificial Sequence
  chemically treated genomic DNA (Homo sapiens) CpG-island No: 258
ttatttattttccaaactaactacaaaacaacttaaacaaaatctaactacgctcgaactaaaacgactctttcgtctctccaaatttttcgcgtctctctactttcaataacacgacaaccaacgataacaaaccgcaactacactactaaaaacgcccaattccgcaaacgaaaaaaccgaaaacgaccacgcatttccactcccgaaacgacaaacttccgaaaattcacgtcctccttccaaaatccttaaatacgaactaaaacgaaaaaaaaaaaaacgcgataactatccctccaaaaaactatcttccgaaaccgccaaatctcgaacgaatcctcttcgaaaaaaaaaaaaaattaaacgaaaccacgaaacgaaactaataaataaaaaacgaataaaaatccgaacgcccccaacgctcgcgaaccgaaataaaaccaacaaccccgcgtaacgtccgcgtttaaaatacaaatcgaatccccgctccccacctcccctcgcccgataaacgaaactccgccgccgcccacgcctcctacgcgccacgacaccaaaacaaacgactctacttaaacaacgcgcgaaccgcgacccgacactcgcctaaaacgcgcgaacaaaacgaacgaaacgcactaaaactcaaaaaaacgcacaacgacgcgctcgcaccgctcgactccgcgcgactctaaaaaataacgacgataacgataacgacgataacgacgacgacgacgacgaaacgcaaaactaaacgaacgtccgaattccgaaactccgaaaaaaacgattacaactcctaaatacaacgcgacttcctaccactatcccgacccgaccacctctctatcataactctaacgaacaacacacgtaaattacccaacgaaaacgacgacgaaaacgacaataactcctcgtcgtcctccgcgaaaccaccgctcttccccgacatcgtaaaactaaacgtaaaaaaccaaatatacgtaacccgacgctacacgataatatcgatacccgactcgctactctaacgcatattcacgcaacaacaaccgcaaaaactaacccgaaacaacaaaaaccgcttctttctaaaccgaaacgacttcctcttccgctacatcctaaattacctacgaaacttacaactcgtactacccgactacttccccgaacgcaaccgactacaacgcgaaaccgaatacttcgaactaccaaaactcgtacgccgcctcgaaacgccccaacaacccgacccgaaaccgccgccctcgcgacgcgaaatacacaaaaaaaactcgctaaataacgaactactaccgcttaactactcgaaacccgaacaacaaaaaaacgcctctaccgaaacgccgtcgcccacgctaaaactaactaaccgcaatccgtccgaaaacgcgacgaacccgctactcacgccgtcccaatcgctaaacgacaaccgacgctcgaactacatcaccatcgactaccgcgactcctacaccatcgaacgaaacgcgcaaacgaacgccaaattccgacgaataacgcgcatcaccgtttacgaaaaaacgtcgctaaccaaaaaaatatttaaaaacaccctaaacgaaaaccgaaaccccgaccgtcccccgaaacgctacacctcgcgctattacctcaaattcaacttcctaaaacaaaccttcgacaaactatccgaatcgaacttccacataataacgtacaactccacg

SEQ ID NO: 259 - DNA, 1757 bp, Artificial Sequence
  chemically treated genomic DNA (Homo sapiens) CpG-island No: 259
ttatttattttttaggttggttgtaaggtaatttgaataaaatttggttgcgttcggattggggcggttttttcgtttttttaggtttttcgcgtttttttatttttagtgatacgataattaacgatggtaggtcgtagttgtattgttggaagcgtttagtttcgtaggcgggagggtcggaggcggttacgtatttttattttcggggcgataggttttcgaaagtttacgttttttttttagagtttttgggtgcgggttggggcgagaggggagggggcgcggtgattgtttttttaaggagttgtttttcgaagtcgttaagtttcgggcgggtttttttcggaagagggagaaagttgggcgggattacggggcggggttggtgggtggggagcgggtgggagttcgggcgtttttagcgttcgcgagtcggggtggagttagtagtttcgcgtggcgttcgcgtttaagatgtaaatcgagttttcgttttttattttttttcgttcggtaagcgaggtttcgtcgtcgtttacgttttttgcgcgttacggtattagagtaggcggttttatttaagtagcgcgcgggtcgcgattcggtattcgtttggagcgcgcgggtaaggcgggcggagcgtattggaatttaagggggcgtatagcggcgcgttcgtatcgttcggtttcgcgcggttttaggaggtggcggcggtggcggtggcggcggtggcggcggcggcggcggcggggcgtagggttgagcgagcgttcgggtttcggggtttcggggaaggcggttgtagtttttgagtgtagcgcggttttttgttattgtttcggttcggttatttttttgttatggttttggcggatagtatacgtggattatttaacgggggcggcggcgggggcggtagtggtttttcgtcgtttttcgcggagttatcgttttttttcgatatcgtggagttgaacgtggggggttaggtgtacgtgattcggcgttgtacggtggtgtcggtgttcgattcgttgttttggcgtatgtttacgtagtagtagtcgtaggagttggttcgggatagtaaaggtcgtttttttttggatcgggacggttttttttttcgttatattttggattatttgcgggatttgtagttcgtgttgttcgattattttttcgagcgtagtcggttgtagcgcgaggtcgagtatttcgagttgttagagttcgtgcgtcgtttcggggcgttttagtagttcggttcggggtcgtcgttttcgcggcgcggggtgtataaggagggttcgttgggtgacgagttgttgtcgtttggttattcggagttcgaatagtaggagggcgtttttgtcggggcgtcgtcgtttacgttggagttggttagtcgtagttcgttcgggggcgcggcgggttcgttgtttacgtcgttttagtcgttggacggtagtcggcgttcgggttatattattatcggttatcgcggtttttatattatcgggcgggacgcgtaggcggacgttaagtttcggcgagtggcgcgtattatcgtttgcggaaagacgtcgttggttaaggaggtgtttggggatattttgaacgaaagtcgggatttcgatcgtttttcggagcgttatatttcgcgttattattttaagtttaattttttggagtaggttttcgataagttgttcgagtcgggtttttatatggtggcgtgtagttttacg

SEQ ID NO: 260 - DNA, 1757 bp, Artificial Sequence
  chemically treated genomic DNA (Homo sapiens) CpG-island No: 260
cgtaaaactacacgccaccatataaaaacccgactcgaacaacttatcgaaaacctactccaaaaaattaaacttaaaataataacgcgaaatataacgctccgaaaaacgatcgaaatcccgactttcgttcaaaatatccccaaacacctccttaaccaacgacgtctttccgcaaacgataatacgcgccactcgccgaaacttaacgtccgcctacgcgtcccgcccgataatataaaaaccgcgataaccgataataatataacccgaacgccgactaccgtccaacgactaaaacgacgtaaacaacgaacccgccgcgcccccgaacgaactacgactaaccaactccaacgtaaacgacgacgccccgacaaaaacgccctcctactattcgaactccgaataaccaaacgacaacaactcgtcacccaacgaaccctccttatacaccccgcgccgcgaaaacgacgaccccgaaccgaactactaaaacgccccgaaacgacgcacgaactctaacaactcgaaatactcgacctcgcgctacaaccgactacgctcgaaaaaataatcgaacaacacgaactacaaatcccgcaaataatccaaaatataacgaaaaaaaaaaccgtcccgatccaaaaaaaaacgacctttactatcccgaaccaactcctacgactactactacgtaaacatacgccaaaacaacgaatcgaacaccgacaccaccgtacaacgccgaatcacgtacacctaaccccccacgttcaactccacgatatcgaaaaaaaacgataactccgcgaaaaacgacgaaaaaccactaccgcccccgccgccgcccccgttaaataatccacgtatactatccgccaaaaccataacaaaaaaataaccgaaccgaaacaataacaaaaaaccgcgctacactcaaaaactacaaccgccttccccgaaaccccgaaacccgaacgctcgctcaaccctacgccccgccgccgccgccgccgccaccgccgccaccgccaccgccgccacctcctaaaaccgcgcgaaaccgaacgatacgaacgcgccgctatacgcccccttaaattccaatacgctccgcccgccttacccgcgcgctccaaacgaataccgaatcgcgacccgcgcgctacttaaataaaaccgcctactctaataccgtaacgcgcaaaaaacgtaaacgacgacgaaacctcgcttaccgaacgaaaaaaaataaaaaacgaaaactcgatttacatcttaaacgcgaacgccacgcgaaactactaactccaccccgactcgcgaacgctaaaaacgcccgaactcccacccgctccccacccaccaaccccgccccgtaatcccgcccaactttctccctcttccgaaaaaaacccgcccgaaacttaacgacttcgaaaaacaactccttaaaaaaacaatcaccgcgccccctcccctctcgccccaacccgcacccaaaaactctaaaaaaaaaacgtaaactttcgaaaacctatcgccccgaaaataaaaatacgtaaccgcctccgaccctcccgcctacgaaactaaacgcttccaacaatacaactacgacctaccatcgttaattatcgtatcactaaaaataaaaaaacgcgaaaaacctaaaaaaacgaaaaaaccgccccaatccgaacgcaaccaaattttattcaaattaccttacaaccaacctaaaaaataaataa

SEQ ID NO: 261 - DNA, 1593 bp, Artificial Sequence
  chemically treated genomic DNA (Homo sapiens) CpG-island No: 261
agttcgagcgtttttggagaaagtcggtcggatttgggtttgcgtcgtaattttcgtttatcgtaattttcgcgggcggtagcggggtaggaagtgggggggcgggggcggcgtttgggatacggggaggtgttaggcgagtgtttcggtttcgtttttgtttcgttcggtcgtggtcgcgttttttgcgtttttagcgtttcggagtcgtggagtcgtcgagtcgtcgagtcgtcgagtcgtagcgtcgggcgtggggattgcgggtggggcgaataaagcggcggcgacgcgggcggtttaggttcgggacgcgcggagcgagcgatttcgtcgggtttttgtttcgggcggggtaggagtcgcggcggtcgcggggcgtttcgagcgtagaatgcggcgttcggcggcgcggattggggagcgttgcggcgattggttgcgtggagttcggttcggggttcgtaggtatttgcgtgtgtgaagcggggagattcggcgcgttgttcgttgttcgtttcgcggtcgtacgtgggcgggagcggcggttcgagaggagttcgaggagtaggaggaggaagaggaggggacgtacggcggcgtagcgggggatttggggtagttcgcgcgaagtttcgtttcggttttgagtttcgcgcgcgcgcgggcgggatgtttcgcggtcgttgtattttggttcgagtattgttttgagtcggtcgggttcgcgggcgttatggagtagtggcggtagtgcggtcgttggtttatcgattgtaaggttttgtcgtttaattatcgggtggtgtggttttcggtcgtggttttcgatttggcgtaggcgttgcgcgacggggtttttttgtgttagttgttgtataatttttttttcggttttatcgattttaaggatattaattttcggtcgtagatgttttaggtgagcgttcggcgggcgggagggtttcggggaggcggcgttcgcgttgttcgacgcgcggattgaacgcggaggtcgtagcggcggcggtttaggcgttttggttggggcggtcgggtttcgggacgcgggcgggcggttggagggtgcgtttcgggttttcgagacgcgattttaggaggcgcgaagttggttaaagtttttttagtttgggtcgcgtcgtcgtcgttcgcgggtattgttttggtgcgtcggtttcgcggtttgcgcggtttgggatgggggaggtttcggcgttgcgttcgttttgcggggttttgcgagtggttttttattttttagggagtttgtcgagtcgggtgtgcgcgtcgtgggtcgtatttttgggtttcgcgttttttggtcggacgtcggtggaagagcgggcgcggtcgttgcgtcggttcggggcgcggttggagggttcgggaggggcgcggggcgggagttttcggggtcggagggagttgggttggtttcgggtatcgttttttcgtcggttttcgttttttttcggattcggattcgggttatttggcgttagttttggttttcgggtcgagtcgtttcgaggatttttagggttatttggttttagttttggtttttatcgt

SEQ ID NO: 262 - DNA, 1593 bp, Artificial Sequence
  chemically treated genomic DNA (Homo sapiens) CpG-island No: 262
acgataaaaaccaaaactaaaaccaaataaccctaaaaatcctcgaaacgactcgacccgaaaaccaaaactaacgccaaataacccgaatccgaatccgaaaaaaaacgaaaaccgacgaaaaaacgatacccgaaaccaacccaactccctccgaccccgaaaactcccgccccgcgcccctcccgaaccctccaaccgcgccccgaaccgacgcaacgaccgcgcccgctcttccaccgacgtccgaccaaaaaacgcgaaacccaaaaatacgacccacgacgcgcacacccgactcgacaaactccctaaaaaataaaaaaccactcgcaaaaccccgcaaaacgaacgcaacgccgaaacctcccccatcccaaaccgcgcaaaccgcgaaaccgacgcaccaaaacaatacccgcgaacgacgacgacgcgacccaaactaaaaaaactttaaccaacttcgcgcctcctaaaatcgcgtctcgaaaacccgaaacgcaccctccaaccgcccgcccgcgtcccgaaacccgaccgccccaaccaaaacgcctaaaccgccgccgctacgacctccgcgttcaatccgcgcgtcgaacaacgcgaacgccgcctccccgaaaccctcccgcccgccgaacgctcacctaaaacatctacgaccgaaaattaatatccttaaaatcgataaaaccgaaaaaaaaattatacaacaactaacacaaaaaaaccccgtcgcgcaacgcctacgccaaatcgaaaaccacgaccgaaaaccacaccacccgataattaaacgacaaaaccttacaatcgataaaccaacgaccgcactaccgccactactccataacgcccgcgaacccgaccgactcaaaacaatactcgaaccaaaatacaacgaccgcgaaacatcccgcccgcgcgcgcgcgaaactcaaaaccgaaacgaaacttcgcgcgaactaccccaaatcccccgctacgccgccgtacgtcccctcctcttcctcctcctactcctcgaactcctctcgaaccgccgctcccgcccacgtacgaccgcgaaacgaacaacgaacaacgcgccgaatctccccgcttcacacacgcaaatacctacgaaccccgaaccgaactccacgcaaccaatcgccgcaacgctccccaatccgcgccgccgaacgccgcattctacgctcgaaacgccccgcgaccgccgcgactcctaccccgcccgaaacaaaaacccgacgaaatcgctcgctccgcgcgtcccgaacctaaaccgcccgcgtcgccgccgctttattcgccccacccgcaatccccacgcccgacgctacgactcgacgactcgacgactcgacgactccacgactccgaaacgctaaaaacgcaaaaaacgcgaccacgaccgaacgaaacaaaaacgaaaccgaaacactcgcctaacacctccccgtatcccaaacgccgcccccgcccccccacttcctaccccgctaccgcccgcgaaaattacgataaacgaaaattacgacgcaaacccaaatccgaccgactttctccaaaaacgctcgaact

SEQ ID NO: 263 - DNA, 1593 bp, Artificial Sequence
  chemically treated genomic DNA (Homo sapiens) CpG-island No: 263
gcgatgggggttaggattggggttaagtggttttggggattttcgaggcggttcgattcgggagttaggattggcgttaagtggttcgggttcgggttcgggaagaggcggaggtcggcgagggggcggtgttcggggttaatttagtttttttcggtttcgagggttttcgtttcgcgtttttttcgggttttttagtcgcgtttcgggtcggcgtagcgatcgcgttcgtttttttatcggcgttcggttaggaggcgcgaggtttaaggatgcgatttacgacgcgtatattcggttcggtaggttttttgggaaatgaggggttattcgtagggtttcgtagagcgagcgtagcgtcggagttttttttattttaggtcgcgtagatcgcggaatcggcgtattagagtagtgttcgcgggcggcggcggcgcgatttaggttgaggggattttggttaatttcgcgttttttgaggtcgcgtttcggaggttcggggcgtattttttagtcgttcgttcgcgtttcggagttcggtcgttttagttagggcgtttgggtcgtcgtcgttgcgattttcgcgtttagttcgcgcgtcgggtagcgcgaacgtcgttttttcggggttttttcgttcgtcgggcgtttatttgggatatttgcggtcggaagttgatgtttttgaggtcgatggagtcgggggagaggttgtgtagtagttggtatagaaggatttcgtcgcgtagcgtttgcgttaggtcgaagattacggtcgagggttatattattcggtggttgggcggtaggattttgtaatcgatgagttagcggtcgtattgtcgttattgttttatggcgttcgcgggttcgatcggtttagggtagtgttcgagttaaagtgtagcggtcgcggggtatttcgttcgcgcgcgcgcggggtttagggtcggggcggggtttcgcgcgggttgttttaggtttttcgttgcgtcgtcgtgcgtttttttttttttttttttttatttttcgggtttttttcgggtcgtcgttttcgtttacgtgcggtcgcggggcgggtaacgggtagcgcgtcggattttttcgttttatatacgtaagtgtttgcgggtttcgggtcgggttttacgtagttagtcgtcgtagcgttttttaattcgcgtcgtcgggcgtcgtattttgcgttcggggcgtttcgcggtcgtcgcggtttttgtttcgttcgagataaaggttcggcggggtcgttcgtttcgcgcgtttcgggtttgggtcgttcgcgtcgtcgtcgttttgttcgttttattcgtagtttttacgttcggcgttgcgattcgacgattcggcggttcggcggttttacggtttcggggcgttgggggcgtagggggcgcggttacggtcgggcggggtaggggcggggtcggagtattcgtttggtattttttcgtgttttaagcgtcgttttcgtttttttattttttgtttcgttatcgttcgcgaaagttgcggtgggcgggggttgcggcgtaggtttaggttcggtcgattttttttaagggcgttcggatt

SEQ ID NO: 264 - DNA, 1593 bp, Artificial Sequence
  chemically treated genomic DNA (Homo sapiens) CpG-island No: 264
aatccgaacgcccttaaaaaaaatcgaccgaacctaaacctacgccgcaacccccgcccaccgcaactttcgcgaacgataacgaaacaaaaaataaaaaaacgaaaacgacgcttaaaacacgaaaaaataccaaacgaatactccgaccccgcccctaccccgcccgaccgtaaccgcgccccctacgcccccaacgccccgaaaccgtaaaaccgccgaaccgccgaatcgtcgaatcgcaacgccgaacgtaaaaactacgaataaaacgaacaaaacgacgacgacgcgaacgacccaaacccgaaacgcgcgaaacgaacgaccccgccgaacctttatctcgaacgaaacaaaaaccgcgacgaccgcgaaacgccccgaacgcaaaatacgacgcccgacgacgcgaattaaaaaacgctacgacgactaactacgtaaaacccgacccgaaacccgcaaacacttacgtatataaaacgaaaaaatccgacgcgctacccgttacccgccccgcgaccgcacgtaaacgaaaacgacgacccgaaaaaaacccgaaaaataaaaaaaaaaaaaaaaaaaaacgcacgacgacgcaacgaaaaacctaaaacaacccgcgcgaaaccccgccccgaccctaaaccccgcgcgcgcgcgaacgaaataccccgcgaccgctacactttaactcgaacactaccctaaaccgatcgaacccgcgaacgccataaaacaataacgacaatacgaccgctaactcatcgattacaaaatcctaccgcccaaccaccgaataatataaccctcgaccgtaatcttcgacctaacgcaaacgctacgcgacgaaatccttctataccaactactacacaacctctcccccgactccatcgacctcaaaaacatcaacttccgaccgcaaatatcccaaataaacgcccgacgaacgaaaaaaccccgaaaaaacgacgttcgcgctacccgacgcgcgaactaaacgcgaaaatcgcaacgacgacgacccaaacgccctaactaaaacgaccgaactccgaaacgcgaacgaacgactaaaaaatacgccccgaacctccgaaacgcgacctcaaaaaacgcgaaattaaccaaaatcccctcaacctaaatcgcgccgccgccgcccgcgaacactactctaatacgccgattccgcgatctacgcgacctaaaataaaaaaaactccgacgctacgctcgctctacgaaaccctacgaataacccctcatttcccaaaaaacctaccgaaccgaatatacgcgtcgtaaatcgcatccttaaacctcgcgcctcctaaccgaacgccgataaaaaaacgaacgcgatcgctacgccgacccgaaacgcgactaaaaaacccgaaaaaaacgcgaaacgaaaaccctcgaaaccgaaaaaaactaaattaaccccgaacaccgccccctcgccgacctccgcctcttcccgaacccgaacccgaaccacttaacgccaatcctaactcccgaatcgaaccgcctcgaaaatccccaaaaccacttaaccccaatcctaacccccatcgc

SEQ ID NO: 265 - DNA, 634 bp, Artificial Sequence
  chemically treated genomic DNA (Homo sapiens) CpG-island No: 265
gtttcgtcgtcgttatgttttatgttgttcgtcgtagcgtttgtcgaacgttttttttagttttttcgtgtagtttggtcgtattattgggtttcgtgcgtcgttttcgtttttattttattatcgttgttttatgcgagttgtcgttttttatatttttttcgttttattttagaatatagtttgttcgtttgtgttttttttatcgtatttggtcgtattttattcgtttatcgtttttcggtttgatttttttttcgttttttgtattgtgttattttcgatttttttattacgcgttagttttgtttttttgttttgtttgtatttcgcgcgtttttcgcgtttttttttttgtacgtttcgttttggtagcgagtcgtatttatttttttgttttatggttcgttcgtttttttcgtttgttttttgttagatcgtttatatatgttttatcgtatttttatttttttcgttcgttacgcggcgttttagttttcgggtattttgtatgcgtgcgttttattttttttacgtttttttgtttgttgtttttatttttttttatgtgtttattgttgtttttcgcgttacgttgtatttttttatatttgttatttttatattttttatt

SEQ ID NO: 266 - DNA, 634 bp, Artificial Sequence
  chemically treated genomic DNA (Homo sapiens) CpG-island No: 266
aataaaaaatataaaaataacaaatataaaaaaatacaacgtaacgcgaaaaacaacaataaacacataaaaaaaaataaaaacaacaaacaaaaaaacgtaaaaaaaataaaacgcacgcatacaaaatacccgaaaactaaaacgccgcgtaacgaacgaaaaaaataaaaatacgataaaacatatataaacgatctaacaaaaaacaaacgaaaaaaacgaacgaaccataaaacaaaaaaataaatacgactcgctaccaaaacgaaacgtacaaaaaaaaaaacgcgaaaaacgcgcgaaatacaaacaaaacaaaaaaacaaaactaacgcgtaataaaaaaatcgaaaataacacaatacaaaaaacgaaaaaaaaatcaaaccgaaaaacgataaacgaataaaatacgaccaaatacgataaaaaaaacacaaacgaacaaactatattctaaaataaaacgaaaaaaatataaaaaacgacaactcgcataaaacaacgataataaaataaaaacgaaaacgacgcacgaaacccaataatacgaccaaactacacgaaaaaactaaaaaaaacgttcgacaaacgctacgacgaacaacataaaacataacgacgacgaaac

SEQ ID NO: 267 - DNA, 634 bp, Artificial Sequence
  chemically treated genomic DNA (Homo sapiens) CpG-island No: 267
ggtgggggatatggaggtagtagatatgagaagatatagcgtagcgcgagaagtagtagtgagtatatagagaagggtagaagtagtaggtagaaggacgtagagaggatgagacgtacgtatgtaggatgttcgaggattagagcgtcgcgtagcgagcggaggaagtgagggtgcgatagagtatatatggacgatttagtaggaagtaggcgagaggagcgagcgagttataggataggagagtgggtgcgattcgttgttaggacgaagcgtgtaggaagagagacgcgaaagacgcgcgaaatgtagatagagtagagagataggattagcgcgtaatagagagatcgaggataatatagtatagagagcgagagaggaattaggtcggaggacggtggacgagtagaatgcgattagatgcgatagaggaggtataggcgagtaggttatgttttgaggtgaaacggagaagatatgagaggcggtagttcgtatgagatagcgatgatggaatgagagcgagagcgacgtacgaggtttaataatacgattaggttgtacgggagagttgagaggaacgttcggtaggcgttacggcgagtagtatggggtatagcggcgacgagat

SEQ ID NO: 268 - DNA, 634 bp, Artificial Sequence
  chemically treated genomic DNA (Homo sapiens) CpG-island No: 268
atctcgtcgccgctataccccatactactcgccgtaacgcctaccgaacgttcctctcaactctcccgtacaacctaatcgtattattaaacctcgtacgtcgctctcgctctcattccatcatcgctatctcatacgaactaccgcctctcatatcttctccgtttcacctcaaaacataacctactcgcctatacctcctctatcgcatctaatcgcattctactcgtccaccgtcctccgacctaattcctctctcgctctctatactatattatcctcgatctctctattacgcgctaatcctatctctctactctatctacatttcgcgcgtctttcgcgtctctcttcctacacgcttcgtcctaacaacgaatcgcacccactctcctatcctataactcgctcgctcctctcgcctacttcctactaaatcgtccatatatactctatcgcaccctcacttcctccgctcgctacgcgacgctctaatcctcgaacatcctacatacgtacgtctcatcctctctacgtccttctacctactacttctacccttctctatatactcactactacttctcgcgctacgctatatcttctcatatctactacctccatatcccccacc

SEQ ID NO: 269 - DNA, 754 bp, Artificial Sequence
  chemically treated genomic DNA (Homo sapiens) CpG-island No: 269
tcgtatcgtcgtgtttttcggtttaagttttaatattcgggcgaattggcgtgttttattagttcggtagtatgaattattattcgttagttattttattggagacgacggaagatcgttgtcgaagttgcgttttatcgtttttagtatgacgttttgtattgttttattgttgaagtcgtcggtagtgatcgtttagtgtagtgttttacgattatagtagtttagcgcgaacgtgatacgtagttttttttcgttattatagtagaattcgaatcgttagagtattatcgttgattgttttttttacggttattttgtttgtatgtgttcgtttcgatggcggtatagtaggttttcgtttaagtaatagcgtattttggcgtatgattcggtaaatacgtttggtattgatcgtaggtatattattaagttttgtttgtttgcgaagtagcgtttatattcgacgataattatacgttggtagtttttcgataatatggtgtatacggagaagtatattcgtattattagtgtgacgattgcggcggttatttatttagttatcggttcgtttgagaatgacgtgtaattgcgtacgcgatattcggagataacgttgaattaagtttattttttattttcggggtatagggcgcgtgcgttatttatttttttgttcgttttatatttaacgggtttttttaggagtttattttttatcgtttttttgtcgagtaggcgttggagtttt

SEQ ID NO: 270 - DNA, 754 bp, Artificial Sequence
  chemically treated genomic DNA (Homo sapiens) CpG-island No: 270
aaaactccaacgcctactcgacaaaaaaacgataaaaaataaactcctaaaaaaacccgttaaatataaaacgaacaaaaaaataaataacgcacgcgccctataccccgaaaataaaaaataaacttaattcaacgttatctccgaatatcgcgtacgcaattacacgtcattctcaaacgaaccgataactaaataaataaccgccgcaatcgtcacactaataatacgaatatacttctccgtatacaccatattatcgaaaaactaccaacgtataattatcgtcgaatataaacgctacttcgcaaacaaacaaaacttaataatatacctacgatcaataccaaacgtatttaccgaatcatacgccaaaatacgctattacttaaacgaaaacctactataccgccatcgaaacgaacacatacaaacaaaataaccgtaaaaaaaacaatcaacgataatactctaacgattcgaattctactataataacgaaaaaaaactacgtatcacgttcgcgctaaactactataatcgtaaaacactacactaaacgatcactaccgacgacttcaacaataaaacaatacaaaacgtcatactaaaaacgataaaacgcaacttcgacaacgatcttccgtcgtctccaataaaataactaacgaataataattcatactaccgaactaataaaacacgccaattcgcccgaatattaaaacttaaaccgaaaaacacgacgatacga

SEQ ID NO: 271 - DNA, 754 bp, Artificial Sequence
  chemically treated genomic DNA (Homo sapiens) CpG-island No: 271
aagattttagcgtttgttcggtaagaaaacgatggaaaatgaatttttgaaagagttcgttgaatatgggacgggtaaaaaagtggatagcgtacgcgttttatgtttcggggatggggagtaagtttagtttagcgttgttttcgagtgtcgcgtgcgtagttgtacgttatttttagacgaatcgatgattggatggatggtcgtcgtagtcgttatattgatgatacggatgtgttttttcgtatatattatgttatcggagagttgttaacgtatggttatcgtcgggtatgggcgttgtttcgtagataggtagaatttgatggtatgtttgcgattaatgttaaacgtgtttatcggattatgcgttagaatgcgttgttgtttgagcgaaaatttgttgtatcgttatcgaaacgggtatatataggtagagtggtcgtgaaagaaataattagcgatggtgttttgacggttcgagttttgttgtgataacgaagagagattgcgtgttacgttcgcgttggattgttgtgatcgtgaggtattgtattgggcggttattatcggcggttttaatagtgaaatagtataggacgttatgttgggagcggtggaacgtagtttcggtaacgatttttcgtcgtttttagtggagtggttgacggataatggtttatgttatcgggttaatgaaatacgttagttcgttcggatgttgggatttgaatcgaagaatacggcggtgcgg

SEQ ID NO: 272 - DNA, 754 bp, Artificial Sequence
  chemically treated genomic DNA (Homo sapiens) CpG-island No: 272
ccgcaccgccgtattcttcgattcaaatcccaacatccgaacgaactaacgtatttcattaacccgataacataaaccattatccgtcaaccactccactaaaaacgacgaaaaatcgttaccgaaactacgttccaccgctcccaacataacgtcctatactatttcactattaaaaccgccgataataaccgcccaatacaatacctcacgatcacaacaatccaacgcgaacgtaacacgcaatctctcttcgttatcacaacaaaactcgaaccgtcaaaacaccatcgctaattatttctttcacgaccactctacctatatatacccgtttcgataacgatacaacaaattttcgctcaaacaacaacgcattctaacgcataatccgataaacacgtttaacattaatcgcaaacataccatcaaattctacctatctacgaaacaacgcccatacccgacgataaccatacgttaacaactctccgataacataatatatacgaaaaaacacatccgtatcatcaatataacgactacgacgaccatccatccaatcatcgattcgtctaaaaataacgtacaactacgcacgcgacactcgaaaacaacgctaaactaaacttactccccatccccgaaacataaaacgcgtacgctatccacttttttacccgtcccatattcaacgaactctttcaaaaattcattttccatcgttttcttaccgaacaaacgctaaaatctt

SEQ ID NO: 273 - DNA, 584 bp, Artificial Sequence
  chemically treated genomic DNA (Homo sapiens) CpG-island No: 273
cggtcgttagcgtttatagtagaattaggagcgtcgcgtacgtggaggcggtagttttttacgttatcgtcgcggttgttgttgtgtaatttttttcgtcgagtgggagtaggcggttcggtagaaattaagggtagggggagatttttgttgcgtaaagagttgacggagatatagtcgggatttttagtcggcgtttttgtatattttatttttttagattttttcggtaattgcgaagtcgtttggattttttaggttcgtattgtaggaagttaggcgcgtgattagttttattcgcgtcgtattttagttcgggggcgggtatcggtcggggaattttttttcgttttcgttcgcggtacgaggttgcgcggttatagtttcggtgtttttcgcgagcggttttgcggtttaggattcggggtattttttgggttcgtttagtaaattgagatcgggatttaagtggttcggggcgttgttttaaggaagatgttgatcgtagtcggtgattgcgagagtaggtgtacgcgtttagagcgatattttatcgttggcgcgataaatttatattattttaa

SEQ ID NO: 274 - DNA, 584 bp, Artificial Sequence
  chemically treated genomic DNA (Homo sapiens) CpG-island No: 274
ttaaaataatataaatttatcgcgccaacgataaaatatcgctctaaacgcgtacacctactctcgcaatcaccgactacgatcaacatcttccttaaaacaacgccccgaaccacttaaatcccgatctcaatttactaaacgaacccaaaaaataccccgaatcctaaaccgcaaaaccgctcgcgaaaaacaccgaaactataaccgcgcaacctcgtaccgcgaacgaaaacgaaaaaaaattccccgaccgatacccgcccccgaactaaaatacgacgcgaataaaactaatcacgcgcctaacttcctacaatacgaacctaaaaaatccaaacgacttcgcaattaccgaaaaaatctaaaaaaataaaatatacaaaaacgccgactaaaaatcccgactatatctccgtcaactctttacgcaacaaaaatctccccctacccttaatttctaccgaaccgcctactcccactcgacgaaaaaaattacacaacaacaaccgcgacgataacgtaaaaaactaccgcctccacgtacgcgacgctcctaattctactataaacgctaacgaccg

SEQ ID NO: 275 - DNA, 584 bp, Artificial Sequence
  chemically treated genomic DNA (Homo sapiens) CpG-island No: 275
ttaaagtaatgtaagtttatcgcgttaacggtaagatgtcgttttggacgcgtgtatttgttttcgtaattatcgattgcggttagtattttttttagagtagcgtttcgggttatttggatttcggttttaatttattaagcgaatttagaggatgtttcgagttttggatcgtagagtcgttcgcgagaggtatcggggttgtaatcgcgtaatttcgtgtcgcgggcggaggcgagggaggatttttcggtcggtgttcgttttcgggttaaagtgcggcgcgggtggggttggttacgcgtttggttttttgtagtgcgaatttgggaaatttaggcgatttcgtagttgtcgaagggatttgaagaagtgggatgtgtaaaagcgtcggttggaaatttcggttgtgttttcgttaattttttacgtaatagaggtttttttttgtttttggtttttatcgggtcgtttgtttttattcggcgaaaaaaattatataatagtagtcgcggcgatgacgtggagggttgtcgtttttacgtgcgcggcgtttttgattttgttgtgggcgttgacgatcg

SEQ ID NO: 276 - DNA, 584 bp, Artificial Sequence
  chemically treated genomic DNA (Homo sapiens) CpG-island No: 276
cgatcgtcaacgcccacaacaaaatcaaaaacgccgcgcacgtaaaaacgacaaccctccacgtcatcgccgcgactactattatataatttttttcgccgaataaaaacaaacgacccgataaaaaccaaaaacaaaaaaaaacctctattacgtaaaaaattaacgaaaacacaaccgaaatttccaaccgacgcttttacacatcccacttcttcaaatcccttcgacaactacgaaatcgcctaaatttcccaaattcgcactacaaaaaaccaaacgcgtaaccaaccccacccgcgccgcactttaacccgaaaacgaacaccgaccgaaaaatcctccctcgcctccgcccgcgacacgaaattacgcgattacaaccccgatacctctcgcgaacgactctacgatccaaaactcgaaacatcctctaaattcgcttaataaattaaaaccgaaatccaaataacccgaaacgctactctaaaaaaaatactaaccgcaatcgataattacgaaaacaaatacacgcgtccaaaacgacatcttaccgttaacgcgataaacttacattactttaa

SEQ ID NO: 277 - DNA, 649 bp, Artificial Sequence
  chemically treated genomic DNA (Homo sapiens) CpG-island No: 277
ttagaacgtagttcgaagggttttagagtcggggcggaattagcgtttgcggaattttttttttcgttttcggtgtttcggaagtttcggtaggaaatgcgttagggattacgttgcgtcgcgtcgtcgtagtcgggtttcggtcgttacggtaacgcgcgcgggtaggtgttcgattatgagcgttcgggtcgtacgggtagcgtgggttaggggtttgggcgttagttatcgtcgcggcgtttcgagtttttcggtgttttcgtcgggcgtttagggtgtagcggagttgttgcgagatgcgatcggggcggaggaggaggcgttttgggcggcgacggagcggcgaatgtcgggttagtgtttcgtgttgtttttttcgggttagggtagttaggtggtgggtatgggtcgcggtttgtttaattattcgcgcgttcgcgaaatttacgtcgtcgttcgtcgcgtgttgggttacgatttgttggaattgagtttgtacgggtcgtaggagattttggatcgtatcgtgtattgttagttcgcgattttcgtggtatcgttggtcgttgtcgagaaattatattatttgtagttttcggtgaggttcgaggtttcgtgataggagggggaaggtgagttttgtttg

SEQ ID NO: 278 - DNA, 649 bp, Artificial Sequence
  chemically treated genomic DNA (Homo sapiens) CpG-island No: 278
caaacaaaactcaccttccccctcctatcacgaaacctcgaacctcaccgaaaactacaaataatataatttctcgacaacgaccaacgataccacgaaaatcgcgaactaacaatacacgatacgatccaaaatctcctacgacccgtacaaactcaattccaacaaatcgtaacccaacacgcgacgaacgacgacgtaaatttcgcgaacgcgcgaataattaaacaaaccgcgacccatacccaccacctaactaccctaacccgaaaaaaacaacacgaaacactaacccgacattcgccgctccgtcgccgcccaaaacgcctcctcctccgccccgatcgcatctcgcaacaactccgctacaccctaaacgcccgacgaaaacaccgaaaaactcgaaacgccgcgacgataactaacgcccaaacccctaacccacgctacccgtacgacccgaacgctcataatcgaacacctacccgcgcgcgttaccgtaacgaccgaaacccgactacgacgacgcgacgcaacgtaatccctaacgcatttcctaccgaaacttccgaaacaccgaaaacgaaaaaaaaaattccgcaaacgctaattccgccccgactctaaaacccttcgaactacgttctaa

SEQ ID NO: 279 - DNA, 649 bp, Artificial Sequence
  chemically treated genomic DNA (Homo sapiens) CpG-island No: 279
taggtagagtttatttttttttttttgttacggggtttcgggttttatcgagggttgtaggtgatgtagtttttcgatagcggttagcgatgttacgaagatcgcgggttgatagtgtacggtgcggtttagggttttttgcggttcgtgtaggtttagttttagtaggtcgtagtttagtacgcggcgggcggcggcgtagatttcgcggacgcgcgggtagttgagtagatcgcggtttatgtttattatttggttgttttggttcgggaagagtagtacggagtattggttcggtattcgtcgtttcgtcgtcgtttagggcgttttttttttcgtttcggtcgtatttcgtagtagtttcgttatattttgggcgttcggcggaggtatcgggaagttcgaggcgtcgcggcggtagttggcgtttaagtttttgatttacgttattcgtgcgattcggacgtttatggtcggatatttgttcgcgcgcgttatcgtggcgatcgaggttcgattgcggcggcgcggcgtagcgtggtttttgacgtattttttgtcggggttttcggggtatcgggagcgggaagaaaggtttcgtagacgttggtttcgtttcggttttgaggtttttcgggttgcgttttgg

SEQ ID NO: 280 - DNA, 649 bp, Artificial Sequence
  chemically treated genomic DNA (Homo sapiens) CpG-island No: 280
ccaaaacgcaacccgaaaaacctcaaaaccgaaacgaaaccaacgtctacgaaacctttcttcccgctcccgataccccgaaaaccccgacaaaaaatacgtcaaaaaccacgctacgccgcgccgccgcaatcgaacctcgatcgccacgataacgcgcgcgaacaaatatccgaccataaacgtccgaatcgcacgaataacgtaaatcaaaaacttaaacgccaactaccgccgcgacgcctcgaacttcccgatacctccgccgaacgcccaaaatataacgaaactactacgaaatacgaccgaaacgaaaaaaaaaacgccctaaacgacgacgaaacgacgaataccgaaccaatactccgtactactcttcccgaaccaaaacaaccaaataataaacataaaccgcgatctactcaactacccgcgcgtccgcgaaatctacgccgccgcccgccgcgtactaaactacgacctactaaaactaaacctacacgaaccgcaaaaaaccctaaaccgcaccgtacactatcaacccgcgatcttcgtaacatcgctaaccgctatcgaaaaactacatcacctacaaccctcgataaaacccgaaaccccgtaacaaaaaaaaaaaaataaactctaccta

SEQ ID NO: 281 - DNA, 1026 bp, Artificial Sequence
  chemically treated genomic DNA (Homo sapiens) CpG-island No: 281
tagacgacgattagtttcgaattttataagttttgtcgtgatcgcgtttcgtaggcggggggttttttcgcgggttattcgtaggggcgtatttttaatttattaaataaggtcgtatgttttagtcgggttttagttttcgtttagtttggggcgtatttgtgtagggcgcgtgggtaagcgagggcgggcggttgcgcgtcgtttcgtgtgtacgtttttgtttcggattttttgggcgtttcgttacgaagttttttttcggtttttttttaggtgcgtagcgttttcgggagtcggtttcggcggtatcgggtacgacgttatttttttttttttaagggtatcggggttgtgcggtcgcggtcgtgggttggcgttgtcgcgttacggtttggtcgggttcgtacgattttagagttcggagtcgggtgttcggaagtcgtattggaggattgtgcggcggcgatggggcgtttagtcgtcgcggcgagacgtagagggattattttattgtataggcgcggagattgaggttcgtaggggtcgcgtttggtacgatcgttcgtcggggatttggagtttcggatagagagggtacgtttcggagtcggagtttcgagacgtcgtttcgttagcgatttgttggagcggtaaaatttgggtacggttttttatatttttagtcgttcggtattcgggtcgcggtttgggcgttaatcgtcgggttcgagttgggcggagtagcgggcggtagtagggtcgggggtatttatttggcggcggcgatgttggtagcgtttgtaagttattcgggaggtttcgtgtttgcggttcggttgtcggcgcgggatttaataggttcgggcgtttcgtttttttcgtttcgttcgggtttcgttttttttcgggagcggtttttcgtatttcgagcgcggaatttcggattggggtttgaatggtattggtaatagaatcgttataagtgtagttcgttggtttgtttatagtttttttgttttttgt

SEQ ID NO: 282 - DNA, 1026 bp, Artificial Sequence
  chemically treated genomic DNA (Homo sapiens) CpG-island No: 282
acaaaaaacaaaaaaactataaacaaaccaacgaactacacttataacgattctattaccaataccattcaaaccccaatccgaaattccgcgctcgaaatacgaaaaaccgctcccgaaaaaaaacgaaacccgaacgaaacgaaaaaaacgaaacgcccgaacctattaaatcccgcgccgacaaccgaaccgcaaacacgaaacctcccgaataacttacaaacgctaccaacatcgccgccgccaaataaatacccccgaccctactaccgcccgctactccgcccaactcgaacccgacgattaacgcccaaaccgcgacccgaataccgaacgactaaaaatataaaaaaccgtacccaaattttaccgctccaacaaatcgctaacgaaacgacgtctcgaaactccgactccgaaacgtaccctctctatccgaaactccaaatccccgacgaacgatcgtaccaaacgcgacccctacgaacctcaatctccgcgcctatacaataaaataatccctctacgtctcgccgcgacgactaaacgccccatcgccgccgcacaatcctccaatacgacttccgaacacccgactccgaactctaaaatcgtacgaacccgaccaaaccgtaacgcgacaacgccaacccacgaccgcgaccgcacaaccccgatacccttaaaaaaaaaaaaataacgtcgtacccgataccgccgaaaccgactcccgaaaacgctacgcacctaaaaaaaaaccgaaaaaaaacttcgtaacgaaacgcccaaaaaatccgaaacaaaaacgtacacacgaaacgacgcgcaaccgcccgccctcgcttacccacgcgccctacacaaatacgccccaaactaaacgaaaactaaaacccgactaaaacatacgaccttatttaataaattaaaaatacgcccctacgaataacccgcgaaaaaaccccccgcctacgaaacgcgatcacgacaaaacttataaaattcgaaactaatcgtcgtcta

SEQ ID NO: 283 - DNA, 1026 bp, Artificial Sequence
  chemically treated genomic DNA (Homo sapiens) CpG-island No: 283
gtagggggtagagaggttgtaaataagttaacgggttgtatttgtagcggttttgttgttaatgttatttagattttagttcgggatttcgcgttcggggtgcgagaggtcgttttcggggaggggcgggattcgggcggggcgggaggggcggggcgttcgggtttattaggtttcgcgtcggtagtcgggtcgtagatacgaagtttttcgggtggtttatagacgttgttagtatcgtcgtcgttaggtgagtgttttcgattttgttgtcgttcgttgtttcgtttagttcgagttcggcggttagcgtttaggtcgcggttcgggtgtcgagcggttggaagtgtggggagtcgtgtttaggttttatcgttttagtaagtcgttggcggggcgacgtttcgggatttcggtttcgaaacgtattttttttgttcggggttttaggttttcgacgggcgatcgtgttaggcgcggtttttgcgggttttagttttcgcgtttgtgtaatggggtggtttttttgcgtttcgtcgcgacggttggacgttttatcgtcgtcgtatagttttttagtgcggttttcgggtattcggtttcgaattttggggtcgtgcggattcggttagatcgtagcgcggtaacgttagtttacggtcgcggtcgtatagtttcggtgtttttaaaagagggaagatggcgtcgtgttcggtgtcgtcgggatcggttttcggaggcgttgcgtatttgaggaagggtcgaggaaaggtttcgtaacgggacgtttagaaagttcggaataggaacgtgtatacggagcggcgcgtagtcgttcgttttcgtttgtttacgcgttttgtataggtgcgttttagattgggcggggattagagttcggttggggtatgcgattttgtttggtaaattggaggtgcgtttttgcgggtgattcgcgagggggtttttcgtttgcggggcgcggttacgataaggtttgtggggttcggagttggtcgtcgtttg

SEQ ID NO: 284 - DNA, 1026 bp, Artificial Sequence
  chemically treated genomic DNA (Homo sapiens) CpG-island No: 284
caaacgacgaccaactccgaaccccacaaaccttatcgtaaccgcgccccgcaaacgaaaaaccccctcgcgaatcacccgcaaaaacgcacctccaatttaccaaacaaaatcgcataccccaaccgaactctaatccccgcccaatctaaaacgcacctatacaaaacgcgtaaacaaacgaaaacgaacgactacgcgccgctccgtatacacgttcctattccgaactttctaaacgtcccgttacgaaacctttcctcgacccttcctcaaatacgcaacgcctccgaaaaccgatcccgacgacaccgaacacgacgccatcttccctcttttaaaaacaccgaaactatacgaccgcgaccgtaaactaacgttaccgcgctacgatctaaccgaatccgcacgaccccaaaattcgaaaccgaatacccgaaaaccgcactaaaaaactatacgacgacgataaaacgtccaaccgtcgcgacgaaacgcaaaaaaaccaccccattacacaaacgcgaaaactaaaacccgcaaaaaccgcgcctaacacgatcgcccgtcgaaaacctaaaaccccgaacaaaaaaaatacgtttcgaaaccgaaatcccgaaacgtcgccccgccaacgacttactaaaacgataaaacctaaacacgactccccacacttccaaccgctcgacacccgaaccgcgacctaaacgctaaccgccgaactcgaactaaacgaaacaacgaacgacaacaaaatcgaaaacactcacctaacgacgacgatactaacaacgtctataaaccacccgaaaaacttcgtatctacgacccgactaccgacgcgaaacctaataaacccgaacgccccgcccctcccgccccgcccgaatcccgcccctccccgaaaacgacctctcgcaccccgaacgcgaaatcccgaactaaaatctaaataacattaacaacaaaaccgctacaaatacaacccgttaacttatttacaacctctctaccccctac

SEQ ID NO: 285 - DNA, 603 bp, Artificial Sequence
  chemically treated genomic DNA (Homo sapiens) CpG-island No: 285
tcgtcgtttttcggatttttttttagttttcgttttttttgtttttttgggattttgcgttttttggagttattattttattcggtttaatcgcggtttttcggatttgcgcgcgattcggcggggttgatttcgagtcgcggtttttcggtttttgtcgttcgttcgcgtcgcggttttcgtttcgcgtcgggtttcggtttcgttcgtcgtcgtcgttgtatttgtttttgttttttacgttacggtcgtcgttttttcgttttttttcgtcgttcgggcgttcgcggttggtcgttttttcgtttgtttgttcgttcgtgggttcgcggagatcgatttgggttaggtaggggtttaggacggcgggaggggggcgtacgaggagaggaacggggtcggggatcgttagggggagttcgatttgtatcggagcgtagggggcggggtcggagtaagttttcgtttttttcgcgttttttttcgttttcgttttttattttttttttcgggatttataattcggtttttggagtttttttgattcgcggaatttagaggttttttttgtttacgttttacgaaagtggggggttgggaggg

SEQ ID NO: 286 - DNA, 603 bp, Artificial Sequence
  chemically treated genomic DNA (Homo sapiens) CpG-island No: 286
ccctcccaaccccccactttcgtaaaacgtaaacaaaaaaaacctctaaattccgcgaatcaaaaaaactccaaaaaccgaattataaatcccgaaaaaaaaaataaaaaacgaaaacgaaaaaaaacgcgaaaaaaacgaaaacttactccgaccccgccccctacgctccgatacaaatcgaactccccctaacgatccccgaccccgttcctctcctcgtacgcccccctcccgccgtcctaaacccctacctaacccaaatcgatctccgcgaacccacgaacgaacaaacaaacgaaaaaacgaccaaccgcgaacgcccgaacgacgaaaaaaaacgaaaaaacgacgaccgtaacgtaaaaaacaaaaacaaatacaacgacgacgacgaacgaaaccgaaacccgacgcgaaacgaaaaccgcgacgcgaacgaacgacaaaaaccgaaaaaccgcgactcgaaatcaaccccgccgaatcgcgcgcaaatccgaaaaaccgcgattaaaccgaataaaataataactccaaaaaacgcaaaatcccaaaaaaacaaaaaaaacgaaaactaaaaaaaaatccgaaaaacgacga

SEQ ID NO: 287 - DNA, 603 bp, Artificial Sequence
  chemically treated genomic DNA (Homo sapiens) CpG-island No: 287
tttttttagttttttattttcgtagagcgtgggtaggaggaatttttgggtttcgcggattagaaaaattttaaaggtcgggttgtgagtttcgggaggggaggtggagggcgggggcggggaggggcgcgggaggggcgggggtttgtttcggtttcgttttttgcgtttcggtgtaggtcgggttttttttggcggttttcggtttcgttttttttttcgtgcgtttttttttcgtcgttttagatttttgtttagtttaggtcggttttcgcggatttacggacggatagatagacgggaggacggttagtcgcgagcgttcgggcggcgggagggggcggggaggcgacggtcgtggcgtgaggagtaggagtaggtgtagcggcggcggcgggcggggtcgggattcggcgcggagcgggagtcgcggcgcgggcgggcggtagggatcgggaggtcgcgattcggagttagtttcgtcgggtcgcgcgtaggttcggggagtcgcggttgagtcgggtggggtggtgattttagagaacgtaggattttaaggagatagagaggacgagagttggagggggattcggaaagcggcgg

SEQ ID NO: 288 - DNA, 603 bp, Artificial Sequence
  chemically treated genomic DNA (Homo sapiens) CpG-island No: 288
ccgccgctttccgaatccccctccaactctcgtcctctctatctccttaaaatcctacgttctctaaaatcaccaccccacccgactcaaccgcgactccccgaacctacgcgcgacccgacgaaactaactccgaatcgcgacctcccgatccctaccgcccgcccgcgccgcgactcccgctccgcgccgaatcccgaccccgcccgccgccgccgctacacctactcctactcctcacgccacgaccgtcgcctccccgccccctcccgccgcccgaacgctcgcgactaaccgtcctcccgtctatctatccgtccgtaaatccgcgaaaaccgacctaaactaaacaaaaatctaaaacgacgaaaaaaaaacgcacgaaaaaaaaaacgaaaccgaaaaccgccaaaaaaaacccgacctacaccgaaacgcaaaaaacgaaaccgaaacaaacccccgcccctcccgcgcccctccccgcccccgccctccacctcccctcccgaaactcacaacccgacctttaaaatttttctaatccgcgaaacccaaaaattcctcctacccacgctctacgaaaataaaaaactaaaaaaa

SEQ ID NO: 289 - DNA, 541 bp, Artificial Sequence
  chemically treated genomic DNA (Homo sapiens) CpG-island No: 289
cgggggtatcgggggagtgaagggatgagttggtgtgcgagtgcggggatcggcgggtaggatatagggtaggggatttcgggaacgaggcggacggcggtcgcgggtcggaaggggacgtcgagcggtgcggcgcgtatcgtttttttttttttttttgttttttcgttttttttttcgcggttcgttgcgcgtatttattaatgaagaggatggggaaggtgatgaagagtaggaagacgtgcggtattacgttgagcgcgtttataaagtagtcgttgttgaggattttttggtttattcggtaggcggtcgagtggttttcgttgtcgtagaaggttaggggtatggcggcgcgggcgcgggttgggttcgggtttagttggtttcgttggtttcgcgcgtttgtcgcgtttttgttttttgtagtttcgtcgttcggttcggtcgttaggttttcgtttttcgggtttcgtttagtttcgttggttttttttttttttatttcgttttgttttattatttgcggggtcggggggcg

SEQ ID NO: 290 - DNA, 541 bp, Artificial Sequence
  chemically treated genomic DNA (Homo sapiens) CpG-island No: 290
cgccccccgaccccgcaaataataaaacaaaacgaaataaaaaaaaaaaaaaccaacgaaactaaacgaaacccgaaaaacgaaaacctaacgaccgaaccgaacgacgaaactacaaaaaacaaaaacgcgacaaacgcgcgaaaccaacgaaaccaactaaacccgaacccaacccgcgcccgcgccgccatacccctaaccttctacgacaacgaaaaccactcgaccgcctaccgaataaaccaaaaaatcctcaacaacgactactttataaacgcgctcaacgtaataccgcacgtcttcctactcttcatcaccttccccatcctcttcattaataaatacgcgcaacgaaccgcgaaaaaaaaaacgaaaaaacaaaaaaaaaaaaaaaaacgatacgcgccgcaccgctcgacgtccccttccgacccgcgaccgccgtccgcctcgttcccgaaatcccctaccctatatcctacccgccgatccccgcactcgcacaccaactcatcccttcactcccccgatacccccg

SEQ ID NO: 291 - DNA, 541 bp, Artificial Sequence
  chemically treated genomic DNA (Homo sapiens) CpG-island No: 291
cgtttttcggtttcgtaggtggtggagtagggcggggtgagggagggggaggttagcggggttgggcggggttcggggggcgggggtttgacggtcgggtcgggcggcggagttgtaagggatagaggcgcggtaggcgcgcggagttagcggagttagttgagttcgagtttagttcgcgttcgcgtcgttatgtttttggttttttgcggtagcgagaattattcggtcgtttatcgggtggattagggggtttttaataacggttgttttgtggacgcgtttaacgtggtgtcgtacgtttttttattttttattattttttttattttttttattggtgagtgcgcgtagcgagtcgcggaggaggggacgggagagtagggagggaggaggaggcgatgcgcgtcgtatcgttcggcgttttttttcggttcgcgatcgtcgttcgtttcgttttcggggttttttgttttgtgttttgttcgtcggttttcgtattcgtatattagtttatttttttattttttcggtgttttcg

SEQ ID NO: 292 - DNA, 541 bp, Artificial Sequence
  chemically treated genomic DNA (Homo sapiens) CpG-island No: 292
cgaaaacaccgaaaaaataaaaaaataaactaatatacgaatacgaaaaccgacgaacaaaacacaaaacaaaaaaccccgaaaacgaaacgaacgacgatcgcgaaccgaaaaaaaacgccgaacgatacgacgcgcatcgcctcctcctccctccctactctcccgtcccctcctccgcgactcgctacgcgcactcaccaataaaaaaaataaaaaaaataataaaaaataaaaaaacgtacgacaccacgttaaacgcgtccacaaaacaaccgttattaaaaaccccctaatccacccgataaacgaccgaataattctcgctaccgcaaaaaaccaaaaacataacgacgcgaacgcgaactaaactcgaactcaactaactccgctaactccgcgcgcctaccgcgcctctatcccttacaactccgccgcccgacccgaccgtcaaacccccgccccccgaaccccgcccaaccccgctaacctccccctccctcaccccgccctactccaccacctacgaaaccgaaaaacg

SEQ ID NO: 293 - DNA, 631 bp, Artificial Sequence
  chemically treated genomic DNA (Homo sapiens) CpG-island No: 293
cgcgggtcgggcgcggggaggtgttatgcgtcggaatttgcgtttggggttaagttttggagttgacgcgtaggggtaaggcgtttcgcgtttcggattggcggtttcgcgtatgttttttttatcggcgtcgtaggtttcgagaggtttcggaagtattgggtgtagtttgatggcgtaggaggtagatacggtatagggcgtcgagatgcggcggggcgcgggcgcggttcggggacgcgttttttggtgttgggttttggcgttgttttggttcgcggtggtttcgggttggtttcgggtttcgggtattttttttcggcgttattggtcggtgttttataagtgagtgcggcggcgcgcgtattgtcggggttggggtcggcgttgacgatgggggatggggtgttggggcggggatttttgtttatcgtggtttgtgtcgggttacgagatggtgcggggatagcgtcgggtgacgttcggagcgtatttgagagtaaagttgaggattggggagtcgtagtcgttcgttacgtgtagttttgggatttttcgttttttttggttatttgcggtagatttaggatagttttgaatcgtggaagaagaaaaggagagtaatgttatt

SEQ ID NO: 294 - DNA, 631 bp, Artificial Sequence
  chemically treated genomic DNA (Homo sapiens) CpG-island No: 294
aataacattactctccttttcttcttccacgattcaaaactatcctaaatctaccgcaaataaccaaaaaaaacgaaaaatcccaaaactacacgtaacgaacgactacgactccccaatcctcaactttactctcaaatacgctccgaacgtcacccgacgctatccccgcaccatctcgtaacccgacacaaaccacgataaacaaaaatccccgccccaacaccccatcccccatcgtcaacgccgaccccaaccccgacaatacgcgcgccgccgcactcacttataaaacaccgaccaataacgccgaaaaaaaatacccgaaacccgaaaccaacccgaaaccaccgcgaaccaaaacaacgccaaaacccaacaccaaaaaacgcgtccccgaaccgcgcccgcgccccgccgcatctcgacgccctataccgtatctacctcctacgccatcaaactacacccaatacttccgaaacctctcgaaacctacgacgccgataaaaaaaacatacgcgaaaccgccaatccgaaacgcgaaacgccttacccctacgcgtcaactccaaaacttaaccccaaacgcaaattccgacgcataacacctccccgcgcccgacccgcg

SEQ ID NO: 295 - DNA, 631 bp, Artificial Sequence
  chemically treated genomic DNA (Homo sapiens) CpG-island No: 295
aataatattattttttttttttttttttacgatttaggattgttttgagtttgtcgtaagtgattagaggggacgaaaggttttagggttgtacgtaacgagcggttgcgattttttagtttttaattttgtttttaagtgcgtttcgagcgttattcggcgttgttttcgtattatttcgtgattcgatataaattacggtgagtaggggttttcgttttagtattttattttttatcgttaacgtcgattttaatttcgatagtgcgcgcgtcgtcgtatttatttgtagggtatcggttagtggcgtcgggaggggatgttcgagattcgggattagttcggaattatcgcgagttaaagtagcgttagggtttagtattaggaagcgcgttttcgagtcgcgttcgcgtttcgtcgtatttcggcgttttgtgtcgtgtttattttttgcgttattaggttgtatttagtattttcggagtttttcgaggtttgcgacgtcggtgggaggagtatgcgcggagtcgttagttcgggacgcggggcgttttgtttttgcgcgttagttttagagtttggttttaagcgtaggtttcggcgtatgatattttttcgcgttcggttcgcg

SEQ ID NO: 296 - DNA, 631 bp, Artificial Sequence
  chemically treated genomic DNA (Homo sapiens) CpG-island No: 296
cgcgaaccgaacgcgaaaaaatatcatacgccgaaacctacgcttaaaaccaaactctaaaactaacgcgcaaaaacaaaacgccccgcgtcccgaactaacgactccgcgcatactcctcccaccgacgtcgcaaacctcgaaaaactccgaaaatactaaatacaacctaataacgcaaaaaataaacacgacacaaaacgccgaaatacgacgaaacgcgaacgcgactcgaaaacgcgcttcctaatactaaaccctaacgctactttaactcgcgataattccgaactaatcccgaatctcgaacatcccctcccgacgccactaaccgataccctacaaataaatacgacgacgcgcgcactatcgaaattaaaatcgacgttaacgataaaaaataaaatactaaaacgaaaacccctactcaccgtaatttatatcgaatcacgaaataatacgaaaacaacgccgaataacgctcgaaacgcacttaaaaacaaaattaaaaactaaaaaatcgcaaccgctcgttacgtacaaccctaaaacctttcgtcccctctaatcacttacgacaaactcaaaacaatcctaaatcgtaaaaaaaaaaaaaaaaaataatattatt

SEQ ID NO: 297 - DNA, 934 bp, Artificial Sequence
  chemically treated genomic DNA (Homo sapiens) CpG-island No: 297
tcgacgtcgggagagtttatagagtgcgagttttatggtgtttgttattagttttcgttaagggttataaagtttggtaggagtcgcggcgaattcgggagcggcggcgtcgcgggtaggttgtaggcggtcgtcgtatacgtattacgttttgttgatatgtttggaagtaggtacggcggggaaacgtttttaagtaagttttaaggtttgggtgtcgcgtttcgcgtttcgttcggtatttttgaggagcggttcgcgcgcgtttcggttttcgcgtttttttttattttattttatttcggttcgtttatagacggttcgcggttttttttcggtttcgtcgtcgtagcggggttcggttttgttttttcgtcgttatttgttgtcgggggcggttttttttatatattatttcgtgtttcggggacggcggcggttgtaggtttcgcggtttttatatgaggcgtttttggtttttcgtttcgcgttttcgtagtcgcggtttttcgcgtttcgttcgtattcgaggcgttggtttcgcggagggcgttaacgcggttttatttttgcggttttggttgtttagaaagaagtttttttttttagtttcgcgttgtttgtgtttagggattttcggcgtcgcgagagattattttagcgagcggttgttatcgcgtaagttttttgtatttgggttataaatagcgagtttaaaatggcgtttagggttcgcggtcgcgcgtttttttggcgcgttttcgtttaagggggcgggaagggggcggggggggggcggagttcggcgggagtagggtcgcgtttaagcgggagcgcgcgttgcggtcgttttagtttttttgttgtgggacgagtttttgtttttttgttagagatgtgattttcgtttgaaggggattttttttgttgtttt

SEQ ID NO: 298 - DNA, 934 bp, Artificial Sequence
  chemically treated genomic DNA (Homo sapiens) CpG-island No: 298
aaaacaacaaaaaaaatccccttcaaacgaaaatcacatctctaacaaaaaaacaaaaactcgtcccacaacaaaaaaactaaaacgaccgcaacgcgcgctcccgcttaaacgcgaccctactcccgccgaactccgccccccccccgcccccttcccgcccccttaaacgaaaacgcgccaaaaaaacgcgcgaccgcgaaccctaaacgccattttaaactcgctatttataacccaaatacaaaaaacttacgcgataacaaccgctcgctaaaataatctctcgcgacgccgaaaatccctaaacacaaacaacgcgaaactaaaaaaaaaaacttctttctaaacaaccaaaaccgcaaaaataaaaccgcgttaacgccctccgcgaaaccaacgcctcgaatacgaacgaaacgcgaaaaaccgcgactacgaaaacgcgaaacgaaaaaccaaaaacgcctcatataaaaaccgcgaaacctacaaccgccgccgtccccgaaacacgaaataatatataaaaaaaaccgcccccgacaacaaataacgacgaaaaaacaaaaccgaaccccgctacgacgacgaaaccgaaaaaaaaccgcgaaccgtctataaacgaaccgaaataaaataaaataaaaaaaaacgcgaaaaccgaaacgcgcgcgaaccgctcctcaaaaataccgaacgaaacgcgaaacgcgacacccaaaccttaaaacttacttaaaaacgtttccccgccgtacctacttccaaacatatcaacaaaacgtaatacgtatacgacgaccgcctacaacctacccgcgacgccgccgctcccgaattcgccgcgactcctaccaaactttataacccttaacgaaaactaataacaaacaccataaaactcgcactctataaactctcccgacgtcga

SEQ ID NO: 299 - DNA, 934 bp, Artificial Sequence
  chemically treated genomic DNA (Homo sapiens) CpG-island No: 299
aaaataataaaaaaaattttttttaagcgggagttatatttttggtaggaaggtagaggttcgttttatagtaaggagattggggcggtcgtagcgcgcgttttcgtttgggcgcggttttattttcgtcgggtttcgtttttttttcgtttttttttcgtttttttgggcggggacgcgttagggaagcgcgcggtcgcgagttttgggcgttattttagattcgttgtttgtggtttaggtgtaggaagtttacgcggtggtagtcgttcgttgaggtagtttttcgcggcgtcggggatttttgaatatagatagcgcgggattgagaaggaaagtttttttttgggtagttagagtcgtaaaggtggagtcgcgttggcgtttttcgcgggattagcgtttcggatgcgggcggagcgcggggggtcgcggttgcgggagcgcgaagcggggggttaggggcgttttatgtgagagtcgcgggatttgtagtcgtcgtcgttttcggagtacggggtggtgtgtgggggaagtcgttttcggtagtaggtaacggcggaggggtagggtcgagtttcgttgcgacggcggagtcggggagggatcgcggatcgtttgtgggcgggtcggggtggggtggggtgggggggggcgcgggggtcggggcgcgcgcgggtcgttttttaggagtgtcgggcggggcgcggggcgcggtatttagattttggagtttgtttgggggcgttttttcgtcgtgtttgtttttaaatatgttaataaggcgtggtgcgtgtgcggcggtcgtttgtagtttgttcgcgacgtcgtcgttttcgggttcgtcgcggtttttgttaggttttatgatttttggcgggggttggtgataggtattatggagttcgtattttgtgggttttttcggcgtcgg

SEQ ID NO: 300 - DNA, 934 bp, Artificial Sequence
  chemically treated genomic DNA (Homo sapiens) CpG-island No: 300
ccgacgccgaaaaaacccacaaaatacgaactccataatacctatcaccaacccccgccaaaaatcataaaacctaacaaaaaccgcgacgaacccgaaaacgacgacgtcgcgaacaaactacaaacgaccgccgcacacgcaccacgccttattaacatatttaaaaacaaacacgacgaaaaaacgcccccaaacaaactccaaaatctaaataccgcgccccgcgccccgcccgacactcctaaaaaacgacccgcgcgcgccccgacccccgcgcccccccccaccccaccccaccccgacccgcccacaaacgatccgcgatccctccccgactccgccgtcgcaacgaaactcgaccctacccctccgccgttacctactaccgaaaacgacttcccccacacaccaccccgtactccgaaaacgacgacgactacaaatcccgcgactctcacataaaacgcccctaaccccccgcttcgcgctcccgcaaccgcgaccccccgcgctccgcccgcatccgaaacgctaatcccgcgaaaaacgccaacgcgactccacctttacgactctaactacccaaaaaaaaactttccttctcaatcccgcgctatctatattcaaaaatccccgacgccgcgaaaaactacctcaacgaacgactaccaccgcgtaaacttcctacacctaaaccacaaacaacgaatctaaaataacgcccaaaactcgcgaccgcgcgcttccctaacgcgtccccgcccaaaaaaacgaaaaaaaaacgaaaaaaaaacgaaacccgacgaaaataaaaccgcgcccaaacgaaaacgcgcgctacgaccgccccaatctccttactataaaacgaacctctaccttcctaccaaaaatataactcccgcttaaaaaaaattttttttattatttt

SEQ ID NO: 301 - DNA, 518 bp, Artificial Sequence
  chemically treated genomic DNA (Homo sapiens) CpG-island No: 301
gatttttagattttcggggtgtttagttcgagtttgggtcgttaggggtcgcgggtttggcgggcggggcgggggtcggggtcgggggttcggcgagttttaatgcgcgtataaagttttatttgtaggttaatgtcgcggtatattcgttttttttttcgttcggcgttttttgttcggtcgcgttcgtttttcgcgttagatggtcgcggaaatgttaatttcgggagtttttgtttttttattttcgcgtttaattgcgtttttgtagatgggtcgcgagtgtgcgttttatgtagatgagcgcggtttcgtcgtttttttcggattttcgggagtcgcggtcgggcgtgttggggtcgagggtagggagggggtcgttgtttttttattcgacgcgtcgtcgggtacgggcgggtatttagcggttcgggttcgggaagcgcgtttttttttttttatttttttaaaatgggattttaagtgattttgaatgaaaataaattggttcgtttttt

SEQ ID NO: 302 - DNA, 518 bp, Artificial Sequence
  chemically treated genomic DNA (Homo sapiens) CpG-island No: 302
aaaaaacgaaccaatttattttcattcaaaatcacttaaaatcccattttaaaaaaataaaaaaaaaaaaacgcgcttcccgaacccgaaccgctaaatacccgcccgtacccgacgacgcgtcgaataaaaaaacaacgaccccctccctaccctcgaccccaacacgcccgaccgcgactcccgaaaatccgaaaaaaacgacgaaaccgcgctcatctacataaaacgcacactcgcgacccatctacaaaaacgcaattaaacgcgaaaataaaaaaacaaaaactcccgaaattaacatttccgcgaccatctaacgcgaaaaacgaacgcgaccgaacaaaaaacgccgaacgaaaaaaaaaacgaatataccgcgacattaacctacaaataaaactttatacgcgcattaaaactcgccgaacccccgaccccgacccccgccccgcccgccaaacccgcgacccctaacgacccaaactcgaactaaacaccccgaaaatctaaaaatc

SEQ ID NO: 303 - DNA, 518 bp, Artificial Sequence
  chemically treated genomic DNA (Homo sapiens) CpG-island No: 303
agaaagcgggttaatttgtttttatttagaattatttaagattttattttggagaaatgaaaagagagaagcgcgtttttcgggttcgggtcgttgggtgttcgttcgtgttcggcggcgcgtcgagtggagggatagcggttttttttttgttttcggttttagtacgttcggtcgcggttttcggaggttcgaggaaggcggcgaggtcgcgtttatttgtatgaagcgtatattcgcggtttatttgtaaaggcgtaattaaacgcgggggtgggggggtaggggttttcgaaattagtattttcgcggttatttggcgcgaggagcgggcgcggtcggataaagggcgtcgggcgaggggagaggcgagtgtgtcgcggtattgatttgtaaatgaggttttgtgcgcgtattaaagttcgtcggattttcgatttcggttttcgtttcgttcgttaggttcgcggtttttagcggtttaggttcggattgggtatttcgaaggtttgggggtt

SEQ ID NO: 304 - DNA, 518 bp, Artificial Sequence
  chemically treated genomic DNA (Homo sapiens) CpG-island No: 304
aacccccaaaccttcgaaatacccaatccgaacctaaaccgctaaaaaccgcgaacctaacgaacgaaacgaaaaccgaaatcgaaaatccgacgaactttaatacgcgcacaaaacctcatttacaaatcaataccgcgacacactcgcctctcccctcgcccgacgccctttatccgaccgcgcccgctcctcgcgccaaataaccgcgaaaatactaatttcgaaaacccctacccccccacccccgcgtttaattacgcctttacaaataaaccgcgaatatacgcttcatacaaataaacgcgacctcgccgccttcctcgaacctccgaaaaccgcgaccgaacgtactaaaaccgaaaacaaaaaaaaaaccgctatccctccactcgacgcgccgccgaacacgaacgaacacccaacgacccgaacccgaaaaacgcgcttctctcttttcatttctccaaaataaaatcttaaataattctaaataaaaacaaattaacccgctttct

SEQ ID NO: 305 - DNA, 707 bp, Artificial Sequence
  chemically treated genomic DNA (Homo sapiens) CpG-island No: 305
gggggttgttgtgtcgacgcggatttgttatatggttgcgcggagttaggaagaatgggtttttgtgtgtgcgatcgggacgtagcggcgcgggtcgtgttagtcgggcggagtcgggtgttcgacggcgtaggacgagcgggcgtaggacgagcgagcgtagcgggcgcgggcgtatcgtcggggcgcggggatttcgagggttagcggagtcgtgttgcgcgtagggatggacgttgggcgtttaaggttcgttttcgtggataggcgcgcggagggtagtaggatcgatgtatcgacggacgtatcgacggacgcgcggatagatgcgtcgatcgtaggttttttcgtcgtttcggggtcgtcgtgttcgtgtaggtcgcgagtagcggcggggtcggttttgcggttgtagtagttttattgtgaggtcggcgagataatgggcggttcgaggaggtatttgttcgtttgaaaggtttataaatcgtcgtcgcgtttagttgttttttcgttttttttcgcggattcgttagcgggaagcgcggtcgcggtcgggagggggaggttcggttcgatagtcgggtagggtcgtttgggttatcgacgcgcgttttttttcgtttgggcgggtttggattttggtcgcgtttagtattgtttttagttttttttttggagtttgtattttaggttttttttcggtt

SEQ ID NO: 306 - DNA, 707 bp, Artificial Sequence
  chemically treated genomic DNA (Homo sapiens) CpG-island No: 306
aaccgaaaaaaaacctaaaatacaaactccaaaaaaaaaactaaaaacaatactaaacgcgaccaaaatccaaacccgcccaaacgaaaaaaaacgcgcgtcgataacccaaacgaccctacccgactatcgaaccgaacctccccctcccgaccgcgaccgcgcttcccgctaacgaatccgcgaaaaaaaacgaaaaaacaactaaacgcgacgacgatttataaacctttcaaacgaacaaatacctcctcgaaccgcccattatctcgccgacctcacaataaaactactacaaccgcaaaaccgaccccgccgctactcgcgacctacacgaacacgacgaccccgaaacgacgaaaaaacctacgatcgacgcatctatccgcgcgtccgtcgatacgtccgtcgatacatcgatcctactaccctccgcgcgcctatccacgaaaacgaaccttaaacgcccaacgtccatccctacgcgcaacacgactccgctaaccctcgaaatccccgcgccccgacgatacgcccgcgcccgctacgctcgctcgtcctacgcccgctcgtcctacgccgtcgaacacccgactccgcccgactaacacgacccgcgccgctacgtcccgatcgcacacacaaaaacccattcttcctaactccgcgcaaccatataacaaatccgcgtcgacacaacaaccccc

SEQ ID NO: 307 - DNA, 707 bp, Artificial Sequence
  chemically treated genomic DNA (Homo sapiens) CpG-island No: 307
ggtcgggaagaagtttggagtgtagattttagaggggaggttggaggtagtattagacgcggttagagtttagattcgtttaggcgggagggagcgcgcgtcggtggtttaggcggttttgttcgattgtcggatcgagtttttttttttcggtcgcggtcgcgtttttcgttagcgggttcgcggggaggggcgggaaggtagttggacgcggcggcgatttatgggttttttaggcgagtaggtgttttttcgggtcgtttattgtttcgtcggttttataatggggttgttgtagtcgtagagtcggtttcgtcgttgttcgcggtttgtacgggtacgacggtttcgggacggcgggagagtttgcggtcggcgtatttgttcgcgcgttcgtcggtgcgttcgtcggtgtatcggttttgttgtttttcgcgcgtttgtttacgggaacgggttttgggcgtttagcgtttatttttgcgcgtagtacggtttcgttggttttcggggttttcgcgtttcgacggtgcgttcgcgttcgttgcgttcgttcgttttgcgttcgttcgttttgcgtcgtcgggtattcggtttcgttcggttggtacggttcgcgtcgttgcgtttcggtcgtatatataggggtttattttttttggtttcgcgtaattatatggtaaattcgcgtcgatatagtagttttt

SEQ ID NO: 308 - DNA, 707 bp, Artificial Sequence
  chemically treated genomic DNA (Homo sapiens) CpG-island No: 308
aaaaactactatatcgacgcgaatttaccatataattacgcgaaaccaaaaaaaataaacccctatatatacgaccgaaacgcaacgacgcgaaccgtaccaaccgaacgaaaccgaatacccgacgacgcaaaacgaacgaacgcaaaacgaacgaacgcaacgaacgcgaacgcaccgtcgaaacgcgaaaaccccgaaaaccaacgaaaccgtactacgcgcaaaaataaacgctaaacgcccaaaacccgttcccgtaaacaaacgcgcgaaaaacaacaaaaccgatacaccgacgaacgcaccgacgaacgcgcgaacaaatacgccgaccgcaaactctcccgccgtcccgaaaccgtcgtacccgtacaaaccgcgaacaacgacgaaaccgactctacgactacaacaaccccattataaaaccgacgaaacaataaacgacccgaaaaaacacctactcgcctaaaaaacccataaatcgccgccgcgtccaactaccttcccgcccctccccgcgaacccgctaacgaaaaacgcgaccgcgaccgaaaaaaaaaaactcgatccgacaatcgaacaaaaccgcctaaaccaccgacgcgcgctccctcccgcctaaacgaatctaaactctaaccgcgtctaatactacctccaacctcccctctaaaatctacactccaaacttcttcccgacc

SEQ ID NO: 309 - DNA, 2395 bp, Artificial Sequence
  chemically treated genomic DNA (Homo sapiens) CpG-island No: 309
cgaggtttagcgtttttttaacgttcgttgtttcggtaggttttttcggggttttttgggttttaaattgcgaggagaggggcggttagtaaagtcggcggggattcggcgggtcggtttttcgcgtttttttaggtgcgttgtatttatttggtttatcgtagttttttgcgcggggtttgttttatcgagtttacgttaggggcggcgtttggagagggatacggcgcggggatatcgttcgacgattttttaggcgttgattttttgcgtttggcgaagaaatttgcgggcgatagcgcgcgcggtcggttagggcggggtcggttcggagattcgagagggggtcgggagagggcgcggggcgcgggtcggtcggggtgggggcgtcgttttcgttcgcgtcgaggttcgcggcgggttagttttgtttacgtcgtcgcgtaatgtgttgtgtaagtatttttttttgtttcgcggttaagtttttcggggtcgtcgtcgcgtttaattttttttacgtcgtgtttacggggcgcgggcgcgttcggggaggggttttcgcggtcgggggcgaaaattgcgttttcggggggtcgcggtcgggatttagttttttatttcggttcgcgcgaagtcgttttattcgagaagaacggggtcgcgaagtcgttggagggtataataacggggcggggaggggggtaagcgtagtcgcgttttgagcgttgcgggttttttaatgttacgggaggaggcgggaatttagcgaggttttcgagggttggggggatcggtcggtcggataaagcggggtcggttcgggtcggggcggggtcgtgcggggtttatcggagattagaggttcggatagttttttgatcgtcgcgtcgttggcgttggcggtcgcggtgtcggtcgcgggacgtttcgaaattttcgagtgtagttggttagcgagaggtttttggtcgcgttgtttttggttcgcgttttgttcggcgtttttttgaggcgtcgcgttcggggtcggggtcggggcgggggtcggggttcgggttcgggtcggggttggggttcgggtcgcgattggagtcggggtcggagtcggagtcggagtcggggtcggggtcggggttaggatcgcgatcgcgatcggagtcgcgatcggagtcgcgatcggagtcggagtcggggtcggggttggagttaggatcgggattgggggcggggtggacgtcggggtcgggatcgggatattaggtagttgtttcggcgttttttcgaggtcgtcgagggatttagcggtcggttcgaggggcgggttgatagttatcgcgatcgcgacgggtcgcggcgttagtagtaggcggtagcgttttatttgtatcgtttcgcggtagaacgcgggtatcgagtcgttgtttatttcggtttattgtaggcgtttagggtttcgtagcggtatgttttgttggaagtcgtaattttagcggttttggttttcggcgtttagttcggttaggcgggtttgtagttcgcggtttagtttttcgtggtttatcggttcgaagaggttgcggtaggcgttggtgcgtattagtattgggaaggttttacgggcgataagacgttttatcgtggatgtgttgcggagggacgcgtcggatatggttcggggttgcgtaaacgcgggtagcgagagaggagaggatagcgagaagaaggggaaaggagaggaggagagggcggaggtcgggcgtaagggagatttcgcgtcgttcgattttgcgtgtgcgagggacgcggcggttatttggttgttcggtggtggatttttttgcgtcgggttcgtttgtttcgttcggacggtagtcgcgttttttcgatgtttgttggttagttcgttcgtttaggtttggtcggtatttttcgagtatagcgtatttggtttgtggaacgtttagttcgtttgcgttttttttatacgcgcgggttttattttcgtgcgcgcgggttcggtcgcgattagtataatgtagtatttttagttttaataatattacggcgattggcggtcgtttcgttgtttcgtttcgtcgcggttcggttttcgcgtatcgtttattggtcgcgcgtatatttatcgggggcggggcggggcgcgcggtcggggcgcgcggttgattggcggtcgcggggcgagcgcgttgtagtaggggaagggggcggtgagcggggcgggggcgggagttaaagggcgttgcgggcggtaacgtgatatcgcgacgtttcgttttttcgttttattttttttgtaatatttttttattttttcggttttcgtttttcgtcggtttttttgtttgtaggcgggggttttagtttagcgcgg

SEQ ID NO: 310 - DNA, 2395 bp, Artificial Sequence
  chemically treated genomic DNA (Homo sapiens) CpG-island No: 310
ccgcgctaaactaaaacccccgcctacaaacaaaaaaaccgacgaaaaacgaaaaccgaaaaaataaaaaaatattacaaaaaaaataaaacgaaaaaacgaaacgtcgcgatatcacgttaccgcccgcaacgccctttaactcccgcccccgccccgctcaccgcccccttcccctactacaacgcgctcgccccgcgaccgccaatcaaccgcgcgccccgaccgcgcgccccgccccgcccccgataaatatacgcgcgaccaataaacgatacgcgaaaaccgaaccgcgacgaaacgaaacaacgaaacgaccgccaatcgccgtaatattattaaaactaaaaatactacattatactaatcgcgaccgaacccgcgcgcacgaaaataaaacccgcgcgtataaaaaaaacgcaaacgaactaaacgttccacaaaccaaatacgctatactcgaaaaataccgaccaaacctaaacgaacgaactaaccaacaaacatcgaaaaaacgcgactaccgtccgaacgaaacaaacgaacccgacgcaaaaaaatccaccaccgaacaaccaaataaccgccgcgtccctcgcacacgcaaaatcgaacgacgcgaaatctcccttacgcccgacctccgccctctcctcctctcctttccccttcttctcgctatcctctcctctctcgctacccgcgtttacgcaaccccgaaccatatccgacgcgtccctccgcaacacatccacgataaaacgtcttatcgcccgtaaaaccttcccaatactaatacgcaccaacgcctaccgcaacctcttcgaaccgataaaccacgaaaaactaaaccgcgaactacaaacccgcctaaccgaactaaacgccgaaaaccaaaaccgctaaaattacgacttccaacaaaacataccgctacgaaaccctaaacgcctacaataaaccgaaataaacaacgactcgatacccgcgttctaccgcgaaacgatacaaataaaacgctaccgcctactactaacgccgcgacccgtcgcgatcgcgataactatcaacccgcccctcgaaccgaccgctaaatccctcgacgacctcgaaaaaacgccgaaacaactacctaatatcccgatcccgaccccgacgtccaccccgcccccaatcccgatcctaactccaaccccgaccccgactccgactccgatcgcgactccgatcgcgactccgatcgcgatcgcgatcctaaccccgaccccgaccccgactccgactccgactccgaccccgactccaatcgcgacccgaaccccaaccccgacccgaacccgaaccccgacccccgccccgaccccgaccccgaacgcgacgcctcaaaaaaacgccgaacaaaacgcgaaccaaaaacaacgcgaccaaaaacctctcgctaaccaactacactcgaaaatttcgaaacgtcccgcgaccgacaccgcgaccgccaacgccaacgacgcgacgatcaaaaaactatccgaacctctaatctccgataaaccccgcacgaccccgccccgacccgaaccgaccccgctttatccgaccgaccgatccccccaaccctcgaaaacctcgctaaattcccgcctcctcccgtaacattaaaaaacccgcaacgctcaaaacgcgactacgcttacccccctccccgccccgttattataccctccaacgacttcgcgaccccgttcttctcgaataaaacgacttcgcgcgaaccgaaataaaaaactaaatcccgaccgcgaccccccgaaaacgcaattttcgcccccgaccgcgaaaacccctccccgaacgcgcccgcgccccgtaaacacgacgtaaaaaaaattaaacgcgacgacgaccccgaaaaacttaaccgcgaaacaaaaaaaaatacttacacaacacattacgcgacgacgtaaacaaaactaacccgccgcgaacctcgacgcgaacgaaaacgacgcccccaccccgaccgacccgcgccccgcgccctctcccgaccccctctcgaatctccgaaccgaccccgccctaaccgaccgcgcgcgctatcgcccgcaaatttcttcgccaaacgcaaaaaatcaacgcctaaaaaatcgtcgaacgatatccccgcgccgtatccctctccaaacgccgcccctaacgtaaactcgataaaacaaaccccgcgcaaaaaactacgataaaccaaataaatacaacgcacctaaaaaaacgcgaaaaaccgacccgccgaatccccgccgactttactaaccgcccctctcctcgcaatttaaaacccaaaaaaccccgaaaaaacctaccgaaacaacgaacgttaaaaaaacgctaaacctcg

SEQ ID NO: 311 - DNA, 2395 bp, Artificial Sequence
  chemically treated genomic DNA (Homo sapiens) CpG-island No: 311
tcgcgttgggttgaggttttcgtttgtagataaaggagtcggcggggggcgggagtcgggggggtgggggagtgttgtaggggggatggggcgagggggcggggcgtcgcggtgttacgttatcgttcgtagcgttttttaattttcgttttcgtttcgtttatcgttttttttttttgttatagcgcgttcgtttcgcggtcgttaattagtcgcgcgtttcggtcgcgcgtttcgtttcgttttcggtgggtgtgcgcgcggttaatgggcggtgcgcgggggtcgggtcgcggcggggcggggtagcggggcggtcgttaatcgtcgtggtgttgttgaaattgaaaatattatattatgttaatcgcggtcgggttcgcgcgtacgggggtggggttcgcgcgtataaagggggcgtaggcgggttgggcgttttataggttaagtgcgttgtgttcgaggggtgtcggttaggtttgagcgagcgagttagttagtaggtatcgagggggcgcggttgtcgttcggacgagataggcgaattcgacgtagaagagtttattatcggatagttaggtagtcgtcgcgtttttcgtatacgtagagtcgggcggcgcggggttttttttgcgttcggttttcgttttttttttttttttttttttttttttttcgttgtttttttttttttcgttgttcgcgtttgcgtagtttcgggttatgttcgacgcgttttttcgtagtatatttacgatggagcgttttgtcgttcgtgggatttttttagtattagtgcgtattagcgtttgtcgtagttttttcgggtcggtggattacgaggagttgagtcgcgagttgtaggttcgtttggtcgagttgaacgtcgaggattagaatcgttgggattacgatttttagtaggatatgtcgttgcggggttttggacgtttgtagtggatcgaagtggatagcgattcggtgttcgcgttttatcgcgagacggtgtaggtggggcgttgtcgtttgttgttggcgtcgcggttcgtcgcggtcgcggtggttgttagttcgtttttcgagtcggtcgttgagtttttcgacggtttcgaggaggcgtcggagtagttgtttagtgtttcggtttcggtttcggcgtttatttcgtttttagtttcggttttggttttagtttcggtttcggtttcggtttcggtcgcggtttcggtcgcggtttcggtcgcggtcgcggttttggtttcggtttcggtttcggtttcggtttcggtttcggtttcggttttagtcgcggttcgggttttagtttcggttcgggttcgggtttcggttttcgtttcggtttcggtttcggacgcggcgttttaagagagcgtcgagtagggcgcgaattaggggtagcgcggttaggagtttttcgttgattagttgtattcggggatttcgggacgtttcgcggtcggtatcgcggtcgttagcgttaacggcgcggcgattaagaagttgttcgggtttttgattttcggtgagtttcgtacggtttcgtttcggttcgggtcggtttcgttttgttcggtcggtcggtttttttagttttcgggggtttcgttgggttttcgttttttttcgtggtattaaagggttcgtagcgtttagggcgcggttgcgtttattttttttttcgtttcgttgttgtgttttttagcggtttcgcggtttcgtttttttcgggtggagcggtttcgcgcgggtcggggtgggaggttgaatttcggtcgcgatttttcgggagcgtagttttcgttttcggtcgcgggagttttttttcgggcgcgttcgcgtttcgtgagtacggcgtggagggggttaagcgcggcggcggtttcggggggtttggtcgcgggataaggggaaatgtttatatagtatattgcgcggcgacgtaaataaagttgattcgtcgcggatttcggcgcgggcggggacggcgtttttatttcggtcggttcgcgtttcgcgttttttttcggttttttttcgggttttcgggtcggtttcgttttgatcggtcgcgcgcgttgtcgttcgtagattttttcgttaagcgtaagagattagcgtttgagaagtcgtcgggcgatgttttcgcgtcgtgtttttttttaagcgtcgtttttggcgtgggttcggtggagtagatttcgcgtaagaggttgcggtgagttaagtgagtatagcgtatttgggggggcgcggagggtcgattcgtcgggttttcgtcggttttgttgatcgttttttttttcgtagtttagagtttaaagagtttcgagggaatttgtcggggtagcggacgttggaagggcgttgggtttcg

SEQ ID NO: 312 - DNA, 2395 bp, Artificial Sequence
  chemically treated genomic DNA (Homo sapiens) CpG-island No: 312
cgaaacccaacgcccttccaacgtccgctaccccgacaaattccctcgaaactctttaaactctaaactacgaaaaaaaaaacgatcaacaaaaccgacgaaaacccgacgaatcgaccctccgcgcccccccaaatacgctatactcacttaactcaccgcaacctcttacgcgaaatctactccaccgaacccacgccaaaaacgacgcttaaaaaaaaacacgacgcgaaaacatcgcccgacgacttctcaaacgctaatctcttacgcttaacgaaaaaatctacgaacgacaacgcgcgcgaccgatcaaaacgaaaccgacccgaaaacccgaaaaaaaaccgaaaaaaaacgcgaaacgcgaaccgaccgaaataaaaacgccgtccccgcccgcgccgaaatccgcgacgaatcaactttatttacgtcgccgcgcaatatactatataaacatttccccttatcccgcgaccaaaccccccgaaaccgccgccgcgcttaaccccctccacgccgtactcacgaaacgcgaacgcgcccgaaaaaaaactcccgcgaccgaaaacgaaaactacgctcccgaaaaatcgcgaccgaaattcaacctcccaccccgacccgcgcgaaaccgctccacccgaaaaaaacgaaaccgcgaaaccgctaaaaaacacaacaacgaaacgaaaaaaaaaataaacgcaaccgcgccctaaacgctacgaaccctttaataccacgaaaaaaaacgaaaacccaacgaaacccccgaaaactaaaaaaaccgaccgaccgaacaaaacgaaaccgacccgaaccgaaacgaaaccgtacgaaactcaccgaaaatcaaaaacccgaacaacttcttaatcgccgcgccgttaacgctaacgaccgcgataccgaccgcgaaacgtcccgaaatccccgaatacaactaatcaacgaaaaactcctaaccgcgctacccctaattcgcgccctactcgacgctctcttaaaacgccgcgtccgaaaccgaaaccgaaacgaaaaccgaaacccgaacccgaaccgaaactaaaacccgaaccgcgactaaaaccgaaaccgaaaccgaaaccgaaaccgaaaccgaaaccgaaaccaaaaccgcgaccgcgaccgaaaccgcgaccgaaaccgcgaccgaaaccgaaaccgaaaccgaaactaaaaccaaaaccgaaactaaaaacgaaataaacgccgaaaccgaaaccgaaacactaaacaactactccgacgcctcctcgaaaccgtcgaaaaactcaacgaccgactcgaaaaacgaactaacaaccaccgcgaccgcgacgaaccgcgacgccaacaacaaacgacaacgccccacctacaccgtctcgcgataaaacgcgaacaccgaatcgctatccacttcgatccactacaaacgtccaaaaccccgcaacgacatatcctactaaaaatcgtaatcccaacgattctaatcctcgacgttcaactcgaccaaacgaacctacaactcgcgactcaactcctcgtaatccaccgacccgaaaaaactacgacaaacgctaatacgcactaatactaaaaaaatcccacgaacgacaaaacgctccatcgtaaatatactacgaaaaaacgcgtcgaacataacccgaaactacgcaaacgcgaacaacgaaaaaaaaaaaaacaacgaaaaaaaaaaaaaaaaaaaaaaaaaaaaaacgaaaaccgaacgcaaaaaaaaccccgcgccgcccgactctacgtatacgaaaaacgcgacgactacctaactatccgataataaactcttctacgtcgaattcgcctatctcgtccgaacgacaaccgcgccccctcgatacctactaactaactcgctcgctcaaacctaaccgacacccctcgaacacaacgcacttaacctataaaacgcccaacccgcctacgccccctttatacgcgcgaaccccacccccgtacgcgcgaacccgaccgcgattaacataatataatattttcaatttcaacaacaccacgacgattaacgaccgccccgctaccccgccccgccgcgacccgacccccgcgcaccgcccattaaccgcgcgcacacccaccgaaaacgaaacgaaacgcgcgaccgaaacgcgcgactaattaacgaccgcgaaacgaacgcgctataacaaaaaaaaaaaacgataaacgaaacgaaaacgaaaattaaaaaacgctacgaacgataacgtaacaccgcgacgccccgccccctcgccccatcccccctacaacactcccccacccccccgactcccgccccccgccgactcctttatctacaaacgaaaacctcaacccaacgcga

SEQ ID NO: 313 - DNA, 1101 bp, Artificial Sequence
  chemically treated genomic DNA (Homo sapiens) CpG-island No: 313
attgcggggcgtcgggttttttaaggaggtgtagcgttttcgtttcgtcgtttggggttgaagtggttttttttaaaggtttcggtttcggttgttagggcgtagggttcgtcgggacgcgggtagttatttatcgcggcgggtttatggcgtgcggggtttgggttgcggggatggtttggagggtttcgagggttcggagggtgcggcggtcgcggtagttacggcgttttcggcgggtgcggcgggtgcggtgcgtttttggcggttgcgaaagttttgtagggcgcggcggttttggaaatcgatgagcgttagcgcgatggtcgcgttttagtagttttcgttcgcgtagcggaagtcgatttttttgtggtcggtggtgacgatggtgaagtatacgtatttgttcgtgcgttttacgtagtttattttgaggatggagtggaagcgtagttttttggggcgcgcgcgggggttggcggggaataggtttaggcggtcggaggtgagtatttcgcgtttttttttttatagttggaagaggttgtcgttgcgtttttttaattcgttttcgcgtagtatttcgtcgggggattttatgtcgtgtcgagcgcgggattgggagcggtaatgcgggcggtgacggcgtcggttttgtttttcgtggtttcggcgcggtttttatagttgttttttttcgtttcgttttttttcgtttcgtttcggttttcgggttatttcgttcgtttgagtttcgcgcgtttcgggttatattttttttaagtttagtcgttcgggttcgtatcgtcgcgttcgcgttttggtcggttttcggtcgtttttttttattttaaaagttcgcgttttttttgtttttcgtgttttagttgttcggtttcgtggggtgattcgaggtttcgtttcgttcgggcgttcgttcgtatcgtttcgtaggtcggtttcgcggaagaatgcgttgtagttagttttgttcgcgatgatttacgtcggggagtttcgggaagtatcggagggtcgggggcgggtttatcgtggggagatagtcgggattagatttttattttttaggcgttttaa

SEQ ID NO: 314 - DNA, 1101 bp, Artificial Sequence
  chemically treated genomic DNA (Homo sapiens) CpG-island No: 314
ttaaaacgcctaaaaaataaaaatctaatcccgactatctccccacgataaacccgcccccgaccctccgatacttcccgaaactccccgacgtaaatcatcgcgaacaaaactaactacaacgcattcttccgcgaaaccgacctacgaaacgatacgaacgaacgcccgaacgaaacgaaacctcgaatcaccccacgaaaccgaacaactaaaacacgaaaaacaaaaaaaacgcgaacttttaaaataaaaaaaaacgaccgaaaaccgaccaaaacgcgaacgcgacgatacgaacccgaacgactaaacttaaaaaaaatataacccgaaacgcgcgaaactcaaacgaacgaaataacccgaaaaccgaaacgaaacgaaaaaaaacgaaacgaaaaaaaacaactataaaaaccgcgccgaaaccacgaaaaacaaaaccgacgccgtcaccgcccgcattaccgctcccaatcccgcgctcgacacgacataaaatcccccgacgaaatactacgcgaaaacgaattaaaaaaacgcaacgacaacctcttccaactataaaaaaaaaaacgcgaaatactcacctccgaccgcctaaacctattccccgccaacccccgcgcgcgccccaaaaaactacgcttccactccatcctcaaaataaactacgtaaaacgcacgaacaaatacgtatacttcaccatcgtcaccaccgaccacaaaaaaatcgacttccgctacgcgaacgaaaactactaaaacgcgaccatcgcgctaacgctcatcgatttccaaaaccgccgcgccctacaaaactttcgcaaccgccaaaaacgcaccgcacccgccgcacccgccgaaaacgccgtaactaccgcgaccgccgcaccctccgaaccctcgaaaccctccaaaccatccccgcaacccaaaccccgcacgccataaacccgccgcgataaataactacccgcgtcccgacgaaccctacgccctaacaaccgaaaccgaaacctttaaaaaaaaccacttcaaccccaaacgacgaaacgaaaacgctacacctccttaaaaaacccgacgccccgcaat

SEQ ID NO: 315 - DNA, 1101 bp, Artificial Sequence
  chemically treated genomic DNA (Homo sapiens) CpG-island No: 315
ttggggcgtttggagggtgaaggtttggtttcggttgtttttttacggtgggttcgttttcggtttttcggtgtttttcggggtttttcggcgtgagttatcgcgggtagggttggttgtagcgtattttttcgcggggtcggtttgcgagacggtgcgggcgagcgttcgggcggggcgggatttcgagttattttacggggtcggatagttggggtacggggggtaagaggagcgcgggtttttgagatgggaggggacggtcggggatcgattagagcgcggacgcgacggtgcgggttcggacggttgggtttggggagggtatggttcggggcgcgcggggtttaggcgggcggggtggttcgagggtcggggcggggcggggaggggcggggcggggaggggtagttataaaggtcgcgtcggggttacgaggagtagagtcggcgtcgttatcgttcgtattgtcgtttttagtttcgcgttcggtacgatatgaaatttttcgacgaggtgttacgcgagggcgagttggagaagcgtagcgatagttttttttagttatggaagaagaagcgcggggtgtttattttcgatcgtttgagtttgtttttcgttagttttcgcgcgcgttttaaggagttgcgtttttattttatttttaaggtggattgcgtggagcgtacgggtaagtacgtgtattttattatcgttattatcgattataaggagatcgattttcgttgcgcgggcgagagttgttggaacgcggttatcgcgttggcgtttatcgatttttagaatcgtcgcgttttgtaggattttcgtagtcgttaggaacgtatcgtattcgtcgtattcgtcgaggacgtcgtggttgtcgcggtcgtcgtatttttcgagttttcggagttttttaggttattttcgtagtttaaatttcgtacgttatgagttcgtcgcggtgagtgattgttcgcgtttcggcgagttttgcgttttaatagtcgggatcggggtttttgggaaaaattattttaattttagacggcggggcgggggcgttgtatttttttgggggattcggcgtttcgtaat

SEQ ID NO: 316 - DNA, 1101 bp, Artificial Sequence
  chemically treated genomic DNA (Homo sapiens) CpG-island No: 316
attacgaaacgccgaatcccccaaaaaaatacaacgcccccgccccgccgtctaaaattaaaataatttttcccaaaaaccccgatcccgactattaaaacgcaaaactcgccgaaacgcgaacaatcactcaccgcgacgaactcataacgtacgaaatttaaactacgaaaataacctaaaaaactccgaaaactcgaaaaatacgacgaccgcgacaaccacgacgtcctcgacgaatacgacgaatacgatacgttcctaacgactacgaaaatcctacaaaacgcgacgattctaaaaatcgataaacgccaacgcgataaccgcgttccaacaactctcgcccgcgcaacgaaaatcgatctccttataatcgataataacgataataaaatacacgtacttacccgtacgctccacgcaatccaccttaaaaataaaataaaaacgcaactccttaaaacgcgcgcgaaaactaacgaaaaacaaactcaaacgatcgaaaataaacaccccgcgcttcttcttccataactaaaaaaaactatcgctacgcttctccaactcgccctcgcgtaacacctcgtcgaaaaatttcatatcgtaccgaacgcgaaactaaaaacgacaatacgaacgataacgacgccgactctactcctcgtaaccccgacgcgacctttataactacccctccccgccccgcccctccccgccccgccccgaccctcgaaccaccccgcccgcctaaaccccgcgcgccccgaaccataccctccccaaacccaaccgtccgaacccgcaccgtcgcgtccgcgctctaatcgatccccgaccgtcccctcccatctcaaaaacccgcgctcctcttaccccccgtaccccaactatccgaccccgtaaaataactcgaaatcccgccccgcccgaacgctcgcccgcaccgtctcgcaaaccgaccccgcgaaaaaatacgctacaaccaaccctacccgcgataactcacgccgaaaaaccccgaaaaacaccgaaaaaccgaaaacgaacccaccgtaaaaaaacaaccgaaaccaaaccttcaccctccaaacgccccaa

SEQ ID NO: 317 - DNA, 826 bp, Artificial Sequence
  chemically treated genomic DNA (Homo sapiens) CpG-island No: 317
tttcgtcgcggtcgtcgttgtttgtttcgattagaacgcggtttcgtttttgttttatcgtttcgaggtttttagagatggtcgtcgtcgcgttcgcgtcggattcgcggttttattcgttcgttcgggttcggtcgttttttttagcgcgtcgttatcggtttagtattcgtgttttcgtattttacgttttttgcggtagtggcggcgattttagtttcgttcgttttggggttgcgtcgtcgtggtttttaataacgtcggtttttattggtcgaggtttttagttttttttttcgcgagtaagataggttgcgattcgtcgagcgcggcgtaagttaattgcgtttcgcgtcgtagttagtaattaattataagttttcgaagaaacgtcgcgttatatgtaaatattttttcgcgcggcgcgcgttttgcgttttttcgtttttttaaatggggcggggtaaggtggagatcgcgtgtgtggtttcggggggtttcgggttttcgttttcgggatttttttcgggtggtattatatttttcgcgggatattgggtattattttttttcgtgggtttcggttttagtcgtttttattttttgcgtttttttagttttttagtttaatttcgttcgcggcgggtcggtgtttttagtatttcgtgcgttcgttgatgtgagaattttattttttatgtcgttttttcgcgttattttttgagaatatcgcggagggttttttcgtttgggagtcgtttttaattagtttcgttagtggttgggacgtaagtttaattttcgtttattttttaggttttaggtt

SEQ ID NO: 318 - DNA, 826 bp, Artificial Sequence
  chemically treated genomic DNA (Homo sapiens) CpG-island No: 318
aacctaaaacctaaaaaataaacgaaaattaaacttacgtcccaaccactaacgaaactaattaaaaacgactcccaaacgaaaaaaccctccgcgatattctcaaaaaataacgcgaaaaaacgacataaaaaataaaattctcacatcaacgaacgcacgaaatactaaaaacaccgacccgccgcgaacgaaattaaactaaaaaactaaaaaaacgcaaaaaataaaaacgactaaaaccgaaacccacgaaaaaaaataatacccaatatcccgcgaaaaatataataccacccgaaaaaaatcccgaaaacgaaaacccgaaaccccccgaaaccacacacgcgatctccaccttaccccgccccatttaaaaaaacgaaaaaacgcaaaacgcgcgccgcgcgaaaaaatatttacatataacgcgacgtttcttcgaaaacttataattaattactaactacgacgcgaaacgcaattaacttacgccgcgctcgacgaatcgcaacctatcttactcgcgaaaaaaaaaactaaaaacctcgaccaataaaaaccgacgttattaaaaaccacgacgacgcaaccccaaaacgaacgaaactaaaatcgccgccactaccgcaaaaaacgtaaaatacgaaaacacgaatactaaaccgataacgacgcgctaaaaaaaacgaccgaacccgaacgaacgaataaaaccgcgaatccgacgcgaacgcgacgacgaccatctctaaaaacctcgaaacgataaaacaaaaacgaaaccgcgttctaatcgaaacaaacaacgacgaccgcgacgaaa

SEQ ID NO: 319 - DNA, 826 bp, Artificial Sequence
  chemically treated genomic DNA (Homo sapiens) CpG-island No: 319
aatttgggatttgggggatgagcgggggttaggtttacgttttaattattaacggggttggttgaaaacggtttttaggcggaggggtttttcgcgatgtttttaaggagtagcgcgaggggacgatataggaggtggggtttttatattagcgggcgtacggagtgttggaggtatcgattcgtcgcggacgggattgaattagggaattgggagggcgtaggagataaagacggttggggtcggggtttacggagaggggtggtgtttagtgtttcgcgagggatgtggtgttattcggggaaggtttcgggagcggggattcgggatttttcggaattatatacgcggtttttattttgtttcgttttatttaaagaggcggaggaacgtagggcgcgcgtcgcgcggaggaatatttgtatatggcgcggcgttttttcggaggtttgtgattggttgttgattgcggcgcgaagcgtagttgatttgcgtcgcgttcggcgaatcgtagtttgttttgttcgcggagagaggagttaggagtttcggttaatgggagtcggcgttgttggaggttacggcggcgtagttttaaagcgagcgaagttagggtcgtcgttattgtcgtaggaggcgtgaggtgcggagatacgggtgttgggtcggtaacggcgcgttggggagggcggtcgggttcggacgggcgggtggggtcgcgggttcggcgcgggcgcggcggcggttatttttggaagtttcggggcggtggggtaggggcggggtcgcgttttggtcggggtaggtagcggcggtcgcggcgggg

SEQ ID NO: 320 - DNA, 826 bp, Artificial Sequence
  chemically treated genomic DNA (Homo sapiens) CpG-island No: 320
ccccgccgcgaccgccgctacctaccccgaccaaaacgcgaccccgcccctaccccaccgccccgaaacttccaaaaataaccgccgccgcgcccgcgccgaacccgcgaccccacccgcccgtccgaacccgaccgccctccccaacgcgccgttaccgacccaacacccgtatctccgcacctcacgcctcctacgacaataacgacgaccctaacttcgctcgctttaaaactacgccgccgtaacctccaacaacgccgactcccattaaccgaaactcctaactcctctctccgcgaacaaaacaaactacgattcgccgaacgcgacgcaaatcaactacgcttcgcgccgcaatcaacaaccaatcacaaacctccgaaaaaacgccgcgccatatacaaatattcctccgcgcgacgcgcgccctacgttcctccgcctctttaaataaaacgaaacaaaataaaaaccgcgtatataattccgaaaaatcccgaatccccgctcccgaaaccttccccgaataacaccacatccctcgcgaaacactaaacaccacccctctccgtaaaccccgaccccaaccgtctttatctcctacgccctcccaattccctaattcaatcccgtccgcgacgaatcgatacctccaacactccgtacgcccgctaatataaaaaccccacctcctatatcgtcccctcgcgctactccttaaaaacatcgcgaaaaacccctccgcctaaaaaccgttttcaaccaaccccgttaataattaaaacgtaaacctaacccccgctcatcccccaaatcccaaatt

SEQ ID NO: 321 - DNA, 978 bp, Artificial Sequence
  chemically treated genomic DNA (Homo sapiens) CpG-island No: 321
tagcggaacgagagggagttgtttttgggtaaacgtcgtcgtttaggagggaagttgtgcgtattttatattttgttttcgtttttttttcgggattaatcgtagcgttttttcgggtgacggacgggtttttaggatttcggagggggacgcggttcgtgcggcgtttcgcgtatttttattttatttcggtcgcgtcgagcgtcgttttcgtttttttataatttttgtacgtattcgtttatttttttttgtttcggtcgagtcgtttcgggttttcgggaaggtgttttcggtaagttcgttttgtagtcggagtaggtgtagtttcgtcgcgtttttaatcgcgtttgtataaatttgtttgttcgcggtaaggggaatattttgttcgtagttcgcgcgggggttcggttggagcgtcgagagataggatttatttcgcgatcgcggtcggttggggcgttcgtattcgcgtttatggttcgtttttttcgggcgtcgagttcgtagtttttcgtagtgttcggagtttagaagtttcggcgttcgtacgttttcggtcgttcgcggtaagcggatttacgcgttcgggtatagggcgtcgtcgtttggtttttcggggttgttggcgttcgggttgaacggcggggcgggcgggcgggcgcggagtcggggcgggtagcgggcgggcgagcgggcgtcgggttttgtatatgtttattcgcgcggttcggggatagcggtcggtcgtcgtcgggttttagaggcgtcggtgcgtatttttcgtcgttcgggggaggggtcgcggtttcgtcggagggggtttacgttttgtttcggttcgcgagaatacgcgcgcggggcgggttatacgcgttattgtcgagtagagacgtcgttatttattttgatatatatatatatatatatatatattagttatttagagttatagttttttatcggggttttacg

SEQ ID NO: 322 - DNA, 978 bp, Artificial Sequence
  chemically treated genomic DNA (Homo sapiens) CpG-island No: 322
cgtaaaaccccgataaaaaactataactctaaataactaatatatatatatatatatatatatatcaaaataaataacgacgtctctactcgacaataacgcgtataacccgccccgcgcgcgtattctcgcgaaccgaaacaaaacgtaaaccccctccgacgaaaccgcgacccctcccccgaacgacgaaaaatacgcaccgacgcctctaaaacccgacgacgaccgaccgctatccccgaaccgcgcgaataaacatatacaaaacccgacgcccgctcgcccgcccgctacccgccccgactccgcgcccgcccgcccgccccgccgttcaacccgaacgccaacaaccccgaaaaaccaaacgacgacgccctatacccgaacgcgtaaatccgcttaccgcgaacgaccgaaaacgtacgaacgccgaaacttctaaactccgaacactacgaaaaactacgaactcgacgcccgaaaaaaacgaaccataaacgcgaatacgaacgccccaaccgaccgcgatcgcgaaataaatcctatctctcgacgctccaaccgaacccccgcgcgaactacgaacaaaatattccccttaccgcgaacaaacaaatttatacaaacgcgattaaaaacgcgacgaaactacacctactccgactacaaaacgaacttaccgaaaacaccttcccgaaaacccgaaacgactcgaccgaaacaaaaaaaaataaacgaatacgtacaaaaattataaaaaaacgaaaacgacgctcgacgcgaccgaaataaaataaaaatacgcgaaacgccgcacgaaccgcgtccccctccgaaatcctaaaaacccgtccgtcacccgaaaaaacgctacgattaatcccgaaaaaaaaacgaaaacaaaatataaaatacgcacaacttccctcctaaacgacgacgtttacccaaaaacaactccctctcgttccgcta

SEQ ID NO: 323 - DNA, 978 bp, Artificial Sequence
  chemically treated genomic DNA (Homo sapiens) CpG-island No: 323
cgtggggtttcggtgaaaggttgtggttttgggtgattggtgtgtgtgtgtgtgtgtgtgtgtattagagtgggtggcggcgtttttgttcggtagtggcgcgtgtggttcgtttcgcgcgcgtgttttcgcgggtcggggtagggcgtgggtttttttcggcggagtcgcgatttttttttcgggcggcgggaggtgcgtatcggcgtttttaggattcggcggcggtcggtcgttgttttcgggtcgcgcgagtgagtatgtgtagagttcggcgttcgttcgttcgttcgttgttcgtttcggtttcgcgttcgttcgttcgtttcgtcgtttagttcggacgttagtagtttcggggagttaggcggcggcgttttgtgttcgggcgcgtgggttcgtttgtcgcgggcggtcggagacgtgcgggcgtcggggtttttgggtttcgggtattgcggggggttgcgggttcggcgttcggggaaggcgggttatgggcgcgggtgcgggcgttttagtcggtcgcgatcgcggggtgagttttgtttttcggcgttttagtcggattttcgcgcgggttgcgagtagggtgttttttttgtcgcgggtaaataagtttgtgtagacgcggttgggagcgcggcggggttgtatttgtttcggttgtagggcgggtttgtcgggggtattttttcgggggttcggggcggttcggtcggggtaggggagagtgagcgggtgcgtgtaggggttgtgggggggcgggggcggcgttcggcgcggtcgggatggggtgggggtgcgcgaggcgtcgtacgagtcgcgttttttttcggagttttgagagttcgttcgttattcgggagggcgttgcggttggtttcggggagggggcgagggtagggtgtggggtgcgtatagttttttttttaggcggcgacgtttatttagaagtagttttttttcgtttcgtta

SEQ ID NO: 324 - DNA, 978 bp, Artificial Sequence
  chemically treated genomic DNA (Homo sapiens) CpG-island No: 324
taacgaaacgaaaaaaaactacttctaaataaacgtcgccgcctaaaaaaaaaactatacgcaccccacaccctaccctcgccccctccccgaaaccaaccgcaacgccctcccgaataacgaacgaactctcaaaactccgaaaaaaaacgcgactcgtacgacgcctcgcgcacccccaccccatcccgaccgcgccgaacgccgcccccgcccccccacaacccctacacgcacccgctcactctcccctaccccgaccgaaccgccccgaacccccgaaaaaatacccccgacaaacccgccctacaaccgaaacaaatacaaccccgccgcgctcccaaccgcgtctacacaaacttatttacccgcgacaaaaaaaacaccctactcgcaacccgcgcgaaaatccgactaaaacgccgaaaaacaaaactcaccccgcgatcgcgaccgactaaaacgcccgcacccgcgcccataacccgccttccccgaacgccgaacccgcaaccccccgcaatacccgaaacccaaaaaccccgacgcccgcacgtctccgaccgcccgcgacaaacgaacccacgcgcccgaacacaaaacgccgccgcctaactccccgaaactactaacgtccgaactaaacgacgaaacgaacgaacgaacgcgaaaccgaaacgaacaacgaacgaacgaacgaacgccgaactctacacatactcactcgcgcgacccgaaaacaacgaccgaccgccgccgaatcctaaaaacgccgatacgcacctcccgccgcccgaaaaaaaaatcgcgactccgccgaaaaaaacccacgccctaccccgacccgcgaaaacacgcgcgcgaaacgaaccacacgcgccactaccgaacaaaaacgccgccacccactctaatacacacacacacacacacacacaccaatcacccaaaaccacaacctttcaccgaaaccccacg

SEQ ID NO: 325 - DNA, 601 bp, Artificial Sequence
  chemically treated genomic DNA (Homo sapiens) CpG-island No: 325
ggtgttggggtttatcgtcgttgtgtttggttggtaatttcgcgtttttatatattttttagagtcgggtttgagtatttattatttttcgtgcgttttttgttatttttttattttcgtttgtgttttttattttatttttttcgtttcgcgtttttttatattagtttgttttttttttttttcgttagcgtgacgtgttttttcgtttttcgtttttcgtttttttagttcgttcgtcgttttttcgtttttttttcgttttttttgcgtcgagcgttatgttattttgtgtttttttcgtttcgtttttttcgtttttttagttacgtttcgtttttttattttttcgcgtcgattcgttttttttttttcgtttcgttttttcgttattgtttatttttttgtttcgcgtcgtcgtttgttttcgttttcgttgttagattttttttttttttattttttttcgtcgcggttgatattgtgttgtttttcgtcgtgtttatttattcgcgtcgtcgttttttgtaatttgttgttgtagtcgagttagatgatttatatattattgtaatttttgtttattaggaataagtagttt

SEQ ID NO: 326 - DNA, 601 bp, Artificial Sequence
  chemically treated genomic DNA (Homo sapiens) CpG-island No: 326
aaactacttattcctaataaacaaaaattacaataatatataaatcatctaactcgactacaacaacaaattacaaaaaacgacgacgcgaataaataaacacgacgaaaaacaacacaatatcaaccgcgacgaaaaaaaataaaaaaaaaaaaaatctaacaacgaaaacgaaaacaaacgacgacgcgaaacaaaaaaataaacaataacgaaaaaacgaaacgaaaaaaaaaaaacgaatcgacgcgaaaaaataaaaaaacgaaacgtaactaaaaaaacgaaaaaaacgaaacgaaaaaaacacaaaataacataacgctcgacgcaaaaaaaacgaaaaaaaaacgaaaaaacgacgaacgaactaaaaaaacgaaaaacgaaaaacgaaaaaacacgtcacgctaacgaaaaaaaaaaaaaacaaactaatataaaaaaacgcgaaacgaaaaaaataaaataaaaaacacaaacgaaaataaaaaaataacaaaaaacgcacgaaaaataataaatactcaaacccgactctaaaaaatatataaaaacgcgaaattaccaaccaaacacaacgacgataaaccccaacacc

SEQ ID NO: 327 - DNA, 601 bp, Artificial Sequence
  chemically treated genomic DNA (Homo sapiens) CpG-island No: 327
aaattgtttgtttttggtggatagaaattataatgatgtgtggattatttagttcgattgtagtagtaagttgtaggggacgacggcgcggatgaataggtacggcgaggagtagtatagtgttaatcgcggcggagaggagtgggaggagagagagtttaatagcgggagcgaaggtaagcgacgacgcgggataaggagataggtagtagcgaggaggcgagacgaggaggagagaacgaatcgacgcgagagagtgggagagcgaagcgtgattgaggaggcgagaggaacgaggcgagggaagtatagagtggtatagcgttcgacgtaggaaggacgagagaagggcgagagggcgacgagcgagttgggagagcgggaagcgggagacggaggagtacgttacgttagcgagaggagaagaggataggttgatgtgggagagcgcggagcgagagagatagggtgagggatatagacgaaagtaaaagaatgatagagagcgtacgaaggatggtaggtatttaaattcggttttgagaggtgtgtagaagcgcggggttattagttagatatagcgacgataggttttagtatt

SEQ ID NO: 328 - DNA, 601 bp, Artificial Sequence
  chemically treated genomic DNA (Homo sapiens) CpG-island No: 328
aatactaaaacctatcgtcgctatatctaactaataaccccgcgcttctacacacctctcaaaaccgaatttaaatacctaccatccttcgtacgctctctatcattcttttactttcgtctatatccctcaccctatctctctcgctccgcgctctcccacatcaacctatcctcttctcctctcgctaacgtaacgtactcctccgtctcccgcttcccgctctcccaactcgctcgtcgccctctcgcccttctctcgtccttcctacgtcgaacgctataccactctatacttccctcgcctcgttcctctcgcctcctcaatcacgcttcgctctcccactctctcgcgtcgattcgttctctcctcctcgtctcgcctcctcgctactacctatctccttatcccgcgtcgtcgcttaccttcgctcccgctattaaactctctctcctcccactcctctccgccgcgattaacactatactactcctcgccgtacctattcatccgcgccgtcgtcccctacaacttactactacaatcgaactaaataatccacacatcattataatttctatccaccaaaaacaaacaattt

SEQ ID NO: 329 - DNA, 653 bp, Artificial Sequence
  chemically treated genomic DNA (Homo sapiens) CpG-island No: 329
  misc_feature (4)..(4): n is either a, c, g or t
  misc_feature (652)..(652): n is either a, c, g or t
cgtnggcggcggtgttagtgcgtttttcgcgttggtttttgcgtatgtttcggtgacgtgcgcgtggcgtacgattgcgtttttgtgcgtttttcgtttttatggcgtattttttttcgtgggcgtagtcgcgcgcgttttcgaatagttatttcgcgatcgtattacgtatgtagtattgattagtagcggcgcgtacgcgttgttaaatagtagcgtcgtagttttcgtaaggtcgagatatcgacgtgtgggagagaggttatattagatttagagagagggagagagggtagatatacgtaggtagcgaattagtgtaggaacgataagtgagttgtacgcgcggagcgattattgttttagtattgtgcggggttagagacgttattgtgcgagtagttcgcgcgtagcgaagtcgatagtaatattatagttaattggcgaaatagataagagataagacgttttagcgagggggagttgaacgagacgtagacgttaagttagcgagagatgtagatagataggtatacggtcgtgttgcgcgatatagtagtacgtacgagtaggagataagtaacgatggagaatagacgataaggtaaattaggtttgtcgcgcgaagtaacgtattagatgttagggagant

SEQ ID NO: 330 - DNA, 653 bp, Artificial Sequence
  chemically treated genomic DNA (Homo sapiens) CpG-island No: 330
  misc_feature (2)..(2): n is either a, c, g or t
  misc_feature (650)..(650): n is either a, c, g or t
antctccctaacatctaatacgttacttcgcgcgacaaacctaatttaccttatcgtctattctccatcgttacttatctcctactcgtacgtactactatatcgcgcaacacgaccgtatacctatctatctacatctctcgctaacttaacgtctacgtctcgttcaactccccctcgctaaaacgtcttatctcttatctatttcgccaattaactataatattactatcgacttcgctacgcgcgaactactcgcacaataacgtctctaaccccgcacaatactaaaacaataatcgctccgcgcgtacaactcacttatcgttcctacactaattcgctacctacgtatatctaccctctctccctctctctaaatctaatataacctctctcccacacgtcgatatctcgaccttacgaaaactacgacgctactatttaacaacgcgtacgcgccgctactaatcaatactacatacgtaatacgatcgcgaaataactattcgaaaacgcgcgcgactacgcccacgaaaaaaaatacgccataaaaacgaaaaacgcacaaaaacgcaatcgtacgccacgcgcacgtcaccgaaacatacgcaaaaaccaacgcgaaaaacgcactaacaccgccgccnacg

SEQ ID NO: 331 - DNA, 653 bp, Artificial Sequence
  chemically treated genomic DNA (Homo sapiens) CpG-island No: 331
  misc_feature (2)..(2): n is either a, c, g or t
  misc_feature (650)..(650): n is either a, c, g or t
antttttttaatatttagtgcgttgtttcgcgcgatagatttgatttgttttgtcgtttgttttttatcgttgtttattttttattcgtgcgtgttgttgtgtcgcgtagtacggtcgtgtatttgtttgtttgtatttttcgttagtttagcgtttgcgtttcgtttagttttttttcgttagagcgttttgttttttatttgtttcgttagttgattgtgatgttgttgtcgatttcgttgcgcgcggattgttcgtatagtgacgtttttgatttcgtatagtgttagagtagtagtcgtttcgcgcgtgtagtttatttatcgtttttgtattaattcgttgtttgcgtatgtttattttttttttttttttttgaatttggtgtggttttttttttatacgtcgatgtttcggttttacgaggattgcgacgttgttgtttagtagcgcgtgcgcgtcgttattagttagtgttgtatgcgtgatgcggtcgcgagatggttattcgagggcgcgcgcggttacgtttacggagagaggtacgttatagaggcggaaggcgtataaggacgtaatcgtacgttacgcgtacgttatcgaggtatacgtagagattagcgcgagaaacgtattgatatcgtcgttngcg

SEQ ID NO: 332 - DNA, 653 bp, Artificial Sequence
  chemically treated genomic DNA (Homo sapiens) CpG-island No: 332
  misc_feature (4)..(4): n is either a, c, g or t
  misc_feature (652)..(652): n is either a, c, g or t
cgcnaacgacgatatcaatacgtttctcgcgctaatctctacgtatacctcgataacgtacgcgtaacgtacgattacgtccttatacgccttccgcctctataacgtacctctctccgtaaacgtaaccgcgcgcgccctcgaataaccatctcgcgaccgcatcacgcatacaacactaactaataacgacgcgcacgcgctactaaacaacaacgtcgcaatcctcgtaaaaccgaaacatcgacgtataaaaaaaaaaccacaccaaattcaaaaaaaaaaaaaaaaaataaacatacgcaaacaacgaattaatacaaaaacgataaataaactacacgcgcgaaacgactactactctaacactatacgaaatcaaaaacgtcactatacgaacaatccgcgcgcaacgaaatcgacaacaacatcacaatcaactaacgaaacaaataaaaaacaaaacgctctaacgaaaaaaaactaaacgaaacgcaaacgctaaactaacgaaaaatacaaacaaacaaatacacgaccgtactacgcgacacaacaacacgcacgaataaaaaataaacaacgataaaaaacaaacgacaaaacaaatcaaatctatcgcgcgaaacaacgcactaaatattaaaaaaant

SEQ ID NO: 333 - DNA, 901 bp, Artificial Sequence
  chemically treated genomic DNA (Homo sapiens) CpG-island No: 333
  misc_feature (29)..(29): n is either a, c, g or t
  misc_feature (49)..(49): n is either a, c, g or t
  misc_feature (101)..(101): n is either a, c, g or t
  misc_feature (146)..(146): n is either a, c, g or t
  misc_feature (194)..(194): n is either a, c, g or t
  misc_feature (199)..(199): n is either a, c, g or t
  misc_feature (217)..(217): n is either a, c, g or t
  misc_feature (238)..(238): n is either a, c, g or t
  misc_feature (251)..(251): n is either a, c, g or t
  misc_feature (310)..(310): n is either a, c, g or t
  misc_feature (396)..(396): n is either a, c, g or t
  misc_feature (416)..(416): n is either a, c, g or t
  misc_feature (465)..(465): n is either a, c, g or t
  misc_feature (486)..(486): n is either a, c, g or t
  misc_feature (502)..(503): n is either a, c, g or t
  misc_feature (550)..(550): n is either a, c, g or t
  misc_feature (568)..(568): n is either a, c, g or t
  misc_feature (630)..(630): n is either a, c, g or t
  misc_feature (669)..(669): n is either a, c, g or t
  misc_feature (762)..(762): n is either a, c, g or t
  misc_feature (806)..(806): n is either a, c, g or t
  misc_feature (839)..(839): n is either a, c, g or t
ttttttttttttttttttttttttttttntttttttttttttttttttntttttttttttttttttttttttcgtttttgttttttttcgtttttcgtttncgcggttttttgtcgtcgggtcgtttttttcgcgttttttttgtngttcgttggtttttgtcgttttcgtttttgcgtttttttggttttttnttttntttttttgtcgtggtttngggtgtcgtgcgcgtttcgtncgtggttgttttntttttcgttcgtcgtggggtcggtcgttcgttttgtgggtgtttttcgttttttttttntttcgggttgcgttgttgttcgtttgttttggtttcgtttttgtgtttttcgtgggtttttcgtttgttcgttgttttttttcgtntgcgcgtgggtgtttcgttnggtcgttcgcgcgcgttttttcgcgttcgtttcgtcgttcgtcgttttntttttttttttcgtttgggtnttgtttttcggttcgnntttttggttcgttcgttgtgtttgtttttttttttgtttcgcgttgntttttttgcgcgtcgcgntttgttttgtttttttttttcggttggtgtttttttcgtttttttttttttggtttgttttngtcgttttcgttttttttttttgtttgtttcgttttttngtgttcgtttttttttcgttttgttggtgtgtttcgtcggtgttttttttttttgttgtgtcggtttcgttcgtcgtcgcgttttttttgttngttcgttggcgttttttgcgtcgtcgtgtgtgttcgttttcgtngttttgtttgttcggtttttggttttgtttttncgtcggcggtttgtttttttttgtttttttttttgtttaaattatataggtgagagtagaaa

SEQ ID NO: 334 - DNA, 901 bp, Artificial Sequence
  chemically treated genomic DNA (Homo sapiens) CpG-island No: 334
  misc_feature (63)..(63): n is either a, c, g or t
  misc_feature (96)..(96): n is either a, c, g or t
  misc_feature (140)..(140): n is either a, c, g or t
  misc_feature (233)..(233): n is either a, c, g or t
  misc_feature (272)..(272): n is either a, c, g or t
  misc_feature (334)..(334): n is either a, c, g or t
  misc_feature (352)..(352): n is either a, c, g or t
  misc_feature (399)..(400): n is either a, c, g or t
  misc_feature (416)..(416): n is either a, c, g or t
  misc_feature (437)..(437): n is either a, c, g or t
  misc_feature (486)..(486): n is either a, c, g or t
  misc_feature (506)..(506): n is either a, c, g or t
  misc_feature (592)..(592): n is either a, c, g or t
  misc_feature (651)..(651): n is either a, c, g or t
  misc_feature (664)..(664): n is either a, c, g or t
  misc_feature (685)..(685): n is either a, c, g or t
  misc_feature (703)..(703): n is either a, c, g or t
  misc_feature (708)..(708): n is either a, c, g or t
  misc_feature (756)..(756): n is either a, c, g or t
  misc_feature (801)..(801): n is either a, c, g or t
  misc_feature (853)..(853): n is either a, c, g or t
  misc_feature (873)..(873): n is either a, c, g or t
tttctactctcacctatataatttaaacaaaaaaaaaaacaaaaaaaaacaaaccgccgacgnaaaaacaaaaccaaaaaccgaacaaacaaaacnacgaaaacgaacacacacgacgacgcaaaaaacgccaacgaacnaacaaaaaaaacgcgacgacgaacgaaaccgacacaacaaaaaaaaaaaacaccgacgaaacacaccaacaaaacgaaaaaaaaacgaacacnaaaaaacgaaacaaacaaaaaaaaaaaacgaaaacgacnaaaacaaaccaaaaaaaaaaaaacgaaaaaaacaccaaccgaaaaaaaaaaacaaaacaaancgcgacgcgcaaaaaaancaacgcgaaacaaaaaaaaaaacaaacacaacgaacgaaccaaaaanncgaaccgaaaaacaanacccaaacgaaaaaaaaaaanaaaacgacgaacgacgaaacgaacgcgaaaaaacgcgcgcgaacgaccnaacgaaacacccacgcgcanacgaaaaaaaacaacgaacaaacgaaaaacccacgaaaaacacaaaaacgaaaccaaaacaaacgaacaacaacgcaacccgaaanaaaaaaaaaacgaaaaacacccacaaaacgaacgaccgaccccacgacgaacgaaaaanaaaacaaccacgnacgaaacgcgcacgacacccnaaaccacgacaaaaaaanaaaanaaaaaaccaaaaaaacgcaaaaacgaaaacgacaaaaaccaacgaacnacaaaaaaaacgcgaaaaaaacgacccgacgacaaaaaaccgcgnaaacgaaaaacgaaaaaaaacaaaaacgaaaaaaaaaaaaaaaaaaaaaaanaaaaaaaaaaaaaaaaaaanaaaaaaaaaaaaaaaaaaaaaaaaaaaa

SEQ ID NO: 335 - DNA, 901 bp, Artificial Sequence
  chemically treated genomic DNA (Homo sapiens) CpG-island No: 335
  misc_feature (63)..(63): n is either a, c, g or t
  misc_feature (96)..(96): n is either a, c, g or t
  misc_feature (140)..(140): n is either a, c, g or t
  misc_feature (233)..(233): n is either a, c, g or t
  misc_feature (272)..(272): n is either a, c, g or t
  misc_feature (334)..(334): n is either a, c, g or t
  misc_feature (352)..(352): n is either a, c, g or t
  misc_feature (399)..(400): n is either a, c, g or t
  misc_feature (416)..(416): n is either a, c, g or t
  misc_feature (437)..(437): n is either a, c, g or t
  misc_feature (486)..(486): n is either a, c, g or t
  misc_feature (506)..(506): n is either a, c, g or t
  misc_feature (592)..(592): n is either a, c, g or t
  misc_feature (651)..(651): n is either a, c, g or t
  misc_feature (664)..(664): n is either a, c, g or t
  misc_feature (685)..(685): n is either a, c, g or t
  misc_feature (703)..(703): n is either a, c, g or t
  misc_feature (708)..(708): n is either a, c, g or t
  misc_feature (756)..(756): n is either a, c, g or t
  misc_feature (801)..(801): n is either a, c, g or t
  misc_feature (853)..(853): n is either a, c, g or t
  misc_feature (873)..(873): n is either a, c, g or t
tttttgtttttatttatatagtttaagtagaagagagggtaggaaggagtaggtcgtcggcgnagagataggattagaggtcgagtaagtaagatnacggggacggatatatacggcggcgtagaaagcgttaacgagtnaataggaggagcgcggcggcgagcgaggtcgatatagtagagagagaagatatcggcggggtatattagtaggacgaggaggaggcgagtatnggggagcggagtaggtagagaggagagacggggacgatnggagtaagttagagaggagggaacgagagaggtattaatcgggagagagaggtaggatagancgcggcgcgtaagggagntaacgcgggataggaggggaagtagatatagcgggcggattaggagnncgaatcggagagtaangtttagacgagaggggagagngaaacggcgggcgacgagacggacgcgagagaacgcgcgcgaacgattnagcgaggtatttacgcgtanacggggaggagtagcgggtagacgggggatttacgagaagtataaaggcggggttaaagtaagcggatagtagcgtagttcgagangaggagaggacgagaagtatttataggacgagcgatcgattttacgacgagcgaggggnagagtaattacgngcgaggcgcgtacgatatttnaagttacggtaggagganggaangagaagttagaaaagcgtagaagcggaagcggtaagaattaacgaatngtagagagagcgcgggagagacggttcgacgataggaagtcgcgnaaacggagagcggagggaggtaggggcgaaagaaggggagaggggaaagagngaggaggagggggaaggagnagaaggagagaggaggaagagaagaaga

SEQ ID NO: 336 - DNA, 901 bp, Artificial Sequence
  chemically treated genomic DNA (Homo sapiens) CpG-island No: 336
  misc_feature (29)..(29): n is either a, c, g or t
  misc_feature (49)..(49): n is either a, c, g or t
  misc_feature (101)..(101): n is either a, c, g or t
  misc_feature (146)..(146): n is either a, c, g or t
  misc_feature (194)..(194): n is either a, c, g or t
  misc_feature (199)..(199): n is either a, c, g or t
  misc_feature (217)..(217): n is either a, c, g or t
  misc_feature (238)..(238): n is either a, c, g or t
  misc_feature (251)..(251): n is either a, c, g or t
  misc_feature (310)..(310): n is either a, c, g or t
  misc_feature (396)..(396): n is either a, c, g or t
  misc_feature (416)..(416): n is either a, c, g or t
  misc_feature (465)..(465): n is either a, c, g or t
  misc_feature (486)..(486): n is either a, c, g or t
  misc_feature (502)..(503): n is either a, c, g or t
  misc_feature (550)..(550): n is either a, c, g or t
  misc_feature (568)..(568): n is either a, c, g or t
  misc_feature (630)..(630): n is either a, c, g or t
  misc_feature (669)..(669): n is either a, c, g or t
  misc_feature (762)..(762): n is either a, c, g or t
  misc_feature (806)..(806): n is either a, c, g or t
  misc_feature (839)..(839): n is either a, c, g or t
tcttcttctcttcctcctctctccttctnctccttccccctcctcctcnctctttcccctctccccttctttcgcccctacctccctccgctctccgtttncgcgacttcctatcgtcgaaccgtctctcccgcgctctctctacnattcgttaattcttaccgcttccgcttctacgcttttctaacttctcnttccntcctcctaccgtaacttnaaatatcgtacgcgcctcgcncgtaattactctncccctcgctcgtcgtaaaatcgatcgctcgtcctataaatacttctcgtcctctcctcntctcgaactacgctactatccgcttactttaaccccgcctttatacttctcgtaaatcccccgtctacccgctactcctccccgtntacgcgtaaatacctcgctnaatcgttcgcgcgcgttctctcgcgtccgtctcgtcgcccgccgtttcnctctcccctctcgtctaaacnttactctccgattcgnnctcctaatccgcccgctatatctacttcccctcctatcccgcgttanctcccttacgcgccgcgntctatcctacctctctctcccgattaatacctctctcgttccctcctctctaacttactccnatcgtccccgtctctcctctctacctactccgctccccnatactcgcctcctcctcgtcctactaatataccccgccgatatcttctctctctactatatcgacctcgctcgccgccgcgctcctcctattnactcgttaacgctttctacgccgccgtatatatccgtccccgtnatcttacttactcgacctctaatcctatctctncgccgacgacctactccttcctaccctctcttctacttaaactatataaataaaaacaaaaa

SEQ ID NO: 337 - DNA, 1598 bp, Artificial Sequence
  chemically treated genomic DNA (Homo sapiens) CpG-island No: 337
ggatagcgcgtttaggtttagtcgcgggggcgaggagtagggcggggtttagtaggaatttagttttgttagcgatgtttttcgtgagttacgcgttacgcgtacgcgtttttttaatggggtcgggcgtggagtcgcgttttgcgcgattggttaaacgggtggtttacgattggttgagattttggttttcgttttttcggttttaggagggtggggcgtgggtgtgggttgcgcggcgcgtgttgttttcggggattttgcgcgtttttcgaatattcgtgttgtcgttagggtcgtttttttttttttatagcgcgcgttgcgcgtgcgaaggtttggcggtttttgggattggcggggttgcgcgcggggttagggtgggggtacgggaaggtttaatttaggatttgcgtattttgttttgggggcgtattaagtatttgtcgggagtagggggcgtatcgggaattcgtagatttcgttagttgggcgtattggggatttgtggattgcgttcgggggatgggttagggggatatgcgtacgttttgggttttatagaatgtgagcgcgcgagggggagggcgaagcgtggcgggagggcgaggcgaaagaaggagggcgtgagaaaggcgacggcggcggcgcggaggagggttatttatatatttaaaaattagtcgtttgcgtcgcgtttgcggagatttgggagagttcggtcgtacgcgcgggatacgagcgttttacgttttttggcgcgtacggtttgttattattaggttttttattttcgggttttagacgatttaggacgcgtgttttggggagttgtttggcggcgtcgtgttagaagtttttttggggcgttatagtttttttcgtcgttttcggtttttttgtttgtttttttttgcggcgcgtcgggatttggagcgggcgggtggatttaggcgcgatggacggcggtatattgtttatgttcgcgttttttgcgtttttcgtttttgtcggttgcgttgttcggcggagattcgcgttttcggaattgttgcgttgtagtcggcggcggcgatcggttatcgtagagatcggaggcggcgtagcggtcgtagcgcggcgtaatgagcgcgagcgtaatcgcgtgaagttggtgaatttgggtttttaggcgttgcggtagtacgtgtcgtacggcggcgttagtaagaagttgagtaaggtggagacgttgcgtttagtcgtggagtatattcgcgcgttgtagcgtttgttggtcgagtacgacgtcgtgcgtaacgcgttggcgggagggttgaggtcgtaggtcgtgcgggcgtttgcgtttcgcgggtcgttagggattatttcggtcgtcgtttcgttttttcgcggtttttcgttttcgggtcgcgggggtagttcggagttcggtttttcgcgtttcgtttattcgtcggacgatagcggttgcgaaggcgcgttgagttttgcggagcgcgagttattcgatttttttagttggttagggggttattgagcgttttcgatttatgaggtaatagtcgggaggtagggaggagggagggtcgggggtt

SEQ ID NO: 338 - DNA, 1598 bp, Artificial Sequence
  chemically treated genomic DNA (Homo sapiens) CpG-island No: 338
aacccccgaccctccctcctccctacctcccgactattacctcataaatcgaaaacgctcaataaccccctaaccaactaaaaaaatcgaataactcgcgctccgcaaaactcaacgcgccttcgcaaccgctatcgtccgacgaataaacgaaacgcgaaaaaccgaactccgaactacccccgcgacccgaaaacgaaaaaccgcgaaaaaacgaaacgacgaccgaaataatccctaacgacccgcgaaacgcaaacgcccgcacgacctacgacctcaaccctcccgccaacgcgttacgcacgacgtcgtactcgaccaacaaacgctacaacgcgcgaatatactccacgactaaacgcaacgtctccaccttactcaacttcttactaacgccgccgtacgacacgtactaccgcaacgcctaaaaacccaaattcaccaacttcacgcgattacgctcgcgctcattacgccgcgctacgaccgctacgccgcctccgatctctacgataaccgatcgccgccgccgactacaacgcaacaattccgaaaacgcgaatctccgccgaacaacgcaaccgacaaaaacgaaaaacgcaaaaaacgcgaacataaacaatataccgccgtccatcgcgcctaaatccacccgcccgctccaaatcccgacgcgccgcaaaaaaaaacaaacaaaaaaaccgaaaacgacgaaaaaaactataacgccccaaaaaaacttctaacacgacgccgccaaacaactccccaaaacacgcgtcctaaatcgtctaaaacccgaaaataaaaaacctaataataacaaaccgtacgcgccaaaaaacgtaaaacgctcgtatcccgcgcgtacgaccgaactctcccaaatctccgcaaacgcgacgcaaacgactaatttttaaatatataaataaccctcctccgcgccgccgccgtcgcctttctcacgccctccttctttcgcctcgccctcccgccacgcttcgccctccccctcgcgcgctcacattctataaaacccaaaacgtacgcatatccccctaacccatcccccgaacgcaatccacaaatccccaatacgcccaactaacgaaatctacgaattcccgatacgccccctactcccgacaaatacttaatacgcccccaaaacaaaatacgcaaatcctaaattaaaccttcccgtacccccaccctaaccccgcgcgcaaccccgccaatcccaaaaaccgccaaaccttcgcacgcgcaacgcgcgctataaaaaaaaaaaaacgaccctaacgacaacacgaatattcgaaaaacgcgcaaaatccccgaaaacaacacgcgccgcgcaacccacacccacgccccaccctcctaaaaccgaaaaaacgaaaaccaaaatctcaaccaatcgtaaaccacccgtttaaccaatcgcgcaaaacgcgactccacgcccgaccccattaaaaaaacgcgtacgcgtaacgcgtaactcacgaaaaacatcgctaacaaaactaaattcctactaaaccccgccctactcctcgcccccgcgactaaacctaaacgcgctatcc

SEQ ID NO: 339 - DNA, 1598 bp, Artificial Sequence
  chemically treated genomic DNA (Homo sapiens) CpG-island No: 339
ggttttcggtttttttttttttttgtttttcggttgttattttataggtcgagggcgtttagtagttttttaattagttggagaagtcgagtagttcgcgtttcgtaggatttagcgcgttttcgtagtcgttgtcgttcgacgagtaggcggaacgcggggagtcgggtttcgagttgttttcgcggttcggggacgaagaatcgcgggagggcgaggcggcgatcggggtggtttttggcggttcgcggggcgtagacgttcgtacggtttgcggttttagttttttcgttagcgcgttgcgtacggcgtcgtgttcggttagtaggcgttgtagcgcgcggatgtattttacggttgagcgtagcgtttttattttgtttagttttttgttggcgtcgtcgtgcggtacgtgttgtcgtagcgtttggaagtttaagtttattagttttacgcggttgcgttcgcgtttattgcgtcgcgttacggtcgttgcgtcgttttcggtttttgcggtggtcggtcgtcgtcgtcggttgtagcgtaatagtttcggggacgcgggttttcgtcgggtagcgtagtcgatagggacggggggcgtagggggcgcggatatgggtagtgtgtcgtcgtttatcgcgtttggatttattcgttcgttttaggtttcggcgcgtcgtaggaaggagtaggtagaggaatcggaggcgacggggaaaattgtggcgttttaagggggtttttggtacggcgtcgttaggtaattttttagggtacgcgttttaggtcgtttggagttcggggataggaggtttagtggtggtaggtcgtacgcgttagggagcgtgggacgttcgtgtttcgcgcgtgcggtcggatttttttaggttttcgtaggcgcggcgtaggcggttggtttttaaatgtatagataattttttttcgcgtcgtcgtcgtcgttttttttacgttttttttttttcgtttcgttttttcgttacgtttcgttttttttttcgcgcgtttatattttgtaaggtttaaagcgtgcgtatgtttttttagtttatttttcggacgtagtttatagatttttagtgcgtttaattggcgaaatttgcgagttttcggtgcgttttttgttttcggtaggtgtttagtgcgtttttaaagtaaggtacgtaggttttgggttgagttttttcgtatttttattttaatttcgcgcgtagtttcgttagttttaagagtcgttagattttcgtacgcgtagcgcgcgttgtgggagggaaggggcggttttggcgataatacggatgttcgggaggcgcgtaagattttcgggggtagtacgcgtcgcgtagtttatatttacgttttatttttttggggtcgaggaggcgggggttagggttttagttaatcgtgggttattcgtttggttaatcgcgtagggcgcggttttacgttcggttttattgaggaagcgcgtacgcgtggcgcgtggtttacggggagtatcgttaataaagttgggtttttgttgggtttcgttttgtttttcgttttcgcgattgggtttgggcgcgttgttt

SEQ ID NO: 340 - DNA, 1598 bp, Artificial Sequence
  chemically treated genomic DNA (Homo sapiens) CpG-island No: 340
aaacaacgcgcccaaacccaatcgcgaaaacgaaaaacaaaacgaaacccaacaaaaacccaactttattaacgatactccccgtaaaccacgcgccacgcgtacgcgcttcctcaataaaaccgaacgtaaaaccgcgccctacgcgattaaccaaacgaataacccacgattaactaaaaccctaacccccgcctcctcgaccccaaaaaaataaaacgtaaatataaactacgcgacgcgtactacccccgaaaatcttacgcgcctcccgaacatccgtattatcgccaaaaccgccccttccctcccacaacgcgcgctacgcgtacgaaaatctaacgactcttaaaactaacgaaactacgcgcgaaattaaaataaaaatacgaaaaaactcaacccaaaacctacgtaccttactttaaaaacgcactaaacacctaccgaaaacaaaaaacgcaccgaaaactcgcaaatttcgccaattaaacgcactaaaaatctataaactacgtccgaaaaataaactaaaaaaacatacgcacgctttaaaccttacaaaatataaacgcgcgaaaaaaaaaacgaaacgtaacgaaaaaacgaaacgaaaaaaaaaaaacgtaaaaaaaacgacgacgacgacgcgaaaaaaaattatctatacatttaaaaaccaaccgcctacgccgcgcctacgaaaacctaaaaaaatccgaccgcacgcgcgaaacacgaacgtcccacgctccctaacgcgtacgacctaccaccactaaacctcctatccccgaactccaaacgacctaaaacgcgtaccctaaaaaattacctaacgacgccgtaccaaaaacccccttaaaacgccacaattttccccgtcgcctccgattcctctacctactccttcctacgacgcgccgaaacctaaaacgaacgaataaatccaaacgcgataaacgacgacacactacccatatccgcgccccctacgccccccgtccctatcgactacgctacccgacgaaaacccgcgtccccgaaactattacgctacaaccgacgacgacgaccgaccaccgcaaaaaccgaaaacgacgcaacgaccgtaacgcgacgcaataaacgcgaacgcaaccgcgtaaaactaataaacttaaacttccaaacgctacgacaacacgtaccgcacgacgacgccaacaaaaaactaaacaaaataaaaacgctacgctcaaccgtaaaatacatccgcgcgctacaacgcctactaaccgaacacgacgccgtacgcaacgcgctaacgaaaaaactaaaaccgcaaaccgtacgaacgtctacgccccgcgaaccgccaaaaaccaccccgatcgccgcctcgccctcccgcgattcttcgtccccgaaccgcgaaaacaactcgaaacccgactccccgcgttccgcctactcgtcgaacgacaacgactacgaaaacgcgctaaatcctacgaaacgcgaactactcgacttctccaactaattaaaaaactactaaacgccctcgacctataaaataacaaccgaaaaacaaaaaaaaaaaaaaaccgaaaacc

SEQ ID NO: 341 - DNA, 801 bp, Artificial Sequence
  chemically treated genomic DNA (Homo sapiens) CpG-island No: 341
  misc_feature (332)..(332): n is either a, c, g or t
gttcggcgggtcgcgtttttaggagttcgcggagtcgagcgttaggttcgagcgatggtttcgatttcgtttattttttattttttttaaagttttttaagttcgtgtaagatcggcgtttgtttgttcgggattgtaaaattttttttcgcggtttagtcgtcgacgagggaggggtagacgaggggaggggagcggtcgtcgggtcgttgaggtttttagtgttggcggattttggggtagattggggtgttggaggcggggtgattttgtattgtaaatcgcgttttcgggtcggggcggtagaaatgagtcggcgggcgcggattttngatttatcgcggtttcgagcgttcgtttcgttttcgtcgtgttttagatcgagtcgcggtatttacggatttaagattttaaaattaatcgagtaaacgaaattgtcgatttcgtttgggggaagtgcgggtaaggtcggttcgggcggggtttgtttcgggttcgcgttcgcgttgacgcgcgtttggttttttatttttttttcgtagttttagtttcggaagtcgagcgagcggtcggcgcgtttatcgtcgggggagttcgttaggtggatcggttcgcgttcgtttttagcgagtcggggatttatttattatttttcgtatcgtcgacgtcgtttcgttcgttcggtttagtttgattaatgtcgcggtggaaacgggtttggagttggttttataagggttggcggtttttttcgacgtcgtttttttttatagtttttcgattgtagtggggcggggggta

SEQ ID NO: 342 - DNA, 801 bp, Artificial Sequence
  chemically treated genomic DNA (Homo sapiens) CpG-island No: 342
  misc_feature (470)..(470): n is either a, c, g or t
taccccccgccccactacaatcgaaaaactataaaaaaaaacgacgtcgaaaaaaaccgccaacccttataaaaccaactccaaacccgtttccaccgcgacattaatcaaactaaaccgaacgaacgaaacgacgtcgacgatacgaaaaataataaataaatccccgactcgctaaaaacgaacgcgaaccgatccacctaacgaactcccccgacgataaacgcgccgaccgctcgctcgacttccgaaactaaaactacgaaaaaaaaataaaaaaccaaacgcgcgtcaacgcgaacgcgaacccgaaacaaaccccgcccgaaccgaccttacccgcacttcccccaaacgaaatcgacaatttcgtttactcgattaattttaaaatcttaaatccgtaaataccgcgactcgatctaaaacacgacgaaaacgaaacgaacgctcgaaaccgcgataaatcnaaaatccgcgcccgccgactcatttctaccgccccgacccgaaaacgcgatttacaatacaaaatcaccccgcctccaacaccccaatctaccccaaaatccgccaacactaaaaacctcaacgacccgacgaccgctcccctcccctcgtctacccctccctcgtcgacgactaaaccgcgaaaaaaaattttacaatcccgaacaaacaaacgccgatcttacacgaacttaaaaaactttaaaaaaaataaaaaataaacgaaatcgaaaccatcgctcgaacctaacgctcgactccgcgaactcctaaaaacgcgacccgccgaac

SEQ ID NO: 343 - DNA, 801 bp, Artificial Sequence
  chemically treated genomic DNA (Homo sapiens) CpG-island No: 343
  misc_feature (470)..(470): n is either a, c, g or t
tgtttttcgttttattgtagtcgagaagttgtggggaggggcggcgtcggaggaagtcgttagtttttatggggttagttttaagttcgtttttatcgcggtattggttaggttgggtcggacgaacgaggcggcgtcggcggtgcggggggtggtgggtgggttttcggttcgttgggggcggacgcgggtcggtttatttggcgggttttttcggcgatgagcgcgtcggtcgttcgttcggttttcggggttgaagttgcggggggaaagtggggaattaaacgcgcgttaacgcgggcgcgggttcggggtagatttcgttcgggtcggttttgttcgtattttttttaagcgaagtcggtagtttcgtttgttcggttggttttggagttttgagttcgtgggtgtcgcgattcggtttgagatacggcgggggcggggcgggcgttcggagtcgcggtgagttnagggttcgcgttcgtcgatttatttttgtcgtttcggttcgggagcgcgatttgtaatgtaaagttatttcgtttttagtattttaatttgttttaggattcgttagtattagagattttaacggttcgacggtcgttttttttttttcgtttatttttttttcgtcggcggttgagtcgcgaggggaagttttgtaatttcggataaataaacgtcggttttgtacgggtttgaaaaattttgggggaaatgaagagtgagcgaaatcgaagttatcgttcgggtttggcgttcggtttcgcgggtttttgggggcgcgattcgtcgggt

SEQ ID NO: 344 - DNA, 801 bp, Artificial Sequence
  chemically treated genomic DNA (Homo sapiens) CpG-island No: 344
  misc_feature (332)..(332): n is either a, c, g or t
acccgacgaatcgcgcccccaaaaacccgcgaaaccgaacgccaaacccgaacgataacttcgatttcgctcactcttcatttcccccaaaatttttcaaacccgtacaaaaccgacgtttatttatccgaaattacaaaacttcccctcgcgactcaaccgccgacgaaaaaaaaataaacgaaaaaaaaaaaacgaccgtcgaaccgttaaaatctctaatactaacgaatcctaaaacaaattaaaatactaaaaacgaaataactttacattacaaatcgcgctcccgaaccgaaacgacaaaaataaatcgacgaacgcgaaccctnaactcaccgcgactccgaacgcccgccccgcccccgccgtatctcaaaccgaatcgcgacacccacgaactcaaaactccaaaaccaaccgaacaaacgaaactaccgacttcgcttaaaaaaaatacgaacaaaaccgacccgaacgaaatctaccccgaacccgcgcccgcgttaacgcgcgtttaattccccactttccccccgcaacttcaaccccgaaaaccgaacgaacgaccgacgcgctcatcgccgaaaaaacccgccaaataaaccgacccgcgtccgcccccaacgaaccgaaaacccacccaccaccccccgcaccgccgacgccgcctcgttcgtccgacccaacctaaccaataccgcgataaaaacgaacttaaaactaaccccataaaaactaacgacttcctccgacgccgcccctccccacaacttctcgactacaataaaacgaaaaaca

SEQ ID NO: 345 - DNA, 564 bp, Artificial Sequence
  chemically treated genomic DNA (Homo sapiens) CpG-island No: 345
tacggttattataatttgaagcgcgaaaggttcgggtatttatgggagagttatcggcgttttttggggttttttcgatattaaagtttaagtagttagagaacggtcgtttttttgggcgagggttttattttcgaacgtacgcgggagtgtacgtgcgagatttcgcgggagagtaattcgcggcgttcgggtttaagtgagttttatggcgtagtttgtttggttagcgggttatcggtcgtgtaataaatcggcgaaacgttggttttaacgattaacggggttttatacgttgtaagtatgtcgaacgcgtggtttaggggttatttatttagcgttaaacgcgtggttacgtggtgttacgggcgagtttattttataatacgtaattagcgttttgtagggtttttacgaggttacgagtattttcgaacgcggaacgtttacgagtgggatatgcgtaacgtttatattattgtatcgtgagatcgtcgttagcgtgtttcggggggcggtaggggttattttattttagttattttgatggggagagtatttttt

SEQ ID NO: 346 - DNA, 564 bp, Artificial Sequence
  chemically treated genomic DNA (Homo sapiens) CpG-island No: 346
aaaaaatactctccccatcaaaataactaaaataaaataacccctaccgccccccgaaacacgctaacgacgatctcacgatacaataatataaacgttacgcatatcccactcgtaaacgttccgcgttcgaaaatactcgtaacctcgtaaaaaccctacaaaacgctaattacgtattataaaataaactcgcccgtaacaccacgtaaccacgcgtttaacgctaaataaataacccctaaaccacgcgttcgacatacttacaacgtataaaaccccgttaatcgttaaaaccaacgtttcgccgatttattacacgaccgataacccgctaaccaaacaaactacgccataaaactcacttaaacccgaacgccgcgaattactctcccgcgaaatctcgcacgtacactcccgcgtacgttcgaaaataaaaccctcgcccaaaaaaacgaccgttctctaactacttaaactttaatatcgaaaaaaccccaaaaaacgccgataactctcccataaatacccgaacctttcgcgcttcaaattataataaccgta

SEQ ID NO: 347 - DNA, 564 bp, Artificial Sequence
  chemically treated genomic DNA (Homo sapiens) CpG-island No: 347
gggggatattttttttattaaaataattggggtaaggtggtttttgtcgtttttcggggtacgttggcggcggttttacggtgtagtggtgtgggcgttgcgtatgttttattcgtgagcgtttcgcgttcggaggtgttcgtggtttcgtgagaattttgtaggacgttggttgcgtgttgtgagatgggttcgttcgtggtattacgtagttacgcgtttggcgttgggtgggtggtttttgagttacgcgttcgatatgtttgtaacgtgtggagtttcgttggtcgttggagttagcgtttcgtcggtttgttgtacgatcggtggttcgttgattaggtaggttacgttatgagatttatttgagttcgggcgtcgcgggttgttttttcgcggagtttcgtacgtatattttcgcgtgcgttcgagagtggggttttcgtttaggaagacgatcgttttttaattgtttaggttttagtgtcgaaggagttttaggggacgtcgatgatttttttatgggtgttcgaatttttcgcgttttaggttgtggtggtcgtg

SEQ ID NO: 348 - DNA, 564 bp, Artificial Sequence
  chemically treated genomic DNA (Homo sapiens) CpG-island No: 348
cacgaccaccacaacctaaaacgcgaaaaattcgaacacccataaaaaaatcatcgacgtcccctaaaactccttcgacactaaaacctaaacaattaaaaaacgatcgtcttcctaaacgaaaaccccactctcgaacgcacgcgaaaatatacgtacgaaactccgcgaaaaaacaacccgcgacgcccgaactcaaataaatctcataacgtaacctacctaatcaacgaaccaccgatcgtacaacaaaccgacgaaacgctaactccaacgaccaacgaaactccacacgttacaaacatatcgaacgcgtaactcaaaaaccacccacccaacgccaaacgcgtaactacgtaataccacgaacgaacccatctcacaacacgcaaccaacgtcctacaaaattctcacgaaaccacgaacacctccgaacgcgaaacgctcacgaataaaacatacgcaacgcccacaccactacaccgtaaaaccgccgccaacgtaccccgaaaaacgacaaaaaccaccttaccccaattattttaataaaaaaaatatccccc

SEQ ID NO: 349 - DNA, 791 bp, Artificial Sequence
  chemically treated genomic DNA (Homo sapiens) CpG-island No: 349
ggtttcggcggcggggcgggtttaaaggtttttcgtttattttagttttttcgcgattgtttaattaacgttaagtaatcgtaattcgtagagatttaaggaaagtatattcgttaattacgagttgcgtcgttatcgtttttttttttaggttttatttttttatttttttttttttattagttaacgttcgggaaaaacgagtaagtataggttttttttgttaattttcgtcggttatagttaattttttcgttcggtttttttttgttataattgaggtgtttataattagttaattaggaacgcgagagtatttcgcgtttgttttcgttcgtcgaggcgcgtattagtcggaattttggggagttaatcgcgtcgtttgtttttggtaagttagcggcggtttaaaggaggtggcgggaagtttgtgtgtgttttaaatcgttatttttatggtcgtttcggtaagtgttgcggggtagtattttttttgaggaggagcggggacgggcgagattggtttaagcgttttcgcgagggagtaaggcggtttgtgggtcggttttatttcggttttcgatttgaaggttttagtatgtagcgcgggcgcggggttcgacggaagtcgggagtcggtcggaagtagtttttgcgttttggtttttgggttttgttttgcgcgatcgcggggttttagatagtttaattcgtcgagatgatttgggtatttttgcgttgaatcggtaaatattgattaagtcgtatttattttgtttttaggaatttta

SEQ ID NO: 350 - DNA, 791 bp, Artificial Sequence
  chemically treated genomic DNA (Homo sapiens) CpG-island No: 350
taaaattcctaaaaacaaaataaatacgacttaatcaatatttaccgattcaacgcaaaaatacccaaatcatctcgacgaattaaactatctaaaaccccgcgatcgcgcaaaacaaaacccaaaaaccaaaacgcaaaaactacttccgaccgactcccgacttccgtcgaaccccgcgcccgcgctacatactaaaaccttcaaatcgaaaaccgaaataaaaccgacccacaaaccgccttactccctcgcgaaaacgcttaaaccaatctcgcccgtccccgctcctcctcaaaaaaaatactaccccgcaacacttaccgaaacgaccataaaaataacgatttaaaacacacacaaacttcccgccacctcctttaaaccgccgctaacttaccaaaaacaaacgacgcgattaactccccaaaattccgactaatacgcgcctcgacgaacgaaaacaaacgcgaaatactctcgcgttcctaattaactaattataaacacctcaattataacaaaaaaaaaccgaacgaaaaaattaactataaccgacgaaaattaacaaaaaaaacctatacttactcgtttttcccgaacgttaactaataaaaaaaaaaaaataaaaaaataaaacctaaaaaaaaaaacgataacgacgcaactcgtaattaacgaatatactttccttaaatctctacgaattacgattacttaacgttaattaaacaatcgcgaaaaaactaaaataaacgaaaaacctttaaacccgccccgccgccgaaacc

SEQ ID NO: 351 - DNA, 791 bp, Artificial Sequence
  chemically treated genomic DNA (Homo sapiens) CpG-island No: 351
tagagtttttgagagtagaataaatgcggtttgattagtatttgtcgatttaacgtagaggtgtttaggttatttcggcgagttgagttgtttaagatttcgcgatcgcgtaggataggatttagaagttagagcgtaggaattgttttcggtcggttttcggttttcgtcgggtttcgcgttcgcgttgtatgttgggatttttaggtcggaggtcggggtgaggtcgatttataggtcgttttgttttttcgcgaagacgtttaagttagtttcgttcgttttcgtttttttttagagaaaatgttgtttcgtagtatttatcggagcgattatgagggtgacgatttgaagtatatataggtttttcgttattttttttaaatcgtcgttggtttgttagggatagacggcgcggttggttttttaaaatttcgattgatacgcgtttcggcgagcgaaagtaaacgcgggatattttcgcgtttttgattggttggttgtggatattttaattatgatagaaaggggtcgggcgggaaagttagttgtggtcggcggggattggtagaaggaatttgtatttattcgtttttttcggacgttggttggtggagaagagagggtggggagatggggtttgggggggggggcggtggcgacgtaattcgtgattggcggatgtgttttttttaggtttttacggattgcggttgtttggcgttgattgggtagtcgcgggaaaattaaagtgggcggggggtttttgggttcgtttcgtcgtcggggtt

SEQ ID NO: 352 - DNA, 791 bp, Artificial Sequence
  chemically treated genomic DNA (Homo sapiens) CpG-island No: 352
aaccccgacgacgaaacgaacccaaaaaccccccgcccactttaattttcccgcgactacccaatcaacgccaaacaaccgcaatccgtaaaaacctaaaaaaaacacatccgccaatcacgaattacgtcgccaccgcccccccccccaaaccccatctccccaccctctcttctccaccaaccaacgtccgaaaaaaacgaataaatacaaattccttctaccaatccccgccgaccacaactaactttcccgcccgacccctttctatcataattaaaatatccacaaccaaccaatcaaaaacgcgaaaatatcccgcgtttactttcgctcgccgaaacgcgtatcaatcgaaattttaaaaaaccaaccgcgccgtctatccctaacaaaccaacgacgatttaaaaaaaataacgaaaaacctatatatacttcaaatcgtcaccctcataatcgctccgataaatactacgaaacaacattttctctaaaaaaaaacgaaaacgaacgaaactaacttaaacgtcttcgcgaaaaaacaaaacgacctataaatcgacctcaccccgacctccgacctaaaaatcccaacatacaacgcgaacgcgaaacccgacgaaaaccgaaaaccgaccgaaaacaattcctacgctctaacttctaaatcctatcctacgcgatcgcgaaatcttaaacaactcaactcgccgaaataacctaaacacctctacgttaaatcgacaaatactaatcaaaccgcatttattctactctcaaaaactcta

SEQ ID NO: 353 - DNA, 918 bp, Artificial Sequence
  chemically treated genomic DNA (Homo sapiens) CpG-island No: 353
gtttcgggcggggttggacgcggagttgcgtaagcgtacgtttagcgtggacgcggcgtcgggtttttttttttcggtgggtgtgggttggggtatacggttttttttttattcgcgacgcgaggttggggacggcgcgtatttatttggtaatttattattatttttagtttcggtggtatatcgtcggttttagggcgggattcggggttcgtagaggtcgttcgtttgggttcgcgcgcggcgtaggggtgcgttcggttgcggggtttatggcgcggttttcggttttcgtcgggtttaggattttgcggttttcggggtcgtttcggtagtcgttagcgtcgtttttattgtttgcgtcgcgtcgcgtttcggtcgttcgggtttcgtcgttcggtttcgtttcggtttttcgggttcgggttcgggtgggcggggatagtcgcggtttcgttttagttcgttcgtaggtgcgaggggcgcgtttcgtcgcgtgagttcggggacgcgttcgggggcgcgtttaggtttttttttcgcgggtcgacgcgggtgtttttttcgcggggtagtcgggtttgttgtttaaggtcgggcgcgtatacggggtttgcgcgggatcgtagatagcgcgtgtacgttatttcgtttcgtcgcgcgtacgcgttacgtttttagcgttatgtgcggtcgattttacgtgttcgttcgttttagtcgtttgtttagtattttttatttcgttaggatttagggttaatttcgttttagttaggcgggggtcgttgagtcggcgcgtcggcgttattaaatatatacgtttattttggcgtttagtatttcgatgttatttgttggattcggttcggcggatggttgggagttgggggattcgaggtgatagcgaatttagtt

SEQ ID NO: 354 - DNA, 918 bp, Artificial Sequence
  chemically treated genomic DNA (Homo sapiens) CpG-island No: 354
aactaaattcgctatcacctcgaatcccccaactcccaaccatccgccgaaccgaatccaacaaataacatcgaaatactaaacgccaaaataaacgtatatatttaataacgccgacgcgccgactcaacgacccccgcctaactaaaacgaaattaaccctaaatcctaacgaaataaaaaatactaaacaaacgactaaaacgaacgaacacgtaaaatcgaccgcacataacgctaaaaacgtaacgcgtacgcgcgacgaaacgaaataacgtacacgcgctatctacgatcccgcgcaaaccccgtatacgcgcccgaccttaaacaacaaacccgactaccccgcgaaaaaaacacccgcgtcgacccgcgaaaaaaaaacctaaacgcgcccccgaacgcgtccccgaactcacgcgacgaaacgcgcccctcgcacctacgaacgaactaaaacgaaaccgcgactatccccgcccacccgaacccgaacccgaaaaaccgaaacgaaaccgaacgacgaaacccgaacgaccgaaacgcgacgcgacgcaaacaataaaaacgacgctaacgactaccgaaacgaccccgaaaaccgcaaaatcctaaacccgacgaaaaccgaaaaccgcgccataaaccccgcaaccgaacgcacccctacgccgcgcgcgaacccaaacgaacgacctctacgaaccccgaatcccgccctaaaaccgacgatataccaccgaaactaaaaataataataaattaccaaataaatacgcgccgtccccaacctcgcgtcgcgaataaaaaaaaaaccgtataccccaacccacacccaccgaaaaaaaaaaacccgacgccgcgtccacgctaaacgtacgcttacgcaactccgcgtccaaccccgcccgaaac

SEQ ID NO: 355 - DNA, 918 bp, Artificial Sequence
  chemically treated genomic DNA (Homo sapiens) CpG-island No: 355
ggttgagttcgttgttatttcgggttttttagtttttagttattcgtcgagtcgagtttagtaggtggtatcggggtgttgggcgttagggtgaacgtgtatatttggtgacgtcggcgcgtcgatttagcggttttcgtttggttggggcgaggttggttttaggttttagcggggtggggagtattgagtaggcggttggggcggacggatacgtgagatcggtcgtatatggcgttgggagcgtggcgcgtgcgcgcggcgaagcggagtgacgtgtacgcgttgtttgcggtttcgcgtaggtttcgtgtgcgcgttcggttttggataataggttcggttgtttcgcggggggaatattcgcgtcggttcgcgggagggaggtttgagcgcgttttcgagcgcgttttcgagtttacgcggcggggcgcgtttttcgtatttgcgggcgggttggggcggggtcgcggttgttttcgtttattcgggttcgagttcggggagtcggggcggaatcgagcggcgaggttcgagcggtcggagcgcggcgcggcgtagataatgggagcggcgttggcggttgtcggggcggtttcgagggtcgtagagttttgggttcggcggggatcggaggtcgcgttatgagtttcgtagtcgggcgtatttttgcgtcgcgcgcgggtttaggcgagcggtttttgcgagtttcgggtttcgttttggggtcggcgatgtgttatcgaggttgaggatgatggtagattgttaggtgagtgcgcgtcgtttttagtttcgcgtcgcgggtggagggaggatcgtatgttttagtttatatttatcggggggagggagttcggcgtcgcgtttacgttgagcgtgcgtttacgtagtttcgcgtttaatttcgttcgggat

SEQ ID NO: 356 - DNA, 918 bp, Artificial Sequence
  chemically treated genomic DNA (Homo sapiens) CpG-island No: 356
atcccgaacgaaattaaacgcgaaactacgtaaacgcacgctcaacgtaaacgcgacgccgaactccctccccccgataaatataaactaaaacatacgatcctccctccacccgcgacgcgaaactaaaaacgacgcgcactcacctaacaatctaccatcatcctcaacctcgataacacatcgccgaccccaaaacgaaacccgaaactcgcaaaaaccgctcgcctaaacccgcgcgcgacgcaaaaatacgcccgactacgaaactcataacgcgacctccgatccccgccgaacccaaaactctacgaccctcgaaaccgccccgacaaccgccaacgccgctcccattatctacgccgcgccgcgctccgaccgctcgaacctcgccgctcgattccgccccgactccccgaactcgaacccgaataaacgaaaacaaccgcgaccccgccccaacccgcccgcaaatacgaaaaacgcgccccgccgcgtaaactcgaaaacgcgctcgaaaacgcgctcaaacctccctcccgcgaaccgacgcgaatattccccccgcgaaacaaccgaacctattatccaaaaccgaacgcgcacacgaaacctacgcgaaaccgcaaacaacgcgtacacgtcactccgcttcgccgcgcgcacgcgccacgctcccaacgccatatacgaccgatctcacgtatccgtccgccccaaccgcctactcaatactccccaccccgctaaaacctaaaaccaacctcgccccaaccaaacgaaaaccgctaaatcgacgcgccgacgtcaccaaatatacacgttcaccctaacgcccaacaccccgataccacctactaaactcgactcgacgaataactaaaaactaaaaaacccgaaataacaacgaactcaacc

SEQ ID NO: 357 - DNA, 817 bp, Artificial Sequence
  chemically treated genomic DNA (Homo sapiens) CpG-island No: 357
cgtcggttttcggcggtttcgttattttttcgtttcgggaggcgttcggtagattttcgatttttagcgggtttttttttttggggtcgtcggggcggggcggggtagggtagggcgaggagcgtatgcgcggcggggtcggttttttttttcgattggatatttatagattgtttttagtattttagataggcgatatagttagcggtattattacgttatgttttttttttgcgcgggcggcgtagagttggcggacgtttcgggcgttttatttgagttgtttatggtgttatcgttaggcgtagtttatagtttttataaagggttcggtagtcggtcgcgttcgagtcggcgcgttgttttgtgggagagggagtatattagtatagggggcggggtttttaggttgcggcgaggcgcgttcgaagggaggcgggtgtttattaatatagtgagcgggatttttatgtcgcgattaggggcgtttgaggggaggtaggtgtttattattgtagggggcgggattcgtaggttgcggcgaggagttgggggtggggagttcgttagtatacggggcggggttcgtaggtatcggagaggtgtgttcgaggggggcgggcgttattagcgtagggggcgggggttcgtagtttgcggcgatttgtttttaaaggaggcgggcgtttattagtatagggggcggggtttggaggcgcgtagatattttagcggttagagttttatattaggatatacgggtggggtttcgtagggagttggttaatgcgttattttcggagtggaattttgattg

SEQ ID NO: 358 - DNA, 817 bp, Artificial Sequence
  chemically treated genomic DNA (Homo sapiens) CpG-island No: 358
caatcaaaattccactccgaaaataacgcattaaccaactccctacgaaaccccacccgtatatcctaatataaaactctaaccgctaaaatatctacgcgcctccaaaccccgccccctatactaataaacgcccgcctcctttaaaaacaaatcgccgcaaactacgaacccccgccccctacgctaataacgcccgcccccctcgaacacacctctccgatacctacgaaccccgccccgtatactaacgaactccccacccccaactcctcgccgcaacctacgaatcccgccccctacaataataaacacctacctcccctcaaacgcccctaatcgcgacataaaaatcccgctcactatattaataaacacccgcctcccttcgaacgcgcctcgccgcaacctaaaaaccccgccccctatactaatatactccctctcccacaaaacaacgcgccgactcgaacgcgaccgactaccgaaccctttataaaaactataaactacgcctaacgataacaccataaacaactcaaataaaacgcccgaaacgtccgccaactctacgccgcccgcgcaaaaaaaaaacataacgtaataataccgctaactatatcgcctatctaaaatactaaaaacaatctataaatatccaatcgaaaaaaaaaaccgaccccgccgcgcatacgctcctcgccctaccctaccccgccccgccccgacgaccccaaaaaaaaaaacccgctaaaaatcgaaaatctaccgaacgcctcccgaaacgaaaaaataacgaaaccgccgaaaaccgacg

SEQ ID NO: 359 - DNA, 817 bp, Artificial Sequence
  chemically treated genomic DNA (Homo sapiens) CpG-island No: 359
taattaggattttatttcgaggatggcgtattagttagttttttgcgaagttttattcgtgtgttttggtgtgaggttttgatcgttaaggtgtttgcgcgtttttaggtttcgttttttatgttaataagcgttcgttttttttgggagtaagtcgtcgtaaattgcgagttttcgttttttacgttaatgacgttcgtttttttcgggtatattttttcgatgtttgcgagtttcgtttcgtatgttaacgagttttttatttttagtttttcgtcgtagtttgcgggtttcgttttttataataatgagtatttatttttttttaaacgtttttagtcgcggtatgagggtttcgtttattatgttaatgagtattcgttttttttcgggcgcgtttcgtcgtagtttgaaagtttcgttttttatgttaatatgtttttttttttataaggtagcgcgtcggttcggacgcggtcggttatcgagttttttgtgagggttgtgagttgcgtttgacggtggtattatgagtagtttaggtggggcgttcggggcgttcgttagttttgcgtcgttcgcgtaggaagagggtatgacgtggtggtatcgttggttgtgtcgtttgtttggggtgttgggggtagtttgtgagtatttagtcggggagaggggtcggtttcgtcgcgtatgcgtttttcgttttgttttgtttcgtttcgtttcggcggttttaggggaaaggattcgttgggggtcgggggtttgtcgggcgtttttcggggcggaggaatggcggggtcgtcgggagtcggcg

SEQ ID NO: 360 - DNA, 817 bp, Artificial Sequence
  chemically treated genomic DNA (Homo sapiens) CpG-island No: 360
cgccgactcccgacgaccccgccattcctccgccccgaaaaacgcccgacaaacccccgacccccaacgaatcctttcccctaaaaccgccgaaacgaaacgaaacaaaacaaaacgaaaaacgcatacgcgacgaaaccgacccctctccccgactaaatactcacaaactacccccaacaccccaaacaaacgacacaaccaacgataccaccacgtcataccctcttcctacgcgaacgacgcaaaactaacgaacgccccgaacgccccacctaaactactcataataccaccgtcaaacgcaactcacaaccctcacaaaaaactcgataaccgaccgcgtccgaaccgacgcgctaccttataaaaaaaaaaacatattaacataaaaaacgaaactttcaaactacgacgaaacgcgcccgaaaaaaaacgaatactcattaacataataaacgaaaccctcataccgcgactaaaaacgtttaaaaaaaaataaatactcattattataaaaaacgaaacccgcaaactacgacgaaaaactaaaaataaaaaactcgttaacatacgaaacgaaactcgcaaacatcgaaaaaatatacccgaaaaaaacgaacgtcattaacgtaaaaaacgaaaactcgcaatttacgacgacttactcccaaaaaaaacgaacgcttattaacataaaaaacgaaacctaaaaacgcgcaaacaccttaacgatcaaaacctcacaccaaaacacacgaataaaacttcgcaaaaaactaactaatacgccatcctcgaaataaaatcctaatta

SEQ ID NO: 361 - DNA, 535 bp, Artificial Sequence
  chemically treated genomic DNA (Homo sapiens) CpG-island No: 361
ggggtaaaaattcgaggtagggtgggggtaaaaagtcgcggtcggtaaaaagtcgtgggggtagggggtaaaaagttacggcggggaaaaagtcgtagtagcggggagttaaaaagtcgtggcgggtaaaaagtcgtcgcggataaaaagttacggcggcgggtgtgtaaaaagtcgaggtagcggggtagtgggggtaaaaagtcggagcgggtaaaaagtcgttgcgataaaaagtcgcggcggtagaggggtaaaaagtcgtagtggcggggggggggtaaaaagttatggtcggtaaaaagtcgcggcggtagggggtaaaaagtcgcggcgggggtgtaaaaagtcggggcgggtagaaagtcgcggcggcggggggtaaaaagtcgtggcggttggcgttaaaaagtcgcgcggcgggggtgtaaaaagttttggtgggtaaataattacggtatttgaggaggggagggtaaaaagtcgaggcgggtaaaaagttacggcggcggggggaaaaaagcgagattacgtt

SEQ ID NO: 362 - DNA, 535 bp, Artificial Sequence
  chemically treated genomic DNA (Homo sapiens) CpG-island No: 362
aacgtaatctcgcttttttccccccgccgccgtaactttttacccgcctcgactttttaccctcccctcctcaaataccgtaattatttacccaccaaaactttttacacccccgccgcgcgactttttaacgccaaccgccacgactttttaccccccgccgccgcgactttctacccgccccgactttttacacccccgccgcgactttttaccccctaccgccgcgactttttaccgaccataactttttaccccccccccgccactacgactttttacccctctaccgccgcgactttttatcgcaacgactttttacccgctccgactttttacccccactaccccgctacctcgactttttacacacccgccgccgtaactttttatccgcgacgactttttacccgccacgactttttaactccccgctactacgactttttccccgccgtaactttttaccccctacccccacgactttttaccgaccgcgactttttacccccaccctacctcgaatttttacccc

SEQ ID NO: 363 - DNA, 535 bp, Artificial Sequence
  chemically treated genomic DNA (Homo sapiens) CpG-island No: 363
gacgtagtttcgttttttttttttcgtcgtcgtggttttttgttcgtttcggttttttgtttttttttttttaggtgtcgtggttatttgtttattagggttttttgtattttcgtcgcgcggttttttgacgttagtcgttacggttttttatttttcgtcgtcgcggttttttgttcgtttcggttttttgtattttcgtcgcggttttttgttttttgtcgtcgcggttttttgtcggttatggttttttgtttttttttcgttattgcggttttttgtttttttgtcgtcgcggttttttgtcgtagcggttttttgttcgtttcggttttttgtttttattgtttcgttgtttcggttttttgtatattcgtcgtcgtggttttttgttcgcggcggttttttgttcgttacggttttttgatttttcgttgttgcggtttttttttcgtcgtggttttttattttttgtttttacggttttttatcggtcgcggttttttgtttttattttgtttcgggtttttgtttt

SEQ ID NO: 364 - DNA, 535 bp, Artificial Sequence
  chemically treated genomic DNA (Homo sapiens) CpG-island No: 364
aaaacaaaaacccgaaacaaaataaaaacaaaaaaccgcgaccgataaaaaaccgtaaaaacaaaaaataaaaaaccacgacgaaaaaaaaaccgcaacaacgaaaaatcaaaaaaccgtaacgaacaaaaaaccgccgcgaacaaaaaaccacgacgacgaatatacaaaaaaccgaaacaacgaaacaataaaaacaaaaaaccgaaacgaacaaaaaaccgctacgacaaaaaaccgcgacgacaaaaaaacaaaaaaccgcaataacgaaaaaaaaacaaaaaaccataaccgacaaaaaaccgcgacgacaaaaaacaaaaaaccgcgacgaaaatacaaaaaaccgaaacgaacaaaaaaccgcgacgacgaaaaataaaaaaccgtaacgactaacgtcaaaaaaccgcgcgacgaaaatacaaaaaaccctaataaacaaataaccacgacacctaaaaaaaaaaaaacaaaaaaccgaaacgaacaaaaaaccacgacgacgaaaaaaaaaaaacgaaactacgtc

SEQ ID NO: 365 - DNA, 511 bp, Artificial Sequence
  chemically treated genomic DNA (Homo sapiens) CpG-island No: 365
gggttttacgtagtaggatcgcgttcgtagtttttaggtatcgcgttcggttggagaggtagttatcgttttatagtgaatatggcggtcgaggcggttttagcgtcgggcgggcggcgtcgggaggtacgttacgtgagcggtttagttgggcggatcgcgcgcgcgttcgttggtttcgtcggtcgtcgttcgttcgttggttcggttgcgtttttttcgcgtcgttcgtttgcgtcgtcgagtcggtgttcggcgtggcggggtttcgtaattacggtaatacgtgttttatgaacgttacgttgtagtgttttagtaatatcgagtttttcgtcgagtatttggcgttgggttagtatcgggcggggcggttcgagttttcgtttgattcggagtagtttgcgggtcgcggcgcgtagggttagggcgaggttattgagtagttggcgtatttggtgcgggttttttggattttggagtatatttcgtagtatagtcgcgattttaa

SEQ ID NO: 366 - DNA, 511 bp, Artificial Sequence
  chemically treated genomic DNA (Homo sapiens) CpG-island No: 366
ttaaaatcgcgactatactacgaaatatactccaaaatccaaaaaacccgcaccaaatacgccaactactcaataacctcgccctaaccctacgcgccgcgacccgcaaactactccgaatcaaacgaaaactcgaaccgccccgcccgatactaacccaacgccaaatactcgacgaaaaactcgatattactaaaacactacaacgtaacgttcataaaacacgtattaccgtaattacgaaaccccgccacgccgaacaccgactcgacgacgcaaacgaacgacgcgaaaaaaacgcaaccgaaccaacgaacgaacgacgaccgacgaaaccaacgaacgcgcgcgcgatccgcccaactaaaccgctcacgtaacgtacctcccgacgccgcccgcccgacgctaaaaccgcctcgaccgccatattcactataaaacgataactacctctccaaccgaacgcgatacctaaaaactacgaacgcgatcctactacgtaaaaccc

SEQ ID NO: 367 - DNA, 511 bp, Artificial Sequence
  chemically treated genomic DNA (Homo sapiens) CpG-island No: 367
ttgaagtcgcggttgtgttgcggggtgtattttagggtttagagggttcgtattaggtgcgttagttgtttagtgatttcgttttggttttgcgcgtcgcggttcgtaggttgtttcgggttaggcgagggttcgggtcgtttcgttcggtattggtttagcgttaggtattcggcgaagagttcggtgttgttgaggtattgtagcgtggcgtttatgaagtacgtgttgtcgtggttgcggagtttcgttacgtcgggtatcggttcggcggcgtaagcgggcggcgcgggaaaagcgtagtcgagttagcgagcgagcggcggtcggcggggttagcgggcgcgcgcgcggttcgtttagttgagtcgtttacgtgacgtgtttttcggcgtcgttcgttcggcgttgaagtcgtttcggtcgttatgtttattgtgggacggtagttgtttttttagtcggacgcgatgtttggaggttgcgggcgcggttttgttgcgtgaagttt

SEQ ID NO: 368 - DNA, 511 bp, Artificial Sequence
  chemically treated genomic DNA (Homo sapiens) CpG-island No: 368
aaacttcacgcaacaaaaccgcgcccgcaacctccaaacatcgcgtccgactaaaaaaacaactaccgtcccacaataaacataacgaccgaaacgacttcaacgccgaacgaacgacgccgaaaaacacgtcacgtaaacgactcaactaaacgaaccgcgcgcgcgcccgctaaccccgccgaccgccgctcgctcgctaactcgactacgcttttcccgcgccgcccgcttacgccgccgaaccgatacccgacgtaacgaaactccgcaaccacgacaacacgtacttcataaacgccacgctacaatacctcaacaacaccgaactcttcgccgaatacctaacgctaaaccaataccgaacgaaacgacccgaaccctcgcctaacccgaaacaacctacgaaccgcgacgcgcaaaaccaaaacgaaatcactaaacaactaacgcacctaatacgaaccctctaaaccctaaaatacaccccgcaacacaaccgcgacttcaa

SEQ ID NO: 369 - DNA, 521 bp, Artificial Sequence
  chemically treated genomic DNA (Homo sapiens) CpG-island No: 369
tacggcgttggggtagcgttggtagagcgttagttcgtgcgagaagtttattatttcgtttttcgtgttttggatgatgagtacgggcggcgtgattttggatattttttggattttgcgggaggggcgtggggcgggtgagatttcgttcggttcgggtttcgtttcgtttcgttttcgttttcgttttcgttttagtttgtttatttggggaaggcgtcgaagtagtaggttttggtgttcggaaggcgacgtttaggtttaaggtgagcggcgagtgtagtattatcgtggcggattcgtagcgcgaggttaggtttacggtgggtatcgtgtcgatgttttgtcggtataggatgatgtcgttcgggttgatgcggtatttggcggtatttgagtagggttagtttaggtttttaacgcgcgcgtattttttttgttagcgggcgttttcgggtttagtttcggatgcgattttttagttttttcgtttagttaagttagttggttaggtttaggtt

SEQ ID NO: 370 - DNA, 521 bp, Artificial Sequence
  chemically treated genomic DNA (Homo sapiens) CpG-island No: 370
aacctaaacctaaccaactaacttaactaaacgaaaaaactaaaaaatcgcatccgaaactaaacccgaaaacgcccgctaacaaaaaaaatacgcgcgcgttaaaaacctaaactaaccctactcaaataccgccaaataccgcatcaacccgaacgacatcatcctataccgacaaaacatcgacacgatacccaccgtaaacctaacctcgcgctacgaatccgccacgataatactacactcgccgctcaccttaaacctaaacgtcgccttccgaacaccaaaacctactacttcgacgccttccccaaataaacaaactaaaacgaaaacgaaaacgaaaacgaaacgaaacgaaacccgaaccgaacgaaatctcacccgccccacgcccctcccgcaaaatccaaaaaatatccaaaatcacgccgcccgtactcatcatccaaaacacgaaaaacgaaataataaacttctcgcacgaactaacgctctaccaacgctaccccaacgccgta

SEQ ID NO: 371 - DNA, 521 bp, Artificial Sequence
  chemically treated genomic DNA (Homo sapiens) CpG-island No: 371
agtttgggtttgattaattgatttggttgagcggggagattggagagtcgtattcggagttgggttcggggacgttcgttggtaggaggggtgcgcgcgcgttggaggtttaggttgattttgtttaggtgtcgttaggtatcgtattagttcggacggtattattttgtatcggtagagtatcggtacggtgtttatcgtggatttggtttcgcgttacgagttcgttacggtggtgttgtattcgtcgtttattttggatttgagcgtcgtttttcggatattaagatttattgtttcgacgttttttttaagtgagtaggttggggcggggacgggggcgggggcggagcggggcggggttcgggtcgggcgaggttttattcgttttacgtttttttcgtagaatttagaaggtgtttaagattacgtcgttcgtgtttattatttaggatacgaaagacgaggtgatggatttttcgtacgggttggcgttttattagcgttgttttaacgtcgtg

SEQ ID NO: 372 - DNA, 521 bp, Artificial Sequence
  chemically treated genomic DNA (Homo sapiens) CpG-island No: 372
cacgacgttaaaacaacgctaataaaacgccaacccgtacgaaaaatccatcacctcgtctttcgtatcctaaataataaacacgaacgacgtaatcttaaacaccttctaaattctacgaaaaaaacgtaaaacgaataaaacctcgcccgacccgaaccccgccccgctccgcccccgcccccgtccccgccccaacctactcacttaaaaaaaacgtcgaaacaataaatcttaatatccgaaaaacgacgctcaaatccaaaataaacgacgaatacaacaccaccgtaacgaactcgtaacgcgaaaccaaatccacgataaacaccgtaccgatactctaccgatacaaaataataccgtccgaactaatacgatacctaacgacacctaaacaaaatcaacctaaacctccaacgcgcgcgcacccctcctaccaacgaacgtccccgaacccaactccgaatacgactctccaatctccccgctcaaccaaatcaattaatcaaacccaaact

SEQ ID NO: 373 - DNA, 972 bp, Artificial Sequence
  chemically treated genomic DNA (Homo sapiens) CpG-island No: 373
cggcggggataaaaattttcggcggcgagggtaaaaagtcgcggtggtaaaaagcggcggcgatcggggtaaaaagtcgcggtagtaaaaagtcgcggcggcggggataaaaagtcgttgcggcgggggtaaaaggcggcggtaatagcggtaaaaagtcgcgggcgtaaaaagcggcggtaatagcggcggcggtaaaaagtcgcggcgaggaaaaagtcgttgcggcgggggggtaaaaagtcgtgatagcggggggtaaaaagtcgcggcgggtaaaaagttacggcggcggtggggtaaaaagtagcggcggtggcggcgggggggtagaaagtcgcggcggtagaaagtcgcggcggtaaaaagttacggcggcgagggtgtaaaaagttgtgtcggcggtggggtaaaaagtttggtcgggtaaaaagtcgcggtcgcggcggggggtaaaaagtcgaggcgggtaaaaagtcgaggtagggtgggggtaaaaagtcgcggcggcggaggggtaaaaagtcgcggcggcgggttagggtagaaagtcgtagcgggtaaaaagtcgaggcggggtgggggtaaaaagtcgcggcggcgggtgggtggtagaaagtcgcggcgggtaaaaagtcgcgggggtagggtggaaaaagttaaggcggtgataaagtcgcggcggcgggggggggggggggataaagttttggcgggtaaaaagttagggcggtaaaattcgtagcggtgaagagttaaaaattcgcggtggttaaaaagttttagcgttgagggggtaaaaagtcgtagcgtataaaaagtcgaggcgcggtggggggagaaagtcgtcgcgacgggggggtaaaaagtcgcggcggcggagggcgaaataatggagatggggtagaaggtcggtatagtttggtattgttggagtggatgtgataggaaatgtgtagttaaagataaaaa

SEQ ID NO: 374 - DNA, 972 bp, Artificial Sequence
  chemically treated genomic DNA (Homo sapiens) CpG-island No: 374
tttttatctttaactacacatttcctatcacatccactccaacaataccaaactataccgaccttctaccccatctccattatttcgccctccgccgccgcgactttttacccccccgtcgcgacgactttctccccccaccgcgcctcgactttttatacgctacgactttttaccccctcaacgctaaaactttttaaccaccgcgaatttttaactcttcaccgctacgaattttaccgccctaactttttacccgccaaaactttatcccccccccccccccgccgccgcgactttatcaccgccttaactttttccaccctacccccgcgactttttacccgccgcgactttctaccacccacccgccgccgcgactttttacccccaccccgcctcgactttttacccgctacgactttctaccctaacccgccgccgcgactttttacccctccgccgccgcgactttttacccccaccctacctcgactttttacccgcctcgactttttaccccccgccgcgaccgcgactttttacccgaccaaactttttaccccaccgccgacacaactttttacaccctcgccgccgtaactttttaccgccgcgactttctaccgccgcgactttctacccccccgccgccaccgccgctactttttaccccaccgccgccgtaactttttacccgccgcgactttttaccccccgctatcacgactttttacccccccgccgcaacgactttttcctcgccgcgactttttaccgccgccgctattaccgccgctttttacgcccgcgactttttaccgctattaccgccgccttttacccccgccgcaacgactttttatccccgccgccgcgactttttactaccgcgactttttaccccgatcgccgccgctttttaccaccgcgactttttaccctcgccgccgaaaatttttatccccgccg

SEQ ID NO: 375 - DNA, 972 bp, Artificial Sequence
  chemically treated genomic DNA (Homo sapiens) CpG-island No: 375
tttttgtttttggttgtatattttttgttatatttattttagtaatgttaagttgtgtcggttttttattttatttttattatttcgtttttcgtcgtcgcggttttttgttttttcgtcgcggcggttttttttttttatcgcgtttcggttttttgtacgttgcggttttttgtttttttaacgttagagttttttgattatcgcgggtttttgattttttatcgttgcgaattttgtcgttttggttttttgttcgttagggttttgtttttttttttttttcgtcgtcgcggttttattatcgttttggttttttttattttgttttcgcggttttttgttcgtcgcggttttttgttatttattcgtcgtcgcggttttttgtttttatttcgtttcggttttttgttcgttgcggttttttgttttaattcgtcgtcgcggttttttgttttttcgtcgtcgcggttttttgtttttattttgtttcggttttttgttcgtttcggttttttgtttttcgtcgcggtcgcggttttttgttcgattaggttttttgttttatcgtcgatatagttttttgtattttcgtcgtcgtggttttttgtcgtcgcggttttttgtcgtcgcggttttttgttttttcgtcgttatcgtcgttgttttttgttttatcgtcgtcgtggttttttgttcgtcgcggttttttgtttttcgttgttacggttttttgttttttcgtcgtagcgatttttttttcgtcgcggttttttgtcgtcgtcgttgttgtcgtcgttttttgcgttcgcggttttttgtcgttgttgtcgtcgttttttgttttcgtcgtagcggttttttgttttcgtcgtcgcggttttttgttatcgcgattttttgtttcggtcgtcgtcgttttttgttatcgcgattttttgttttcgtcgtcgaggatttttgttttcgtcg

SEQ ID NO: 376 - DNA, 972 bp, Artificial Sequence
  chemically treated genomic DNA (Homo sapiens) CpG-island No: 376
cgacgaaaacaaaaatcctcgacgacgaaaacaaaaaatcgcgataacaaaaaacgacgacgaccgaaacaaaaaatcgcgataacaaaaaaccgcgacgacgaaaacaaaaaaccgctacgacgaaaacaaaaaacgacgacaacaacgacaaaaaaccgcgaacgcaaaaaacgacgacaacaacgacgacgacaaaaaaccgcgacgaaaaaaaaatcgctacgacgaaaaaacaaaaaaccgtaacaacgaaaaacaaaaaaccgcgacgaacaaaaaaccacgacgacgataaaacaaaaaacaacgacgataacgacgaaaaaacaaaaaaccgcgacgacaaaaaaccgcgacgacaaaaaaccacgacgacgaaaatacaaaaaactatatcgacgataaaacaaaaaacctaatcgaacaaaaaaccgcgaccgcgacgaaaaacaaaaaaccgaaacgaacaaaaaaccgaaacaaaataaaaacaaaaaaccgcgacgacgaaaaaacaaaaaaccgcgacgacgaattaaaacaaaaaaccgcaacgaacaaaaaaccgaaacgaaataaaaacaaaaaaccgcgacgacgaataaataacaaaaaaccgcgacgaacaaaaaaccgcgaaaacaaaataaaaaaaaccaaaacgataataaaaccgcgacgacgaaaaaaaaaaaaaaacaaaaccctaacgaacaaaaaaccaaaacgacaaaattcgcaacgataaaaaatcaaaaacccgcgataatcaaaaaactctaacgttaaaaaaacaaaaaaccgcaacgtacaaaaaaccgaaacgcgataaaaaaaaaaaaccgccgcgacgaaaaaacaaaaaaccgcgacgacgaaaaacgaaataataaaaataaaataaaaaaccgacacaacttaacattactaaaataaatataacaaaaaatatacaaccaaaaacaaaaa

SEQ ID NO: 377 - DNA, 938 bp, Artificial Sequence
  chemically treated genomic DNA (Homo sapiens) CpG-island No: 377
gtagtattcggttagcggcggtttttgcgtttttttttgcgttatcgtattattttcgttatcgttttttttttttttttttatcgtagtcgggcgtagcgttattttatgtaggttgtagcggttaaggcggggagttaggggtgcgggcgtttaggtaaggaatttttgagtcgggagagttggacgaggagcgtttttcggcgttgttcgagttaggacgtcggtagagttggtagtttagttggcggattttgtagttagagtcgcggcggcgggggtaaaaagtggtatgggggggcgggtgtaaaaagtcgtaaaggtagaaagttgcggcggcgggtgtagaaagtcgaggcggcggaggtaaaaagtcgcggtgggaataatttgtggcggcgggggtaaaaagtcggggcggcgggggttaaaagttataaaaagtcgttgtggtagggtaaaaagtcgtggcggcgggggtaaaaaatcgtaaaaagtcgtggtttcgggggtaaaaagtcgcggcggcggaggtaaaaagtcgtgtcggcgggagtaaaaagtaacgggggcgggggtagaaagtcgtcgcgacgaggtcgaaagtcgcggcggcgggggtaaagagtcgcggcgacggggttaaaaagtcgcggtagagaaagttacggcggcgggggtaaaaagtcgcggcggcggaggtagaaagtcgtaaaaagtcgcggcggcggggataaaaagtcgtagcggtaaaaagttgcgtcggcggggggtataaagtcggggcgggagaaatttgcggcggcggtaaaaatttgcggcggcggttaaaagtcgtaaaaagtcgcggcggcgggattaaaaagttagttgtttttttgggatttttttaattattttgtttaaagtttttgtttatttatgcgttggaagaggga

SEQ ID NO: 378 - DNA, 938 bp, Artificial Sequence
  chemically treated genomic DNA (Homo sapiens) CpG-island No: 378
tccctcttccaacgcataaataaacaaaaactttaaacaaaataattaaaaaaatcccaaaaaaacaactaactttttaatcccgccgccgcgactttttacgacttttaaccgccgccgcaaatttttaccgccgccgcaaatttctcccgccccgactttataccccccgccgacgcaactttttaccgctacgactttttatccccgccgccgcgactttttacgactttctacctccgccgccgcgactttttacccccgccgccgtaactttctctaccgcgactttttaaccccgtcgccgcgactctttacccccgccgccgcgactttcgacctcgtcgcgacgactttctacccccgcccccgttactttttactcccgccgacacgactttttacctccgccgccgcgactttttacccccgaaaccacgactttttacgattttttacccccgccgccacgactttttaccctaccacaacgactttttataacttttaacccccgccgccccgactttttacccccgccgccacaaattattcccaccgcgactttttacctccgccgcctcgactttctacacccgccgccgcaactttctacctttacgactttttacacccgcccccccataccactttttacccccgccgccgcgactctaactacaaaatccgccaactaaactaccaactctaccgacgtcctaactcgaacaacgccgaaaaacgctcctcgtccaactctcccgactcaaaaattccttacctaaacgcccgcacccctaactccccgccttaaccgctacaacctacataaaataacgctacgcccgactacgataaaaaaaaaaaaaaaaaacgataacgaaaataatacgataacgcaaaaaaaaacgcaaaaaccgccgctaaccgaatactac

SEQ ID NO: 379 - DNA, 938 bp, Artificial Sequence
  chemically treated genomic DNA (Homo sapiens) CpG-island No: 379
ttttttttttagcgtatgagtgagtagaggttttaaatagggtaattggaggaattttaggggagtagttggttttttgatttcgtcgtcgcggttttttgcggtttttggtcgtcgtcgtaggtttttgtcgtcgtcgtaggtttttttcgtttcggttttatgtttttcgtcgacgtagttttttgtcgttgcggttttttgttttcgtcgtcgcggttttttgcggttttttattttcgtcgtcgcggttttttgttttcgtcgtcgtggttttttttgtcgcggttttttgatttcgtcgtcgcggttttttgttttcgtcgtcgcggttttcggtttcgtcgcggcggttttttgttttcgttttcgttgttttttgttttcgtcggtacggttttttgttttcgtcgtcgcggttttttgttttcgaagttacggttttttgcggttttttgttttcgtcgttacgattttttgttttgttatagcggttttttgtggtttttggttttcgtcgtttcggttttttgttttcgtcgttataggttgtttttatcgcggttttttgttttcgtcgtttcggttttttatattcgtcgtcgtagttttttgtttttgcggttttttgtattcgtttttttatgttattttttgttttcgtcgtcgcggttttgattgtaggattcgttaattaggttgttagttttatcggcgttttggttcgggtagcgtcgaggggcgtttttcgtttagttttttcggtttaggggttttttgtttagacgttcgtatttttagtttttcgttttgatcgttgtagtttgtatagagtggcgttgcgttcggttgcgatgggagagaagaaggagggcggtggcgggggtgatgcggtggcgtagagggaggcgtaggggtcgtcgttagtcgggtgttgt

SEQ ID NO: 380 - DNA, 938 bp, Artificial Sequence
  chemically treated genomic DNA (Homo sapiens) CpG-island No: 380
acaacacccgactaacgacgacccctacgcctccctctacgccaccgcatcacccccgccaccgccctccttcttctctcccatcgcaaccgaacgcaacgccactctatacaaactacaacgatcaaaacgaaaaactaaaaatacgaacgtctaaacaaaaaacccctaaaccgaaaaaactaaacgaaaaacgcccctcgacgctacccgaaccaaaacgccgataaaactaacaacctaattaacgaatcctacaatcaaaaccgcgacgacgaaaacaaaaaataacataaaaaaacgaatacaaaaaaccgcaaaaacaaaaaactacgacgacgaatataaaaaaccgaaacgacgaaaacaaaaaaccgcgataaaaacaacctataacgacgaaaacaaaaaaccgaaacgacgaaaaccaaaaaccacaaaaaaccgctataacaaaacaaaaaatcgtaacgacgaaaacaaaaaaccgcaaaaaaccgtaacttcgaaaacaaaaaaccgcgacgacgaaaacaaaaaaccgtaccgacgaaaacaaaaaacaacgaaaacgaaaacaaaaaaccgccgcgacgaaaccgaaaaccgcgacgacgaaaacaaaaaaccgcgacgacgaaatcaaaaaaccgcgacaaaaaaaaccacgacgacgaaaacaaaaaaccgcgacgacgaaaataaaaaaccgcaaaaaaccgcgacgacgaaaacaaaaaaccgcaacgacaaaaaactacgtcgacgaaaaacataaaaccgaaacgaaaaaaacctacgacgacgacaaaaacctacgacgacgaccaaaaaccgcaaaaaaccgcgacgacgaaatcaaaaaaccaactactcccctaaaattcctccaattaccctatttaaaacctctactcactcatacgctaaaaaaaaaa

SEQ ID NO: 381 - DNA, 607 bp, Artificial Sequence
  chemically treated genomic DNA (Homo sapiens) CpG-island No: 381
gagacgtttttcgttttataggcgttttttagttttaggttcggtttggtttttatcgtcggagttttataaagaaagttttcgggttttagttttttacgtatttatcggtatcgacgtcggcggcgattcgggttttcgtcgtttttagttttttgcggtggttggtttttgggtgggtttcggcgttagcggcggcgattgttttatatttacggggttcgggtcgtattcgtttcgatttaacggtttcgttagttaggcgcgcgcgtcggtttcgcgcgttatgttttcgtcgtgttgcgtatcgtttaggcgattttcgttgttcgttaattacgcgcgcgttttcgcgggtttatatatgaatcgcgtacgcgcgcgttagtcgtatttttttttcgtgcgtttcgttttacgttttttagagttggcggttgtttttagtgttttgtttatttttgtcgggtcgtcggattcggcgggtgagtgcgtggttttcggtttcgtatcgtcgtttgtttttttgtagattatttcggatttaattttttagttatttttttatattgtttttttcgttttttttattacgcggggtttagga

SEQ ID NO: 382 - DNA, 607 bp, Artificial Sequence
  chemically treated genomic DNA (Homo sapiens) CpG-island No: 382
tcctaaaccccgcgtaataaaaaaaacgaaaaaaacaatataaaaaaataactaaaaaattaaatccgaaataatctacaaaaaaacaaacgacgatacgaaaccgaaaaccacgcactcacccgccgaatccgacgacccgacaaaaataaacaaaacactaaaaacaaccgccaactctaaaaaacgtaaaacgaaacgcacgaaaaaaaaatacgactaacgcgcgcgtacgcgattcatatataaacccgcgaaaacgcgcgcgtaattaacgaacaacgaaaatcgcctaaacgatacgcaacacgacgaaaacataacgcgcgaaaccgacgcgcgcgcctaactaacgaaaccgttaaatcgaaacgaatacgacccgaaccccgtaaatataaaacaatcgccgccgctaacgccgaaacccacccaaaaaccaaccaccgcaaaaaactaaaaacgacgaaaacccgaatcgccgccgacgtcgataccgataaatacgtaaaaaactaaaacccgaaaactttctttataaaactccgacgataaaaaccaaaccgaacctaaaactaaaaaacgcctataaaacgaaaaacgtctc

SEQ ID NO: 383 - DNA, 607 bp, Artificial Sequence
  chemically treated genomic DNA (Homo sapiens) CpG-island No: 383
ttttaggtttcgcgtggtgggggaagcgaaaggggtagtgtggggaagtggttgaggggttgggttcggggtggtttgtagagaggtaggcggcggtgcggagtcgggaattacgtatttattcgtcgagttcgacggttcggtaggggtgggtaaggtattgggaatagtcgttagttttagagggcgtgaggcggggcgtacggggagggggtgcggttaacgcgcgcgtgcgcggtttatgtgtgggttcgcgggggcgcgcgcgtggttagcgggtagcgagggtcgtttgggcggtgcgtagtacggcgggaatatggcgcgcggaatcggcgcgcgcgtttagttggcgggatcgttagatcgaggcggatgcggttcggatttcgtggatatggagtagtcgtcgtcgttggcgtcggagtttatttaagggttaattatcgtaaggagttgaaggcggcgggagttcgagtcgtcgtcggcgtcggtgtcggtgagtgcgtgaggggttggggttcggagattttttttgtgaaatttcggcggtgggagttaggtcgggtttgaggttgaggagcgtttgtgaggcggaaggcgtttt

SEQ ID NO: 384 - DNA, 607 bp, Artificial Sequence
  chemically treated genomic DNA (Homo sapiens) CpG-island No: 384
aaaacgccttccgcctcacaaacgctcctcaacctcaaacccgacctaactcccaccgccgaaatttcacaaaaaaaatctccgaaccccaacccctcacgcactcaccgacaccgacgccgacgacgactcgaactcccgccgccttcaactccttacgataattaacccttaaataaactccgacgccaacgacgacgactactccatatccacgaaatccgaaccgcatccgcctcgatctaacgatcccgccaactaaacgcgcgcgccgattccgcgcgccatattcccgccgtactacgcaccgcccaaacgaccctcgctacccgctaaccacgcgcgcgcccccgcgaacccacacataaaccgcgcacgcgcgcgttaaccgcaccccctccccgtacgccccgcctcacgccctctaaaactaacgactattcccaataccttacccacccctaccgaaccgtcgaactcgacgaataaatacgtaattcccgactccgcaccgccgcctacctctctacaaaccaccccgaacccaacccctcaaccacttccccacactacccctttcgcttcccccaccacgcgaaacctaaaa

SEQ ID NO: 385 - DNA, 527 bp, Artificial Sequence
  chemically treated genomic DNA (Homo sapiens) CpG-island No: 385
tttttttttttttttttggtcgttacgcgtagcgtcgttttatgtaggtcgtagcggttaaggcggggagttcggggcgcgggcgtttaggtaaggaattttcgagtcgggagagttggattaggagcgtttttcggtttcgttcgaataaggacgtcggtagagtcggtagtcgagtgtgtcgttttcgtttttagagtcgcgtcggtggtggtaaaaagcggcggcggcgggggtaaaaagttggggcggcggggataaaaagtttcggtggcgggggtaaaaagttacggcggtaaaaatcggcggcggcgggggtaaaatgtcgtaggggtaaaaagtcgtaaaaagtcgcggcggcgggggtaagaagtcgcggtggcgggagtaaaaaattgcggcggtaaaaaggggcggcggcgggggtaaaaagtcgtaaaaagtttcggcgtagggggtaaaaagtcgtggcgtcgggggtaagaattcgcggcggcgggggtaaaaaaaatatatatataattata

SEQ ID NO: 386 - DNA, 527 bp, Artificial Sequence
  chemically treated genomic DNA (Homo sapiens) CpG-island No: 386
tataattatatatatattttttttacccccgccgccgcgaattcttacccccgacgccacgactttttaccccctacgccgaaactttttacgactttttacccccgccgccgcccctttttaccgccgcaattttttactcccgccaccgcgacttcttacccccgccgccgcgactttttacgactttttacccctacgacattttacccccgccgccgccgatttttaccgccgtaactttttacccccgccaccgaaactttttatccccgccgccccaactttttacccccgccgccgccgctttttaccaccaccgacgcgactctaaaaacgaaaacgacacactcgactaccgactctaccgacgtccttattcgaacgaaaccgaaaaacgctcctaatccaactctcccgactcgaaaattccttacctaaacgcccgcgccccgaactccccgccttaaccgctacgacctacataaaacgacgctacgcgtaacgaccaaaaaaaaaaaaaaaaa

SEQ ID NO: 387 - DNA, 527 bp, Artificial Sequence
  chemically treated genomic DNA (Homo sapiens) CpG-island No: 387
tataattatatatatattttttttgttttcgtcgtcgcggatttttgttttcgacgttacggttttttgttttttacgtcgaggttttttgcggttttttgttttcgtcgtcgtttttttttgtcgtcgtagttttttgttttcgttatcgcggttttttgttttcgtcgtcgcggttttttgcggttttttgtttttgcggtattttgttttcgtcgtcgtcggtttttgtcgtcgtggttttttattttcgttatcgaggttttttgttttcgtcgttttagttttttgttttcgtcgtcgtcgttttttgttattatcgacgcggttttgagggcgggagcggtatattcggttgtcggttttatcggcgtttttgttcgggcggagtcgaggggcgtttttggtttagttttttcggttcgggggttttttgtttaggcgttcgcgtttcgagtttttcgttttggtcgttgcggtttgtatagagcggcgttgcgcgtagcggttaggggagagaagaagga

SEQ ID NO: 388 - DNA, 527 bp, Artificial Sequence
  chemically treated genomic DNA (Homo sapiens) CpG-island No: 388
tccttcttctctcccctaaccgctacgcgcaacgccgctctatacaaaccgcaacgaccaaaacgaaaaactcgaaacgcgaacgcctaaacaaaaaacccccgaaccgaaaaaactaaaccaaaaacgcccctcgactccgcccgaacaaaaacgccgataaaaccgacaaccgaatataccgctcccgccctcaaaaccgcgtcgataataacaaaaaacgacgacgacgaaaacaaaaaactaaaacgacgaaaacaaaaaacctcgataacgaaaataaaaaaccacgacgacaaaaaccgacgacgacgaaaacaaaataccgcaaaaacaaaaaaccgcaaaaaaccgcgacgacgaaaacaaaaaaccgcgataacgaaaacaaaaaactacgacgacaaaaaaaaacgacgacgaaaacaaaaaaccgcaaaaaacctcgacgtaaaaaacaaaaaaccgtaacgtcgaaaacaaaaatccgcgacgacgaaaacaaaaaaaatatatatataattata

SEQ ID NO: 389 - DNA, 792 bp, Artificial Sequence
  chemically treated genomic DNA (Homo sapiens) CpG-island No: 389
aggcgtcgcgcgtattaggcgttgatagtatatcgatttttttttcggtgtgcgtaggttaatatttatatatatttttatatattcgtatatattttcgtggaaattgaggtaggtaggcggcggattaggtttcgtcgtttgacggttagcggttgggatggaattcggattgttagacgtttttcgttttataggtattttttagtcgttgaggttcggttaggtttttatcgtcggagttttataaagaaagtttttcggttcgagttttttacgtatttatcggcgtcgacgttcgcggcgattggggtttttattttttttagttttttgcgggggtcggttttggggtcggtttgggcgtcggtagcggcgattgttttatatttatcgggttcgggtcgcgttcgtttcgagttaacggtttcgttagttaggcgcgttcgttagtttcgggcgttatgttttcgttgtgttgttcgtcgtcgaggcgatttttattgttttttagttacgcgcgttttcgcgggtttatatacgaatttcgtacgcgcgcgttcgtcgcgtttttttttttttcgcgcgtttcgtttcgcgttttttggagttggtcgttgtttttagtgtttcgtttattttcgtcgggttcgttcgatttcgcgggtgagcgcgtggttttcggttcggtatcgtcgtttgtttttttgtagattatttcggatcgattttcgggttatttttttatattgttttttcgttttttttattacgcggggtttaggagagggt

SEQ ID NO: 390 - DNA, 792 bp, Artificial Sequence
  chemically treated genomic DNA (Homo sapiens) CpG-island No: 390
accctctcctaaaccccgcgtaataaaaaaaacgaaaaaacaatataaaaaaataacccgaaaatcgatccgaaataatctacaaaaaaacaaacgacgataccgaaccgaaaaccacgcgctcacccgcgaaatcgaacgaacccgacgaaaataaacgaaacactaaaaacaacgaccaactccaaaaaacgcgaaacgaaacgcgcgaaaaaaaaaaaaacgcgacgaacgcgcgcgtacgaaattcgtatataaacccgcgaaaacgcgcgtaactaaaaaacaataaaaatcgcctcgacgacgaacaacacaacgaaaacataacgcccgaaactaacgaacgcgcctaactaacgaaaccgttaactcgaaacgaacgcgacccgaacccgataaatataaaacaatcgccgctaccgacgcccaaaccgaccccaaaaccgacccccgcaaaaaactaaaaaaaataaaaaccccaatcgccgcgaacgtcgacgccgataaatacgtaaaaaactcgaaccgaaaaactttctttataaaactccgacgataaaaacctaaccgaacctcaacgactaaaaaatacctataaaacgaaaaacgtctaacaatccgaattccatcccaaccgctaaccgtcaaacgacgaaacctaatccgccgcctacctacctcaatttccacgaaaatatatacgaatatataaaaatatatataaatattaacctacgcacaccgaaaaaaaaatcgatatactatcaacgcctaatacgcgcgacgcct

SEQ ID NO: 391 - DNA, 792 bp, Artificial Sequence
  chemically treated genomic DNA (Homo sapiens) CpG-island No: 391
atttttttttaggtttcgcgtggtgggggaagcgaaagggtagtgtggggaagtggttcgagggtcggttcggggtggtttgtagagaggtaggcggcggtgtcgagtcgggaattacgcgtttattcgcggagtcggacgggttcggcgggggtgggcgagatattgggaatagcggttagttttagagggcgcgaggcggggcgcgcggggagggagggggcgcggcgaacgcgcgcgtgcggggttcgtgtgtgggttcgcgggggcgcgcgtggttggggggtagtgagggtcgtttcggcggcgagtagtatagcgggaatatggcgttcggaattggcgagcgcgtttagttggcgggatcgttagttcgaggcggacgcggttcggattcggtggatgtggagtagtcgtcgttgtcggcgtttaagtcgattttagggtcgattttcgtaaggagttgaaggaggtgggagttttagtcgtcgcgggcgtcggcgtcggtgagtgcgtgaggggttcgggtcgggagattttttttgtgaaatttcggcggtgggagtttggtcgggttttagcggttgaggagtgtttgtgaggcggaaggcgtttggtagttcgggttttattttagtcgttagtcgttaggcggcgggatttggttcgtcgtttgtttgttttagtttttacgggagtgtgtgcgggtgtgtgagggtgtgtatgggtgttggtttgcgtatatcggagggggggtcggtatattgttagcgtttaatgcgcgcggcgttt

SEQ ID NO: 392 - DNA, 792 bp, Artificial Sequence
  chemically treated genomic DNA (Homo sapiens) CpG-island No: 392
aaacgccgcgcgcattaaacgctaacaatataccgaccccccctccgatatacgcaaaccaacacccatacacaccctcacacacccgcacacactcccgtaaaaactaaaacaaacaaacgacgaaccaaatcccgccgcctaacgactaacgactaaaataaaacccgaactaccaaacgccttccgcctcacaaacactcctcaaccgctaaaacccgaccaaactcccaccgccgaaatttcacaaaaaaaatctcccgacccgaacccctcacgcactcaccgacgccgacgcccgcgacgactaaaactcccacctccttcaactccttacgaaaatcgaccctaaaatcgacttaaacgccgacaacgacgactactccacatccaccgaatccgaaccgcgtccgcctcgaactaacgatcccgccaactaaacgcgctcgccaattccgaacgccatattcccgctatactactcgccgccgaaacgaccctcactaccccccaaccacgcgcgcccccgcgaacccacacacgaaccccgcacgcgcgcgttcgccgcgccccctccctccccgcgcgccccgcctcgcgccctctaaaactaaccgctattcccaatatctcgcccacccccgccgaacccgtccgactccgcgaataaacgcgtaattcccgactcgacaccgccgcctacctctctacaaaccaccccgaaccgaccctcgaaccacttccccacactaccctttcgcttcccccaccacgcgaaacctaaaaaaaaat

SEQ ID NO: 393 - DNA, 717 bp, Artificial Sequence
  chemically treated genomic DNA (Homo sapiens) CpG-island No: 393
gaacggcggaaagagaagggaattattagtagtttcgggtgcggagttagggtgacggggaggtaggtacggggtttgggcggcgtgggttttgggcgcgaggtgcgtttttcgtcgcgtttttttttttttagattattgttggggcggtttttcgggtttcgtggtttttttgggtattcgtaggggtataatggggtgatcgaattgtttcgttcgggtttgttttttcgtttattcgaggggtcgttgggttatgttttacgtgtatttgtgaggggcgtttgggttttagtgcggcgattttgtattggtttaagcgttttagtcggtgttttcggggagtcggagggttcgaggttttttttcgggagtttagagttcgtaggaaaaaaaagggtttcgaaatggagatgagtgtgtcgggtattagggacgcgtacgttggtttcgtgaattgggattagtatttcggggtaattgtcgaatttttaatgataaggttttgggaacgagaggcggggagggaaggggtttgcgttatataatatttagcgtagagggacggaagagtagatacgagaagggcgcgttttacgttcgggttagaggaaattggcgtcgaatgtttttgtagttcgttgagttttggaattaaatagggaggcggttgagagggcgcgtttcgagtttataggggattagtgttttgttcgt

SEQ ID NO: 394 - DNA, 717 bp, Artificial Sequence
  chemically treated genomic DNA (Homo sapiens) CpG-island No: 394
acgaacaaaacactaatcccctataaactcgaaacgcgccctctcaaccgcctccctatttaattccaaaactcaacgaactacaaaaacattcgacgccaatttcctctaacccgaacgtaaaacgcgcccttctcgtatctactcttccgtccctctacgctaaatattatataacgcaaaccccttccctccccgcctctcgttcccaaaaccttatcattaaaaattcgacaattaccccgaaatactaatcccaattcacgaaaccaacgtacgcgtccctaatacccgacacactcatctccatttcgaaacccttttttttcctacgaactctaaactcccgaaaaaaaacctcgaaccctccgactccccgaaaacaccgactaaaacgcttaaaccaatacaaaatcgccgcactaaaacccaaacgcccctcacaaatacacgtaaaacataacccaacgacccctcgaataaacgaaaaaacaaacccgaacgaaacaattcgatcaccccattatacccctacgaatacccaaaaaaaccacgaaacccgaaaaaccgccccaacaataatctaaaaaaaaaaaaacgcgacgaaaaacgcacctcgcgcccaaaacccacgccgcccaaaccccgtacctacctccccgtcaccctaactccgcacccgaaactactaataattcccttctctttccgccgttc

SEQ ID NO: 395 - DNA, 717 bp, Artificial Sequence
  chemically treated genomic DNA (Homo sapiens) CpG-island No: 395
gcgggtagggtattggttttttgtggattcggggcgcgtttttttagtcgtttttttgtttaattttagagtttagcgggttgtagggatattcgacgttagttttttttggttcgggcgtgagacgcgtttttttcgtgtttgttttttcgtttttttgcgttggatgttgtatagcgtaggtttttttttttttcgtttttcgtttttaaaattttattattgagaattcgatagttgtttcgagatgttgattttagtttacggagttagcgtgcgcgtttttaatgttcggtatatttatttttatttcgggattttttttttttttgcgggttttggattttcgggaggaagtttcgggtttttcggtttttcggagatatcggttgaggcgtttaggttagtgtagagtcgtcgtattgggatttaggcgttttttataggtgtacgtagggtatggtttaacggtttttcggatgggcggggaaataggttcgggcggagtaattcgattattttattatgtttttgcggatgtttagaaaagttacgaggttcgggggatcgttttagtagtggtttggaaaggagagggcgcggcgaggggcgtatttcgcgtttagggtttacgtcgtttaggtttcgtgtttgttttttcgttattttaatttcgtattcgggattgttggtggttttttttttttttcgtcgttt

SEQ ID NO: 396 - DNA, 717 bp, Artificial Sequence
  chemically treated genomic DNA (Homo sapiens) CpG-island No: 396
aaacgacgaaaaaaaaaaaaaaccaccaacaatcccgaatacgaaattaaaataacgaaaaaacaaacacgaaacctaaacgacgtaaaccctaaacgcgaaatacgcccctcgccgcgccctctcctttccaaaccactactaaaacgatcccccgaacctcgtaacttttctaaacatccgcaaaaacataataaaataatcgaattactccgcccgaacctatttccccgcccatccgaaaaaccgttaaaccataccctacgtacacctataaaaaacgcctaaatcccaatacgacgactctacactaacctaaacgcctcaaccgatatctccgaaaaaccgaaaaacccgaaacttcctcccgaaaatccaaaacccgcaaaaaaaaaaaaaatcccgaaataaaaataaatataccgaacattaaaaacgcgcacgctaactccgtaaactaaaatcaacatctcgaaacaactatcgaattctcaataataaaattttaaaaacgaaaaacgaaaaaaaaaaaaacctacgctatacaacatccaacgcaaaaaaacgaaaaaacaaacacgaaaaaaacgcgtctcacgcccgaaccaaaaaaaactaacgtcgaatatccctacaacccgctaaactctaaaattaaacaaaaaaacgactaaaaaaacgcgccccgaatccacaaaaaaccaataccctacccgc

SEQ ID NO: 397 - DNA, 679 bp, Artificial Sequence
  chemically treated genomic DNA (Homo sapiens) CpG-island No: 397
agggcgcgttttttttttttcgttcgattttaggtcggtttttgatttttgatgagcgaggggttagcgttttcgggagggtttgggttttgttttcgtcggggtcggttttcggggcggcgtaggtcgagcggcgagggtttttggttttaggcgggtgcgcgggattttcggtttgttttaaggttcgcgttttaagcggagcgagcgtagttgagcgttcgggtttcgcgcgtttttgtgcgttttcgggtttttgcgggcgggcgggcgcggtcgtcgtcgagtaattcggtttgcgttcggtacgattgtagatgttaggttttgttcggggagtcgagcggtagcggggttgtgagttttaaattaatttttcgttttgttgttgtgtaatgtggattttcgaaggtttttcgtttcgttcgtttttttttttcgggcggtgcgcgttgtaaattgcgagttgggttttatttatataaagcgatttcgggcgggcggcggtagaggaggaggcggcggcggcgggtaggtcggggattcggacgttagcgtcgcgtttcgtgggtgaattttcgtcgcgtttcggggattttttttcggggacgggtcgatcgttagttttgtcgttattatgagttttttttttttgttttcgggttttttgtttttgatt

SEQ ID NO: 398 - DNA, 679 bp, Artificial Sequence
  chemically treated genomic DNA (Homo sapiens) CpG-island No: 398
aatcaaaaacaaaaaacccgaaaacaaaaaaaaaaaactcataataacgacaaaactaacgatcgacccgtccccgaaaaaaaatccccgaaacgcgacgaaaattcacccacgaaacgcgacgctaacgtccgaatccccgacctacccgccgccgccgcctcctcctctaccgccgcccgcccgaaatcgctttatataaataaaacccaactcgcaatttacaacgcgcaccgcccgaaaaaaaaaaacgaacgaaacgaaaaaccttcgaaaatccacattacacaacaacaaaacgaaaaattaatttaaaactcacaaccccgctaccgctcgactccccgaacaaaacctaacatctacaatcgtaccgaacgcaaaccgaattactcgacgacgaccgcgcccgcccgcccgcaaaaacccgaaaacgcacaaaaacgcgcgaaacccgaacgctcaactacgctcgctccgcttaaaacgcgaaccttaaaacaaaccgaaaatcccgcgcacccgcctaaaaccaaaaaccctcgccgctcgacctacgccgccccgaaaaccgaccccgacgaaaacaaaacccaaaccctcccgaaaacgctaacccctcgctcatcaaaaatcaaaaaccgacctaaaatcgaacgaaaaaaaaaaaacgcgccct

SEQ ID NO: 399 - DNA, 679 bp, Artificial Sequence
  chemically treated genomic DNA (Homo sapiens) CpG-island No: 399
ggttaggagtagggggttcggagataggggaggggagtttatggtggcggtagggttggcggtcggttcgttttcggagggaggttttcgggacgcggcggggatttatttacggggcgcggcgttggcgttcgggttttcggtttgttcgtcgtcgtcgtttttttttttgtcgtcgttcgttcggaatcgttttatgtaaatgaagtttaattcgtagtttgtagcgcgtatcgttcggggaaggggggcgggcggggcggggggttttcggggatttatattatatagtaataaagcggaaggttaatttgaaatttatagtttcgttgtcgttcggtttttcgggtaaagtttgatatttatagtcgtgtcgggcgtaggtcgggttgttcggcggcgatcgcgttcgttcgttcgtagggattcggggacgtatagggacgcgcgggattcgggcgtttagttgcgttcgtttcgtttggggcgcgggttttggggtaggtcgggggtttcgcgtattcgtttggggttaggaattttcgtcgttcggtttgcgtcgtttcgggaatcggtttcggcgggaataaagtttaggttttttcggaggcgttgatttttcgtttattaaaggttaggggtcggtttagaatcgggcgagaagaaagggacgcgtttt

SEQ ID NO: 400 - DNA, 679 bp, Artificial Sequence
  chemically treated genomic DNA (Homo sapiens) CpG-island No: 400
aaaacgcgtccctttcttctcgcccgattctaaaccgacccctaacctttaataaacgaaaaatcaacgcctccgaaaaaacctaaactttattcccgccgaaaccgattcccgaaacgacgcaaaccgaacgacgaaaattcctaaccccaaacgaatacgcgaaacccccgacctaccccaaaacccgcgccccaaacgaaacgaacgcaactaaacgcccgaatcccgcgcgtccctatacgtccccgaatccctacgaacgaacgaacgcgatcgccgccgaacaacccgacctacgcccgacacgactataaatatcaaactttacccgaaaaaccgaacgacaacgaaactataaatttcaaattaaccttccgctttattactatataatataaatccccgaaaaccccccgccccgcccgccccccttccccgaacgatacgcgctacaaactacgaattaaacttcatttacataaaacgattccgaacgaacgacgacaaaaaaaaaaacgacgacgacgaacaaaccgaaaacccgaacgccaacgccgcgccccgtaaataaatccccgccgcgtcccgaaaacctccctccgaaaacgaaccgaccgccaaccctaccgccaccataaactcccctcccctatctccgaaccccctactcctaacc

SEQ ID NO: 401 - DNA, 618 bp, Artificial Sequence
  chemically treated genomic DNA (Homo sapiens) CpG-island No: 401
cgggtcggcggggatttttcgttttttggcgtttttttttatcgtttcgtcggttgttggggaagcggcgggtgtttagtgtttggaggtcgttttttttttatttttggttgcgggaacggagaggtcgcggcggtcggagtagggtgggcggtttgaggcgagagtttagtcggttttcgcggggaatatggcgatttgcggcgagttgagcgttaattgttgcgtcgtcgatttttcggagtagcgaaggcgattcgagagaagacgtcgttaagtggaattcgggtttcgcggttttgggatggggtagtagttattgtagttaggaagttttgggcggggcgttgggcgttaacgagcgttacggtaatttttatgcggcgtttttattagtttataggcggtatcgtagtagtttttaggtagcgtttatattagtttataggggtcgtcgttcgtattgtatttgttttcgtcgtttcggggtgtgaattgcgttgtttgtcggtttggttacgttgattcgggtagtttaggttcgtagtagtcggacgaggagtttagggttattgttcggggttacgagaaggagtaggacggtgttttagaaaaatg

SEQ ID NO: 402 - DNA, 618 bp, Artificial Sequence
  chemically treated genomic DNA (Homo sapiens) CpG-island No: 402
catttttctaaaacaccgtcctactccttctcgtaaccccgaacaataaccctaaactcctcgtccgactactacgaacctaaactacccgaatcaacgtaaccaaaccgacaaacaacgcaattcacaccccgaaacgacgaaaacaaatacaatacgaacgacgacccctataaactaatataaacgctacctaaaaactactacgataccgcctataaactaataaaaacgccgcataaaaattaccgtaacgctcgttaacgcccaacgccccgcccaaaacttcctaactacaataactactaccccatcccaaaaccgcgaaacccgaattccacttaacgacgtcttctctcgaatcgccttcgctactccgaaaaatcgacgacgcaacaattaacgctcaactcgccgcaaatcgccatattccccgcgaaaaccgactaaactctcgcctcaaaccgcccaccctactccgaccgccgcgacctctccgttcccgcaaccaaaaataaaaaaaaaacgacctccaaacactaaacacccgccgcttccccaacaaccgacgaaacgataaaaaaaaacgccaaaaaacgaaaaatccccgccgacccg

SEQ ID NO: 403 - DNA, 618 bp, Artificial Sequence
  chemically treated genomic DNA (Homo sapiens) CpG-island No: 403
tatttttttggggtatcgttttgttttttttcgtaatttcgggtagtggttttgggtttttcgttcggttgttgcgggtttgggttgttcgggttagcgtagttaggtcgatagatagcgtagtttatatttcggggcggcggaggtaggtgtagtgcgagcggcgatttttgtaggttggtgtgggcgttgtttggaggttgttgcggtgtcgtttgtaggttggtgagggcgtcgtatggaggttgtcgtgacgttcgttggcgtttagcgtttcgtttagggttttttggttgtagtggttgttgttttattttagggtcgcggggttcgggttttatttggcggcgttttttttcgagtcgttttcgttgtttcgagaagtcggcggcgtagtagttgacgtttagttcgtcgtaggtcgttatatttttcgcggaggtcggttgggttttcgttttaggtcgtttattttgtttcggtcgtcgcggttttttcgttttcgtagttagaggtggggagagagcgatttttaggtattgggtattcgtcgtttttttagtagtcggcggggcgatggagaaagacgttaggaagcggaaggttttcgtcggttcg

SEQ ID NO: 404 - DNA, 618 bp, Artificial Sequence
  chemically treated genomic DNA (Homo sapiens) CpG-island No: 404
cgaaccgacgaaaaccttccgcttcctaacgtctttctccatcgccccgccgactactaaaaaaacgacgaatacccaatacctaaaaatcgctctctccccacctctaactacgaaaacgaaaaaaccgcgacgaccgaaacaaaataaacgacctaaaacgaaaacccaaccgacctccgcgaaaaatataacgacctacgacgaactaaacgtcaactactacgccgccgacttctcgaaacaacgaaaacgactcgaaaaaaaacgccgccaaataaaacccgaaccccgcgaccctaaaataaaacaacaaccactacaaccaaaaaaccctaaacgaaacgctaaacgccaacgaacgtcacgacaacctccatacgacgccctcaccaacctacaaacgacaccgcaacaacctccaaacaacgcccacaccaacctacaaaaatcgccgctcgcactacacctacctccgccgccccgaaatataaactacgctatctatcgacctaactacgctaacccgaacaacccaaacccgcaacaaccgaacgaaaaacccaaaaccactacccgaaattacgaaaaaaaacaaaacgataccccaaaaaaata

SEQ ID NO: 405 - DNA, 652 bp, Artificial Sequence
  chemically treated genomic DNA (Homo sapiens) CpG-island No: 405
gttcgcggttttcgcgcgttcgcggtcgtgtttcgcggtttcggtttcggttttcggcgatacgtattttcgtatatttcgttcgtacgtcgattatcggcgtattacgcgcgttagcgcgtttttggacgtttgcggattttattgggggtttttgagcgtgtacggggcgtacgagcggttgcgcgtcgagttcgtgggtatttttttggtgcgcgatagtcgttagcggaattgttttttcgtttttagcgtgaagatggtttcgggatttacgagtattcgcgtgtatttttaggtcggtcgtttttatttggatggtagtcgcgagagtttcgattgttttttcgagttgttggagtattacgtggcggcgtcgcgtcgtatgttgggggtttcgttgcgttagcgtcgcgtgcggtcgttgtaggagttgtgtcgttagcgtatcgtggttatcgtgggtcgcgagaatttggttcgtattttttttaatttcgtttttcgcgattatttgagttttttttttttttagatttgatcggtagcgttcgtcgtgtacgtagtattaattgggatgtcgtgttattttgttattatttgtttggaattatgtgggtatttttttcggtttgggttggagggagcggat

SEQ ID NO: 406 - DNA, 652 bp, Artificial Sequence
  chemically treated genomic DNA (Homo sapiens) CpG-island No: 406
atccgctccctccaacccaaaccgaaaaaaatacccacataattccaaacaaataataacaaaataacacgacatcccaattaatactacgtacacgacgaacgctaccgatcaaatctaaaaaaaaaaaaaactcaaataatcgcgaaaaacgaaattaaaaaaaatacgaaccaaattctcgcgacccacgataaccacgatacgctaacgacacaactcctacaacgaccgcacgcgacgctaacgcaacgaaacccccaacatacgacgcgacgccgccacgtaatactccaacaactcgaaaaaacaatcgaaactctcgcgactaccatccaaataaaaacgaccgacctaaaaatacacgcgaatactcgtaaatcccgaaaccatcttcacgctaaaaacgaaaaaacaattccgctaacgactatcgcgcaccaaaaaaatacccacgaactcgacgcgcaaccgctcgtacgccccgtacacgctcaaaaacccccaataaaatccgcaaacgtccaaaaacgcgctaacgcgcgtaatacgccgataatcgacgtacgaacgaaatatacgaaaatacgtatcgccgaaaaccgaaaccgaaaccgcgaaacacgaccgcgaacgcgcgaaaaccgcgaac

SEQ ID NO: 407 - DNA, 652 bp, Artificial Sequence
  chemically treated genomic DNA (Homo sapiens) CpG-island No: 407
attcgttttttttaatttaggtcggggagggtatttatatggttttaggtaagtaataataaaataatacggtattttagttaatgttgcgtgtacggcgggcgttgtcggttaaatttggaaggggaaggagtttaggtagtcgcggaggacggggttgagggggatgcgagttaggttttcgcggtttacggtggttacgatgcgttggcggtatagtttttgtagcggtcgtacgcggcgttggcgtagcggggtttttagtatgcggcgcggcgtcgttacgtagtgttttagtagttcgaagaggtagtcgaagttttcgcggttgttatttaggtgaaagcggtcggtttgaaagtgtacgcggatgttcgtgggtttcgaggttatttttacgttaagggcgaaaaagtagtttcgttggcggttgtcgcgtattaggaaggtgtttacgggttcggcgcgtagtcgttcgtgcgtttcgtgtacgtttaggggtttttagtagaattcgtaggcgtttaggagcgcgttggcgcgcgtgatgcgtcggtaatcggcgtgcgaacggaatgtgcggaagtgcgtgtcgtcgggggtcggggtcgggatcgcggggtacggtcgcgggcgcgcgggggtcgcgggt

SEQ ID NO: 408 - DNA, 652 bp, Artificial Sequence
  chemically treated genomic DNA (Homo sapiens) CpG-island No: 408
acccgcgacccccgcgcgcccgcgaccgtaccccgcgatcccgaccccgacccccgacgacacgcacttccgcacattccgttcgcacgccgattaccgacgcatcacgcgcgccaacgcgctcctaaacgcctacgaattctactaaaaacccctaaacgtacacgaaacgcacgaacgactacgcgccgaacccgtaaacaccttcctaatacgcgacaaccgccaacgaaactactttttcgcccttaacgtaaaaataacctcgaaacccacgaacatccgcgtacactttcaaaccgaccgctttcacctaaataacaaccgcgaaaacttcgactacctcttcgaactactaaaacactacgtaacgacgccgcgccgcatactaaaaaccccgctacgccaacgccgcgtacgaccgctacaaaaactataccgccaacgcatcgtaaccaccgtaaaccgcgaaaacctaactcgcatccccctcaaccccgtcctccgcgactacctaaactccttccccttccaaatttaaccgacaacgcccgccgtacacgcaacattaactaaaataccgtattattttattattacttacctaaaaccatataaataccctccccgacctaaattaaaaaaaacgaat

SEQ ID NO: 409 - DNA, 685 bp, Artificial Sequence
  chemically treated genomic DNA (Homo sapiens) CpG-island No: 409
tttcgtcgatcgcgtggggtttttcgttggggggtgcggggtgttttaagttatggatgtttcggcgtgtttttttgcgggcgtgtgtgtgtgttttagtgtgtatgacgacgttttatttttgttgtgtacgaatttcgtggtaagagtacgggagtttgtgtttattagtagaggttgtttgtagtttttatttcgtttggtatagcgttttatacgtacgtatatatacgtatataaagattttttcggcgtgtgtttgtcgtcgcggtattttcggggagggggttcgttaggagtttttcggtttttttgggttttagttatttttttttttacgtcgggaaatcgtttcggtatcgttttttgatttgttttcgatgtatttgttgtcgtgtttgtcgtggttgagtgtgttttttttttttttttcgatttttttttcgattggggataatatttcgttataattttgttcgatgtagatgcggggttcggggcgtttggggttaagtcgggtcgggcgggcgggtatatttgggggtgtggagtgtgcgcgtttacgcgcgtgaaacgtggatgtagagggtatcgtcgtttttttttatgtgcgttttaagaaggaggaaaaaaatgttaggcgtaacgtttattgtcgaaatttcgtttttttgttatttacggt

SEQ ID NO: 410 - DNA, 685 bp, Artificial Sequence
  chemically treated genomic DNA (Homo sapiens) CpG-island No: 410
accgtaaataacaaaaaaacgaaatttcgacaataaacgttacgcctaacatttttttcctccttcttaaaacgcacataaaaaaaaacgacgataccctctacatccacgtttcacgcgcgtaaacgcgcacactccacacccccaaatatacccgcccgcccgacccgacttaaccccaaacgccccgaaccccgcatctacatcgaacaaaattataacgaaatattatccccaatcgaaaaaaaaatcgaaaaaaaaaaaaaaaacacactcaaccacgacaaacacgacaacaaatacatcgaaaacaaatcaaaaaacgataccgaaacgatttcccgacgtaaaaaaaaaaataactaaaacccaaaaaaaccgaaaaactcctaacgaaccccctccccgaaaataccgcgacgacaaacacacgccgaaaaaatctttatatacgtatatatacgtacgtataaaacgctataccaaacgaaataaaaactacaaacaacctctactaataaacacaaactcccgtactcttaccacgaaattcgtacacaacaaaaataaaacgtcgtcatacacactaaaacacacacacacgcccgcaaaaaaacacgccgaaacatccataacttaaaacaccccgcaccccccaacgaaaaaccccacgcgatcgacgaaa

SEQ ID NO: 411 - DNA, 685 bp, Artificial Sequence
  chemically treated genomic DNA (Homo sapiens) CpG-island No: 411
gtcgtgaataataggaaggcgaggtttcggtagtgaacgttgcgtttgatatttttttttttttttttgaaacgtatataaaaggaaacggcggtgttttttgtatttacgttttacgcgcgtgggcgcgtatattttatatttttaaatatattcgttcgttcggttcggtttggttttaggcgtttcgggtttcgtatttatatcggataggattgtaacggaatgttatttttagtcgggaagggggtcggggaaaagagggagaatatatttagttacgataagtacgataataaatgtatcggaaataaattagaaggcgatgtcggggcggtttttcggcgtgggaggggaggtggttgggatttagggggatcgaagggtttttggcgagtttttttttcgaaagtatcgcggcgataggtatacgtcgaggaagtttttgtgtacgtgtgtgtgcgtgcgtgtggagcgttgtgttaggcgaaatggaaattataggtagtttttgttgatgggtataaattttcgtgtttttgttacggggttcgtgtataataaaaatgagacgtcgttatatatattgaaatatatatatacgttcgtaggaaaatacgtcgaggtatttataatttagagtatttcgtattttttagcgaaaagttttacgcgatcggcgagg

SEQ ID NO: 412 - DNA, 685 bp, Artificial Sequence
  chemically treated genomic DNA (Homo sapiens) CpG-island No: 412
cctcgccgatcgcgtaaaacttttcgctaaaaaatacgaaatactctaaattataaatacctcgacgtattttcctacgaacgtatatatatatttcaatatatataacgacgtctcatttttattatacacgaaccccgtaacaaaaacacgaaaatttatacccatcaacaaaaactacctataatttccatttcgcctaacacaacgctccacacgcacgcacacacacgtacacaaaaacttcctcgacgtatacctatcgccgcgatactttcgaaaaaaaaactcgccaaaaacccttcgatccccctaaatcccaaccacctcccctcccacgccgaaaaaccgccccgacatcgccttctaatttatttccgatacatttattatcgtacttatcgtaactaaatatattctccctcttttccccgacccccttcccgactaaaaataacattccgttacaatcctatccgatataaatacgaaacccgaaacgcctaaaaccaaaccgaaccgaacgaacgaatatatttaaaaatataaaatatacgcgcccacgcgcgtaaaacgtaaatacaaaaaacaccgccgtttccttttatatacgtttcaaaaaaaaaaaaaaaaatatcaaacgcaacgttcactaccgaaacctcgccttcctattattcacgac

SEQ ID NO: 413 - DNA, 577 bp, Artificial Sequence
  chemically treated genomic DNA (Homo sapiens) CpG-island No: 413
tattttttttaggcgggcggtattcgttgaagtttcggtattatatttatagttaggagttttagtttcgtattcggtcgtatgcgtattttttgcggttttttcgttaggcgtcgcgttgggtagttagcgtttcggcggggttttttaggttttcggtcgggtagtttttttcggggtttttgtgcggttgcgtagtagttgcgaggacgcgggtcgagtcggaagtggagtgcgttgcggcgcgagttgggtcggcgggcgtggttcgagagcgcgtagagtttagattggcggtagggttcgaggggtcgattcgtagcgtttttggtttttttagtttttattcggaatcgtacgtgagggtaaattcgtttcggtggttggtttagtacgcggggatagttttttcgaggtttttttagcggtgtgggcgagagggcgttcgggtcgggggaagtacggaaaggtggtttcgcgaggttgttgtggggggcgggacgggtagtttggcgatgtttggatatggttggtggttaaaaatatttatcgaaagatagtttatttatttagatgg

SEQ ID NO: 414 - DNA, 577 bp, Artificial Sequence
  chemically treated genomic DNA (Homo sapiens) CpG-island No: 414
ccatctaaataaataaactatctttcgataaatatttttaaccaccaaccatatccaaacatcgccaaactacccgtcccgccccccacaacaacctcgcgaaaccacctttccgtacttcccccgacccgaacgccctctcgcccacaccgctaaaaaaacctcgaaaaaactatccccgcgtactaaaccaaccaccgaaacgaatttaccctcacgtacgattccgaataaaaactaaaaaaaccaaaaacgctacgaatcgacccctcgaaccctaccgccaatctaaactctacgcgctctcgaaccacgcccgccgacccaactcgcgccgcaacgcactccacttccgactcgacccgcgtcctcgcaactactacgcaaccgcacaaaaaccccgaaaaaaactacccgaccgaaaacctaaaaaaccccgccgaaacgctaactacccaacgcgacgcctaacgaaaaaaccgcaaaaaatacgcatacgaccgaatacgaaactaaaactcctaactataaatataataccgaaacttcaacgaataccgcccgcctaaaaaaaata

SEQ ID NO: 415 - DNA, 577 bp, Artificial Sequence
  chemically treated genomic DNA (Homo sapiens) CpG-island No: 415
ttatttaagtgggtaagttatttttcgataaatgtttttggttattaattatgtttaggtatcgttaggttgttcgtttcgttttttataatagtttcgcgaagttattttttcgtgtttttttcgattcggacgttttttcgtttatatcgttagggaggtttcggaggggttgttttcgcgtgttaagttagttatcggggcggatttgtttttacgtgcggtttcgagtgagggttggagagattagggacgttgcgggtcggtttttcgggttttgtcgttagtttggattttgcgcgttttcgaattacgttcgtcggtttagttcgcgtcgtagcgtattttattttcggttcggttcgcgttttcgtagttgttacgtaatcgtataaggatttcgagggaggttgttcggtcgaaggtttgaaggatttcgtcggggcgttggttgtttagcgcggcgtttggcgggagggtcgtagggagtgcgtatgcggtcgagtgcgggattggggtttttggttgtgggtgtggtatcgaggttttagcgggtgtcgttcgtttagagggagtg

SEQ ID NO: 416 - DNA, 577 bp, Artificial Sequence
  chemically treated genomic DNA (Homo sapiens) CpG-island No: 416
cactccctctaaacgaacgacacccgctaaaacctcgataccacacccacaaccaaaaaccccaatcccgcactcgaccgcatacgcactccctacgaccctcccgccaaacgccgcgctaaacaaccaacgccccgacgaaatccttcaaaccttcgaccgaacaacctccctcgaaatccttatacgattacgtaacaactacgaaaacgcgaaccgaaccgaaaataaaatacgctacgacgcgaactaaaccgacgaacgtaattcgaaaacgcgcaaaatccaaactaacgacaaaacccgaaaaaccgacccgcaacgtccctaatctctccaaccctcactcgaaaccgcacgtaaaaacaaatccgccccgataactaacttaacacgcgaaaacaacccctccgaaacctccctaacgatataaacgaaaaaacgtccgaatcgaaaaaaacacgaaaaaataacttcgcgaaactattataaaaaacgaaacgaacaacctaacgatacctaaacataattaataaccaaaaacatttatcgaaaaataacttacccacttaaataa

SEQ ID NO: 417 - DNA, 511 bp, Artificial Sequence
  chemically treated genomic DNA (Homo sapiens) CpG-island No: 417
ttttcgcgttttacggtttttttcgattttagttagcgtttttcgggttttcggcgttacgagttgttcgggtacgtagtttttagcggcgcgtcgttgttaagtcggttttcgcgcgttttttttttttttttttttttggttgttcgcgatttagtttgggtaggcggggaagtagttggagtgcgatcgtcgcggtagttattttgtaatcgttagtcggaggtgtagttcgtaggttttggttttcgggtgggtttttggggagtcggcgtcgttttcggggagttgtaaggttcgtttttgttcggcgtggagggcgcggggggcgcggaggtgagcgggtcggggaggagcgcgaaagaaggtagcggcggcggagttgagggttaagatgtagtttgcgttacgcgttgtatttatttttttcgattttgcgtttttatcgggcgttcgttttgagttgcggggttttttattttttggtattttaaggtggaaagtgagaagg

SEQ ID NO: 418 - DNA, 511 bp, Artificial Sequence
  chemically treated genomic DNA (Homo sapiens) CpG-island No: 418
ccttctcactttccaccttaaaataccaaaaaataaaaaaccccgcaactcaaaacgaacgcccgataaaaacgcaaaatcgaaaaaaataaatacaacgcgtaacgcaaactacatcttaaccctcaactccgccgccgctaccttctttcgcgctcctccccgacccgctcacctccgcgccccccgcgccctccacgccgaacaaaaacgaaccttacaactccccgaaaacgacgccgactccccaaaaacccacccgaaaaccaaaacctacgaactacacctccgactaacgattacaaaataactaccgcgacgatcgcactccaactacttccccgcctacccaaactaaatcgcgaacaaccaaaaaaaaaaaaaaaaaaaaaacgcgcgaaaaccgacttaacaacgacgcgccgctaaaaactacgtacccgaacaactcgtaacgccgaaaacccgaaaaacgctaactaaaatcgaaaaaaaccgtaaaacgcgaaaa

SEQ ID NO: 419 - DNA, 511 bp, Artificial Sequence
  chemically treated genomic DNA (Homo sapiens) CpG-island No: 419
tttttttattttttattttaaggtgttaggagatgagggatttcgtagtttagggcggacgttcggtgagggcgtagaatcggggaggatggatgtagcgcgtggcgtagattgtattttgatttttaatttcgtcgtcgttattttttttcgcgttttttttcgattcgtttattttcgcgtttttcgcgttttttacgtcgggtaggggcgagttttgtagtttttcgggagcggcgtcgattttttaagggtttattcgggggttagggtttacggattgtattttcgattggcggttgtagggtggttgtcgcggcggtcgtattttagttgttttttcgtttatttaagttggatcgcgaatagttaggggagaaggaaggagggaggcgcgcggaggtcggtttggtagcgacgcgtcgttaggggttgcgtgttcggatagttcgtggcgtcgagggttcgaggaacgttgattggagtcgggaagagtcgtggagcgcgggga

SEQ ID NO: 420 - DNA, 511 bp, Artificial Sequence
  chemically treated genomic DNA (Homo sapiens) CpG-island No: 420
tccccgcgctccacgactcttcccgactccaatcaacgttcctcgaaccctcgacgccacgaactatccgaacacgcaacccctaacgacgcgtcgctaccaaaccgacctccgcgcgcctccctccttccttctcccctaactattcgcgatccaacttaaataaacgaaaaaacaactaaaatacgaccgccgcgacaaccaccctacaaccgccaatcgaaaatacaatccgtaaaccctaacccccgaataaacccttaaaaaatcgacgccgctcccgaaaaactacaaaactcgcccctacccgacgtaaaaaacgcgaaaaacgcgaaaataaacgaatcgaaaaaaaacgcgaaaaaaaataacgacgacgaaattaaaaatcaaaatacaatctacgccacgcgctacatccatcctccccgattctacgccctcaccgaacgtccgccctaaactacgaaatccctcatctcctaacaccttaaaataaaaaataaaaaaa

SEQ ID NO: 421 - DNA, 741 bp, Artificial Sequence
  chemically treated genomic DNA (Homo sapiens) CpG-island No: 421
cgcgggtttagcggttttcgatagcgttttcgtttcgtttttcggcgggcgtttttttttgttttttcgggtgcgaatcgggcgttggtcggggatttcggggacgcgtgcgtttttcgtcgcgcgaggtgtcgtcgagttagttcgagagggcggggggcgggcggggcggcgcgcgggggcgggggagcggtcgggatacgtgtggcggcggcgggggggacgcggcgttcggggttttaagaaggtgtggagcggggcgggcgtttttttaggtttggtcgaggggcgtcgcgtagaggcggcggcggcgtacggaggcggtagacgacgcgttttcggcgttcgtagtttcggtttcgcgttttcgcggtttaaagtaattttgggagtcgtcgtttttcgcggaatttttcggcgggggttcgtttttaggttcgttttcgagttcgtttcgttttcgttcgtttttttttcgtttttttttcgcgtggttttttcgtttcggcgtttttaaaattgaatgagcgagcggcgcgtagggcgcgcggcggcggcggcggcggcggcggtatggagcgtagtggttgggttcggtagattttttttttagcgttgttgttgggggcgacgttgagggcgcgcgcggcggttggttattattttcgtttttcgttttttttttttttgtgtatttattacggggagttggaaggggatggggagtagggcgaggtgttt

SEQ ID NO: 422 - DNA, 741 bp, Artificial Sequence
  chemically treated genomic DNA (Homo sapiens) CpG-island No: 422
aaacacctcgccctactccccatccccttccaactccccgtaataaatacacaaaaaaaaaaaaaacgaaaaacgaaaataataaccaaccgccgcgcgcgccctcaacgtcgcccccaacaacaacgctaaaaaaaaaatctaccgaacccaaccactacgctccataccgccgccgccgccgccgccgccgcgcgccctacgcgccgctcgctcattcaattttaaaaacgccgaaacgaaaaaaccacgcgaaaaaaaaacgaaaaaaaaacgaacgaaaacgaaacgaactcgaaaacgaacctaaaaacgaacccccgccgaaaaattccgcgaaaaacgacgactcccaaaattactttaaaccgcgaaaacgcgaaaccgaaactacgaacgccgaaaacgcgtcgtctaccgcctccgtacgccgccgccgcctctacgcgacgcccctcgaccaaacctaaaaaaacgcccgccccgctccacaccttcttaaaaccccgaacgccgcgtcccccccgccgccgccacacgtatcccgaccgctcccccgcccccgcgcgccgccccgcccgccccccgccctctcgaactaactcgacgacacctcgcgcgacgaaaaacgcacgcgtccccgaaatccccgaccaacgcccgattcgcacccgaaaaaacaaaaaaaaacgcccgccgaaaaacgaaacgaaaacgctatcgaaaaccgctaaacccgcg

SEQ ID NO: 423 - DNA, 741 bp, Artificial Sequence
  chemically treated genomic DNA (Homo sapiens) CpG-island No: 423
gagtatttcgttttgttttttatttttttttagtttttcgtggtgggtgtataggaaaaagaagggcgaaaagcgggggtaatagttagtcgtcgcgcgcgtttttagcgtcgtttttagtaatagcgttaggaggaaagtttgtcgggtttagttattgcgttttatgtcgtcgtcgtcgtcgtcgtcgtcgcgcgttttacgcgtcgttcgtttatttagttttggagacgtcgggacggaggagttacgcggagagaaggcgagaagaaggcggacgggagcggaacgggttcgggagcgggtttgggagcgggttttcgtcgagaagtttcgcgggagacggcggtttttaaagttattttgggtcgcgggagcgcgggatcggggttgcgggcgtcgagagcgcgtcgtttgtcgttttcgtgcgtcgtcgtcgtttttgcgcgacgtttttcggttaggtttgggaaagcgttcgtttcgttttatatttttttaaagtttcgggcgtcgcgtttttttcgtcgtcgttatacgtgtttcggtcgttttttcgttttcgcgcgtcgtttcgttcgtttttcgttttttcgggttggttcggcggtatttcgcgcggcgaggggcgtacgcgttttcggagttttcggttagcgttcggttcgtattcgggaggatagggaggggcgttcgtcggggagcgggacggggacgttgtcgaggatcgttgagttcgcg

SEQ ID NO: 424 - DNA, 741 bp, Artificial Sequence
  chemically treated genomic DNA (Homo sapiens) CpG-island No: 424
cgcgaactcaacgatcctcgacaacgtccccgtcccgctccccgacgaacgcccctccctatcctcccgaatacgaaccgaacgctaaccgaaaactccgaaaacgcgtacgcccctcgccgcgcgaaataccgccgaaccaacccgaaaaaacgaaaaacgaacgaaacgacgcgcgaaaacgaaaaaacgaccgaaacacgtataacgacgacgaaaaaaacgcgacgcccgaaactttaaaaaaatataaaacgaaacgaacgctttcccaaacctaaccgaaaaacgtcgcgcaaaaacgacgacgacgcacgaaaacgacaaacgacgcgctctcgacgcccgcaaccccgatcccgcgctcccgcgacccaaaataactttaaaaaccgccgtctcccgcgaaacttctcgacgaaaacccgctcccaaacccgctcccgaacccgttccgctcccgtccgccttcttctcgccttctctccgcgtaactcctccgtcccgacgtctccaaaactaaataaacgaacgacgcgtaaaacgcgcgacgacgacgacgacgacgacgacataaaacgcaataactaaacccgacaaactttcctcctaacgctattactaaaaacgacgctaaaaacgcgcgcgacgactaactattacccccgcttttcgcccttctttttcctatacacccaccacgaaaaactaaaaaaaaataaaaaacaaaacgaaatactc

SEQ ID NO: 425 - DNA, 613 bp, Artificial Sequence
  chemically treated genomic DNA (Homo sapiens) CpG-island No: 425
tggttggacgcgtagagcgggttggtttcggttttcgtgtcgggtaagtgtttttcgggggacggtttcggggttggcgggcggcggtcgcgttttcggtgttagtttcggtatatatttttttttttttttttttaggggtcggtaattatagttattgtcgaaattcggacgaggattcgcgcgggttttggtgttacgttagtggcgaggtcggcgtttttgagaaacggttttgcgaggatttgcgttgtttaggtatttgttcgggatttcgggaattttcgtttttggcgttgataggaagcggttgagatattcgtggcgtacgtgcggtcgcgcgatgtcggtcggtttcgtttcgttttcgcgtcgttcgattggttagggttgtttttaggtcgcggggtttaaagtttattggtcgtcgtcgttattcgtatgagtttattcgtcgcgagcgtttgtaaataattgcgcggggcgaggttggggtgaggttaggttttttcgtcgcgcgttttgaggagtggtttttggttttttagcgtttattgatcgtttgcggagcgtttgtagtgtgttagatttatattgtttataattttagttt

SEQ ID NO: 426 - DNA, 613 bp, Artificial Sequence
  chemically treated genomic DNA (Homo sapiens) CpG-island No: 426
aaactaaaattataaacaatataaatctaacacactacaaacgctccgcaaacgatcaataaacgctaaaaaaccaaaaaccactcctcaaaacgcgcgacgaaaaaacctaacctcaccccaacctcgccccgcgcaattatttacaaacgctcgcgacgaataaactcatacgaataacgacgacgaccaataaactttaaaccccgcgacctaaaaacaaccctaaccaatcgaacgacgcgaaaacgaaacgaaaccgaccgacatcgcgcgaccgcacgtacgccacgaatatctcaaccgcttcctatcaacgccaaaaacgaaaattcccgaaatcccgaacaaatacctaaacaacgcaaatcctcgcaaaaccgtttctcaaaaacgccgacctcgccactaacgtaacaccaaaacccgcgcgaatcctcgtccgaatttcgacaataactataattaccgacccctaaaaaaaaaaaaaaaaaaatatataccgaaactaacaccgaaaacgcgaccgccgcccgccaaccccgaaaccgtcccccgaaaaacacttacccgacacgaaaaccgaaaccaacccgctctacgcgtccaacca

SEQ ID NO: 427 - DNA, 613 bp, Artificial Sequence
  chemically treated genomic DNA (Homo sapiens) CpG-island No: 427
gagttggggttgtgagtagtgtgggtttagtatattgtagacgtttcgtaaacggttaataaacgttgaggggttaaaagttattttttaggacgcgcggcggagagatttagttttattttagtttcgtttcgcgtagttgtttataagcgttcgcggcggatgagtttatacgagtggcggcggcggttaataggttttgagtttcgcggtttggagatagttttggttaatcggacggcgcggaggcggagcggggtcggtcggtatcgcgcggtcgtacgtgcgttacgagtgttttagtcgttttttgttagcgttaggagcggggattttcggggtttcgggtaggtatttggatagcgtaggttttcgtaaggtcgttttttagggacgtcggtttcgttattgacgtagtattagggttcgcgcgggttttcgttcgggtttcggtagtaattgtgattgtcggtttttaagagaggagagaaggaaatgtgtgtcggggttggtatcgggaacgcggtcgtcgttcgttagtttcggggtcgtttttcggaggatatttattcgatacgggggtcgaggttagttcgttttgcgcgtttagtta

SEQ ID NO: 428 - DNA, 613 bp, Artificial Sequence
  chemically treated genomic DNA (Homo sapiens) CpG-island No: 428
taactaaacgcgcaaaacgaactaacctcgacccccgtatcgaataaatatcctccgaaaaacgaccccgaaactaacgaacgacgaccgcgttcccgataccaaccccgacacacatttccttctctcctctcttaaaaaccgacaatcacaattactaccgaaacccgaacgaaaacccgcgcgaaccctaatactacgtcaataacgaaaccgacgtccctaaaaaacgaccttacgaaaacctacgctatccaaatacctacccgaaaccccgaaaatccccgctcctaacgctaacaaaaaacgactaaaacactcgtaacgcacgtacgaccgcgcgataccgaccgaccccgctccgcctccgcgccgtccgattaaccaaaactatctccaaaccgcgaaactcaaaacctattaaccgccgccgccactcgtataaactcatccgccgcgaacgcttataaacaactacgcgaaacgaaactaaaataaaactaaatctctccgccgcgcgtcctaaaaaataacttttaacccctcaacgtttattaaccgtttacgaaacgtctacaatatactaaacccacactactcacaaccccaactc

SEQ ID NO: 429 - DNA, 725 bp, Artificial Sequence
  chemically treated genomic DNA (Homo sapiens) CpG-island No: 429
tcgaagtcggaagcggtttcggggtgcgttgtatcgtttttttcggggtttttttaggtcggagcgcgggatttcggtggtcgggagaggtcggaacggtttcgcggggtagcggcgttttttggcgggtttggggtgcggcgcgggagtcgaggtcgatttagtattttttcgcgttttagttttcgtttcgcggtttttatttacggtggttttcgttttgtttgtttttttgtttcgttttgttttcgggtttggttttcgttttcgtcgatttgttattttttggtcgtcgaggttcggttttcgtagagttgtagtcgttacgcgtttttttgtaattagttttttgtggtattttattttttttgtttcgcgcggggttttatttcgttagggtttttttcgcgatagtcgttatcggtttatttttagaacgtttttagtgatattcgtttttttgtttcgtttagtttagcgtttttatatttttcgttatgagacgttttttttttttcgcgtttttattttatagtagagattagacggtgatgtgggtgattttttcgttgggtatttcgtttgttttttgagggcggagtagtttcgtatcgtttatgttagtttagggtcgttgcgtcgtgggggttcggatgatttgttgagtttgattttagagttatcgggaggatagagaggaattgggtaaaatttgtttttagagg

SEQ ID NO: 430 - DNA, 725 bp, Artificial Sequence
  chemically treated genomic DNA (Homo sapiens) CpG-island No: 430
cctctaaaaacaaattttacccaattcctctctatcctcccgataactctaaaatcaaactcaacaaatcatccgaacccccacgacgcaacgaccctaaactaacataaacgatacgaaactactccgccctcaaaaaacaaacgaaatacccaacgaaaaaatcacccacatcaccgtctaatctctactataaaataaaaacgcgaaaaaaaaaaaacgtctcataacgaaaaatataaaaacgctaaactaaacgaaacaaaaaaacgaatatcactaaaaacgttctaaaaataaaccgataacgactatcgcgaaaaaaaccctaacgaaataaaaccccgcgcgaaacaaaaaaaataaaataccacaaaaaactaattacaaaaaaacgcgtaacgactacaactctacgaaaaccgaacctcgacgaccaaaaaataacaaatcgacgaaaacgaaaaccaaacccgaaaacaaaacgaaacaaaaaaacaaacaaaacgaaaaccaccgtaaataaaaaccgcgaaacgaaaactaaaacgcgaaaaaatactaaatcgacctcgactcccgcgccgcaccccaaacccgccaaaaaacgccgctaccccgcgaaaccgttccgacctctcccgaccaccgaaatcccgcgctccgacctaaaaaaaccccgaaaaaaacgatacaacgcaccccgaaaccgcttccgacttcga

SEQ ID NO: 431 - DNA, 725 bp, Artificial Sequence
  chemically treated genomic DNA (Homo sapiens) CpG-island No: 431
tttttgagagtaaattttatttagtttttttttattttttcgatgattttgaaattaaatttagtaagttattcgagtttttacggcgtagcggttttaggttggtatgggcgatgcggagttatttcgtttttaggaagtaggcgaggtgtttagcgggagaattatttatattatcgtttaatttttgttgtgaagtggaagcgcgagaaggagggagcgttttatgacggagggtgtgaagacgttaggttggacgaagtagaaaggcgggtgttattggggacgttttgagggtaagtcgatggcggttatcgcggaggagattttggcgaggtggggtttcgcgcggggtaagggggatggggtgttatagagggttagttgtaagaggacgcgtgacggttgtagttttgcggagatcgggtttcgacggttaaggagtggtaggtcggcggaggcgggggttaggttcggaggtagagcgagataggagagtaggtaaggcgggggttatcgtgagtgggggtcgcgaggcgggggttggggcgcggggaggtgttaggtcggtttcggttttcgcgtcgtattttaggttcgttaggaggcgtcgttgtttcgcgaagtcgtttcggtttttttcggttatcgaaatttcgcgtttcggtttagagaggtttcggaagaggcggtgtagcgtatttcgaggtcgttttcggtttcgg

SEQ ID NO: 432 - DNA, 725 bp, Artificial Sequence
  chemically treated genomic DNA (Homo sapiens) CpG-island No: 432
ccgaaaccgaaaacgacctcgaaatacgctacaccgcctcttccgaaacctctctaaaccgaaacgcgaaatttcgataaccgaaaaaaaccgaaacgacttcgcgaaacaacgacgcctcctaacgaacctaaaatacgacgcgaaaaccgaaaccgacctaacacctccccgcgccccaacccccgcctcgcgacccccactcacgataacccccgccttacctactctcctatctcgctctacctccgaacctaacccccgcctccgccgacctaccactccttaaccgtcgaaacccgatctccgcaaaactacaaccgtcacgcgtcctcttacaactaaccctctataacaccccatcccccttaccccgcgcgaaaccccacctcgccaaaatctcctccgcgataaccgccatcgacttaccctcaaaacgtccccaataacacccgcctttctacttcgtccaacctaacgtcttcacaccctccgtcataaaacgctccctccttctcgcgcttccacttcacaacaaaaattaaacgataatataaataattctcccgctaaacacctcgcctacttcctaaaaacgaaataactccgcatcgcccataccaacctaaaaccgctacgccgtaaaaactcgaataacttactaaatttaatttcaaaatcatcgaaaaaataaaaaaaaactaaataaaatttactctcaaaaa

SEQ ID NO: 433 - DNA, 580 bp, Artificial Sequence
  chemically treated genomic DNA (Homo sapiens) CpG-island No: 433
tagaggcgggaggaaacgcgattttcgcggggttaggcgcggcgcggacggtaggaagggcgggggtcgatttttttttgggtggtgttagtttttattttagcggttttcggaattcgcggattaggggacggatagtacgcgaggtagatagatacgtgttggggcgggtaggcgagcgttttagtttggtcgtttggcggtgttttcggttttaacgcgttcgggtcgtcgcgggtcgcgcgcgtcgatgttcggttgagttattggtagggtagcgcgcgtgtgggaaggggcggagggagtgcggtcggcgggcgggcggggcgttgggtttagttcggtcgtaggtgattcggaggttttcgtcgttcgcggcgtttcgagcgttttgtgagtagatgcggagtcgagtggagggcgcgagttagatgcggggcgatagttgatttgttgagaggaggcggggaggcgcggagcgcgcgtgtggtttttgcgtcgttgatttttttattggtttttgggtatcgaaaggtaaaattgtagttttttttagatttagtatttaatttttcgtttt

SEQ ID NO: 434 - DNA, 580 bp, Artificial Sequence
  chemically treated genomic DNA (Homo sapiens) CpG-island No: 434
aaaacgaaaaattaaatactaaatctaaaaaaaactacaattttacctttcgatacccaaaaaccaataaaaaaatcaacgacgcaaaaaccacacgcgcgctccgcgcctccccgcctcctctcaacaaatcaactatcgccccgcatctaactcgcgccctccactcgactccgcatctactcacaaaacgctcgaaacgccgcgaacgacgaaaacctccgaatcacctacgaccgaactaaacccaacgccccgcccgcccgccgaccgcactccctccgccccttcccacacgcgcgctaccctaccaataactcaaccgaacatcgacgcgcgcgacccgcgacgacccgaacgcgttaaaaccgaaaacaccgccaaacgaccaaactaaaacgctcgcctacccgccccaacacgtatctatctacctcgcgtactatccgtcccctaatccgcgaattccgaaaaccgctaaaataaaaactaacaccacccaaaaaaaaatcgacccccgcccttcctaccgtccgcgccgcgcctaaccccgcgaaaatcgcgtttcctcccgcctcta

SEQ ID NO: 435 - DNA, 580 bp, Artificial Sequence
  chemically treated genomic DNA (Homo sapiens) CpG-island No: 435
gaggcgagggattgggtattggatttgaaaggggttgtaattttatttttcggtgtttaggaattagtggagaagttagcggcgtaaggattatacgcgcgtttcgcgttttttcgtttttttttagtaagttagttgtcgtttcgtatttggttcgcgttttttattcggtttcgtatttgtttataaagcgttcggggcgtcgcgggcggcgagggttttcgggttatttgcggtcgggttgagtttagcgtttcgttcgttcgtcggtcgtatttttttcgtttttttttatacgcgcgttgttttgttagtgatttagtcgggtatcggcgcgcgcggttcgcggcggttcgggcgcgttggggtcggaggtatcgttaggcgattagattgaggcgttcgtttgttcgttttagtacgtgtttgtttgtttcgcgtgttgttcgttttttagttcgcgggtttcgaggatcgttgaggtggggattggtattatttagagggaaatcggttttcgttttttttgtcgttcgcgtcgcgtttggtttcgcgggggtcgcgttttttttcgtttttg

SEQ ID NO: 436 - DNA, 580 bp, Artificial Sequence
  chemically treated genomic DNA (Homo sapiens) CpG-island No: 436
caaaaacgaaaaaaaacgcgacccccgcgaaaccaaacgcgacgcgaacgacaaaaaaaacgaaaaccgatttccctctaaataataccaatccccacctcaacgatcctcgaaacccgcgaactaaaaaacgaacaacacgcgaaacaaacaaacacgtactaaaacgaacaaacgaacgcctcaatctaatcgcctaacgatacctccgaccccaacgcgcccgaaccgccgcgaaccgcgcgcgccgatacccgactaaatcactaacaaaacaacgcgcgtataaaaaaaaacgaaaaaaatacgaccgacgaacgaacgaaacgctaaactcaacccgaccgcaaataacccgaaaaccctcgccgcccgcgacgccccgaacgctttataaacaaatacgaaaccgaataaaaaacgcgaaccaaatacgaaacgacaactaacttactaaaaaaaaacgaaaaaacgcgaaacgcgcgtataatccttacgccgctaacttctccactaattcctaaacaccgaaaaataaaattacaacccctttcaaatccaatacccaatccctcgcctc

SEQ ID NO: 437 - DNA, 652 bp, Artificial Sequence
  chemically treated genomic DNA (Homo sapiens) CpG-island No: 437
aaagagtcgaatatataagagttttttagttttttttcgtttttttgcggaaagaatcgaaggtagagtacggcgtcgaagtggagtcgttttaagttcgggttttttcggattatttcggtttgcgttcggaagaggagggcgtttttggttttagcgtttcgttttcgcgttgtgttttttgtcggcggcgtggggtagttgtagtagcgttggcggtaggaggcggcggtcgcgtcgacgtcgatttagattggagcgacgtttaaagaaggggtagaatcgttggggagtgcggtttttttttgttgggggatttttagtttttcgcgcgttcggaggaggagaagcggcggcgtcgggaagtaggtgaggattcggttttaattagggagggggcgaaggagcgcgtttgtttttttcgtttttgggtcgcgtttgcgtttgtattcgttttatttgaattaggaagcggtagagtcggaggtttagttttttcggttttttttttgtgtgggtcggggagcgaaggaggggacgagtcgcgagggtcgcggcgcggtttttttcgtcgttaggggtcgaggggttgtcggtgttttgggtaggtttcggggtttggggaatttattatagagatttatttggtttt

SEQ ID NO: 438 - DNA, 652 bp, Artificial Sequence
  chemically treated genomic DNA (Homo sapiens) CpG-island No: 438
aaaaccaaataaatctctataataaattccccaaaccccgaaacctacccaaaacaccgacaacccctcgacccctaacgacgaaaaaaaccgcgccgcgaccctcgcgactcgtcccctccttcgctccccgacccacacaaaaaaaaaaccgaaaaaactaaacctccgactctaccgcttcctaattcaaataaaacgaatacaaacgcaaacgcgacccaaaaacgaaaaaaacaaacgcgctccttcgccccctccctaattaaaaccgaatcctcacctacttcccgacgccgccgcttctcctcctccgaacgcgcgaaaaactaaaaatcccccaacaaaaaaaaaccgcactccccaacgattctaccccttctttaaacgtcgctccaatctaaatcgacgtcgacgcgaccgccgcctcctaccgccaacgctactacaactaccccacgccgccgacaaaaaacacaacgcgaaaacgaaacgctaaaaccaaaaacgccctcctcttccgaacgcaaaccgaaataatccgaaaaaacccgaacttaaaacgactccacttcgacgccgtactctaccttcgattctttccgcaaaaaaacgaaaaaaaactaaaaaactcttatatattcgactcttt

SEQ ID NO: 439 - DNA, 652 bp, Artificial Sequence
  chemically treated genomic DNA (Homo sapiens) CpG-island No: 439
aaagttaagtgggtttttgtgatggattttttaagtttcggggtttatttagggtatcggtagtttttcggtttttaacggcgaaggggatcgcgtcgcggttttcgcggttcgttttttttttcgtttttcggtttatataaagaaagagtcggaggagttgagttttcgattttgtcgttttttggtttaagtgaggcgaatgtaaacgtaggcgcggtttagggacggagaaggtaagcgcgttttttcgttttttttttgattggggtcgggtttttatttgtttttcggcgtcgtcgttttttttttttcggacgcgcggaaggttgggagttttttaataagaagaagtcgtattttttagcgattttgttttttttttaaacgtcgttttagtttgggtcgacgtcgacgcggtcgtcgttttttgtcgttaacgttgttatagttgttttacgtcgtcgatagagggtatagcgcgggggcgaagcgttgaagttaaaggcgtttttttttttcgagcgtaggtcggggtggttcggaagggttcgagtttgaggcggttttatttcggcgtcgtgttttgttttcggtttttttcgtaagggggcggaggaagattgggaagtttttgtgtgttcggtttttt

SEQ ID NO: 440 - DNA, 652 bp, Artificial Sequence
  chemically treated genomic DNA (Homo sapiens) CpG-island No: 440
aaaaaaccgaacacacaaaaacttcccaatcttcctccgcccccttacgaaaaaaaccgaaaacaaaacacgacgccgaaataaaaccgcctcaaactcgaacccttccgaaccaccccgacctacgctcgaaaaaaaaaaacgcctttaacttcaacgcttcgcccccgcgctataccctctatcgacgacgtaaaacaactataacaacgttaacgacaaaaaacgacgaccgcgtcgacgtcgacccaaactaaaacgacgtttaaaaaaaaaacaaaatcgctaaaaaatacgacttcttcttattaaaaaactcccaaccttccgcgcgtccgaaaaaaaaaaaacgacgacgccgaaaaacaaataaaaacccgaccccaatcaaaaaaaaaacgaaaaaacgcgcttaccttctccgtccctaaaccgcgcctacgtttacattcgcctcacttaaaccaaaaaacgacaaaatcgaaaactcaactcctccgactctttctttatataaaccgaaaaacgaaaaaaaaaacgaaccgcgaaaaccgcgacgcgatccccttcgccgttaaaaaccgaaaaactaccgataccctaaataaaccccgaaacttaaaaaatccatcacaaaaacccacttaacttt

SEQ ID NO: 441 - DNA, 869 bp, Artificial Sequence
  chemically treated genomic DNA (Homo sapiens) CpG-island No: 441
agggtgcgagcgggaggttggtgttttgttcgcgatgggtaggggagtcgggtggtcgcggggcgaggagtcgcgagggtcgggtcggcgtgatattatttggcggagtttcggggaagagttttaaaggcgcgcgttttttcgtgtttcgcgtattcgaacgggagtcgcggagagttcgtttttcgttgtcgtcggcgtttcggggaggtaagtgttattcgcggatttcgagtcgcggtcgggtgggggcggttcgcggttgtttcgcgttcgggaagttttggttggggttgcggtcggagggcggcgtttaagtttttttgaaggtttcggagggtagttggagcggcgtagagtttgcgcggggatggcgggggtggtcgcgggtcggggtcgtttgggggcggttatttcgggcggtgcgtggaaaagtaggtattggtgcgcggcgaggggcgtacgttagagttttagtttcgcgttttgcgtatttggcgcgttttggtcgcggtttcggcgagttttagtttgtttcgggtcgcgatttcggtttcgcgtttttttgttcgttcgggttttttgtagttcgttggtttcgcggtcgcgtacggttacgtcggtaggtcgcgttcggcggtcggttaagttagtttcggttttgtcgcgttcgcgtttcgggttatttcgttcggttttttcggcgttgtatttttcgttttttttatttttagtcgttcgttatttttatatttttcggtgtttcggtttcggcgtttgatttagtgtttagtaattaatttggcgttttagaatggttagcgggttggataatgggtgtatttatttttcgggttaatttgaataga

SEQ ID NO: 442 - DNA, 869 bp, Artificial Sequence
  chemically treated genomic DNA (Homo sapiens) CpG-island No: 442
tctattcaaattaacccgaaaaataaatacacccattatccaacccgctaaccattctaaaacgccaaattaattactaaacactaaatcaaacgccgaaaccgaaacaccgaaaaatataaaaataacgaacgactaaaaataaaaaaaacgaaaaatacaacgccgaaaaaaccgaacgaaataacccgaaacgcgaacgcgacaaaaccgaaactaacttaaccgaccgccgaacgcgacctaccgacgtaaccgtacgcgaccgcgaaaccaacgaactacaaaaaacccgaacgaacaaaaaaacgcgaaaccgaaatcgcgacccgaaacaaactaaaactcgccgaaaccgcgaccaaaacgcgccaaatacgcaaaacgcgaaactaaaactctaacgtacgcccctcgccgcgcaccaatacctacttttccacgcaccgcccgaaataaccgcccccaaacgaccccgacccgcgaccacccccgccatccccgcgcaaactctacgccgctccaactaccctccgaaaccttcaaaaaaacttaaacgccgccctccgaccgcaaccccaaccaaaacttcccgaacgcgaaacaaccgcgaaccgcccccacccgaccgcgactcgaaatccgcgaataacacttacctccccgaaacgccgacgacaacgaaaaacgaactctccgcgactcccgttcgaatacgcgaaacacgaaaaaacgcgcgcctttaaaactcttccccgaaactccgccaaataatatcacgccgacccgaccctcgcgactcctcgccccgcgaccacccgactcccctacccatcgcgaacaaaacaccaacctcccgctcgcaccct

SEQ ID NO: 443 - DNA, 869 bp, Artificial Sequence
  chemically treated genomic DNA (Homo sapiens) CpG-island No: 443
tttgtttagattagttcgggggatgaatgtatttattatttagttcgttgattattttgaaacgttaaattaattattaagtattgaattaggcgtcggggtcggggtatcgggaggtgtgaaaatagcgagcggttggagatggggaaagcgaggggtgtagcgtcgagggggtcgggcggggtggttcggggcgcgggcgcggtagggtcggggttggtttggtcggtcgtcgagcgcgatttgtcggcgtgatcgtgcgcgatcgcggggttagcgggttataaaggattcgggcgggtaggaaggcgcggagtcggggtcgcggttcggagtaggttggggttcgtcgggatcgcggttagagcgcgttaagtgcgtaggacgcggggttggggttttggcgtgcgtttttcgtcgcgtattagtgtttatttttttacgtatcgttcgggatggtcgtttttagacggtttcggttcgcggttattttcgttattttcgcgtaggttttacgtcgttttagttgtttttcgaggtttttaagaaaatttgggcgtcgtttttcgatcgtagttttagttagagtttttcgagcgcggggtagtcgcgggtcgtttttattcggtcgcgattcgggattcgcgggtggtatttattttttcgaggcgtcggcggtagcgggaggcgagtttttcgcggttttcgttcgagtgcgcggggtacggaggagcgcgcgtttttaagattttttttcgagatttcgttaggtggtgttacgtcggttcggttttcgcggtttttcgtttcgcggttattcggtttttttgtttatcgcgggtagaatattagtttttcgttcgtatttt

SEQ ID NO: 444 - DNA, 869 bp, Artificial Sequence
  chemically treated genomic DNA (Homo sapiens) CpG-island No: 444
aaaatacgaacgaaaaactaatattctacccgcgataaacaaaaaaaccgaataaccgcgaaacgaaaaaccgcgaaaaccgaaccgacgtaacaccacctaacgaaatctcgaaaaaaaatcttaaaaacgcgcgctcctccgtaccccgcgcactcgaacgaaaaccgcgaaaaactcgcctcccgctaccgccgacgcctcgaaaaaataaataccacccgcgaatcccgaatcgcgaccgaataaaaacgacccgcgactaccccgcgctcgaaaaactctaactaaaactacgatcgaaaaacgacgcccaaattttcttaaaaacctcgaaaaacaactaaaacgacgtaaaacctacgcgaaaataacgaaaataaccgcgaaccgaaaccgtctaaaaacgaccatcccgaacgatacgtaaaaaaataaacactaatacgcgacgaaaaacgcacgccaaaaccccaaccccgcgtcctacgcacttaacgcgctctaaccgcgatcccgacgaaccccaacctactccgaaccgcgaccccgactccgcgccttcctacccgcccgaatcctttataacccgctaaccccgcgatcgcgcacgatcacgccgacaaatcgcgctcgacgaccgaccaaaccaaccccgaccctaccgcgcccgcgccccgaaccaccccgcccgaccccctcgacgctacacccctcgctttccccatctccaaccgctcgctattttcacacctcccgataccccgaccccgacgcctaattcaatacttaataattaatttaacgtttcaaaataatcaacgaactaaataataaatacattcatcccccgaactaatctaaacaaa

SEQ ID NO: 445 - DNA, 704 bp, Artificial Sequence
  chemically treated genomic DNA (Homo sapiens) CpG-island No: 445
ggcgagaaggaggttcggcgcggggcggggcggggacgtttacgtttagttttggtcgtaggcggtcgtattgtttcgatatttagaagtcgcgtcggttttttagcgcgatgaagggttggtcgggaaagcgcgcgcggaattttttgaggaattcgttttcgaagttagttagtacgtcgtttatgtttattagtattcgtagggcgcggtttttcgttaggtttagttcgttcgtcgtttcgcgtcgtttcgcgggaatcgtcgcgttgtagagtcgtcgcgtatattagtcgtttagtcggattatggtttagcgcgttggttcgtcgtgggcgcggggatttgggtcgcgtcgtgttgtcggagtcggttagatattttcgtcgcggaggagaagtttttaacgttggggcgcgcgtggagcgcgggacggggagcggggcggggagcgcggggtgcgggcgcgtaagtatcggttttagagcgaggtcgcggcgcgcgcggtttttaaaggaatacgcgtcggcggaggcggagtttcggggcggggtttcgaggacggatagcggtaagcgtcgcgcgtttttagaaggttcgcgttttcgcgttgtcgatttgcgtttttttcgtggattttgggttcgggttgtttttttttattgtatagattattatggaggagtagtgtaaatcgagaagta

SEQ ID NO: 446 - DNA, 704 bp, Artificial Sequence
  chemically treated genomic DNA (Homo sapiens) CpG-island No: 446
tacttctcgatttacactactcctccataataatctatacaataaaaaaaaacaacccgaacccaaaatccacgaaaaaaacgcaaatcgacaacgcgaaaacgcgaaccttctaaaaacgcgcgacgcttaccgctatccgtcctcgaaaccccgccccgaaactccgcctccgccgacgcgtattcctttaaaaaccgcgcgcgccgcgacctcgctctaaaaccgatacttacgcgcccgcaccccgcgctccccgccccgctccccgtcccgcgctccacgcgcgccccaacgttaaaaacttctcctccgcgacgaaaatatctaaccgactccgacaacacgacgcgacccaaatccccgcgcccacgacgaaccaacgcgctaaaccataatccgactaaacgactaatatacgcgacgactctacaacgcgacgattcccgcgaaacgacgcgaaacgacgaacgaactaaacctaacgaaaaaccgcgccctacgaatactaataaacataaacgacgtactaactaacttcgaaaacgaattcctcaaaaaattccgcgcgcgctttcccgaccaacccttcatcgcgctaaaaaaccgacgcgacttctaaatatcgaaacaatacgaccgcctacgaccaaaactaaacgtaaacgtccccgccccgccccgcgccgaacctccttctcgcc

SEQ ID NO: 447 - DNA, 704 bp, Artificial Sequence
  chemically treated genomic DNA (Homo sapiens) CpG-island No: 447
tgtttttcggtttgtattgtttttttatggtagtttgtgtagtgggagaaggtagttcgggtttagggtttacggagaagacgtaaatcgatagcgcgggagcgcggattttttggaggcgcgcggcgtttatcgttgttcgttttcgaagtttcgtttcggggtttcgttttcgtcggcgcgtgtttttttagggatcgcgcgcgtcgcggtttcgttttggggtcggtatttgcgcgttcgtatttcgcgtttttcgtttcgtttttcgtttcgcgttttacgcgcgttttagcgttgggggtttttttttcgcggcgggaatgtttggtcggtttcggtagtacggcgcggtttaggttttcgcgtttacgacgggttagcgcgttgggttatgattcggttgggcggttggtgtgcgcggcggttttgtagcgcggcggttttcgcggggcggcgcggggcggcgggcgggttgggtttggcgggaggtcgcgttttacgggtgttggtggatatggacggcgtgttggttgatttcgagggcggattttttaggaagtttcgcgcgcgttttttcgattagttttttatcgcgttggaggatcggcgcggtttttgggtgtcggagtagtacggtcgtttgcggttagggttgagcgtgagcgttttcgtttcgtttcgcgtcgggtttttttttcgtt

SEQ ID NO: 448 - DNA, 704 bp, Artificial Sequence
  chemically treated genomic DNA (Homo sapiens) CpG-island No: 448
aacgaaaaaaaaacccgacgcgaaacgaaacgaaaacgctcacgctcaaccctaaccgcaaacgaccgtactactccgacacccaaaaaccgcgccgatcctccaacgcgataaaaaactaatcgaaaaaacgcgcgcgaaacttcctaaaaaatccgccctcgaaatcaaccaacacgccgtccatatccaccaacacccgtaaaacgcgacctcccgccaaacccaacccgcccgccgccccgcgccgccccgcgaaaaccgccgcgctacaaaaccgccgcgcacaccaaccgcccaaccgaatcataacccaacgcgctaacccgtcgtaaacgcgaaaacctaaaccgcgccgtactaccgaaaccgaccaaacattcccgccgcgaaaaaaaaacccccaacgctaaaacgcgcgtaaaacgcgaaacgaaaaacgaaacgaaaaacgcgaaatacgaacgcgcaaataccgaccccaaaacgaaaccgcgacgcgcgcgatccctaaaaaaacacgcgccgacgaaaacgaaaccccgaaacgaaacttcgaaaacgaacaacgataaacgccgcgcgcctccaaaaaatccgcgctcccgcgctatcgatttacgtcttctccgtaaaccctaaacccgaactaccttctcccactacacaaactaccataaaaaaacaatacaaaccgaaaaaca

SEQ ID NO: 449 - DNA, 844 bp, Artificial Sequence
  chemically treated genomic DNA (Homo sapiens) CpG-island No: 449
  misc_feature (190)..(190): n is either a, c, g or t
  misc_feature (307)..(307): n is either a, c, g or t
  misc_feature (330)..(330): n is either a, c, g or t
  misc_feature (333)..(333): n is either a, c, g or t
  misc_feature (351)..(351): n is either a, c, g or t
  misc_feature (357)..(357): n is either a, c, g or t
  misc_feature (363)..(363): n is either a, c, g or t
  misc_feature (384)..(384): n is either a, c, g or t
  misc_feature (392)..(392): n is either a, c, g or t
  misc_feature (405)..(405): n is either a, c, g or t
  misc_feature (407)..(407): n is either a, c, g or t
  misc_feature (410)..(410): n is either a, c, g or t
  misc_feature (428)..(428): n is either a, c, g or t
  misc_feature (458)..(458): n is either a, c, g or t
  misc_feature (460)..(460): n is either a, c, g or t
  misc_feature (492)..(492): n is either a, c, g or t
  misc_feature (495)..(495): n is either a, c, g or t
  misc_feature (525)..(525): n is either a, c, g or t
  misc_feature (535)..(535): n is either a, c, g or t
  misc_feature (581)..(581): n is either a, c, g or t
  misc_feature (601)..(601): n is either a, c, g or t
  misc_feature (652)..(652): n is either a, c, g or t
  misc_feature (677)..(677): n is either a, c, g or t
  misc_feature (688)..(688): n is either a, c, g or t
  misc_feature (691)..(691): n is either a, c, g or t
  misc_feature (720)..(720): n is either a, c, g or t
  misc_feature (769)..(769): n is either a, c, g or t
  misc_feature (778)..(778): n is either a, c, g or t
  misc_feature (788)..(788): n is either a, c, g or t
ttcgtttatttgtgttcgtttacgttttttttttcgatcgtttatatgtgtttgtttcgtttttattttgttcgattattaatttgtattcggtttttttttagtttatcggtgtacgattcgttaatcggtgtttttttcgtttatcggtgttcgtttcgtttatcggtgttcgtttcgtttatttgtnttcgtttcgttttttgttttcgtttcgtttttttgttttcgtttcgtttcgtttgtttatttgtgttcgttttcgtttcgttagtttatttgttttcgtttcgttcgtttatttgtngtgcgtattgtatttcgtggttngtntgtcgggtagggtagttncgtagncggttntcgcggaagtcgggcgggtanggtgtatntttcggaggcggntntgntagcggtttcgtatatanttcgtattgttgttggtattcgggattttnanttagttcggtcggtaggcgtagcggtcggagnttntgttcgtacggggagtcgtggtagttgtangcggaagaangtaggggcgtttttattagttcggtttgtatacgtaggcgttcgtnggtttgttcgtagcgcgttngtcgcggtgttgtattggtacgggcggcggtacgtggacgattattagttngggttcgtagtggtatacgtcggtncgcggggtcgntangcgttcgtgggggtcgtaggcgtacgggnaattcgtagcgggttttttagcggtcggtttggtattggtacgcgtttngtggttggnttcgtattgngtcgtgcgggtggtaggggtagtttttacggtagtcggggttttagtattggttcg

SEQ ID NO: 450 - DNA, 844 bp, Artificial Sequence
  chemically treated genomic DNA (Homo sapiens) CpG-island No: 450
  misc_feature (57)..(57): n is either a, c, g or t
  misc_feature (67)..(67): n is either a, c, g or t
  misc_feature (76)..(76): n is either a, c, g or t
  misc_feature (125)..(125): n is either a, c, g or t
  misc_feature (154)..(154): n is either a, c, g or t
  misc_feature (157)..(157): n is either a, c, g or t
  misc_feature (168)..(168): n is either a, c, g or t
  misc_feature (193)..(193): n is either a, c, g or t
  misc_feature (244)..(244): n is either a, c, g or t
  misc_feature (264)..(264): n is either a, c, g or t
  misc_feature (310)..(310): n is either a, c, g or t
  misc_feature (320)..(320): n is either a, c, g or t
  misc_feature (350)..(350): n is either a, c, g or t
  misc_feature (353)..(353): n is either a, c, g or t
  misc_feature (385)..(385): n is either a, c, g or t
  misc_feature (387)..(387): n is either a, c, g or t
  misc_feature (417)..(417): n is either a, c, g or t
  misc_feature (435)..(435): n is either a, c, g or t
  misc_feature (438)..(438): n is either a, c, g or t
  misc_feature (440)..(440): n is either a, c, g or t
  misc_feature (453)..(453): n is either a, c, g or t
  misc_feature (461)..(461): n is either a, c, g or t
  misc_feature (482)..(482): n is either a, c, g or t
  misc_feature (488)..(488): n is either a, c, g or t
  misc_feature (494)..(494): n is either a, c, g or t
  misc_feature (512)..(512): n is either a, c, g or t
  misc_feature (515)..(515): n is either a, c, g or t
  misc_feature (538)..(538): n is either a, c, g or t
  misc_feature (655)..(655): n is either a, c, g or t
cgaaccaatactaaaaccccgactaccgtaaaaactacccctaccacccgcacgacncaatacgaanccaaccacnaaacgcgtaccaataccaaaccgaccgctaaaaaacccgctacgaattncccgtacgcctacgacccccacgaacgcntancgaccccgcgnaccgacgtataccactacgaacccnaactaataatcgtccacgtaccgccgcccgtaccaatacaacaccgcgacnaacgcgctacgaacaaaccnacgaacgcctacgtatacaaaccgaactaataaaaacgcccctacnttcttccgcntacaactaccacgactccccgtacgaacanaanctccgaccgctacgcctaccgaccgaactaantnaaaatcccgaataccaacaacaatacgaantatatacgaaaccgctancananccgcctccgaaanatacaccntacccgcccgacttccgcganaaccgnctacgnaactaccctacccgacanacnaaccacgaaatacaatacgcacnacaaataaacgaacgaaacgaaaacaaataaactaacgaaacgaaaacgaacacaaataaacaaacgaaacgaaacgaaaacaaaaaaacgaaacgaaaacaaaaaacgaaacgaanacaaataaacgaaacgaacaccgataaacgaaacgaacaccgataaacgaaaaaaacaccgattaacgaatcgtacaccgataaactaaaaaaaaaccgaatacaaattaataatcgaacaaaataaaaacgaaacaaacacatataaacgatcgaaaaaaaaaacgtaaacgaacacaaataaacgaa

SEQ ID NO: 451 - DNA, 844 bp, Artificial Sequence
  chemically treated genomic DNA (Homo sapiens) CpG-island No: 451
  misc_feature (57)..(57): n is either a, c, g or t
  misc_feature (67)..(67): n is either a, c, g or t
  misc_feature (76)..(76): n is either a, c, g or t
  misc_feature (125)..(125): n is either a, c, g or t
  misc_feature (154)..(154): n is either a, c, g or t
  misc_feature (157)..(157): n is either a, c, g or t
  misc_feature (168)..(168): n is either a, c, g or t
  misc_feature (193)..(193): n is either a, c, g or t
  misc_feature (244)..(244): n is either a, c, g or t
  misc_feature (264)..(264): n is either a, c, g or t
  misc_feature (310)..(310): n is either a, c, g or t
  misc_feature (320)..(320): n is either a, c, g or t
  misc_feature (350)..(350): n is either a, c, g or t
  misc_feature (353)..(353): n is either a, c, g or t
  misc_feature (385)..(385): n is either a, c, g or t
  misc_feature (387)..(387): n is either a, c, g or t
  misc_feature (417)..(417): n is either a, c, g or t
  misc_feature (435)..(435): n is either a, c, g or t
  misc_feature (438)..(438): n is either a, c, g or t
  misc_feature (440)..(440): n is either a, c, g or t
  misc_feature (453)..(453): n is either a, c, g or t
  misc_feature (461)..(461): n is either a, c, g or t
  misc_feature (482)..(482): n is either a, c, g or t
  misc_feature (488)..(488): n is either a, c, g or t
  misc_feature (494)..(494): n is either a, c, g or t
  misc_feature (512)..(512): n is either a, c, g or t
  misc_feature (515)..(515): n is either a, c, g or t
  misc_feature (538)..(538): n is either a, c, g or t
  misc_feature (655)..(655): n is either a, c, g or t
cgggttagtattggggtttcgattgtcgtgagagttgtttttgttattcgtacggtntagtgcgagnttagttatngggcgcgtgttagtgttaggtcgatcgttggggagttcgttgcgagttnttcgtgcgtttgcggtttttacgggcgtntgncgatttcgcgnatcggcgtgtgttattgcgaatttnggttggtggtcgtttacgtgtcgtcgttcgtgttagtgtaatatcgcggtnggcgcgttgcgagtaggttnacgggcgtttgcgtgtgtaagtcgggttggtgggggcgtttttgtnttttttcgtntgtaattgttacggtttttcgtgcgagtangantttcggtcgttgcgtttgtcggtcgggttggntnggggtttcgaatgttagtagtagtgcgagntgtgtgcggggtcgttgntangntcgttttcggagngtgtattntgttcgttcggttttcgcggnagtcgnttgcgnagttgttttgttcggtangtnagttacggggtgtagtgcgtatnataggtgagcgggcggggcggggataggtgggttggcggggcgggggcggatataagtgagtaggcggggcggggcggagataggggggcggggcggagatagggggcggggcgaanataggtgggcggggcggatatcggtgggcggggcggatatcggtgggcggggagggtatcggttggcgggtcgtatatcggtgggttgggagggggtcgggtgtaaattagtgatcgggtaaggtgggggcggggtaggtatatgtgagcggtcgggggaagaggcgtaagcggatataggtgagcgaa

SEQ ID NO: 452 - DNA, 844 bp, Artificial Sequence
  chemically treated genomic DNA (Homo sapiens) CpG-island No: 452
  misc_feature (190)..(190): n is either a, c, g or t
  misc_feature (307)..(307): n is either a, c, g or t
  misc_feature (330)..(330): n is either a, c, g or t
  misc_feature (333)..(333): n is either a, c, g or t
  misc_feature (351)..(351): n is either a, c, g or t
  misc_feature (357)..(357): n is either a, c, g or t
  misc_feature (363)..(363): n is either a, c, g or t
  misc_feature (384)..(384): n is either a, c, g or t
  misc_feature (392)..(392): n is either a, c, g or t
  misc_feature (405)..(405): n is either a, c, g or t
  misc_feature (407)..(407): n is either a, c, g or t
  misc_feature (410)..(410): n is either a, c, g or t
  misc_feature (428)..(428): n is either a, c, g or t
  misc_feature (458)..(458): n is either a, c, g or t
  misc_feature (460)..(460): n is either a, c, g or t
  misc_feature (492)..(492): n is either a, c, g or t
  misc_feature (495)..(495): n is either a, c, g or t
  misc_feature (525)..(525): n is either a, c, g or t
  misc_feature (535)..(535): n is either a, c, g or t
  misc_feature (581)..(581): n is either a, c, g or t
  misc_feature (601)..(601): n is either a, c, g or t
  misc_feature (652)..(652): n is either a, c, g or t
  misc_feature (677)..(677): n is either a, c, g or t
  misc_feature (688)..(688): n is either a, c, g or t
  misc_feature (691)..(691): n is either a, c, g or t
  misc_feature (720)..(720): n is either a, c, g or t
  misc_feature (769)..(769): n is either a, c, g or t
  misc_feature (778)..(778): n is either a, c, g or t
  misc_feature (788)..(788): n is either a, c, g or t
ttcgctcacctatatccgcttacgcctcttcccccgaccgctcacatatacctaccccgcccccaccttacccgatcactaatttacacccgaccccctcccaacccaccgatatacgacccgccaaccgataccctccccgcccaccgatatccgccccgcccaccgatatccgccccgcccacctatnttcgccccgccccctatctccgccccgcccccctatctccgccccgccccgcctactcacttatatccgcccccgccccgccaacccacctatccccgccccgcccgctcacctatnatacgcactacaccccgtaactnacntaccgaacaaaacaactncgcaancgactnccgcgaaaaccgaacgaacanaatacacnctccgaaaacgancntancaacgaccccgcacacanctcgcactactactaacattcgaaaccccnanccaacccgaccgacaaacgcaacgaccgaaantcntactcgcacgaaaaaccgtaacaattacanacgaaaaaanacaaaaacgcccccaccaacccgacttacacacgcaaacgcccgtnaacctactcgcaacgcgccnaccgcgatattacactaacacgaacgacgacacgtaaacgaccaccaaccnaaattcgcaataacacacgccgatncgcgaaatcgncanacgcccgtaaaaaccgcaaacgcacgaanaactcgcaacgaactccccaacgatcgacctaacactaacacgcgcccnataactaanctcgcactanaccgtacgaataacaaaaacaactctcacgacaatcgaaaccccaatactaacccg

SEQ ID NO: 453 - DNA, 714 bp, Artificial Sequence
  chemically treated genomic DNA (Homo sapiens) CpG-island No: 453
  misc_feature (294)..(294): n is either a, c, g or t
  misc_feature (334)..(334): n is either a, c, g or t
  misc_feature (355)..(356): n is either a, c, g or t
  misc_feature (363)..(364): n is either a, c, g or t
  misc_feature (370)..(370): n is either a, c, g or t
  misc_feature (388)..(388): n is either a, c, g or t
  misc_feature (393)..(393): n is either a, c, g or t
  misc_feature (395)..(395): n is either a, c, g or t
  misc_feature (449)..(449): n is either a, c, g or t
  misc_feature (504)..(504): n is either a, c, g or t
  misc_feature (514)..(514): n is either a, c, g or t
  misc_feature (516)..(516): n is either a, c, g or t
  misc_feature (594)..(594): n is either a, c, g or t
  misc_feature (609)..(609): n is either a, c, g or t
  misc_feature (612)..(612): n is either a, c, g or t
  misc_feature (627)..(627): n is either a, c, g or t
  misc_feature (644)..(644): n is either a, c, g or t
  misc_feature (653)..(653): n is either a, c, g or t
  misc_feature (659)..(659): n is either a, c, g or t
  misc_feature (665)..(665): n is either a, c, g or t
  misc_feature (670)..(670): n is either a, c, g or t
  misc_feature (674)..(674): n is either a, c, g or t
cgtttagcgtttgttacgttcgttttcgtttcgttttagagtttcgtttcgtttttatcgtttcggttttttggcgcgttgttgtaggtcgcggttgtgcgttcggagttcgtttcgttgtcggttcgtgatttttttttaagtgtcgaagtagcgcgcgtttttttgaggaagggtcgtttttagcggcggcggcgtcggttcgcgggagggaggggaggattcgagtaggtcgttattcgttttgttttggtcggggttgcgtttattttgtggtttcgcgcgtagtttttntgcggaggcgttcgtttttttttcgtagtcgtcgtagttntttgtttcgtcggttgcgcgnnatatttnngtagtntggggagattcgggtttntaggntnttcggttttgtcggtttcgtgggtggcgaagggagggttatgatttatcgagtntcggggcgggttttacggtagtttgttttaagagttttagcgttcgtattattangcggtattangnttcggtcgtcgttttcggttcgaaacggcgcgttagattttgtagtttagtgtttagggtttcggttagatggtatantaagtttcgcggttngantgtcgatttcgcggntttttcgagatttttangttaggtantttcgnggcgtncgttntttntgggttttatgttttttagaggtttagggttgcgattttt

SEQ ID NO: 454 - DNA, 714 bp, Artificial Sequence
  chemically treated genomic DNA (Homo sapiens) CpG-island No: 454
  misc_feature (41)..(41): n is either a, c, g or t
  misc_feature (45)..(45): n is either a, c, g or t
  misc_feature (50)..(50): n is either a, c, g or t
  misc_feature (56)..(56): n is either a, c, g or t
  misc_feature (62)..(62): n is either a, c, g or t
  misc_feature (71)..(71): n is either a, c, g or t
  misc_feature (88)..(88): n is either a, c, g or t
  misc_feature (103)..(103): n is either a, c, g or t
  misc_feature (106)..(106): n is either a, c, g or t
  misc_feature (121)..(121): n is either a, c, g or t
  misc_feature (199)..(199): n is either a, c, g or t
  misc_feature (201)..(201): n is either a, c, g or t
  misc_feature (211)..(211): n is either a, c, g or t
  misc_feature (266)..(266): n is either a, c, g or t
  misc_feature (320)..(320): n is either a, c, g or t
  misc_feature (322)..(322): n is either a, c, g or t
  misc_feature (327)..(327): n is either a, c, g or t
  misc_feature (345)..(345): n is either a, c, g or t
  misc_feature (351)..(352): n is either a, c, g or t
  misc_feature (359)..(360): n is either a, c, g or t
  misc_feature (381)..(381): n is either a, c, g or t
  misc_feature (421)..(421): n is either a, c, g or t
aaaaatcgcaaccctaaacctctaaaaaacataaaacccanaaanaacgnacgccncgaaantacctaacntaaaaatctcgaaaaanccgcgaaatcgacantcnaaccgcgaaacttantataccatctaaccgaaaccctaaacactaaactacaaaatctaacgcgccgtttcgaaccgaaaacgacgaccgaancntaataccgcntaataatacgaacgctaaaactcttaaaacaaactaccgtaaaacccgccccganactcgataaatcataaccctcccttcgccacccacgaaaccgacaaaaccgaanancctanaaacccgaatctccccanactacnnaaatatnncgcgcaaccgacgaaacaaanaactacgacgactacgaaaaaaaaacgaacgcctccgcanaaaaactacgcgcgaaaccacaaaataaacgcaaccccgaccaaaacaaaacgaataacgacctactcgaatcctcccctccctcccgcgaaccgacgccgccgccgctaaaaacgacccttcctcaaaaaaacgcgcgctacttcgacacttaaaaaaaaatcacgaaccgacaacgaaacgaactccgaacgcacaaccgcgacctacaacaacgcgccaaaaaaccgaaacgataaaaacgaaacgaaactctaaaacgaaacgaaaacgaacgtaacaaacgctaaacg

SEQ ID NO: 455 - DNA, 714 bp, Artificial Sequence
  chemically treated genomic DNA (Homo sapiens) CpG-island No: 455
  misc_feature (41)..(41): n is either a, c, g or t
  misc_feature (45)..(45): n is either a, c, g or t
  misc_feature (50)..(50): n is either a, c, g or t
  misc_feature (56)..(56): n is either a, c, g or t
  misc_feature (62)..(62): n is either a, c, g or t
  misc_feature (71)..(71): n is either a, c, g or t
  misc_feature (88)..(88): n is either a, c, g or t
  misc_feature (103)..(103): n is either a, c, g or t
  misc_feature (106)..(106): n is either a, c, g or t
  misc_feature (121)..(121): n is either a, c, g or t
  misc_feature (199)..(199): n is either a, c, g or t
  misc_feature (201)..(201): n is either a, c, g or t
  misc_feature (211)..(211): n is either a, c, g or t
  misc_feature (266)..(266): n is either a, c, g or t
  misc_feature (320)..(320): n is either a, c, g or t
  misc_feature (322)..(322): n is either a, c, g or t
  misc_feature (327)..(327): n is either a, c, g or t
  misc_feature (345)..(345): n is either a, c, g or t
  misc_feature (351)..(352): n is either a, c, g or t
  misc_feature (359)..(360): n is either a, c, g or t
  misc_feature (381)..(381): n is either a, c, g or t
  misc_feature (421)..(421): n is either a, c, g or t
gggggtcgtagttttaagtttttgggagatatggagtttangganggcgngcgttncggggntgtttggtntgggggtttcgggaggntcgcggggtcggtanttnggtcgcggagtttgntgtattatttagtcggggttttgggtattgagttgtaggatttggcgcgtcgtttcgggtcggaggcggcggtcgggntntggtgtcgtntagtggtgcgggcgttggagtttttggaataggttgtcgtggggttcgtttcggnattcggtgagttatggtttttttttcgttatttacggggtcggtagggtcgaangntttgnagattcgggtttttttangttgtnnaggtgtnncgcgtagtcggcggagtaggnagttgcggcggttgcgggaggagaacgagcgttttcgtangggagttgcgcgcggggttatagggtaagcgtagtttcggttagggtagggcgggtgacgatttgttcgggtttttttttttttttcgcgggtcggcgtcgtcgtcgttaagaacggtttttttttagaggagcgcgcgttgtttcggtatttgaagggaggttacggatcgatagcgggacgaatttcgggcgtataatcgcgatttgtagtagcgcgttaggagatcgaggcggtgagggcggggcggggttttggggcggggcgggggcggacgtggtaggcgttgggcg

SEQ ID NO: 456 - DNA, 714 bp, Artificial Sequence
  chemically treated genomic DNA (Homo sapiens) CpG-island No: 456
  misc_feature (294)..(294): n is either a, c, g or t
  misc_feature (334)..(334): n is either a, c, g or t
  misc_feature (355)..(356): n is either a, c, g or t
  misc_feature (363)..(364): n is either a, c, g or t
  misc_feature (370)..(370): n is either a, c, g or t
  misc_feature (388)..(388): n is either a, c, g or t
  misc_feature (393)..(393): n is either a, c, g or t
  misc_feature (395)..(395): n is either a, c, g or t
  misc_feature (449)..(449): n is either a, c, g or t
  misc_feature (504)..(504): n is either a, c, g or t
  misc_feature (514)..(514): n is either a, c, g or t
  misc_feature (516)..(516): n is either a, c, g or t
  misc_feature (594)..(594): n is either a, c, g or t
  misc_feature (609)..(609): n is either a, c, g or t
  misc_feature (612)..(612): n is either a, c, g or t
  misc_feature (627)..(627): n is either a, c, g or t
  misc_feature (644)..(644): n is either a, c, g or t
  misc_feature (653)..(653): n is either a, c, g or t
  misc_feature (659)..(659): n is either a, c, g or t
  misc_feature (665)..(665): n is either a, c, g or t
  misc_feature (670)..(670): n is either a, c, g or t
  misc_feature (674)..(674): n is either a, c, g or t
cgcccaacgcctaccacgtccgcccccgccccgccccaaaaccccgccccgccctcaccgcctcgatctcctaacgcgctactacaaatcgcgattatacgcccgaaattcgtcccgctatcgatccgtaacctcccttcaaataccgaaacaacgcgcgctcctctaaaaaaaaaccgttcttaacgacgacgacgccgacccgcgaaaaaaaaaaaaaaacccgaacaaatcgtcacccgccctaccctaaccgaaactacgcttaccctataaccccgcgcgcaactcccntacgaaaacgctcgttctcctcccgcaaccgccgcaactncctactccgccgactacgcgnnacacctnnacaacntaaaaaaacccgaatctncaaancnttcgaccctaccgaccccgtaaataacgaaaaaaaaaccataactcaccgaatnccgaaacgaaccccacgacaacctattccaaaaactccaacgcccgcaccactanacgacaccanancccgaccgccgcctccgacccgaaacgacgcgccaaatcctacaactcaatacccaaaaccccgactaaataatacancaaactccgcgaccnaantaccgaccccgcgancctcccgaaacccccanaccaaacanccccgnaacgcncgccntccntaaactccatatctcccaaaaacttaaaactacgaccccc

SEQ ID NO: 457 - DNA, 639 bp, Artificial Sequence
  chemically treated genomic DNA (Homo sapiens) CpG-island No: 457
  misc_feature (2)..(2): n is either a, c, g or t
  misc_feature (6)..(6): n is either a, c, g or t
  misc_feature (26)..(26): n is either a, c, g or t
  misc_feature (232)..(232): n is either a, c, g or t
  misc_feature (414)..(414): n is either a, c, g or t
  misc_feature (426)..(426): n is either a, c, g or t
tnatanttcgattttttttcggtttncggcgtcgttttatattttcgttttattttttttttgtagtttttttttcgatatgtagttcggtagcggggttagagggttaggtatcgggttattcggttttcgataaggaaatatttcggttatattcggagaatttggggagcggcgggatagaaaaatttattaattataggttcgggtttataagaagcgtagtagaaanggcgttcggggatttcggtttgtagtttcgttatatagtgtatttagtttcgttcggtttaaatttttcggttattcggttcgattcgattacgtttttcgtagttcggttttaaacgtttgttacgtattttataggtttttatataagaggtcgtttttttcgtagcgtaatggcggttnagattgtcgttntttcgcgtttttagcgtcgggaagtgcgtaattcgagtttagtagttgatttagtcggcgtcgaggtgtttagatggattagtgagacgattaattagagttgtatattgcgtcgaggaggcgggtttataggcggaaaggttttgaacgtaagggggtgtggtcggggtgaagtttcgttttttttattttcgaggttgtttttggggtttt

SEQ ID NO: 458 - DNA, 639 bp, Artificial Sequence
  chemically treated genomic DNA (Homo sapiens) CpG-island No: 458
  misc_feature (214)..(214): n is either a, c, g or t
  misc_feature (226)..(226): n is either a, c, g or t
  misc_feature (408)..(408): n is either a, c, g or t
  misc_feature (614)..(614): n is either a, c, g or t
  misc_feature (634)..(634): n is either a, c, g or t
  misc_feature (638)..(638): n is either a, c, g or t
aaaaccccaaaaacaacctcgaaaataaaaaaaacgaaacttcaccccgaccacacccccttacgttcaaaacctttccgcctataaacccgcctcctcgacgcaatatacaactctaattaatcgtctcactaatccatctaaacacctcgacgccgactaaatcaactactaaactcgaattacgcacttcccgacgctaaaaacgcgaaanaacgacaatctnaaccgccattacgctacgaaaaaaacgacctcttatataaaaacctataaaatacgtaacaaacgtttaaaaccgaactacgaaaaacgtaatcgaatcgaaccgaataaccgaaaaatttaaaccgaacgaaactaaatacactatataacgaaactacaaaccgaaatccccgaacgccntttctactacgcttcttataaacccgaacctataattaataaatttttctatcccgccgctccccaaattctccgaatataaccgaaatatttccttatcgaaaaccgaataacccgatacctaaccctctaaccccgctaccgaactacatatcgaaaaaaaaactacaaaaaaaaaataaaacgaaaatataaaacgacgccgnaaaccgaaaaaaaatcgaantatna

SEQ ID NO: 459 - DNA, 639 bp, Artificial Sequence
  chemically treated genomic DNA (Homo sapiens) CpG-island No: 459
  misc_feature (214)..(214): n is either a, c, g or t
  misc_feature (226)..(226): n is either a, c, g or t
  misc_feature (408)..(408): n is either a, c, g or t
  misc_feature (614)..(614): n is either a, c, g or t
  misc_feature (634)..(634): n is either a, c, g or t
  misc_feature (638)..(638): n is either a, c, g or t
gaggttttagaaatagtttcggaaatggaggaggcggggttttatttcgattatatttttttgcgtttaaagttttttcgtttatgggttcgttttttcggcgtagtgtgtaattttaattggtcgttttattaatttatttgagtatttcggcgtcgattggattaattgttgaattcgggttgcgtatttttcggcgttgggaacgcggagnaacggtagtttnggtcgttattgcgttgcggggaaagcggttttttgtgtgagggtttgtggggtgcgtggtaggcgtttaaggtcgggttgcgggaggcgtggtcgggtcgggtcgagtgatcgaagggtttaggtcgggcggggttggatgtattgtgtggcgggattgtaggtcggggttttcggacgttntttttgttgcgttttttgtgggttcgggtttgtggttagtgaatttttttatttcgtcgttttttagatttttcggatatggtcggagtgtttttttatcgagggtcgggtaattcggtgtttggttttttagtttcgttatcggattatatgtcggaggagaagttgtaggagaaaggtgaggcgagagtgtggagcggcgtcgngggtcggaggggggtcgggntgtng

SEQ ID NO: 460 - DNA, 639 bp, Artificial Sequence
  chemically treated genomic DNA (Homo sapiens) CpG-island No: 460
  misc_feature (2)..(2): n is either a, c, g or t
  misc_feature (6)..(6): n is either a, c, g or t
  misc_feature (26)..(26): n is either a, c, g or t
  misc_feature (232)..(232): n is either a, c, g or t
  misc_feature (414)..(414): n is either a, c, g or t
  misc_feature (426)..(426): n is either a, c, g or t
cnacancccgacccccctccgacccncgacgccgctccacactctcgcctcacctttctcctacaacttctcctccgacatataatccgataacgaaactaaaaaaccaaacaccgaattacccgaccctcgataaaaaaacactccgaccatatccgaaaaatctaaaaaacgacgaaataaaaaaattcactaaccacaaacccgaacccacaaaaaacgcaacaaaaanaacgtccgaaaaccccgacctacaatcccgccacacaatacatccaaccccgcccgacctaaacccttcgatcactcgacccgacccgaccacgcctcccgcaacccgaccttaaacgcctaccacgcaccccacaaaccctcacacaaaaaaccgctttccccgcaacgcaataacgaccnaaactaccgttnctccgcgttcccaacgccgaaaaatacgcaacccgaattcaacaattaatccaatcgacgccgaaatactcaaataaattaataaaacgaccaattaaaattacacactacgccgaaaaaacgaacccataaacgaaaaaactttaaacgcaaaaaaatataatcgaaataaaaccccgcctcctccatttccgaaactatttctaaaacctc

SEQ ID NO: 461 - DNA, 1157 bp, Artificial Sequence
  chemically treated genomic DNA (Homo sapiens) CpG-island No: 461
  misc_feature (31)..(31): n is either a, c, g or t
  misc_feature (48)..(48): n is either a, c, g or t
  misc_feature (106)..(106): n is either a, c, g or t
  misc_feature (118)..(118): n is either a, c, g or t
  misc_feature (125)..(125): n is either a, c, g or t
  misc_feature (135)..(135): n is either a, c, g or t
  misc_feature (138)..(138): n is either a, c, g or t
  misc_feature (147)..(147): n is either a, c, g or t
  misc_feature (162)..(162): n is either a, c, g or t
  misc_feature (166)..(166): n is either a, c, g or t
  misc_feature (174)..(174): n is either a, c, g or t
  misc_feature (203)..(203): n is either a, c, g or t
  misc_feature (205)..(205): n is either a, c, g or t
  misc_feature (221)..(221): n is either a, c, g or t
  misc_feature (321)..(321): n is either a, c, g or t
  misc_feature (331)..(331): n is either a, c, g or t
  misc_feature (376)..(376): n is either a, c, g or t
  misc_feature (402)..(402): n is either a, c, g or t
  misc_feature (423)..(423): n is either a, c, g or t
  misc_feature (438)..(438): n is either a, c, g or t
  misc_feature (442)..(442): n is either a, c, g or t
  misc_feature (580)..(580): n is either a, c, g or t
  misc_feature (597)..(597): n is either a, c, g or t
  misc_feature (796)..(796): n is either a, c, g or t
  misc_feature (814)..(814): n is either a, c, g or t
  misc_feature (816)..(816): n is either a, c, g or t
  misc_feature (893)..(893): n is either a, c, g or t
  misc_feature (901)..(901): n is either a, c, g or t
  misc_feature (1054)..(1054): n is either a, c, g or t
tacggaacggttcgtttcggcgcgtttattnggtcggacggcgtaggnaattgtcgcgttattggtcgtcgtttaggtcgttaggcgttgcggttacgcgaatttnagcgtgggagancgaggangtcggtttanaantcggcggtngcgagttagtcgcgncgantttttatnttcgggcgttttttcggtaattcgttcgntnttttatggtttcgganttttcgcgtttttattttttagttcgtatttgttcgttattttttttttggcggttttttatcgttttatttttttttttttgtttttacgttttttttnttacggtttnttcggcggtcgtttttgttttcgcgttttcgtttcggtcgcgatntttttttttgttgtagtttattcggnttttttcggcgtgtgtcgggnttcgttcggcgtttntttnttgtttttttttattttagtttttttatttcgattttaagaagaaaatattgtcgttcgttgattggttgagcggggttggaaataggcgtcgattaattagtagttagtttttcgttcgtttcgtcgcgagtagaangtcggtttcggtcgganttcggagataaataagagagatgggggacgggaggggtttgggcgttgcgggtcgggtttcggttttgtagtttttaattcgagttatagcgcggtcgggaattttcggcgaatatcgtttcgcggtttttttagcggtttgattttgcgaggttggggtttcggtttcgcgtttcggtttttagcggattttttttangaagtcgtcgggttattnangcgtttttagtcgggttttttcgcggtcgtttcgtcgtttttagttgttttttgcgcgcgggttattacgtttagantgcgtcgngtttcgtacggtggttttattttcgaatttttatttcgttttttttttacgtagcgtcgtcgttttcgtcgtttcgggttttgggttttggtttttcgttttttcgtttcggtggttttcgtttcggcgtattcggggtttgggatttcgganttcggtttagtcgtggcgtttttcgttgatgtatcgattttttttttttttttcggtggcgtttgttcggtttttggaagttggtttttggaaatttgtaagg

SEQ ID NO: 462 - DNA, 1157 bp, Artificial Sequence
  chemically treated genomic DNA (Homo sapiens) CpG-island No: 462
  misc_feature (104)..(104): n is either a, c, g or t
  misc_feature (257)..(257): n is either a, c, g or t
  misc_feature (265)..(265): n is either a, c, g or t
  misc_feature (342)..(342): n is either a, c, g or t
  misc_feature (344)..(344): n is either a, c, g or t
  misc_feature (362)..(362): n is either a, c, g or t
  misc_feature (561)..(561): n is either a, c, g or t
  misc_feature (578)..(578): n is either a, c, g or t
  misc_feature (716)..(716): n is either a, c, g or t
  misc_feature (720)..(720): n is either a, c, g or t
  misc_feature (735)..(735): n is either a, c, g or t
  misc_feature (756)..(756): n is either a, c, g or t
  misc_feature (782)..(782): n is either a, c, g or t
  misc_feature (827)..(827): n is either a, c, g or t
  misc_feature (837)..(837): n is either a, c, g or t
  misc_feature (937)..(937): n is either a, c, g or t
  misc_feature (953)..(953): n is either a, c, g or t
  misc_feature (955)..(955): n is either a, c, g or t
  misc_feature (984)..(984): n is either a, c, g or t
  misc_feature (992)..(992): n is either a, c, g or t
  misc_feature (996)..(996): n is either a, c, g or t
  misc_feature (1011)..(1011): n is either a, c, g or t
  misc_feature (1020)..(1020): n is either a, c, g or t
  misc_feature (1023)..(1023): n is either a, c, g or t
  misc_feature (1033)..(1033): n is either a, c, g or t
  misc_feature (1040)..(1040): n is either a, c, g or t
  misc_feature (1052)..(1052): n is either a, c, g or t
  misc_feature (1110)..(1110): n is either a, c, g or t
  misc_feature (1127)..(1127): n is either a, c, g or t
ccttacaaatttccaaaaaccaacttccaaaaaccgaacaaacgccaccgaaaaaaaaaaaaaaaatcgatacatcaacgaaaaacgccacgactaaaccgaantccgaaatcccaaaccccgaatacgccgaaacgaaaaccaccgaaacgaaaaaacgaaaaaccaaaacccaaaacccgaaacgacgaaaacgacgacgctacgtaaaaaaaaaacgaaataaaaattcgaaaataaaaccaccgtacgaaacncgacgcantctaaacgtaataacccgcgcgcaaaaaacaactaaaaacgacgaaacgaccgcgaaaaaacccgactaaaaacgcntnaataacccgacgacttcntaaaaaaaatccgctaaaaaccgaaacgcgaaaccgaaaccccaacctcgcaaaatcaaaccgctaaaaaaaccgcgaaacgatattcgccgaaaattcccgaccgcgctataactcgaattaaaaactacaaaaccgaaacccgacccgcaacgcccaaacccctcccgtcccccatctctcttatttatctccgaantccgaccgaaaccgacnttctactcgcgacgaaacgaacgaaaaactaactactaattaatcgacgcctatttccaaccccgctcaaccaatcaacgaacgacaatattttcttcttaaaatcgaaataaaaaaactaaaataaaaaaaaacaanaaanaaacgccgaacgaancccgacacacgccgaaaaaanccgaataaactacaacaaaaaaaaanatcgcgaccgaaacgaaaacgcgaaaacaaaaacgaccgccgaanaaaccgtaanaaaaaaaacgtaaaaacaaaaaaaaaaaaataaaacgataaaaaaccgccaaaaaaaaaataacgaacaaatacgaactaaaaaataaaaacgcgaaaantccgaaaccataaaanancgaacgaattaccgaaaaaacgcccgaanataaaaantcgncgcgactaactcgcnaccgccganttntaaaccgacntcctcgntctcccacgctnaaattcgcgtaaccgcaacgcctaacgacctaaacgacgaccaataacgcgacaattncctacgccgtccgaccnaataaacgcgccgaaacgaaccgttccgta

SEQ ID NO: 463 - DNA, 1157 bp, Artificial Sequence
  chemically treated genomic DNA (Homo sapiens) CpG-island No: 463
  misc_feature (104)..(104): n is either a, c, g or t
  misc_feature (257)..(257): n is either a, c, g or t
  misc_feature (265)..(265): n is either a, c, g or t
  misc_feature (342)..(342): n is either a, c, g or t
  misc_feature (344)..(344): n is either a, c, g or t
  misc_feature (362)..(362): n is either a, c, g or t
  misc_feature (561)..(561): n is either a, c, g or t
  misc_feature (578)..(578): n is either a, c, g or t
  misc_feature (716)..(716): n is either a, c, g or t
  misc_feature (720)..(720): n is either a, c, g or t
  misc_feature (735)..(735): n is either a, c, g or t
  misc_feature (756)..(756): n is either a, c, g or t
  misc_feature (782)..(782): n is either a, c, g or t
  misc_feature (827)..(827): n is either a, c, g or t
  misc_feature (837)..(837): n is either a, c, g or t
  misc_feature (937)..(937): n is either a, c, g or t
  misc_feature (953)..(953): n is either a, c, g or t
  misc_feature (955)..(955): n is either a, c, g or t
  misc_feature (984)..(984): n is either a, c, g or t
  misc_feature (992)..(992): n is either a, c, g or t
  misc_feature (996)..(996): n is either a, c, g or t
  misc_feature (1011)..(1011): n is either a, c, g or t
  misc_feature (1020)..(1020): n is either a, c, g or t
  misc_feature (1023)..(1023): n is either a, c, g or t
  misc_feature (1033)..(1033): n is either a, c, g or t
  misc_feature (1040)..(1040): n is either a, c, g or t
  misc_feature (1052)..(1052): n is either a, c, g or t
  misc_feature (1110)..(1110): n is either a, c, g or t
  misc_feature (1127)..(1127): n is either a, c, g or t
ttttgtagatttttaagggttaatttttagggatcgggtagacgttatcggggagaggggaaggggtcggtgtattagcggggggcgttacggttggatcgggnttcgggattttaggtttcgaatacgtcgggacgggaattatcggggcgggggagcgaggaattaggatttaaagttcgaggcggcggggacggcggcgttgcgtggggaggaggcggggtggggattcgagagtggaattatcgtgcggagtncggcgtantttgggcgtggtgattcgcgcgtagggggtagttggggacggcggggcggtcgcgggagagttcggttgggggcgtntnggtggttcggcggttttntggggggagttcgttgggggtcgggacgcggagtcggagttttagtttcgtagggttaggtcgttggagaggtcgcggggcgatgttcgtcggggattttcggtcgcgttgtgattcgggttgaaggttgtaaagtcgaggttcggttcgtagcgtttaggtttttttcgttttttattttttttgtttgttttcgagnttcggtcggaatcggtnttttgttcgcggcggggcgggcggggggttggttgttgattggtcgacgtttgtttttagtttcgtttagttaattagcgggcggtagtgttttttttttggggtcggaataaaagggttggaataaaagagggtagnaaanaggcgtcgggcgggnttcgatatacgtcggaggagntcgggtgagttgtagtagggaggggnatcgcggtcggggcgagggcgcgggggtagaagcggtcgtcgaangggtcgtagnggagaaaacgtgggaataagaggagagagatggagcgatgaggggtcgttagggaagagatgacgaatagatgcgggttggggaatggaggcgcgggggnttcgaggttatggaanancgggcgagttgtcgggggaacgttcgagnatgggggntcgncgcggttggttcgtngtcgtcggnttntgaatcggtnttttcgnttttttacgttngggttcgcgtggtcgtagcgtttagcgatttagacggcggttaatggcgcggtagttntttgcgtcgttcggttnaatgagcgcgtcggggcgggtcgtttcgta

SEQ ID NO: 464 - DNA, 1157 bp, Artificial Sequence
  chemically treated genomic DNA (Homo sapiens) CpG-island No: 464
  misc_feature (31)..(31): n is either a, c, g or t
  misc_feature (48)..(48): n is either a, c, g or t
  misc_feature (106)..(106): n is either a, c, g or t
  misc_feature (118)..(118): n is either a, c, g or t
  misc_feature (125)..(125): n is either a, c, g or t
  misc_feature (135)..(135): n is either a, c, g or t
  misc_feature (138)..(138): n is either a, c, g or t
  misc_feature (147)..(147): n is either a, c, g or t
  misc_feature (162)..(162): n is either a, c, g or t
  misc_feature (166)..(166): n is either a, c, g or t
  misc_feature (174)..(174): n is either a, c, g or t
  misc_feature (203)..(203): n is either a, c, g or t
  misc_feature (205)..(205): n is either a, c, g or t
  misc_feature (221)..(221): n is either a, c, g or t
  misc_feature (321)..(321): n is either a, c, g or t
  misc_feature (331)..(331): n is either a, c, g or t
  misc_feature (376)..(376): n is either a, c, g or t
  misc_feature (402)..(402): n is either a, c, g or t
  misc_feature (423)..(423): n is either a, c, g or t
  misc_feature (438)..(438): n is either a, c, g or t
  misc_feature (442)..(442): n is either a, c, g or t
  misc_feature (580)..(580): n is either a, c, g or t
  misc_feature (597)..(597): n is either a, c, g or t
  misc_feature (796)..(796): n is either a, c, g or t
  misc_feature (814)..(814): n is either a, c, g or t
  misc_feature (816)..(816): n is either a, c, g or t
  misc_feature (893)..(893): n is either a, c, g or t
  misc_feature (901)..(901): n is either a, c, g or t
  misc_feature (1054)..(1054): n is either a, c, g or t
tacgaaacgacccgccccgacgcgctcattnaaccgaacgacgcaaanaactaccgcgccattaaccgccgtctaaatcgctaaacgctacgaccacgcgaacccnaacgtaaaaaancgaaaanaccgattcanaanccgacgacnacgaaccaaccgcgncgancccccatnctcgaacgttcccccgacaactcgcccgntnttccataacctcgaancccccgcgcctccattccccaacccgcatctattcgtcatctcttccctaacgacccctcatcgctccatctctctcctcttattcccacgttttctccnctacgacccnttcgacgaccgcttctacccccgcgccctcgccccgaccgcgatncccctccctactacaactcacccganctcctccgacgtatatcgaancccgcccgacgcctntttnctaccctcttttattccaacccttttattccgaccccaaaaaaaaaacactaccgcccgctaattaactaaacgaaactaaaaacaaacgtcgaccaatcaacaaccaaccccccgcccgccccgccgcgaacaaaanaccgattccgaccgaanctcgaaaacaaacaaaaaaaataaaaaacgaaaaaaacctaaacgctacgaaccgaacctcgactttacaaccttcaacccgaatcacaacgcgaccgaaaatccccgacgaacatcgccccgcgacctctccaacgacctaaccctacgaaactaaaactccgactccgcgtcccgacccccaacgaactccccccanaaaaccgccgaaccaccnanacgcccccaaccgaactctcccgcgaccgccccgccgtccccaactaccccctacgcgcgaatcaccacgcccaaantacgccgnactccgcacgataattccactctcgaatccccaccccgcctcctccccacgcaacgccgccgtccccgccgcctcgaactttaaatcctaattcctcgctcccccgccccgataattcccgtcccgacgtattcgaaacctaaaatcccgaancccgatccaaccgtaacgccccccgctaatacaccgaccccttcccctctccccgataacgtctacccgatccctaaaaattaacccttaaaaatctacaaaa

SEQ ID NO: 465 - DNA, 981 bp, Artificial Sequence
  chemically treated genomic DNA (Homo sapiens) CpG-island No: 465
  misc_feature (36)..(36): n is either a, c, g or t
  misc_feature (49)..(49): n is either a, c, g or t
  misc_feature (63)..(63): n is either a, c, g or t
  misc_feature (131)..(131): n is either a, c, g or t
  misc_feature (135)..(135): n is either a, c, g or t
  misc_feature (148)..(148): n is either a, c, g or t
  misc_feature (269)..(269): n is either a, c, g or t
  misc_feature (378)..(378): n is either a, c, g or t
  misc_feature (387)..(387): n is either a, c, g or t
  misc_feature (437)..(437): n is either a, c, g or t
  misc_feature (574)..(574): n is either a, c, g or t
  misc_feature (623)..(623): n is either a, c, g or t
  misc_feature (659)..(659): n is either a, c, g or t
  misc_feature (710)..(710): n is either a, c, g or t
  misc_feature (795)..(795): n is either a, c, g or t
  misc_feature (802)..(802): n is either a, c, g or t
  misc_feature (809)..(809): n is either a, c, g or t
  misc_feature (816)..(816): n is either a, c, g or t
  misc_feature (821)..(821): n is either a, c, g or t
  misc_feature (832)..(832): n is either a, c, g or t
  misc_feature (841)..(841): n is either a, c, g or t
  misc_feature (898)..(898): n is either a, c, g or t
  misc_feature (954)..(954): n is either a, c, g or t
  misc_feature (968)..(968): n is either a, c, g or t
tcgttttcgttgttttcggttttttttcgggtttantttgggttttcgnaggtttcggggcgntttgaggagtcgttcgttcgggttgttttttcgtgttcgtgggtttttttatgtttcggttgttcgtnttantgtttcgtgggtnttcggtttagatgtcgaacgtttcggttgtttttttacgtttcggtcgtttttttacgtttcggtcgttttttcgtgtttcgtgggtttcgttttacgtgtcgttcgtttcggattttttnttattttcgttgggttcgttttaggtatttttcgtttttgttgttttttcgtttattcgggttttgcgtttttcgtcgcgtcgtcgtttcggcggtcgtttttattttnttttttttnttcgttttcgtacggtcgtcggatatttattattttttgagtagtattantgtcgtttcgcggttcggtggttgttcgcggttcgttcggtttttcgttcgttgttcgtcggtcgtttttttcgtggttcggttcggttcggttgtttgtgcgttttcgtcgtgttttgtttcgttttcgtcgtttntcgtcgcggtcgtcgcgtcggtttttgtcgttcgggtttcgtcgttttntcgcgtcgttgtcgacgtcgttcggagtttcggttntcgtagcgtcgcgcgggggcggggcgtttttgcggtaattagagcgttatnacgtcgcggtgcgcgttgacgttacgcggggtcgagtttttttaggttcgttttttcgtttttaagtgggtcgcggcggcgttgntcggttntcgaggntggggtnttcgncggttggggtnagattcggntagaaggcggagtagattagggtgttcgttatcgttttcggtgtgaatcgttacggnatgtacgcgggtgttggttggggggttttttcggttgagggaattgagatttaggnaaaaggttgttttnaaaaaatattaat

SEQ ID NO: 466 - DNA, 981 bp, Artificial Sequence
  chemically treated genomic DNA (Homo sapiens) CpG-island No: 466
  misc_feature (14)..(14): n is either a, c, g or t
  misc_feature (28)..(28): n is either a, c, g or t
  misc_feature (84)..(84): n is either a, c, g or t
  misc_feature (141)..(141): n is either a, c, g or t
  misc_feature (150)..(150): n is either a, c, g or t
  misc_feature (161)..(161): n is either a, c, g or t
  misc_feature (166)..(166): n is either a, c, g or t
  misc_feature (173)..(173): n is either a, c, g or t
  misc_feature (180)..(180): n is either a, c, g or t
  misc_feature (187)..(187): n is either a, c, g or t
  misc_feature (272)..(272): n is either a, c, g or t
  misc_feature (323)..(323): n is either a, c, g or t
  misc_feature (359)..(359): n is either a, c, g or t
  misc_feature (408)..(408): n is either a, c, g or t
  misc_feature (545)..(545): n is either a, c, g or t
  misc_feature (595)..(595): n is either a, c, g or t
  misc_feature (604)..(604): n is either a, c, g or t
  misc_feature (713)..(713): n is either a, c, g or t
  misc_feature (834)..(834): n is either a, c, g or t
  misc_feature (847)..(847): n is either a, c, g or t
  misc_feature (851)..(851): n is either a, c, g or t
  misc_feature (919)..(919): n is either a, c, g or t
  misc_feature (933)..(933): n is either a, c, g or t
  misc_feature (946)..(946): n is either a, c, g or t
attaatattttttnaaaacaaccttttncctaaatctcaattccctcaaccgaaaaaaccccccaaccaacacccgcgtacatnccgtaacgattcacaccgaaaacgataacgaacaccctaatctactccgccttctanccgaatctnaccccaaccgncgaanaccccancctcganaaccgancaacgccgccgcgacccacttaaaaacgaaaaaacgaacctaaaaaaactcgaccccgcgtaacgtcaacgcgcaccgcgacgtnataacgctctaattaccgcaaaaacgccccgcccccgcgcgacgctacganaaccgaaactccgaacgacgtcgacaacgacgcganaaaacgacgaaacccgaacgacaaaaaccgacgcgacgaccgcgacganaaacgacgaaaacgaaacaaaacacgacgaaaacgcacaaacaaccgaaccgaaccgaaccacgaaaaaaacgaccgacgaacaacgaacgaaaaaccgaacgaaccgcgaacaaccaccgaaccgcgaaacgacantaatactactcaaaaaataataaatatccgacgaccgtacgaaaacgaanaaaaaaaanaaaataaaaacgaccgccgaaacgacgacgcgacgaaaaacgcaaaacccgaataaacgaaaaaacaacaaaaacgaaaaatacctaaaacgaacccaacgaaaataanaaaaaatccgaaacgaacgacacgtaaaacgaaacccacgaaacacgaaaaaacgaccgaaacgtaaaaaaacgaccgaaacgtaaaaaaacaaccgaaacgttcgacatctaaaccgaanacccacgaaacantaanacgaacaaccgaaacataaaaaaacccacgaacacgaaaaaacaacccgaacgaacgactcctcaaancgccccgaaacctncgaaaacccaaantaaacccgaaaaaaaaccgaaaacaacgaaaacga

SEQ ID NO: 467 - DNA, 981 bp, Artificial Sequence
  chemically treated genomic DNA (Homo sapiens) CpG-island No: 467
  misc_feature (14)..(14): n is either a, c, g or t
  misc_feature (28)..(28): n is either a, c, g or t
  misc_feature (84)..(84): n is either a, c, g or t
  misc_feature (141)..(141): n is either a, c, g or t
  misc_feature (150)..(150): n is either a, c, g or t
  misc_feature (161)..(161): n is either a, c, g or t
  misc_feature (166)..(166): n is either a, c, g or t
  misc_feature (173)..(173): n is either a, c, g or t
  misc_feature (180)..(180): n is either a, c, g or t
  misc_feature (187)..(187): n is either a, c, g or t
  misc_feature (272)..(272): n is either a, c, g or t
  misc_feature (323)..(323): n is either a, c, g or t
  misc_feature (359)..(359): n is either a, c, g or t
  misc_feature (408)..(408): n is either a, c, g or t
  misc_feature (545)..(545): n is either a, c, g or t
  misc_feature (595)..(595): n is either a, c, g or t
  misc_feature (604)..(604): n is either a, c, g or t
  misc_feature (713)..(713): n is either a, c, g or t
  misc_feature (834)..(834): n is either a, c, g or t
  misc_feature (847)..(847): n is either a, c, g or t
  misc_feature (851)..(851): n is either a, c, g or t
  misc_feature (919)..(919): n is either a, c, g or t
  misc_feature (933)..(933): n is either a, c, g or t
  misc_feature (946)..(946): n is either a, c, g or t
attaatattttttngaaataattttttntttgggttttaatttttttaatcggggaggttttttagttagtattcgcgtgtatntcgtggcggtttatatcgaggacggtgacggatattttagtttgtttcgttttttgntcgggtttngttttagtcgncgggngttttantttcggnaatcgantagcgtcgtcgcggtttatttaaggacgggagggcgggtttgggaaggttcggtttcgcgtgacgttagcgcgtatcgcggcgtngtgacgttttggttgtcgtagagacgtttcgttttcgcgcggcgttgcggnaatcggagtttcgggcggcgtcggtagcggcgcgangaggcgacgaggttcgggcggtaggagtcggcgcggcgatcgcggcgangggcggcggggacggagtagagtacgacgaagacgtataggtagtcgggtcgggtcgggttacggggagagcggtcggcgggtagcgggcgggaggtcgggcgggtcgcgggtagttatcgagtcgcgaagcgatantggtgttgtttaaggagtagtgagtgttcggcggtcgtgcggaagcgggngaggagggnagggtggggacggtcgtcggggcgacggcgcggcgagggacgtagggttcggatggacggaggggtagtagggacggagggtgtttgaggcgggtttagcggggatggnaggggattcggggcgggcggtacgtgaggcggggtttacggggtacggaggggcggtcggggcgtggaggggcggtcggggcgtggaggggtagtcggggcgttcggtatttgagtcgggngtttacggggtantggnacgggtagtcggggtatggaggggtttacgggtacggagggataattcgggcggacggttttttaggncgtttcggggtttncggaggtttaagntggattcgaggagaggtcggggatagcgagggcga

SEQ ID NO: 468 - DNA, 981 bp, Artificial Sequence
  chemically treated genomic DNA (Homo sapiens) CpG-island No: 468
  misc_feature (36)..(36): n is either a, c, g or t
  misc_feature (49)..(49): n is either a, c, g or t
  misc_feature (63)..(63): n is either a, c, g or t
  misc_feature (131)..(131): n is either a, c, g or t
  misc_feature (135)..(135): n is either a, c, g or t
  misc_feature (148)..(148): n is either a, c, g or t
  misc_feature (269)..(269): n is either a, c, g or t
  misc_feature (378)..(378): n is either a, c, g or t
  misc_feature (387)..(387): n is either a, c, g or t
  misc_feature (437)..(437): n is either a, c, g or t
  misc_feature (574)..(574): n is either a, c, g or t
  misc_feature (623)..(623): n is either a, c, g or t
  misc_feature (659)..(659): n is either a, c, g or t
  misc_feature (710)..(710): n is either a, c, g or t
  misc_feature (795)..(795): n is either a, c, g or t
  misc_feature (802)..(802): n is either a, c, g or t
  misc_feature (809)..(809): n is either a, c, g or t
  misc_feature (816)..(816): n is either a, c, g or t
  misc_feature (821)..(821): n is either a, c, g or t
  misc_feature (832)..(832): n is either a, c, g or t
  misc_feature (841)..(841): n is either a, c, g or t
  misc_feature (898)..(898): n is either a, c, g or t
  misc_feature (954)..(954): n is either a, c, g or t
  misc_feature (968)..(968): n is either a, c, g or t
tcgccctcgctatccccgacctctcctcgaatccancttaaacctccgnaaaccccgaaacgncctaaaaaaccgtccgcccgaattatccctccgtacccgtaaacccctccataccccgactacccgtnccantaccccgtaaacncccgactcaaataccgaacgccccgactacccctccacgccccgaccgcccctccacgccccgaccgcccctccgtaccccgtaaaccccgcctcacgtaccgcccgccccgaatcccctnccatccccgctaaacccgcctcaaacaccctccgtccctactacccctccgtccatccgaaccctacgtccctcgccgcgccgtcgccccgacgaccgtccccaccctnccctcctcncccgcttccgcacgaccgccgaacactcactactccttaaacaacaccantatcgcttcgcgactcgataactacccgcgacccgcccgacctcccgcccgctacccgccgaccgctctccccgtaacccgacccgacccgactacctatacgtcttcgtcgtactctactccgtccccgccgcccntcgccgcgatcgccgcgccgactcctaccgcccgaacctcgtcgcctcntcgcgccgctaccgacgccgcccgaaactccgattnccgcaacgccgcgcgaaaacgaaacgtctctacgacaaccaaaacgtcacnacgccgcgatacgcgctaacgtcacgcgaaaccgaaccttcccaaacccgccctcccgtccttaaataaaccgcgacgacgctantcgattnccgaaantaaaacncccgncgactaaaacnaaacccgancaaaaaacgaaacaaactaaaatatccgtcaccgtcctcgatataaaccgccacganatacacgcgaatactaactaaaaaacctccccgattaaaaaaattaaaacccaaanaaaaaattatttcnaaaaaatattaat

SEQ ID NO: 469 - DNA, 606 bp, Artificial Sequence
  chemically treated genomic DNA (Homo sapiens) CpG-island No: 469
gtcgagtaacggtacgaggcgttgtaggtcgtcgggttcgcggttttggtttgtgtcgttggcgtttattagatagcgggcgaagcggttagggtttagcgaggttataagcggttttacgagcgttagcgtgttcgagcgttttatttcgcgttttatttttttgttagtcgttaatatcgttattgcgaggtaggcgtgtagcgaaagtagttcgttttttttggagaaggcgagcgggaagagttattcggttgcgcgtttttttattatgcgtcgttgtatcgtttggttttcgtgtagcgcgtagttgtttagcgttagcgcgtagtggcgtagtagcgcggggttcgtgcggcggtattaatatagtatcgcgtttaggtcgtcggtcgttattagtttttggtatgtttttttcgaatgtttgaatatgtgttttaagatgtttgatttatttcgcgttagttttacgggttcgcgttttttcgttaggtttaggattacgtttagtttaatgcgcgttacgcggtttttgtttagtgaaagtggaaggggatagtggaattgtcgtagtttggggagtttggtttgttcgtttggggt

SEQ ID NO: 470 - DNA, 606 bp, Artificial Sequence
  chemically treated genomic DNA (Homo sapiens) CpG-island No: 470
accccaaacgaacaaaccaaactccccaaactacgacaattccactatccccttccactttcactaaacaaaaaccgcgtaacgcgcattaaactaaacgtaatcctaaacctaacgaaaaaacgcgaacccgtaaaactaacgcgaaataaatcaaacatcttaaaacacatattcaaacattcgaaaaaaacataccaaaaactaataacgaccgacgacctaaacgcgatactatattaataccgccgcacgaaccccgcgctactacgccactacgcgctaacgctaaacaactacgcgctacacgaaaaccaaacgatacaacgacgcataataaaaaaacgcgcaaccgaataactcttcccgctcgccttctccaaaaaaaacgaactactttcgctacacgcctacctcgcaataacgatattaacgactaacaaaaaaataaaacgcgaaataaaacgctcgaacacgctaacgctcgtaaaaccgcttataacctcgctaaaccctaaccgcttcgcccgctatctaataaacgccaacgacacaaaccaaaaccgcgaacccgacgacctacaacgcctcgtaccgttactcgac

SEQ ID NO: 471 - DNA, 606 bp, Artificial Sequence
  chemically treated genomic DNA (Homo sapiens) CpG-island No: 471
gttttaaacgggtaagttaagttttttaagttgcggtaattttattgtttttttttatttttattgggtagagatcgcgtggcgcgtattgggttgggcgtgattttgaatttggcgaaggaacgcgaattcgtagagttggcgcggagtgggttaggtattttggagtatatgtttaagtattcggaggagatatgttagaggttggtggcggtcggcggtttggacgcggtgttgtattggtgtcgtcgtacggatttcgcgttgttgcgttattgcgcgttggcgttgggtaattgcgcgttgtacgggggttaggcggtgtagcgacgtatggtagagaagcgcgtagtcgagtggtttttttcgttcgttttttttaaggaggacgagttgttttcgttgtacgtttgtttcgtagtagcggtgttggcgattaataaggaggtggagcgcgaggtggagcgttcgggtacgttggcgttcgtggagtcgtttgtggtttcgttggattttggtcgtttcgttcgttgtttggtggacgttagcgatataagttagggtcgcgggttcgacgatttgtagcgtttcgtgtcgttgttcgat

SEQ ID NO: 472 - DNA, 606 bp, Artificial Sequence
  chemically treated genomic DNA (Homo sapiens) CpG-island No: 472
atcgaacaacgacacgaaacgctacaaatcgtcgaacccgcgaccctaacttatatcgctaacgtccaccaaacaacgaacgaaacgaccaaaatccaacgaaaccacaaacgactccacgaacgccaacgtacccgaacgctccacctcgcgctccacctccttattaatcgccaacaccgctactacgaaacaaacgtacaacgaaaacaactcgtcctccttaaaaaaaacgaacgaaaaaaaccactcgactacgcgcttctctaccatacgtcgctacaccgcctaacccccgtacaacgcgcaattacccaacgccaacgcgcaataacgcaacaacgcgaaatccgtacgacgacaccaatacaacaccgcgtccaaaccgccgaccgccaccaacctctaacatatctcctccgaatacttaaacatatactccaaaatacctaacccactccgcgccaactctacgaattcgcgttccttcgccaaattcaaaatcacgcccaacccaatacgcgccacgcgatctctacccaataaaaataaaaaaaaacaataaaattaccgcaacttaaaaaacttaacttacccgtttaaaac

SEQ ID NO: 473 - DNA, 672 bp, Artificial Sequence
  chemically treated genomic DNA (Homo sapiens) CpG-island No: 473
atattacgcggcgtttttttaatttcggtttggcgcgtttatcggtttttagttattaggatttgttttagtaggcgcgcggtttgtatacgcgtttttaatttcggcgtttgtagtagtcgtaatagtaggtcgaggtcgttatcgaggcggatggcgtcgtatagattttgggttatttcgcggtttacggtcgtagtagttaggttttttttattagttggaagatttcggttaggtcggcgtttacggttcgcgcgtcgttcgtttgttttagcgcggataaggtttgttgtagtttcggtagcgcgcgttttagggcgttttgtatttcggtgtttgttttcggcgatattttcgcgggttcgggttattcgtagtttattatgggttcgtgttatcgtttttatttggtttaggtatcgttagtcgttcggcgtttcgtcgtgggttcgatatggcgaagaagcgatatagtttgtaggcggagagaagtagcgttaggattatgggcgcggggtcgcgggggatattttcggtttggaggcggggttacgcggagagattcgggttttgggaaaagagggattcgagaggggtcggggaaagaagatggagggggaggaatggagagaagggtattaggtaagggtgtcggttagaagtttgggg

SEQ ID NO: 474 - DNA, 672 bp, Artificial Sequence
  chemically treated genomic DNA (Homo sapiens) CpG-island No: 474
ccccaaacttctaaccgacacccttacctaatacccttctctccattcctccccctccatcttctttccccgacccctctcgaatccctcttttcccaaaacccgaatctctccgcgtaaccccgcctccaaaccgaaaatatcccccgcgaccccgcgcccataatcctaacgctacttctctccgcctacaaactatatcgcttcttcgccatatcgaacccacgacgaaacgccgaacgactaacgatacctaaaccaaataaaaacgataacacgaacccataataaactacgaataacccgaacccgcgaaaatatcgccgaaaacaaacaccgaaatacaaaacgccctaaaacgcgcgctaccgaaactacaacaaaccttatccgcgctaaaacaaacgaacgacgcgcgaaccgtaaacgccgacctaaccgaaatcttccaactaataaaaaaaacctaactactacgaccgtaaaccgcgaaataacccaaaatctatacgacgccatccgcctcgataacgacctcgacctactattacgactactacaaacgccgaaattaaaaacgcgtatacaaaccgcgcgcctactaaaacaaatcctaataactaaaaaccgataaacgcgccaaaccgaaattaaaaaaacgccgcgtaatat

SEQ ID NO: 475 - DNA, 672 bp, Artificial Sequence
  chemically treated genomic DNA (Homo sapiens) CpG-island No: 475
ttttaaatttttgatcggtatttttgtttggtatttttttttttatttttttttttttatttttttttttcgatttttttcgggtttttttttttttaaaattcgggttttttcgcgtggtttcgtttttaggtcggggatgtttttcgcggtttcgcgtttatggttttgacgttgttttttttcgtttataagttgtgtcgttttttcgttatgtcgggtttacggcggggcgtcgagcggttggcggtgtttgggttagatgggggcggtggtacgggtttatggtgggttgcgggtggttcgggttcgcgaaagtgtcgtcgggggtaggtatcgaggtgtaggacgttttggagcgcgcgttgtcggagttgtagtaggttttgttcgcgttgaagtaggcgggcggcgcgcgggtcgtgggcgtcggtttggtcgaggttttttaattggtggaggaggtttggttgttgcggtcgtgggtcgcgaggtagtttagggtttgtgcgacgttattcgtttcgatggcggtttcgatttgttgttgcggttgttgtaggcgtcggagttggagacgcgtgtgtaggtcgcgcgtttgttggagtagattttggtggttgagaatcggtgagcgcgttaggtcggggttgggagagcgtcgcgtggtgt

SEQ ID NO: 476 - DNA, 672 bp, Artificial Sequence
  chemically treated genomic DNA (Homo sapiens) CpG-island No: 476
acaccacgcgacgctctcccaaccccgacctaacgcgctcaccgattctcaaccaccaaaatctactccaacaaacgcgcgacctacacacgcgtctccaactccgacgcctacaacaaccgcaacaacaaatcgaaaccgccatcgaaacgaataacgtcgcacaaaccctaaactacctcgcgacccacgaccgcaacaaccaaacctcctccaccaattaaaaaacctcgaccaaaccgacgcccacgacccgcgcgccgcccgcctacttcaacgcgaacaaaacctactacaactccgacaacgcgcgctccaaaacgtcctacacctcgatacctacccccgacgacactttcgcgaacccgaaccacccgcaacccaccataaacccgtaccaccgcccccatctaacccaaacaccgccaaccgctcgacgccccgccgtaaacccgacataacgaaaaaacgacacaacttataaacgaaaaaaaacaacgtcaaaaccataaacgcgaaaccgcgaaaaacatccccgacctaaaaacgaaaccacgcgaaaaaacccgaattttaaaaaaaaaaaaacccgaaaaaaatcgaaaaaaaaaaataaaaaaaaaaaaataaaaaaaaaaataccaaacaaaaataccgatcaaaaatttaaaa

SEQ ID NO: 477 - DNA, 579 bp, Artificial Sequence
  chemically treated genomic DNA (Homo sapiens) CpG-island No: 477
gcgcggttttaagttcggttcgtagttttcggggtagtcgttttggttttagtttttcgtcggggtttaaagtacgtattaatcgttcgttcgtaagtaaagaggacgttatatttagtcggtttttcggttaggtgattttaattcggattttcgttcgtcgcgcgtcggaagtaacgttaagcgtatcggaagttgttttgagtttcggggtgggattaggcgggttaagagggtcgggacgtcgcgcggggtagtgtgggattggggcggaatcgttcggtcgcgggtcgggttttgtgttagtagtcgggcgggcgttcgggcgggatatggtagtttgtatagttcggcggtttttggtcgtgggtagtcgttggtggtttcggtcgttgattggggttcggtggtaaagtcgttttgtgcggcggtcggagttggagttttttcgttagcgtcgattacgacgacgcggaggtatttttcgtttcggtgagggacggagttagggggcgcgaggaattgggtttggagtttagagagcgtgtttttagttagtgcggaggttaggggttcggg

SEQ ID NO: 478 - DNA, 579 bp, Artificial Sequence
  chemically treated genomic DNA (Homo sapiens) CpG-island No: 478
cccgaacccctaacctccgcactaactaaaaacacgctctctaaactccaaacccaattcctcgcgccccctaactccgtccctcaccgaaacgaaaaatacctccgcgtcgtcgtaatcgacgctaacgaaaaaactccaactccgaccgccgcacaaaacgactttaccaccgaaccccaatcaacgaccgaaaccaccaacgactacccacgaccaaaaaccgccgaactatacaaactaccatatcccgcccgaacgcccgcccgactactaacacaaaacccgacccgcgaccgaacgattccgccccaatcccacactaccccgcgcgacgtcccgaccctcttaacccgcctaatcccaccccgaaactcaaaacaacttccgatacgcttaacgttacttccgacgcgcgacgaacgaaaatccgaattaaaatcacctaaccgaaaaaccgactaaatataacgtcctctttacttacgaacgaacgattaatacgtactttaaaccccgacgaaaaactaaaaccaaaacgactaccccgaaaactacgaaccgaacttaaaaccgcgc

SEQ ID NO: 479 - DNA, 579 bp, Artificial Sequence
  chemically treated genomic DNA (Homo sapiens) CpG-island No: 479
ttcgggtttttggttttcgtattggttaggaatacgttttttgggttttaggtttagtttttcgcgttttttggtttcgttttttatcgggacgagaggtgttttcgcgtcgtcgtggtcgacgttggcgagaaggttttagtttcggtcgtcgtatagagcggttttgttatcgggttttagttagcgatcgggattattagcggttgtttacggttaggggtcgtcgggttgtataggttgttatgtttcgttcgagcgttcgttcggttgttgatatagagttcgattcgcggtcgggcggtttcgttttagttttatattgtttcgcgcggcgtttcggtttttttggttcgtttggttttatttcggagtttagagtaattttcggtgcgtttagcgttattttcggcgcgcggcgggcggaagttcgggttggggttatttgatcggagagtcggttagatatggcgttttttttgtttgcgggcgagcgattggtgcgtgttttgggtttcggcggggagttggagttagagcggttatttcgaaagttgcgggtcgagtttgaggtcgcgt

SEQ ID NO: 480 - DNA, 579 bp, Artificial Sequence
  chemically treated genomic DNA (Homo sapiens) CpG-island No: 480
acgcgacctcaaactcgacccgcaactttcgaaataaccgctctaactccaactccccgccgaaacccaaaacacgcaccaatcgctcgcccgcaaacaaaaaaaacgccatatctaaccgactctccgatcaaataaccccaacccgaacttccgcccgccgcgcgccgaaaataacgctaaacgcaccgaaaattactctaaactccgaaataaaaccaaacgaaccaaaaaaaccgaaacgccgcgcgaaacaatataaaactaaaacgaaaccgcccgaccgcgaatcgaactctatatcaacaaccgaacgaacgctcgaacgaaacataacaacctatacaacccgacgacccctaaccgtaaacaaccgctaataatcccgatcgctaactaaaacccgataacaaaaccgctctatacgacgaccgaaactaaaaccttctcgccaacgtcgaccacgacgacgcgaaaacacctctcgtcccgataaaaaacgaaaccaaaaaacgcgaaaaactaaacctaaaacccaaaaaacgtattcctaaccaatacgaaaaccaaaaacccgaa

SEQ ID NO: 481 - DNA, 502 bp, Artificial Sequence
  chemically treated genomic DNA (Homo sapiens) CpG-island No: 481
atacgaatcgtatatttcgagttgggttgtttcgtgggcgcgcgattcggttttagttgcgggtttcggtcgcgtattcgacgtcgtagtggaggttttcgagtcgtcgttagcgtcgcgacgggtaggggtgttcggttatttgtattaattcgaagatgtggttttttttttcgtattggggtatttcgggggggatacggtgcggggcgatagtggcgtttatgtagtcgtttcggttcgtcgttttttagtaatcgcgtcgttagggtcgtcgcgtcgattgcgttattagtacgcgtcgcggtttcgttttgtaggtttcgcgtcgggtttagatattcgattttcggtcgcgcgggtcgttttcgtttcgattttttcggttgacgcgttttgcggttcgggtaagttttttttttaatttcggtttcgttttttttatttgcgtattttagcgggggatatttttaggtggtttttagttgggttttttcgtatt

SEQ ID NO: 482 - DNA, 502 bp, Artificial Sequence
  chemically treated genomic DNA (Homo sapiens) CpG-island No: 482
aatacgaaaaaacccaactaaaaaccacctaaaaatatcccccgctaaaatacgcaaataaaaaaaacgaaaccgaaattaaaaaaaaaacttacccgaaccgcaaaacgcgtcaaccgaaaaaatcgaaacgaaaacgacccgcgcgaccgaaaatcgaatatctaaacccgacgcgaaacctacaaaacgaaaccgcgacgcgtactaataacgcaatcgacgcgacgaccctaacgacgcgattactaaaaaacgacgaaccgaaacgactacataaacgccactatcgccccgcaccgtatcccccccgaaataccccaatacgaaaaaaaaaaccacatcttcgaattaatacaaataaccgaacacccctacccgtcgcgacgctaacgacgactcgaaaacctccactacgacgtcgaatacgcgaccgaaacccgcaactaaaaccgaatcgcgcgcccacgaaacaacccaactcgaaatatacgattcgtat

SEQ ID NO: 483 - DNA, 502 bp, Artificial Sequence
  chemically treated genomic DNA (Homo sapiens) CpG-island No: 483
gatacgaggaggtttagttggaagttatttgagggtgtttttcgttaagatgcgtaaatgggaaaagcgaggtcggggttggggaaagaatttgttcgagtcgtagagcgcgttagtcggggaggtcggggcgggggcgattcgcgcgatcgaggatcgggtatttgggttcggcgcggagtttgtagggcggggtcgcggcgcgtgttgatgacgtagtcggcgcggcggttttagcgacgcggttattagggagcggcgagtcgagacggttatatggacgttattatcgtttcgtatcgtatttttttcgagatgttttagtacggggaggagaattatattttcgagttgatgtaggtgatcggatatttttgttcgtcgcgacgttggcggcggttcgggagtttttattgcgacgtcgggtgcgcggtcgggattcgtagttggggtcgagtcgcgcgtttacgaagtagtttaattcgggatgtacgattcgtgt

SEQ ID NO: 484 - DNA, 502 bp, Artificial Sequence
  chemically treated genomic DNA (Homo sapiens) CpG-island No: 484
acacgaatcgtacatcccgaattaaactacttcgtaaacgcgcgactcgaccccaactacgaatcccgaccgcgcacccgacgtcgcaataaaaactcccgaaccgccgccaacgtcgcgacgaacaaaaatatccgatcacctacatcaactcgaaaatataattctcctccccgtactaaaacatctcgaaaaaaatacgatacgaaacgataataacgtccatataaccgtctcgactcgccgctccctaataaccgcgtcgctaaaaccgccgcgccgactacgtcatcaacacgcgccgcgaccccgccctacaaactccgcgccgaacccaaatacccgatcctcgatcgcgcgaatcgcccccgccccgacctccccgactaacgcgctctacgactcgaacaaattctttccccaaccccgacctcgcttttcccatttacgcatcttaacgaaaaacaccctcaaataacttccaactaaacctcctcgtatc

SEQ ID NO: 485 - DNA, 695 bp, Artificial Sequence
  chemically treated genomic DNA (Homo sapiens) CpG-island No: 485
ttcggagcggttcgggcggtttgggtcgggatcggggtcgggggaggagttcgtaggtcgtatttggtcggcgaagttttcggtcgtgtttattaggtcgttttggtttatggcgacggcgggaggttcggttcggttcgttcgttcgttcgttggttttcgttcgtcggcgttcgtattcgttgcggtttttataggaagtgttcggcggtcggtttcgtttcgcgtcggttgcggttttagcggttgttacgtaggttaagttttaaaggggtcgcgcgtcgttcgggttcgtttcggtgcgttttaaaggggttacgcgttatttttagtttttcgatttattcgttcgaagttacgttcgtcgcgttcgacgttacgttttttacgttggaggtttcgttcgtcgcgcgtaggttttgcggtttttttcggttcggcggaacgcgttttttttaagggggcggggatttgggggtttggggttagcgcgcgggagggacgtttgagtgtttcgagggcgtcgttcgggcggggaggatttcgcgggttttattgatttacgcggggtggggttaggggtggacgttcgttcgtacgcggtcgttattgattatgtttgggttagggtttaatcgtaggcgttttacgtagggggagcgaggtttagggtttttcggagagtttatggagaa

SEQ ID NO: 486 - DNA, 695 bp, Artificial Sequence
  chemically treated genomic DNA (Homo sapiens) CpG-island No: 486
ttctccataaactctccgaaaaaccctaaacctcgctccccctacgtaaaacgcctacgattaaaccctaacccaaacataatcaataacgaccgcgtacgaacgaacgtccacccctaaccccaccccgcgtaaatcaataaaacccgcgaaatcctccccgcccgaacgacgccctcgaaacactcaaacgtccctcccgcgcgctaaccccaaacccccaaatccccgcccccttaaaaaaaacgcgttccgccgaaccgaaaaaaaccgcaaaacctacgcgcgacgaacgaaacctccaacgtaaaaaacgtaacgtcgaacgcgacgaacgtaacttcgaacgaataaatcgaaaaactaaaaataacgcgtaacccctttaaaacgcaccgaaacgaacccgaacgacgcgcgacccctttaaaacttaacctacgtaacaaccgctaaaaccgcaaccgacgcgaaacgaaaccgaccgccgaacacttcctataaaaaccgcaacgaatacgaacgccgacgaacgaaaaccaacgaacgaacgaacgaaccgaaccgaacctcccgccgtcgccataaaccaaaacgacctaataaacacgaccgaaaacttcgccgaccaaatacgacctacgaactcctcccccgaccccgatcccgacccaaaccgcccgaaccgctccgaa

SEQ ID NO: 487 - DNA, 695 bp, Artificial Sequence
  chemically treated genomic DNA (Homo sapiens) CpG-island No: 487
ttttttatgggtttttcgggggattttgggtttcgttttttttgcgtggggcgtttgcgattggattttggtttaagtatgattagtagcgatcgcgtacgggcgagcgtttatttttggttttatttcgcgtgggttagtgggattcgcgggatttttttcgttcgaacggcgttttcgaggtatttaggcgtttttttcgcgcgttggttttagatttttaggttttcgtttttttaaaagggacgcgtttcgtcgggtcgggagggatcgtagggtttgcgcgcggcgggcggggtttttagcgtgagaggcgtggcgtcgagcgcggcgggcgtggtttcgagcggatgggtcgggaggttggggatggcgcgtggtttttttaagacgtatcggggcgggttcgggcggcgcgcggtttttttaaggtttggtttacgtggtagtcgttggagtcgtagtcgacgcggagcgaggtcggtcgtcgggtattttttgtggaggtcgtagcgggtgcgggcgtcgacgggcgagagttagcgagcgagcgagcgagtcgagtcgagtttttcgtcgtcgttatgggttagaacgatttgatgggtacggtcgaggatttcgtcgattaggtgcggtttgcgggtttttttttcggtttcggtttcgatttaggtcgttcgggtcgtttcgga

SEQ ID NO: 488 - DNA, 695 bp, Artificial Sequence
  chemically treated genomic DNA (Homo sapiens) CpG-island No: 488
tccgaaacgacccgaacgacctaaatcgaaaccgaaaccgaaaaaaaaacccgcaaaccgcacctaatcgacgaaatcctcgaccgtacccatcaaatcgttctaacccataacgacgacgaaaaactcgactcgactcgctcgctcgctcgctaactctcgcccgtcgacgcccgcacccgctacgacctccacaaaaaatacccgacgaccgacctcgctccgcgtcgactacgactccaacgactaccacgtaaaccaaaccttaaaaaaaccgcgcgccgcccgaacccgccccgatacgtcttaaaaaaaccacgcgccatccccaacctcccgacccatccgctcgaaaccacgcccgccgcgctcgacgccacgcctctcacgctaaaaaccccgcccgccgcgcgcaaaccctacgatccctcccgacccgacgaaacgcgtcccttttaaaaaaacgaaaacctaaaaatctaaaaccaacgcgcgaaaaaaacgcctaaatacctcgaaaacgccgttcgaacgaaaaaaatcccgcgaatcccactaacccacgcgaaataaaaccaaaaataaacgctcgcccgtacgcgatcgctactaatcatacttaaaccaaaatccaatcgcaaacgccccacgcaaaaaaaacgaaacccaaaatcccccgaaaaacccataaaaaa

SEQ ID NO: 489 - DNA, 528 bp, Artificial Sequence
  chemically treated genomic DNA (Homo sapiens) CpG-island No: 489
ggggttgttcggggcgcgtttggaggcggggattttcgttttttttattttgttgtcgtttagcgtttgggtcggcggttattcgagatttcggttttttcgggttcggcgttttggtagtataagcgtttgtttaggttagttcgaaatatatttatcgtagggatttcgtttaggaaaagatttcggaagagatttcgtacgcgttgcgtatattttagtacgtacgttttagttttcggaagcgttcgtttttttataatcggttggaaatcggatttttgtttttggtttcgcgtagtttgggcggtttattcgtacgggatttgggtcgtcgttttagttagcggtattcggggttatcgatttcgagtttgattggggtaagtcgaggatttttttaagattcgggatggggatgagagatgcgaacgtcggaagggaattggggggtcgttgtgtgtgtagtattcggtagggtagttgagttgggggtattgggcggtggggttagtgagagtcgggtta

SEQ ID NO: 490 - DNA, 528 bp, Artificial Sequence
  chemically treated genomic DNA (Homo sapiens) CpG-island No: 490
taacccgactctcactaaccccaccgcccaatacccccaactcaactaccctaccgaatactacacacacaacgaccccccaattcccttccgacgttcgcatctctcatccccatcccgaatcttaaaaaaatcctcgacttaccccaatcaaactcgaaatcgataaccccgaataccgctaactaaaacgacgacccaaatcccgtacgaataaaccgcccaaactacgcgaaaccaaaaacaaaaatccgatttccaaccgattataaaaaaacgaacgcttccgaaaactaaaacgtacgtactaaaatatacgcaacgcgtacgaaatctcttccgaaatcttttcctaaacgaaatccctacgataaatatatttcgaactaacctaaacaaacgcttatactaccaaaacgccgaacccgaaaaaaccgaaatctcgaataaccgccgacccaaacgctaaacgacaacaaaataaaaaaaacgaaaatccccgcctccaaacgcgccccgaacaacccc

SEQ ID NO: 491 - DNA, 528 bp, Artificial Sequence
  chemically treated genomic DNA (Homo sapiens) CpG-island No: 491
tagttcggtttttattagttttatcgtttagtgtttttagtttagttgttttatcgggtgttatatatatagcggttttttagttttttttcggcgttcgtattttttatttttatttcggattttggggaggttttcggtttgttttagttaaattcgaggtcgatgatttcggatgtcgttggttaaggcggcggtttaagtttcgtgcgggtgaatcgtttaggttgcgcggaattagaggtagggattcggtttttagtcggttgtggagagacgagcgttttcggggattggagcgtgcgtgttgaggtatgcgtaacgcgtgcggggtttttttcggagtttttttttggacggggtttttgcggtgggtgtgtttcggattggtttgggtaggcgtttgtgttgttagggcgtcgggttcggggaggtcggggtttcgggtggtcgtcggtttaggcgttggacggtagtaggatggggaaggcgaaggttttcgtttttaagcgcgtttcgagtagtttt

SEQ ID NO: 492 - DNA, 528 bp, Artificial Sequence
  chemically treated genomic DNA (Homo sapiens) CpG-island No: 492
aaaactactcgaaacgcgcttaaaaacgaaaaccttcgccttccccatcctactaccgtccaacgcctaaaccgacgaccacccgaaaccccgacctccccgaacccgacgccctaacaacacaaacgcctacccaaaccaatccgaaacacacccaccgcaaaaaccccgtccaaaaaaaaactccgaaaaaaaccccgcacgcgttacgcatacctcaacacgcacgctccaatccccgaaaacgctcgtctctccacaaccgactaaaaaccgaatccctacctctaattccgcgcaacctaaacgattcacccgcacgaaacttaaaccgccgccttaaccaacgacatccgaaatcatcgacctcgaatttaactaaaacaaaccgaaaacctccccaaaatccgaaataaaaataaaaaatacgaacgccgaaaaaaaactaaaaaaccgctatatatataacacccgataaaacaactaaactaaaaacactaaacgataaaactaataaaaaccgaacta

SEQ ID NO: 493 - DNA, 807 bp, Artificial Sequence
  chemically treated genomic DNA (Homo sapiens) CpG-island No: 493
gggcgtacgcgattttttttattgcgtttagttagtagatggcggcgttaggggtcgattcgggtcggaaaaatttttggcgttgcggtattagggcgtcgggtcgttgattcgtcgattttcgtttcgtttttattttcgttttcgttttgtcggtcgttttagcgtaatttttcgtttttcgattagtttcggtttggagtacgacggcgcgttcggtagcggttgcggttttagcggatacgtgatggtttcggaacggcgtcgtttcgcgtcggtttcgtttggtttttttgtagtcgtcggtagttgttgagtttgtttaggtagcggtcgtttcgtgggaggggcgcgcgagtttttagtttagttcgttgggcgcgttagcgttatttttttttacgttcgtttttacgttcgttattgtaggttttttttttttgttttattttttttcgtttaatttagttttttcgtttaatttcgcgtttatcgttttcgttcgtggaggggcgggcgcgcgacgttttgtagttagttcgttggggcgtttcgcgttatttttttttaggttcgtttttatttttttttacgtcggtttttattcggtatttagttttttttcgggtcgtatttgtttatcgtgatttattttttcgtttaatttcgcgtttatagttcggttttatttcgttgcgtttaattttgcgtttattttttcgttttaattcgtgtatttattttttcgttttatttatttgttttattttttgtattttttttcgtgttgttttattgtgcggttat

SEQ ID NO: 494 - DNA, 807 bp, Artificial Sequence
  chemically treated genomic DNA (Homo sapiens) CpG-island No: 494
ataaccgcacaataaaacaacacgaaaaaaaatacaaaaaataaaacaaataaataaaacgaaaaaataaatacacgaattaaaacgaaaaaataaacgcaaaattaaacgcaacgaaataaaaccgaactataaacgcgaaattaaacgaaaaaataaatcacgataaacaaatacgacccgaaaaaaaactaaataccgaataaaaaccgacgtaaaaaaaaataaaaacgaacctaaaaaaaaataacgcgaaacgccccaacgaactaactacaaaacgtcgcgcgcccgcccctccacgaacgaaaacgataaacgcgaaattaaacgaaaaaactaaattaaacgaaaaaaaataaaacaaaaaaaaaaaacctacaataacgaacgtaaaaacgaacgtaaaaaaaaataacgctaacgcgcccaacgaactaaactaaaaactcgcgcgcccctcccacgaaacgaccgctacctaaacaaactcaacaactaccgacgactacaaaaaaaccaaacgaaaccgacgcgaaacgacgccgttccgaaaccatcacgtatccgctaaaaccgcaaccgctaccgaacgcgccgtcgtactccaaaccgaaactaatcgaaaaacgaaaaattacgctaaaacgaccgacaaaacgaaaacgaaaataaaaacgaaacgaaaatcgacgaatcaacgacccgacgccctaataccgcaacgccaaaaatttttccgacccgaatcgacccctaacgccgccatctactaactaaacgcaataaaaaaaatcgcgtacgccc

SEQ ID NO: 495 - DNA, 807 bp, Artificial Sequence
  chemically treated genomic DNA (Homo sapiens) CpG-island No: 495
gtggtcgtatagtgggatagtacggggggaggtgtagggggtggggtaggtgggtgggacgggggggtgggtgtacgggttgggacggaggggtgggcgtaggattgggcgtagcggggtgggatcgaattgtgggcgcggggttggacggaagaatgggttacgatggataggtacgattcgaaggagggttgaatgtcgagtggggatcgacgtagggagaggtggggacggatttagggaggggtggcgcggggcgttttagcgggttggttgtaaggcgtcgcgcgttcgtttttttacggacggaggcggtgggcgcggggttggacggaggggttgggttggacgggaggggatgggataggaaggaagggtttgtaatgacggacgtggggacggacgtagagagaggtggcgttggcgcgtttagcgggttggattggaggttcgcgcgttttttttacggggcggtcgttatttgagtaggtttagtagttgtcggcggttgtagggggattaggcgaggtcggcgcggggcggcgtcgtttcgaagttattacgtgttcgttggggtcgtagtcgttgtcgggcgcgtcgtcgtgttttaggtcgaagttggtcggggggcggggagttgcgttaaggcggtcggtagggcgggggcgggggtgggggcgggacgggggtcggcgagttagcggttcggcgttttagtgtcgtagcgttagaagttttttcgattcgggtcgatttttgacgtcgttatttgttaattgggcgtagtggagagggtcgcgtgcgttt

SEQ ID NO: 496 - DNA, 807 bp, Artificial Sequence
  chemically treated genomic DNA (Homo sapiens) CpG-island No: 496
aaacgcacgcgaccctctccactacgcccaattaacaaataacgacgtcaaaaatcgacccgaatcgaaaaaacttctaacgctacgacactaaaacgccgaaccgctaactcgccgacccccgtcccgcccccacccccgcccccgccctaccgaccgccttaacgcaactccccgccccccgaccaacttcgacctaaaacacgacgacgcgcccgacaacgactacgaccccaacgaacacgtaataacttcgaaacgacgccgccccgcgccgacctcgcctaatccccctacaaccgccgacaactactaaacctactcaaataacgaccgccccgtaaaaaaaacgcgcgaacctccaatccaacccgctaaacgcgccaacgccacctctctctacgtccgtccccacgtccgtcattacaaacccttccttcctatcccatcccctcccgtccaacccaacccctccgtccaaccccgcgcccaccgcctccgtccgtaaaaaaacgaacgcgcgacgccttacaaccaacccgctaaaacgccccgcgccacccctccctaaatccgtccccacctctccctacgtcgatccccactcgacattcaaccctccttcgaatcgtacctatccatcgtaacccattcttccgtccaaccccgcgcccacaattcgatcccaccccgctacgcccaatcctacgcccacccctccgtcccaacccgtacacccacccccccgtcccacccacctaccccaccccctacacctccccccgtactatcccactatacgaccac

SEQ ID NO: 497 - DNA, 1594 bp, Artificial Sequence
  chemically treated genomic DNA (Homo sapiens) CpG-island No: 497
ttcgggttcgggaagaggcggaggtcggcgagggggcggtgttcggggttaatttagtttttttcggtttcgagggttttcgtttcgcgtttttttcgggttttttagtcgcgtttcgggtcggcgtagcgatcgcgttcgtttttttatcggcgttcggttaggaggcgcgaggtttaaggatgcgatttacgacgcgtatattcggttcggtaggttttttgggaaatgaggggttattcgtagggtttcgtagagcgagcgtagcgtcggagttttttttattttaggtcgcgtagatcgcggaatcggcgtattagagtagtgttcgcgggcggcggcggcgcgatttaggttgaggggattttggttaatttcgcgttttttgaggtcgcgtttcggaggttcggggcgtattttttagtcgttcgttcgcgtttcggagttcggtcgttttagttagggcgtttgggtcgtcgtcgttgcgattttcgcgtttagttcgcgcgtcgggtagcgcgaacgtcgttttttcggggttttttcgttcgtcgggcgtttatttgggatatttgcggtcggaagttgatgtttttgaggtcgatggagtcgggggagaggttgtgtagtagttggtatagaaggatttcgtcgcgtagcgtttgcgttaggtcgaagattacggtcgagggttatattattcggtggttgggcggtaggattttgtaatcgatgagttagcggtcgtattgtcgttattgttttatggcgttcgcgggttcgatcggtttagggtagtgttcgagttaaagtgtagcggtcgcggggtatttcgttcgcgcgcgcgcggggtttagggtcggggcggggtttcgcgcgggttgttttaggtttttcgttgcgtcgtcgtgcgtttttttttttttttttttttatttttcgggtttttttcgggtcgtcgttttcgtttacgtgcggtcgcggggcgggtaacgggtagcgcgtcggattttttcgttttatatacgtaagtgtttgcgggtttcgggtcgggttttacgtagttagtcgtcgtagcgttttttaattcgcgtcgtcgggcgtcgtattttgcgttcggggcgtttcgcggtcgtcgcggtttttgtttcgttcgagataaaggttcggcggggtcgttcgtttcgcgcgtttcgggtttgggtcgttcgcgtcgtcgtcgttttgttcgttttattcgtagtttttacgttcggcgttgcgattcgacgattcggcggttcggcggttttacggtttcggggcgttgggggcgtagggggcgcggttacggtcgggcggggtaggggcggggtcggagtattcgtttggtattttttcgtgttttaagcgtcgttttcgtttttttattttttgtttcgttatcgttcgcgaaagttgcggtgggcgggggttgcggcgtaggtttaggttcggtcgattttttttaagggcgttcggattttggggagtttttttttttgggggagcgatttcgttcgtggagtgatggtcgggcgttttttcgggtgtttttggtttttcgtggaggtta

SEQ ID NO: 498 - DNA, 1594 bp, Artificial Sequence
  chemically treated genomic DNA (Homo sapiens) CpG-island No: 498
taacctccacgaaaaaccaaaaacacccgaaaaaacgcccgaccatcactccacgaacgaaatcgctcccccaaaaaaaaaaactccccaaaatccgaacgcccttaaaaaaaatcgaccgaacctaaacctacgccgcaacccccgcccaccgcaactttcgcgaacgataacgaaacaaaaaataaaaaaacgaaaacgacgcttaaaacacgaaaaaataccaaacgaatactccgaccccgcccctaccccgcccgaccgtaaccgcgccccctacgcccccaacgccccgaaaccgtaaaaccgccgaaccgccgaatcgtcgaatcgcaacgccgaacgtaaaaactacgaataaaacgaacaaaacgacgacgacgcgaacgacccaaacccgaaacgcgcgaaacgaacgaccccgccgaacctttatctcgaacgaaacaaaaaccgcgacgaccgcgaaacgccccgaacgcaaaatacgacgcccgacgacgcgaattaaaaaacgctacgacgactaactacgtaaaacccgacccgaaacccgcaaacacttacgtatataaaacgaaaaaatccgacgcgctacccgttacccgccccgcgaccgcacgtaaacgaaaacgacgacccgaaaaaaacccgaaaaataaaaaaaaaaaaaaaaaaaaacgcacgacgacgcaacgaaaaacctaaaacaacccgcgcgaaaccccgccccgaccctaaaccccgcgcgcgcgcgaacgaaataccccgcgaccgctacactttaactcgaacactaccctaaaccgatcgaacccgcgaacgccataaaacaataacgacaatacgaccgctaactcatcgattacaaaatcctaccgcccaaccaccgaataatataaccctcgaccgtaatcttcgacctaacgcaaacgctacgcgacgaaatccttctataccaactactacacaacctctcccccgactccatcgacctcaaaaacatcaacttccgaccgcaaatatcccaaataaacgcccgacgaacgaaaaaaccccgaaaaaacgacgttcgcgctacccgacgcgcgaactaaacgcgaaaatcgcaacgacgacgacccaaacgccctaactaaaacgaccgaactccgaaacgcgaacgaacgactaaaaaatacgccccgaacctccgaaacgcgacctcaaaaaacgcgaaattaaccaaaatcccctcaacctaaatcgcgccgccgccgcccgcgaacactactctaatacgccgattccgcgatctacgcgacctaaaataaaaaaaactccgacgctacgctcgctctacgaaaccctacgaataacccctcatttcccaaaaaacctaccgaaccgaatatacgcgtcgtaaatcgcatccttaaacctcgcgcctcctaaccgaacgccgataaaaaaacgaacgcgatcgctacgccgacccgaaacgcgactaaaaaacccgaaaaaaacgcgaaacgaaaaccctcgaaaccgaaaaaaactaaattaaccccgaacaccgccccctcgccgacctccgcctcttcccgaacccgaa

SEQ ID NO: 499 - DNA, 1594 bp, Artificial Sequence
  chemically treated genomic DNA (Homo sapiens) CpG-island No: 499
tgatttttacggaggattaaaggtattcggggggacgttcggttattattttacgggcgaggtcgtttttttagggagaagggttttttaaagttcgagcgtttttggagaaagtcggtcggatttgggtttgcgtcgtaattttcgtttatcgtaattttcgcgggcggtagcggggtaggaagtgggggggcgggggcggcgtttgggatacggggaggtgttaggcgagtgtttcggtttcgtttttgtttcgttcggtcgtggtcgcgttttttgcgtttttagcgtttcggagtcgtggagtcgtcgagtcgtcgagtcgtcgagtcgtagcgtcgggcgtggggattgcgggtggggcgaataaagcggcggcgacgcgggcggtttaggttcgggacgcgcggagcgagcgatttcgtcgggtttttgtttcgggcggggtaggagtcgcggcggtcgcggggcgtttcgagcgtagaatgcggcgttcggcggcgcggattggggagcgttgcggcgattggttgcgtggagttcggttcggggttcgtaggtatttgcgtgtgtgaagcggggagattcggcgcgttgttcgttgttcgtttcgcggtcgtacgtgggcgggagcggcggttcgagaggagttcgaggagtaggaggaggaagaggaggggacgtacggcggcgtagcgggggatttggggtagttcgcgcgaagtttcgtttcggttttgagtttcgcgcgcgcgcgggcgggatgtttcgcggtcgttgtattttggttcgagtattgttttgagtcggtcgggttcgcgggcgttatggagtagtggcggtagtgcggtcgttggtttatcgattgtaaggttttgtcgtttaattatcgggtggtgtggttttcggtcgtggttttcgatttggcgtaggcgttgcgcgacggggtttttttgtgttagttgttgtataatttttttttcggttttatcgattttaaggatattaattttcggtcgtagatgttttaggtgagcgttcggcgggcgggagggtttcggggaggcggcgttcgcgttgttcgacgcgcggattgaacgcggaggtcgtagcggcggcggtttaggcgttttggttggggcggtcgggtttcgggacgcgggcgggcggttggagggtgcgtttcgggttttcgagacgcgattttaggaggcgcgaagttggttaaagtttttttagtttgggtcgcgtcgtcgtcgttcgcgggtattgttttggtgcgtcggtttcgcggtttgcgcggtttgggatgggggaggtttcggcgttgcgttcgttttgcggggttttgcgagtggttttttattttttagggagtttgtcgagtcgggtgtgcgcgtcgtgggtcgtatttttgggtttcgcgttttttggtcggacgtcggtggaagagcgggcgcggtcgttgcgtcggttcggggcgcggttggagggttcgggaggggcgcggggcgggagttttcggggtcggagggagttgggttggtttcgggtatcgttttttcgtcggttttcgttttttttcggattcgga

SEQ ID NO: 500 - DNA, 1594 bp, Artificial Sequence
  chemically treated genomic DNA (Homo sapiens) CpG-island No: 500
tccgaatccgaaaaaaaacgaaaaccgacgaaaaaacgatacccgaaaccaacccaactccctccgaccccgaaaactcccgccccgcgcccctcccgaaccctccaaccgcgccccgaaccgacgcaacgaccgcgcccgctcttccaccgacgtccgaccaaaaaacgcgaaacccaaaaatacgacccacgacgcgcacacccgactcgacaaactccctaaaaaataaaaaaccactcgcaaaaccccgcaaaacgaacgcaacgccgaaacctcccccatcccaaaccgcgcaaaccgcgaaaccgacgcaccaaaacaatacccgcgaacgacgacgacgcgacccaaactaaaaaaactttaaccaacttcgcgcctcctaaaatcgcgtctcgaaaacccgaaacgcaccctccaaccgcccgcccgcgtcccgaaacccgaccgccccaaccaaaacgcctaaaccgccgccgctacgacctccgcgttcaatccgcgcgtcgaacaacgcgaacgccgcctccccgaaaccctcccgcccgccgaacgctcacctaaaacatctacgaccgaaaattaatatccttaaaatcgataaaaccgaaaaaaaaattatacaacaactaacacaaaaaaaccccgtcgcgcaacgcctacgccaaatcgaaaaccacgaccgaaaaccacaccacccgataattaaacgacaaaaccttacaatcgataaaccaacgaccgcactaccgccactactccataacgcccgcgaacccgaccgactcaaaacaatactcgaaccaaaatacaacgaccgcgaaacatcccgcccgcgcgcgcgcgaaactcaaaaccgaaacgaaacttcgcgcgaactaccccaaatcccccgctacgccgccgtacgtcccctcctcttcctcctcctactcctcgaactcctctcgaaccgccgctcccgcccacgtacgaccgcgaaacgaacaacgaacaacgcgccgaatctccccgcttcacacacgcaaatacctacgaaccccgaaccgaactccacgcaaccaatcgccgcaacgctccccaatccgcgccgccgaacgccgcattctacgctcgaaacgccccgcgaccgccgcgactcctaccccgcccgaaacaaaaacccgacgaaatcgctcgctccgcgcgtcccgaacctaaaccgcccgcgtcgccgccgctttattcgccccacccgcaatccccacgcccgacgctacgactcgacgactcgacgactcgacgactccacgactccgaaacgctaaaaacgcaaaaaacgcgaccacgaccgaacgaaacaaaaacgaaaccgaaacactcgcctaacacctccccgtatcccaaacgccgcccccgcccccccacttcctaccccgctaccgcccgcgaaaattacgataaacgaaaattacgacgcaaacccaaatccgaccgactttctccaaaaacgctcgaactttaaaaaacccttctccctaaaaaaacgacctcgcccgtaaaataataaccgaacgtccccccgaatacctttaatcctccgtaaaaatca

SEQ ID NO: 501 - DNA, 503 bp, Artificial Sequence
  chemically treated genomic DNA (Homo sapiens) CpG-island No: 501
tttgggttcgtcgtatacgtttgtttagtttttgcgttcggttcgttaggtttgcggcgttgttatggagatacggtttagcggtcgtcggtttcgttttgggagtttcgtagtgcgtcgcgtcgttgttcgtattttcgaggttcgcgacgagcggtgattggggcgggcgacgtgggggattcggggatgcgggtagacgatagggggttggaggatggggcgatttagagcgcgcggggtttggggcgcggggatgggggtcgcgggttacgcgacggggattttagggtgcgcgtaggtggcggggacgcgcgatgggggttcgggaagttgaggttgatttagcgtaggtattttaggaggggaggtttttgacgttgcgtagttgggaaggcgttcgggagtgggttgcgatgtttttttgtttgtttttttttgatatcgtttttgtttgggtttaggggttttacgggagttggatgttcggagtagtaaggcgg

SEQ ID NO: 502 - DNA, 503 bp, Artificial Sequence
  chemically treated genomic DNA (Homo sapiens) CpG-island No: 502
ccgccttactactccgaacatccaactcccgtaaaacccctaaacccaaacaaaaacgatatcaaaaaaaaacaaacaaaaaaacatcgcaacccactcccgaacgccttcccaactacgcaacgtcaaaaacctcccctcctaaaatacctacgctaaatcaacctcaacttcccgaacccccatcgcgcgtccccgccacctacgcgcaccctaaaatccccgtcgcgtaacccgcgacccccatccccgcgccccaaaccccgcgcgctctaaatcgccccatcctccaaccccctatcgtctacccgcatccccgaatcccccacgtcgcccgccccaatcaccgctcgtcgcgaacctcgaaaatacgaacaacgacgcgacgcactacgaaactcccaaaacgaaaccgacgaccgctaaaccgtatctccataacaacgccgcaaacctaacgaaccgaacgcaaaaactaaacaaacgtatacgacgaacccaaa

SEQ ID NO: 503 - DNA, 503 bp, Artificial Sequence
  chemically treated genomic DNA (Homo sapiens) CpG-island No: 503
tcgttttgttgtttcgagtatttagttttcgtgaggtttttggatttaaataaaaacgatgttaggagaaaataaatagggaagtatcgtaatttattttcgaacgtttttttagttgcgtagcgttagggatttttttttttgggatgtttgcgttaggttagttttagtttttcgggtttttatcgcgcgttttcgttatttgcgcgtattttggggttttcgtcgcgtggttcgcggtttttattttcgcgttttagatttcgcgcgttttgggtcgttttattttttagttttttatcgtttgttcgtattttcgggttttttacgtcgttcgttttagttatcgttcgtcgcgggtttcggagatgcgggtagcggcgcgacgtattgcggggtttttagggcggggtcggcggtcgttgggtcgtgtttttatggtagcgtcgtaggtttggcgagtcgagcgtagaggttgggtaggcgtgtgcgacgagtttaag

SEQ ID NO: 504 - DNA, 503 bp, Artificial Sequence
  chemically treated genomic DNA (Homo sapiens) CpG-island No: 504
cttaaactcgtcgcacacgcctacccaacctctacgctcgactcgccaaacctacgacgctaccataaaaacacgacccaacgaccgccgaccccgccctaaaaaccccgcaatacgtcgcgccgctacccgcatctccgaaacccgcgacgaacgataactaaaacgaacgacgtaaaaaacccgaaaatacgaacaaacgataaaaaactaaaaaataaaacgacccaaaacgcgcgaaatctaaaacgcgaaaataaaaaccgcgaaccacgcgacgaaaaccccaaaatacgcgcaaataacgaaaacgcgcgataaaaacccgaaaaactaaaactaacctaacgcaaacatcccaaaaaaaaaaatccctaacgctacgcaactaaaaaaacgttcgaaaataaattacgatacttccctatttattttctcctaacatcgtttttatttaaatccaaaaacctcacgaaaactaaatactcgaaacaacaaaacga

SEQ ID NO: 505 - DNA, 844 bp, Artificial Sequence
  chemically treated genomic DNA (Homo sapiens) CpG-island No: 505
gtggtcgttcggtttcggcgttttggggcgggggttttttttcggagggtcggtttcgtcgggtgtgcggttgcgggcggggaagggattgtttttgtagtcgggacgggattttgcgcgcggtcgggtgtcgggcggggggcgtagaggggtggtttcggggatcgcgcgggggtagcgggtgtgcgggtgtttggagcgcggttggagtggcggtgacggttttggtcgtcgtcgttatcgtcgttttgttggtgcggtcgttttttgattatgtgtagcggtagtcgtcgttcggagtcgggagttcgcgagcgttttagttcgggtcggcgttttcgttagtattcgcggtaggagacgaggagtcgcggtaggcgttgttttgagtcgggagtgaacggttgcgcggttgttgggagggtgaatgaagttaggaggaggaggaggagcggcggtcgtcgcggaggaggcgttgcggggattgggatgcgttttggagttttattgttcgtttattttgggtcgggtcggagattttgttattttcgggggcgtcgtcgtttttttttacgtggttttagtgttgcgcgtaggtcggtttcgtagggggtagggaagggggtcggacgggcggagcgagaggtgaggcggtgtcggagcgcggcgtgagtgtgagtgagtgtgtgagtgattgtgtgtgtgtatttgtgcgcgcgcgcgtcgggcggggggcgagggtcgtcgcgacgcggagggggtttttttttggttatttggttgattttgtagcgtttcgatttttttttagtttttcgtttttaggttgtttttttaaatttcg

SEQ ID NO: 506 - DNA, 844 bp, Artificial Sequence
  chemically treated genomic DNA (Homo sapiens) CpG-island No: 506
cgaaatttaaaaaaacaacctaaaaacgaaaaactaaaaaaaaatcgaaacgctacaaaatcaaccaaataaccaaaaaaaaaccccctccgcgtcgcgacgaccctcgccccccgcccgacgcgcgcgcgcacaaatacacacacacaatcactcacacactcactcacactcacgccgcgctccgacaccgcctcacctctcgctccgcccgtccgacccccttccctaccccctacgaaaccgacctacgcgcaacactaaaaccacgtaaaaaaaaacgacgacgcccccgaaaataacaaaatctccgacccgacccaaaataaacgaacaataaaactccaaaacgcatcccaatccccgcaacgcctcctccgcgacgaccgccgctcctcctcctcctcctaacttcattcaccctcccaacaaccgcgcaaccgttcactcccgactcaaaacaacgcctaccgcgactcctcgtctcctaccgcgaatactaacgaaaacgccgacccgaactaaaacgctcgcgaactcccgactccgaacgacgactaccgctacacataatcaaaaaacgaccgcaccaacaaaacgacgataacgacgacgaccaaaaccgtcaccgccactccaaccgcgctccaaacacccgcacacccgctacccccgcgcgatccccgaaaccacccctctacgccccccgcccgacacccgaccgcgcgcaaaatcccgtcccgactacaaaaacaatcccttccccgcccgcaaccgcacacccgacgaaaccgaccctccgaaaaaaaacccccgccccaaaacgccgaaaccgaacgaccac

SEQ ID NO: 507 - DNA, 844 bp, Artificial Sequence
  chemically treated genomic DNA (Homo sapiens) CpG-island No: 507
cggagtttaagaaggtagtttgaaggcggggggttgaagaggggtcggggcgttgtagagttagttaagtagttaaggaagggtttttttcgcgtcgcgacggttttcgtttttcgttcggcgcgcgcgcgtataaatatatatatatagttatttatatatttatttatatttacgtcgcgtttcgatatcgttttatttttcgtttcgttcgttcggtttttttttttgttttttgcgggatcggtttgcgcgtagtattggaattacgtaggaggaggcggcggcgttttcgggagtggtagagttttcggttcggtttagagtgaacgagtagtggggttttagggcgtattttaattttcgtagcgtttttttcgcggcggtcgtcgtttttttttttttttttggttttatttatttttttagtagtcgcgtagtcgtttattttcggtttagggtagcgtttgtcgcggtttttcgttttttgtcgcgggtgttggcgggggcgtcggttcggattggggcgttcgcgggttttcggtttcgggcggcggttgtcgttgtatatgattaggaagcggtcgtattaatagggcggcggtggcggcggcggttagggtcgttatcgttattttagtcgcgttttaggtattcgtatattcgttattttcgcgcggttttcgaggttatttttttgcgtttttcgttcggtattcggtcgcgcgtaaagtttcgtttcggttgtaggagtagtttttttttcgttcgtagtcgtatattcggcgaggtcggtttttcgaggggagattttcgttttagggcgtcgaggtcgggcgattat

SEQ ID NO: 508 - DNA, 844 bp, Artificial Sequence
  chemically treated genomic DNA (Homo sapiens) CpG-island No: 508
ataatcgcccgacctcgacgccctaaaacgaaaatctcccctcgaaaaaccgacctcgccgaatatacgactacgaacgaaaaaaaaactactcctacaaccgaaacgaaactttacgcgcgaccgaataccgaacgaaaaacgcaaaaaaataacctcgaaaaccgcgcgaaaataacgaatatacgaatacctaaaacgcgactaaaataacgataacgaccctaaccgccgccgccaccgccgccctattaatacgaccgcttcctaatcatatacaacgacaaccgccgcccgaaaccgaaaacccgcgaacgccccaatccgaaccgacgcccccgccaacacccgcgacaaaaaacgaaaaaccgcgacaaacgctaccctaaaccgaaaataaacgactacgcgactactaaaaaaataaataaaaccaaaaaaaaaaaaaaaaacgacgaccgccgcgaaaaaaacgctacgaaaattaaaatacgccctaaaaccccactactcgttcactctaaaccgaaccgaaaactctaccactcccgaaaacgccgccgcctcctcctacgtaattccaatactacgcgcaaaccgatcccgcaaaaaacaaaaaaaaaaaccgaacgaacgaaacgaaaaataaaacgatatcgaaacgcgacgtaaatataaataaatatataaataactatatatatatatttatacgcgcgcgcgccgaacgaaaaacgaaaaccgtcgcgacgcgaaaaaaacccttccttaactacttaactaactctacaacgccccgacccctcttcaaccccccgccttcaaactaccttcttaaactccg

SEQ ID NO: 509 - DNA, 512 bp, Artificial Sequence
  chemically treated genomic DNA (Homo sapiens) CpG-island No: 509
gcgcgcgcggagtttggttagatcgcgtatttagcgttgcgtttttttagtcgtgggcgtcgttaggtttaggtttttgcggcggtttttgaaggcgatggtgaggtagcgcgttggcgcgaaggtattttcgaagcgtcgtaggttttcggattggtggttttcgcggatcgtttcgatgtgttgtacgaagattgagaggagggtcgggttagggcggaggatcgggtttgtttttatttttttgttcgttcggcgtttttcggttttttatagatgtgttgcgatggcgtacgcgggatgcgtcgttggaattatacgtttaggtcgtttttttgtagtcggtatagtcgttttttgtgttacgtgcgcgagcggattttgcggagtcgggagtttcgtagtatggcgcgtacgttttcgtttttcgttaggtttggcggggcgggaggattcggggcgttaggtcgtatttgtttagaggtttttttgttttttttcgttaggatttg

SEQ ID NO: 510 - DNA, 512 bp, Artificial Sequence
  chemically treated genomic DNA (Homo sapiens) CpG-island No: 510
caaatcctaacgaaaaaaaacaaaaaaacctctaaacaaatacgacctaacgccccgaatcctcccgccccgccaaacctaacgaaaaacgaaaacgtacgcgccatactacgaaactcccgactccgcaaaatccgctcgcgcacgtaacacaaaaaacgactataccgactacaaaaaaacgacctaaacgtataattccaacgacgcatcccgcgtacgccatcgcaacacatctataaaaaaccgaaaaacgccgaacgaacaaaaaaataaaaacaaacccgatcctccgccctaacccgaccctcctctcaatcttcgtacaacacatcgaaacgatccgcgaaaaccaccaatccgaaaacctacgacgcttcgaaaataccttcgcgccaacgcgctacctcaccatcgccttcaaaaaccgccgcaaaaacctaaacctaacgacgcccacgactaaaaaaacgcaacgctaaatacgcgatctaaccaaactccgcgcgcgc

SEQ ID NO: 511 - DNA, 512 bp, Artificial Sequence
  chemically treated genomic DNA (Homo sapiens) CpG-island No: 511
taggttttagcgggggagggtaggggagtttttgggtaggtacggtttgacgtttcgggttttttcgtttcgttaggtttgacggaggacgaggacgtgcgcgttatgttgcggggttttcggtttcgtaagattcgttcgcgtacgtggtataaggagcggttgtatcggttgtaggaggacggtttgagcgtgtggttttagcggcgtatttcgcgtgcgttatcgtagtatatttgtgagaggtcggggagcgtcgggcggatagggaggtggggataggttcggtttttcgttttgattcggttttttttttagttttcgtgtagtatatcgaggcggttcgcgagggttattagttcgagggtttgcggcgtttcgggggtgttttcgcgttagcgcgttgttttattatcgtttttaagggtcgtcgtaagaatttggatttggcggcgtttacggttgaggaagcgtagcgttgggtgcgcggtttgattaagtttcgcgcgcgt

SEQ ID NO: 512 - DNA, 512 bp, Artificial Sequence
  chemically treated genomic DNA (Homo sapiens) CpG-island No: 512
acgcgcgcgaaacttaatcaaaccgcgcacccaacgctacgcttcctcaaccgtaaacgccgccaaatccaaattcttacgacgacccttaaaaacgataataaaacaacgcgctaacgcgaaaacacccccgaaacgccgcaaaccctcgaactaataaccctcgcgaaccgcctcgatatactacacgaaaactaaaaaaaaaaccgaatcaaaacgaaaaaccgaacctatccccacctccctatccgcccgacgctccccgacctctcacaaatatactacgataacgcacgcgaaatacgccgctaaaaccacacgctcaaaccgtcctcctacaaccgatacaaccgctccttataccacgtacgcgaacgaatcttacgaaaccgaaaaccccgcaacataacgcgcacgtcctcgtcctccgtcaaacctaacgaaacgaaaaaacccgaaacgtcaaaccgtacctacccaaaaactcccctaccctcccccgctaaaaccta

SEQ ID NO: 513 - DNA, 1017 bp, Artificial Sequence
  chemically treated genomic DNA (Homo sapiens) CpG-island No: 513
  misc_feature (163)..(163): n is either a, c, g or t
  misc_feature (181)..(181): n is either a, c, g or t
  misc_feature (237)..(237): n is either a, c, g or t
  misc_feature (295)..(295): n is either a, c, g or t
  misc_feature (422)..(422): n is either a, c, g or t
  misc_feature (606)..(606): n is either a, c, g or t
  misc_feature (634)..(634): n is either a, c, g or t
  misc_feature (636)..(636): n is either a, c, g or t
  misc_feature (649)..(649): n is either a, c, g or t
  misc_feature (662)..(662): n is either a, c, g or t
  misc_feature (835)..(835): n is either a, c, g or t
  misc_feature (854)..(854): n is either a, c, g or t
  misc_feature (992)..(992): n is either a, c, g or t
ttttcgtcggttttcggattattttttttggaaggaagttttttcgtttttttttttttttttcgttttcgtttcgttggtgtggttgtaggttcgagttggggttattcggcggttagtgtgcgtaggttttttggtcgtcggttagagggcgaaagtattntattcgaggttttttatnttcgcggttgttttggttgcgagtaacgagggaagaggaggtaggcgttttaaaanttgggcgaagatttttattttaatttttaattcgagttttttatcgttagtgcgtttnaatggcgttgttggtcggatggataatcgagttttttggagggatagacgcggtcgttatttttaataaatcgtgaataacgaatgagggaatcgattatttttatgaggtttacgggcgtttagtnaacgtagtatcgattcgttttttcggcgtcggttttatcgttattttcggcgtttttaagttttttttttcgttttttttttttttgtcggagttattgcggatcggagttttagcgttaggtggagtcggggcgttagtgggagtcgggtttagtcgttttggcgttcgttcgattttttcgnttcgcgcggtttagggaggcgtataggntnagcgttaggtagnggcgcgagcgaanaaatgcgggaattagcgttaggtaggagaaaaggcgcgggtttattttatagttcggcgtttcgttttttagtttagtgtggtcgttcgttttcggtcggattattgtgttttagattcggagtttgagtttttatttttagcgggttttcgtttttttttgttcgagttatntcgggggcgtagttttcgnttagagttattcgattttttcgcggcgaggttttttattcggttttatttcgtatttttatttttttttcgcgattgttttttgttaggcgtttaggttggattttggtgcgtcgtttttttgggttagcgtttttgntcgtcgagggggtaaggggagtggg

SEQ ID NO: 514 - DNA, 1017 bp, Artificial Sequence
  chemically treated genomic DNA (Homo sapiens) CpG-island No: 514
  misc_feature (26)..(26): n is either a, c, g or t
  misc_feature (164)..(164): n is either a, c, g or t
  misc_feature (183)..(183): n is either a, c, g or t
  misc_feature (356)..(356): n is either a, c, g or t
  misc_feature (369)..(369): n is either a, c, g or t
  misc_feature (382)..(382): n is either a, c, g or t
  misc_feature (384)..(384): n is either a, c, g or t
  misc_feature (412)..(412): n is either a, c, g or t
  misc_feature (596)..(596): n is either a, c, g or t
  misc_feature (723)..(723): n is either a, c, g or t
  misc_feature (781)..(781): n is either a, c, g or t
  misc_feature (837)..(837): n is either a, c, g or t
  misc_feature (855)..(855): n is either a, c, g or t
cccactccccttaccccctcgacgancaaaaacgctaacccaaaaaaacgacgcaccaaaatccaacctaaacgcctaacaaaaaacaatcgcgaaaaaaaaataaaaatacgaaataaaaccgaataaaaaacctcgccgcgaaaaaatcgaataactctaancgaaaactacgcccccganataactcgaacaaaaaaaaacgaaaacccgctaaaaataaaaactcaaactccgaatctaaaacacaataatccgaccgaaaacgaacgaccacactaaactaaaaaacgaaacgccgaactataaaataaacccgcgccttttctcctacctaacgctaattcccgcatttnttcgctcgcgccnctacctaacgctnancctatacgcctccctaaaccgcgcgaancgaaaaaatcgaacgaacgccaaaacgactaaacccgactcccactaacgccccgactccacctaacgctaaaactccgatccgcaataactccgacaaaaaaaaaaaaaacgaaaaaaaaaacttaaaaacgccgaaaataacgataaaaccgacgccgaaaaaacgaatcgatactacgttnactaaacgcccgtaaacctcataaaaataatcgattccctcattcgttattcacgatttattaaaaataacgaccgcgtctatccctccaaaaaactcgattatccatccgaccaacaacgccattnaaacgcactaacgataaaaaactcgaattaaaaattaaaataaaaatcttcgcccaanttttaaaacgcctacctcctcttccctcgttactcgcaaccaaaacaaccgcgaanataaaaaacctcgaatanaatactttcgccctctaaccgacgaccaaaaaacctacgcacactaaccgccgaataaccccaactcgaacctacaaccacaccaacgaaacgaaaacgaaaaaaaaaaaaaaaaacgaaaaaacttccttccaaaaaaaataatccgaaaaccgacgaaaa

SEQ ID NO: 515 - DNA, 1017 bp, Artificial Sequence
  chemically treated genomic DNA (Homo sapiens) CpG-island No: 515
  misc_feature (26)..(26): n is either a, c, g or t
  misc_feature (164)..(164): n is either a, c, g or t
  misc_feature (183)..(183): n is either a, c, g or t
  misc_feature (356)..(356): n is either a, c, g or t
  misc_feature (369)..(369): n is either a, c, g or t
  misc_feature (382)..(382): n is either a, c, g or t
  misc_feature (384)..(384): n is either a, c, g or t
  misc_feature (412)..(412): n is either a, c, g or t
  misc_feature (596)..(596): n is either a, c, g or t
  misc_feature (723)..(723): n is either a, c, g or t
  misc_feature (781)..(781): n is either a, c, g or t
  misc_feature (837)..(837): n is either a, c, g or t
  misc_feature (855)..(855): n is either a, c, g or t
tttattttttttgttttttcggcggntaggggcgttggtttagaaaagcggcgtattaggatttagtttgggcgtttggtagggagtaatcgcgagaggggagtggaggtgcggggtgaggtcgggtggggggtttcgtcgcggggggatcgggtagttttggncggaggttgcgttttcggngtggttcgggtagagaagaacggaggttcgttgaggatgggaatttaggtttcgggtttgggatataataattcggtcgaaggcgagcggttatattggattaggaaacgaggcgtcgggttgtaaggtgggttcgcgtttttttttttgtttggcgttgattttcgtatttnttcgttcgcgttnttgtttggcgttngntttgtgcgtttttttgggtcgcgcgggncgggagagtcgggcgagcgttaagacggttgggttcgatttttattggcgtttcggttttatttggcgttggggtttcggttcgtagtggtttcggtaggaggggagagaacgaggagggaggtttggaaacgtcgggagtagcggtgaggtcgacgtcggggaagcgaatcgatattgcgttnattggacgttcgtgggttttatgaggatggtcgatttttttattcgttatttacgatttattagggatggcggtcgcgtttgtttttttagagagttcgattatttattcggttagtagcgttattnaagcgtattgacggtgggaggttcgagttagaaattaggataggaattttcgtttagnttttggagcgtttgtttttttttttttcgttgttcgtagttaaggtagtcgcgaangtggggggtttcgggtgnaatgttttcgttttttggtcggcgattaggagatttgcgtatattggtcgtcgagtgattttagttcgagtttgtagttatattagcgggacgggggcggggaggaagaggaagggcggagagatttttttttagagggagtggttcgagaatcggcgggag

SEQ ID NO: 516 - DNA, 1017 bp, Artificial Sequence
  chemically treated genomic DNA (Homo sapiens) CpG-island No: 516
  misc_feature (163)..(163): n is either a, c, g or t
  misc_feature (181)..(181): n is either a, c, g or t
  misc_feature (237)..(237): n is either a, c, g or t
  misc_feature (295)..(295): n is either a, c, g or t
  misc_feature (422)..(422): n is either a, c, g or t
  misc_feature (606)..(606): n is either a, c, g or t
  misc_feature (634)..(634): n is either a, c, g or t
  misc_feature (636)..(636): n is either a, c, g or t
  misc_feature (649)..(649): n is either a, c, g or t
  misc_feature (662)..(662): n is either a, c, g or t
  misc_feature (835)..(835): n is either a, c, g or t
  misc_feature (854)..(854): n is either a, c, g or t
  misc_feature (992)..(992): n is either a, c, g or t
ctcccgccgattctcgaaccactccctctaaaaaaaaatctctccgcccttcctcttcctccccgcccccgtcccgctaatataactacaaactcgaactaaaatcactcgacgaccaatatacgcaaatctcctaatcgccgaccaaaaaacgaaaacattncacccgaaaccccccacnttcgcgactaccttaactacgaacaacgaaaaaaaaaaaaacaaacgctccaaaanctaaacgaaaattcctatcctaatttctaactcgaacctcccaccgtcaatacgcttnaataacgctactaaccgaataaataatcgaactctctaaaaaaacaaacgcgaccgccatccctaataaatcgtaaataacgaataaaaaaatcgaccatcctcataaaacccacgaacgtccaatnaacgcaatatcgattcgcttccccgacgtcgacctcaccgctactcccgacgtttccaaacctccctcctcgttctctcccctcctaccgaaaccactacgaaccgaaaccccaacgccaaataaaaccgaaacgccaataaaaatcgaacccaaccgtcttaacgctcgcccgactctcccgncccgcgcgacccaaaaaaacgcacaaancnaacgccaaacaanaacgcgaacgaanaaatacgaaaatcaacgccaaacaaaaaaaaaaacgcgaacccaccttacaacccgacgcctcgtttcctaatccaatataaccgctcgccttcgaccgaattattatatcccaaacccgaaacctaaattcccatcctcaacgaacctccgttcttctctacccgaaccacnccgaaaacgcaacctccgnccaaaactacccgatccccccgcgacgaaaccccccacccgacctcaccccgcacctccactcccctctcgcgattactccctaccaaacgcccaaactaaatcctaatacgccgcttttctaaaccaacgcccctanccgccgaaaaaacaaaaaaaataaa

SEQ ID NO: 517 - DNA, 570 bp, Artificial Sequence
  chemically treated genomic DNA (Homo sapiens) CpG-island No: 517
  misc_feature (21)..(21): n is either a, c, g or t
  misc_feature (173)..(173): n is either a, c, g or t
  misc_feature (191)..(191): n is either a, c, g or t
  misc_feature (212)..(212): n is either a, c, g or t
  misc_feature (307)..(307): n is either a, c, g or t
  misc_feature (329)..(329): n is either a, c, g or t
  misc_feature (426)..(426): n is either a, c, g or t
  misc_feature (435)..(435): n is either a, c, g or t
tcgggcgtcggcgtagttttntttttcgagtttgggtttgtttaatggtttagagggagaggtcgtattttcgatttttggtatttgcgaaattaagcgttcggtcggttggtagaaacgaaattttaatattttttagtttttttcgtttggttttcggaatcggcgagttnaggtttcgcggaaatttngttcggcggtagtcgtttagnggtttcgggatcgttttgatcgtagttcgtagtttcgggtcgggaggtgcgggtcggcgcggtcgggttcgagtaagttagcgtacgcgtttttntcgtttcgttcggtttcggcgngcgtcgcggcggttttataatttttttttggtttcggggacgggcggggcggggcgagcgggcggaaataattttttgtttggtcgtttttgttttnagttttttncgtcgcgggacgcgcgagacgggagaaggtgcgggaagcgggaagtaggagcgggagcgcgcggttttggtacgtatagggcggcggagagggtacgagtagggattgagtatttattgtgtgtttttacgtttt

SEQ ID NO: 518 - DNA, 570 bp, Artificial Sequence
  chemically treated genomic DNA (Homo sapiens) CpG-island No: 518
  misc_feature (136)..(136): n is either a, c, g or t
  misc_feature (145)..(145): n is either a, c, g or t
  misc_feature (242)..(242): n is either a, c, g or t
  misc_feature (264)..(264): n is either a, c, g or t
  misc_feature (359)..(359): n is either a, c, g or t
  misc_feature (380)..(380): n is either a, c, g or t
  misc_feature (398)..(398): n is either a, c, g or t
  misc_feature (550)..(550): n is either a, c, g or t
aaaacgtaaaaacacacaataaatactcaatccctactcgtaccctctccgccgccctatacgtaccaaaaccgcgcgctcccgctcctacttcccgcttcccgcaccttctcccgtctcgcgcgtcccgcgacgnaaaaaactnaaaacaaaaacgaccaaacaaaaaattatttccgcccgctcgccccgccccgcccgtccccgaaaccaaaaaaaaattataaaaccgccgcgacgcncgccgaaaccgaacgaaacganaaaaacgcgtacgctaacttactcgaacccgaccgcgccgacccgcacctcccgacccgaaactacgaactacgatcaaaacgatcccgaaaccnctaaacgactaccgccgaacnaaatttccgcgaaacctnaactcgccgattccgaaaaccaaacgaaaaaaactaaaaaatattaaaatttcgtttctaccaaccgaccgaacgcttaatttcgcaaataccaaaaatcgaaaatacgacctctccctctaaaccattaaacaaacccaaactcgaaaaanaaaactacgccgacgcccga

SEQ ID NO: 519 - DNA, 570 bp, Artificial Sequence
  chemically treated genomic DNA (Homo sapiens) CpG-island No: 519
  misc_feature (136)..(136): n is either a, c, g or t
  misc_feature (145)..(145): n is either a, c, g or t
  misc_feature (242)..(242): n is either a, c, g or t
  misc_feature (264)..(264): n is either a, c, g or t
  misc_feature (359)..(359): n is either a, c, g or t
  misc_feature (380)..(380): n is either a, c, g or t
  misc_feature (398)..(398): n is either a, c, g or t
  misc_feature (550)..(550): n is either a, c, g or t
aaagcgtgaaggtatatagtaggtgtttaatttttgttcgtgtttttttcgtcgttttatgcgtgttagggtcgcgcgttttcgtttttgtttttcgtttttcgtattttttttcgtttcgcgcgtttcgcggcgnaagggattnggggtagagacgattaaatagaaaattattttcgttcgttcgtttcgtttcgttcgttttcggagttagaaggggattgtggggtcgtcgcggcgtncgtcggagtcgagcggggcggnaaaggcgcgtgcgttggtttgttcgggttcgatcgcgtcggttcgtatttttcggttcggagttgcgggttgcggttagggcgatttcggggttnttaggcggttgtcgtcgggtnaagttttcgcgaagtttnggttcgtcggtttcgggaattaagcgggggaggttggagggtgttgaggtttcgtttttgttagtcgatcgggcgtttggtttcgtaggtgttaggggtcgggggtgcgatttttttttttgggttattagatagatttaggttcggggaangaggttgcgtcgacgttcga

SEQ ID NO: 520 - DNA, 570 bp, Artificial Sequence
  chemically treated genomic DNA (Homo sapiens) CpG-island No: 520
  misc_feature (21)..(21): n is either a, c, g or t
  misc_feature (173)..(173): n is either a, c, g or t
  misc_feature (191)..(191): n is either a, c, g or t
  misc_feature (212)..(212): n is either a, c, g or t
  misc_feature (307)..(307): n is either a, c, g or t
  misc_feature (329)..(329): n is either a, c, g or t
  misc_feature (426)..(426): n is either a, c, g or t
  misc_feature (435)..(435): n is either a, c, g or t
tcgaacgtcgacgcaacctcnttccccgaacctaaatctatctaataacccaaaaaaaaaaatcgcacccccgacccctaacacctacgaaaccaaacgcccgatcgactaacaaaaacgaaacctcaacaccctccaacctcccccgcttaattcccgaaaccgacgaaccnaaacttcgcgaaaacttnacccgacgacaaccgcctaanaaccccgaaatcgccctaaccgcaacccgcaactccgaaccgaaaaatacgaaccgacgcgatcgaacccgaacaaaccaacgcacgcgcctttnccgccccgctcgactccgacgnacgccgcgacgaccccacaatccccttctaactccgaaaacgaacgaaacgaaacgaacgaacgaaaataattttctatttaatcgtctctaccccnaatcccttncgccgcgaaacgcgcgaaacgaaaaaaaatacgaaaaacgaaaaacaaaaacgaaaacgcgcgaccctaacacgcataaaacgacgaaaaaaacacgaacaaaaattaaacacctactatataccttcacgcttt

SEQ ID NO: 521 - DNA, 577 bp, Artificial Sequence
  chemically treated genomic DNA (Homo sapiens) CpG-island No: 521
  misc_feature (257)..(257): n is either a, c, g or t
  misc_feature (282)..(282): n is either a, c, g or t
  misc_feature (284)..(284): n is either a, c, g or t
  misc_feature (480)..(480): n is either a, c, g or t
  misc_feature (515)..(515): n is either a, c, g or t
  misc_feature (559)..(559): n is either a, c, g or t
cgggagtgcgggtagagggagggttcgggagcgacgatttagagtcgtgaaacgaaaaagaaagtaggtaaagtagtacggagcgaaagagcgaaaagttttttattaagttaggttttgttttttgaatttaagattttattcggcggttggcggcgggcgggtcgggagcgagcgagcggaggcgcgcggttatggttgtcgcggtcgggtaggggggtcgggggggcggcgcgtgagcgggtggcgcggggcgngcgtaagagggcgggcgttcgcgantngtgttattcggcgtttttttcgtcgggttcgggttacgcggcggcggggcggttttaggagtcgggcgagcggcgcggagggggcgagttcggcgtgcgagttttattgttgtgggggggattcgtcggggtatgagggcgagagtatagcggggggggcggttagatagagcgagcgaggaggaggaggaggagnacgcggaggaggaggaaggaggaggtaaagaaaanaagcggcggcggcggagggagaggaggagggggagaggaggggngggtttttcgtttttttt

SEQ ID NO: 522 - DNA, 577 bp, Artificial Sequence
  chemically treated genomic DNA (Homo sapiens) CpG-island No: 522
  misc_feature (19)..(19): n is either a, c, g or t
  misc_feature (63)..(63): n is either a, c, g or t
  misc_feature (98)..(98): n is either a, c, g or t
  misc_feature (294)..(294): n is either a, c, g or t
  misc_feature (296)..(296): n is either a, c, g or t
  misc_feature (321)..(321): n is either a, c, g or t
aaaaaaaacgaaaaacccncccctcctctccccctcctcctctccctccgccgccgccgcttnttttctttacctcctccttcctcctcctccgcgtnctcctcctcctcctcctcgctcgctctatctaaccgccccccccgctatactctcgccctcataccccgacgaatcccccccacaacaataaaactcgcacgccgaactcgccccctccgcgccgctcgcccgactcctaaaaccgccccgccgccgcgtaacccgaacccgacgaaaaaaacgccgaataacacnantcgcgaacgcccgccctcttacgcncgccccgcgccacccgctcacgcgccgcccccccgacccccctacccgaccgcgacaaccataaccgcgcgcctccgctcgctcgctcccgacccgcccgccgccaaccgccgaataaaatcttaaattcaaaaaacaaaacctaacttaataaaaaacttttcgctctttcgctccgtactactttacctactttctttttcgtttcacgactctaaatcgtcgctcccgaaccctccctctacccgcactcccg

SEQ ID NO: 523 - DNA, 577 bp, Artificial Sequence
  chemically treated genomic DNA (Homo sapiens) CpG-island No: 523
  misc_feature (19)..(19): n is either a, c, g or t
  misc_feature (63)..(63): n is either a, c, g or t
  misc_feature (98)..(98): n is either a, c, g or t
  misc_feature (294)..(294): n is either a, c, g or t
  misc_feature (296)..(296): n is either a, c, g or t
  misc_feature (321)..(321): n is either a, c, g or t
ggagggagcggggggtttntttttttttttttttttttttttttttttcgtcgtcgtcgtttnttttttttgttttttttttttttttttttcgcgtntttttttttttttttttcgttcgttttgtttggtcgtttttttcgttgtgttttcgtttttatgtttcgacgggttttttttataataatgagattcgtacgtcgggttcgtttttttcgcgtcgttcgttcggtttttagggtcgtttcgtcgtcgcgtagttcgagttcggcgggggaggcgtcgagtggtatnantcgcgggcgttcgtttttttgcgtncgtttcgcgttattcgtttacgcgtcgttttttcggtttttttgttcggtcgcggtagttatggtcgcgcgttttcgttcgttcgttttcggttcgttcgtcgttagtcgtcgggtaaagttttaggtttagggaataaagtttggtttggtagggagtttttcgttttttcgtttcgtgttgttttgtttgttttttttttcgttttacggttttgggtcgtcgttttcgagttttttttttgttcgtattttcg

SEQ ID NO: 524 - DNA, 577 bp, Artificial Sequence
  chemically treated genomic DNA (Homo sapiens) CpG-island No: 524
  misc_feature (257)..(257): n is either a, c, g or t
  misc_feature (282)..(282): n is either a, c, g or t
  misc_feature (284)..(284): n is either a, c, g or t
  misc_feature (480)..(480): n is either a, c, g or t
  misc_feature (515)..(515): n is either a, c, g or t
  misc_feature (559)..(559): n is either a, c, g or t
cgaaaatacgaacaaaaaaaaaactcgaaaacgacgacccaaaaccgtaaaacgaaaaaaaaaacaaacaaaacaacacgaaacgaaaaaacgaaaaactccctaccaaaccaaactttattccctaaacctaaaactttacccgacgactaacgacgaacgaaccgaaaacgaacgaacgaaaacgcgcgaccataactaccgcgaccgaacaaaaaaaccgaaaaaacgacgcgtaaacgaataacgcgaaacgnacgcaaaaaaacgaacgcccgcgantnataccactcgacgcctcccccgccgaactcgaactacgcgacgacgaaacgaccctaaaaaccgaacgaacgacgcgaaaaaaacgaacccgacgtacgaatctcattattataaaaaaaacccgtcgaaacataaaaacgaaaacacaacgaaaaaaacgaccaaacaaaacgaacgaaaaaaaaaaaaaaaaanacgcgaaaaaaaaaaaaaaaaaaaacaaaaaaaanaaacgacgacgacgaaaaaaaaaaaaaaaaaaaaaaaaaaaaanaaaccccccgctccctcc

SEQ ID NO: 525 - DNA, 1395 bp, Artificial Sequence
  chemically treated genomic DNA (Homo sapiens) CpG-island No: 525
gcgttttaggtttttgtttttggcgtttttgttgttttgtacggtcgtatagtggtttacggtggtcgcgttatttttaaatagcgtggtttttcggtagttgggagatagggatagtatcgtgtttatggtgttgttgcgcgtcgggcgggggttcgcgtttttgcgcgtttagtttgtcggtcggagggataaaatcgtttatcgagtttgcggcggtttcggagaggaggcgggggcgttttcgggaagcgtgttgtttttttggatttgtttggaaaataagatggtttttagcgttaggttgggtttcgcgtcgcgtttttgcgtttttgcgttttttcgtttcgcgtttcggcgtatttcgtcgttttagtttcgggttttattcgcgttttcgcgacgtagtttcgtcgtttttattgtagtattttcgttcgtcgtcgtcgttgcggtttttaggcgtagtcgggaggggttcggtcgtcgacggaggcggtcgaggattttcgtttggatatttcgtacgggcgcgatttcggttttcgttttttagggttaaggacggtcgtttagcgtaggtttattcggtaggcggtagtttttgcgtttcgcgtttttcgtaatgcgcgtcgcggtttcgtcgtcgcggtttcggcgttcggcggcgttcgggggcgttcggcggggatcggttgggttcgcgttcggcggcggcgacggcggcggcggcggcggcggtagttagggagtttttgtttaaggttttgtaggtatcgtagtttcgtttttcgttcggtcgttcgtattttcgtcgtcgtcgtcgcgttttcgttttcgttttcgttttcggcgcgcgttttagcgttttttttcgcggggcgcgcgcgtcgtttacgtttcggtttggtttcgtcggggagtcgcggtcgttggtgtttttagttcgagtcgcgtacggtgcgggtaggacgcggtaacgagcgggaggtatttttacgcgtcgggttttatttaggagtcggatttcgcggttgcggcgggatacgcggcgtcggttcgtttcgtttttcggggtcgtttttttcgtatagttcgtcgttcgtttcgcgtcgtcgtttaatagtagttcggtcgtcggagagttttcggcgttcgcgtaatttaattttgtcgacgcggggcgggcgtcgagtagggcggagtcgagggtcgatttcgttcgcgtttcgtttagatacgtgttgtttttgttttcgtcgcggcgttcgtagttgtcggtcgcgggggtattttcggtcgagtttttgttttggtagcgcgcggttcgttttttttgaggttgtcgttttggtttggtgaggagtttttcgtcgaggttagggttcggagttt

SEQ ID NO: 526 - DNA, 1395 bp, Artificial Sequence
  chemically treated genomic DNA (Homo sapiens) CpG-island No: 526
aaactccgaaccctaacctcgacgaaaaactcctcaccaaaccaaaacgacaacctcaaaaaaaacgaaccgcgcgctaccaaaacaaaaactcgaccgaaaatacccccgcgaccgacaactacgaacgccgcgacgaaaacaaaaacaacacgtatctaaacgaaacgcgaacgaaatcgaccctcgactccgccctactcgacgcccgccccgcgtcgacaaaattaaattacgcgaacgccgaaaactctccgacgaccgaactactattaaacgacgacgcgaaacgaacgacgaactatacgaaaaaaacgaccccgaaaaacgaaacgaaccgacgccgcgtatcccgccgcaaccgcgaaatccgactcctaaataaaacccgacgcgtaaaaatacctcccgctcgttaccgcgtcctacccgcaccgtacgcgactcgaactaaaaacaccaacgaccgcgactccccgacgaaaccaaaccgaaacgtaaacgacgcgcgcgccccgcgaaaaaaaacgctaaaacgcgcgccgaaaacgaaaacgaaaacgaaaacgcgacgacgacgacgaaaatacgaacgaccgaacgaaaaacgaaactacgatacctacaaaaccttaaacaaaaactccctaactaccgccgccgccgccgccgccgtcgccgccgccgaacgcgaacccaaccgatccccgccgaacgcccccgaacgccgccgaacgccgaaaccgcgacgacgaaaccgcgacgcgcattacgaaaaacgcgaaacgcaaaaactaccgcctaccgaataaacctacgctaaacgaccgtccttaaccctaaaaaacgaaaaccgaaatcgcgcccgtacgaaatatccaaacgaaaatcctcgaccgcctccgtcgacgaccgaacccctcccgactacgcctaaaaaccgcaacgacgacgacgaacgaaaatactacaataaaaacgacgaaactacgtcgcgaaaacgcgaataaaacccgaaactaaaacgacgaaatacgccgaaacgcgaaacgaaaaaacgcaaaaacgcaaaaacgcgacgcgaaacccaacctaacgctaaaaaccatcttattttccaaacaaatccaaaaaaacaacacgcttcccgaaaacgcccccgcctcctctccgaaaccgccgcaaactcgataaacgattttatccctccgaccgacaaactaaacgcgcaaaaacgcgaacccccgcccgacgcgcaacaacaccataaacacgatactatccctatctcccaactaccgaaaaaccacgctatttaaaaataacgcgaccaccgtaaaccactatacgaccgtacaaaacaacaaaaacgccaaaaacaaaaacctaaaacgc

SEQ ID NO: 527 - DNA, 1395 bp, Artificial Sequence
  chemically treated genomic DNA (Homo sapiens) CpG-island No: 527
gagtttcggattttggtttcggcggagggttttttattaggttagggcggtagttttagagagggcgggtcgcgcgttgttagggtagggattcggtcgagagtgttttcgcggtcggtagttgcgggcgtcgcggcgggaataaaggtagtacgtgtttgggcgggacgcgggcggggtcggttttcggtttcgttttgttcggcgttcgtttcgcgtcggtagagttgggttgcgcgggcgtcgaggatttttcggcggtcgggttgttgttgggcggcggcgcggagcgggcggcgagttgtgcgggaggggcggtttcgaggggcggggcgggtcgacgtcgcgtgtttcgtcgtagtcgcggagttcggtttttagatggggttcggcgcgtagaggtgtttttcgttcgttgtcgcgttttattcgtatcgtgcgcggttcgagttgaggatattaacggtcgcgatttttcggcgagattaggtcggagcgtggacggcgcgcgcgtttcgcgagggagggcgttgaggcgcgcgtcggaagcgggagcgggagcgggagcgcggcggcggcggcgaaggtgcgggcggtcgagcggggggcggggttgcggtgtttgtagaattttggatagaagttttttagttgtcgtcgtcgtcgtcgtcgtcgtcgtcgtcgtcgagcgcgagtttagtcgattttcgtcgagcgttttcgagcgtcgtcgagcgtcgggatcgcggcggcggggtcgcggcgcgtattgcggagggcgcggagcgtaggagttgtcgtttgtcgggtaagtttgcgttgggcggtcgtttttggttttggggagcggagatcggggtcgcgttcgtgcggggtgtttaggcgggggttttcggtcgttttcgtcggcgatcgggtttttttcggttgcgtttggggatcgtagcggcggcggcgggcgggggtgttgtagtggaggcggcgaggttgcgtcgcgggggcgcgggtagggttcgggattggggcggcggggtgcgtcgaggcgcggggcggaggggcgtaggggcgtaggggcgcggcgcggagtttagtttggcgttaagaattattttgttttttaggtagatttaagggggtagtacgtttttcgggagcgttttcgtttttttttcggggtcgtcgtaggttcggtgagcggttttattttttcggtcggtaggttgggcgcgtaggggcgcgagttttcgttcggcgcgtagtagtattatgggtacggtgttgtttttgttttttagttatcggaaggttacgttgtttgaggatggcgcggttatcgtgggttattatacggtcgtatagaatagtaagaacgttaaggataagaatttgaagcgt

SEQ ID NO: 528 - DNA, 1395 bp, Artificial Sequence
  chemically treated genomic DNA (Homo sapiens) CpG-island No: 528
acgcttcaaattcttatccttaacgttcttactattctatacgaccgtataataacccacgataaccgcgccatcctcaaacaacgtaaccttccgataactaaaaaacaaaaacaacaccgtacccataatactactacgcgccgaacgaaaactcgcgcccctacgcgcccaacctaccgaccgaaaaaataaaaccgctcaccgaacctacgacgaccccgaaaaaaaaacgaaaacgctcccgaaaaacgtactacccccttaaatctacctaaaaaacaaaataattcttaacgccaaactaaactccgcgccgcgcccctacgcccctacgcccctccgccccgcgcctcgacgcaccccgccgccccaatcccgaaccctacccgcgcccccgcgacgcaacctcgccgcctccactacaacacccccgcccgccgccgccgctacgatccccaaacgcaaccgaaaaaaacccgatcgccgacgaaaacgaccgaaaacccccgcctaaacaccccgcacgaacgcgaccccgatctccgctccccaaaaccaaaaacgaccgcccaacgcaaacttacccgacaaacgacaactcctacgctccgcgccctccgcaatacgcgccgcgaccccgccgccgcgatcccgacgctcgacgacgctcgaaaacgctcgacgaaaatcgactaaactcgcgctcgacgacgacgacgacgacgacgacgacgacgacaactaaaaaacttctatccaaaattctacaaacaccgcaaccccgccccccgctcgaccgcccgcaccttcgccgccgccgccgcgctcccgctcccgctcccgcttccgacgcgcgcctcaacgccctccctcgcgaaacgcgcgcgccgtccacgctccgacctaatctcgccgaaaaatcgcgaccgttaatatcctcaactcgaaccgcgcacgatacgaataaaacgcgacaacgaacgaaaaacacctctacgcgccgaaccccatctaaaaaccgaactccgcgactacgacgaaacacgcgacgtcgacccgccccgcccctcgaaaccgcccctcccgcacaactcgccgcccgctccgcgccgccgcccaacaacaacccgaccgccgaaaaatcctcgacgcccgcgcaacccaactctaccgacgcgaaacgaacgccgaacaaaacgaaaccgaaaaccgaccccgcccgcgtcccgcccaaacacgtactacctttattcccgccgcgacgcccgcaactaccgaccgcgaaaacactctcgaccgaatccctaccctaacaacgcgcgacccgccctctctaaaactaccgccctaacctaataaaaaaccctccgccgaaaccaaaatccgaaactc

SEQ ID NO: 529 - DNA, 785 bp, Artificial Sequence
  chemically treated genomic DNA (Homo sapiens) CpG-island No: 529
cgataggattcgcgttttggcgtaggcgtatcggggatgagatgggtcgcgatttatgttagtaaggatgggtgagatagatagaggggttcggaacggagacgtttcgtattggtcgttgtttaacggcggatcggtagtgggtaggattttatggagacgcggtgttaggcgatcgttagtttcgcgtagggggcgtagtgttagcgttttgtcgtagagttgggcggtcgggcggggtacgagagcggcgtcgatgttcgcggcggtaggtacggttgttacgtagcgggtacggacgtcgggcgtaggcgcggtttcggcgcgcgttcggcggtgcggcgtcgcgtttgcgcgggcgtagcgggggcgcgttgcgtcgtcggtcgtcgcgggtcgcgcgcgttgggcgcgcgagtggttaggagttaggcgtttgcggtaggtcgcgttttcgggtcgggtacggttcggacgcgggtcgttgcgggcgtgcgagcgcgggaggcggtgcggtggtcgcgtggtagcgttttttcgggcgtgtcgtcgcgttgcgtttgttggcgagcgagttggtagcgttcgcgagcgggacggtttttgttttcggacgcgtcgtgggcgcggttggtacgggcgcggtatcgaagcgtcggtgagtgtcggcggtggttggtcgtcgttcgcgttcggttgttagagcgcgcgcggtgcgcgtcgtggtggcgcgcgaggcggcgtcgcgcggcgagcgcggcggcgtttgggcgtcgcggttcgcg

SEQ ID NO: 530 - DNA, 785 bp, Artificial Sequence
  chemically treated genomic DNA (Homo sapiens) CpG-island No: 530
cgcgaaccgcgacgcccaaacgccgccgcgctcgccgcgcgacgccgcctcgcgcgccaccacgacgcgcaccgcgcgcgctctaacaaccgaacgcgaacgacgaccaaccaccgccgacactcaccgacgcttcgataccgcgcccgtaccaaccgcgcccacgacgcgtccgaaaacaaaaaccgtcccgctcgcgaacgctaccaactcgctcgccaacaaacgcaacgcgacgacacgcccgaaaaaacgctaccacgcgaccaccgcaccgcctcccgcgctcgcacgcccgcaacgacccgcgtccgaaccgtacccgacccgaaaacgcgacctaccgcaaacgcctaactcctaaccactcgcgcgcccaacgcgcgcgacccgcgacgaccgacgacgcaacgcgcccccgctacgcccgcgcaaacgcgacgccgcaccgccgaacgcgcgccgaaaccgcgcctacgcccgacgtccgtacccgctacgtaacaaccgtacctaccgccgcgaacatcgacgccgctctcgtaccccgcccgaccgcccaactctacgacaaaacgctaacactacgccccctacgcgaaactaacgatcgcctaacaccgcgtctccataaaatcctacccactaccgatccgccgttaaacaacgaccaatacgaaacgtctccgttccgaacccctctatctatctcacccatccttactaacataaatcgcgacccatctcatccccgatacgcctacgccaaaacgcgaatcctatcg

SEQ ID NO: 531 - DNA, 785 bp, Artificial Sequence
  chemically treated genomic DNA (Homo sapiens) CpG-island No: 531
cgcgagtcgcggcgtttagacgtcgtcgcgttcgtcgcgcgacgtcgtttcgcgcgttattacgacgcgtatcgcgcgcgttttggtagtcgaacgcgggcggcggttagttatcgtcgatatttatcggcgtttcgatgtcgcgttcgtgttagtcgcgtttacggcgcgttcgagagtaggggtcgtttcgttcgcggacgttattagttcgttcgttagtaggcgtagcgcgacggtacgttcggaggagcgttgttacgcgattatcgtatcgtttttcgcgttcgtacgttcgtagcggttcgcgttcgaatcgtgttcggttcgggggcgcggtttgtcgtaggcgtttggtttttagttattcgcgcgtttagcgcgcgcggttcgcgacgatcggcggcgtaacgcgttttcgttgcgttcgcgtaggcgcggcgtcgtatcgtcgagcgcgcgtcgaggtcgcgtttgcgttcgacgttcgtgttcgttgcgtggtagtcgtgtttgtcgtcgcgagtatcggcgtcgttttcgtatttcgttcggtcgtttaattttgcgatagggcgttaatattgcgttttttgcgcgggattgacgatcgtttggtatcgcgtttttatggagttttgtttattatcggttcgtcgttgggtagcgattagtacgaggcgttttcgtttcgaatttttttgtttgttttatttatttttattgatatgggtcgcgatttattttattttcgatgcgtttacgttagggcgcgagttttgtcg

SEQ ID NO: 532 - DNA, 785 bp, Artificial Sequence
  chemically treated genomic DNA (Homo sapiens) CpG-island No: 532
cgacaaaactcgcgccctaacgtaaacgcatcgaaaataaaataaatcgcgacccatatcaataaaaataaataaaacaaacaaaaaaattcgaaacgaaaacgcctcgtactaatcgctacccaacgacgaaccgataataaacaaaactccataaaaacgcgataccaaacgatcgtcaatcccgcgcaaaaaacgcaatattaacgccctatcgcaaaattaaacgaccgaacgaaatacgaaaacgacgccgatactcgcgacgacaaacacgactaccacgcaacgaacacgaacgtcgaacgcaaacgcgacctcgacgcgcgctcgacgatacgacgccgcgcctacgcgaacgcaacgaaaacgcgttacgccgccgatcgtcgcgaaccgcgcgcgctaaacgcgcgaataactaaaaaccaaacgcctacgacaaaccgcgcccccgaaccgaacacgattcgaacgcgaaccgctacgaacgtacgaacgcgaaaaacgatacgataatcgcgtaacaacgctcctccgaacgtaccgtcgcgctacgcctactaacgaacgaactaataacgtccgcgaacgaaacgacccctactctcgaacgcgccgtaaacgcgactaacacgaacgcgacatcgaaacgccgataaatatcgacgataactaaccgccgcccgcgttcgactaccaaaacgcgcgcgatacgcgtcgtaataacgcgcgaaacgacgtcgcgcgacgaacgcgacgacgtctaaacgccgcgactcgcg

SEQ ID NO: 533 - DNA, 788 bp, Artificial Sequence
  chemically treated genomic DNA (Homo sapiens) CpG-island No: 533
ttcgtttacggacgcgaagatgtagtttttaattttcgcggttcgagtttcgtagagtttttggtttttttatttacgttggcgggcgtattttttgtttcgttcggtcggggcgtttttcgtagttcgtaattcgtagttttgtaggtttcgtacgttttttttagggtttggagttcgtttttagttttcgttcgtcgtcgcggagtttatcgagtcgtggtcgtttgtcgcgtcggtcgcgtcgttttgttgtagtttcgtagttatggtcgaggcgtttagtcgcgggttatcggtttttcgtcgtagtcgtcgtcggtttagttttttaggattaggtttcgttttcgttttttatttcgtttcgtttcgttttcgttcgtagcgcgcgtcggaggtttggtttatatgtttcgttttcggtatgcgcgcgtacgtaaggcgcgcggttcggggtcgaatagttttgcgtgttttcgcgtacgttcggttgattagacgtcggttacgtgatttcggtttcgtttgtcgttgttggttagttttatagtcggtggaggttgcgggtcgcgttgttagtgttcgggaattgggtttgcgaattttgggagtcgcgtttttgagtttttttcgttttttgtttttaaaattttatttgtaggattgattttcggttttattttttttacgggcgagttaaaattgttttttcgtcgtgggaaattgtcgaatgatcgtggaataaaggattttttattaggttttgtagttatttttaattttaa

SEQ ID NO: 534 - DNA, 788 bp, Artificial Sequence
  chemically treated genomic DNA (Homo sapiens) CpG-island No: 534
ttaaaattaaaaataactacaaaacctaataaaaaatcctttattccacgatcattcgacaatttcccacgacgaaaaaacaattttaactcgcccgtaaaaaaaataaaaccgaaaatcaatcctacaaataaaattttaaaaacaaaaaacgaaaaaaactcaaaaacgcgactcccaaaattcgcaaacccaattcccgaacactaacaacgcgacccgcaacctccaccgactataaaactaaccaacaacgacaaacgaaaccgaaatcacgtaaccgacgtctaatcaaccgaacgtacgcgaaaacacgcaaaactattcgaccccgaaccgcgcgccttacgtacgcgcgcataccgaaaacgaaacatataaaccaaacctccgacgcgcgctacgaacgaaaacgaaacgaaacgaaataaaaaacgaaaacgaaacctaatcctaaaaaactaaaccgacgacgactacgacgaaaaaccgataacccgcgactaaacgcctcgaccataactacgaaactacaacaaaacgacgcgaccgacgcgacaaacgaccacgactcgataaactccgcgacgacgaacgaaaactaaaaacgaactccaaaccctaaaaaaaacgtacgaaacctacaaaactacgaattacgaactacgaaaaacgccccgaccgaacgaaacaaaaaatacgcccgccaacgtaaataaaaaaaccaaaaactctacgaaactcgaaccgcgaaaattaaaaactacatcttcgcgtccgtaaacgaa

SEQ ID NO: 535 - DNA, 788 bp, Artificial Sequence
  chemically treated genomic DNA (Homo sapiens) CpG-island No: 535
ttggagttggaaatggttataaagtttgatgggaaattttttattttacggttattcggtagttttttacggcgggggaatagttttaattcgttcgtggggagggtggagtcggaggttagttttataaatgaggttttgagggtagagagcggagaagatttaggaacgcggtttttaggattcgtaaatttagttttcggatattggtagcgcggttcgtagtttttatcggttgtgaagttgattaatagcgataggcggggtcgggattacgtgatcgacgtttggttagtcgggcgtgcgcgggagtacgtagaattgttcggtttcgggtcgcgcgttttgcgtgcgcgcgtatgtcgggggcggggtatgtgggttaagttttcggcgcgcgttgcgggcgggggcgggacggagcggggtggagggcgggggcggggtttagttttgagaggttgggtcggcggcggttgcggcgggagatcggtgattcgcggttgggcgtttcggttatgattgcggagttgtagtaggacgacgcggtcggcgcggtagacggttacggttcggtgggtttcgcggcggcgagcgggagttgggggcgggttttaggttttgaggggagcgtgcggggtttgtagggttgcgggttgcgggttgcggagggcgtttcggtcgggcgggatagggggtgcgttcgttagcgtgggtgagaaggttaagggttttgcggggttcgggtcgcggagattgaggattgtattttcgcgttcgtgggcgag

SEQ ID NO: 536 - DNA, 788 bp, Artificial Sequence
  chemically treated genomic DNA (Homo sapiens) CpG-island No: 536
ctcgcccacgaacgcgaaaatacaatcctcaatctccgcgacccgaaccccgcaaaacccttaaccttctcacccacgctaacgaacgcaccccctatcccgcccgaccgaaacgccctccgcaacccgcaacccgcaaccctacaaaccccgcacgctcccctcaaaacctaaaacccgcccccaactcccgctcgccgccgcgaaacccaccgaaccgtaaccgtctaccgcgccgaccgcgtcgtcctactacaactccgcaatcataaccgaaacgcccaaccgcgaatcaccgatctcccgccgcaaccgccgccgacccaacctctcaaaactaaaccccgcccccgccctccaccccgctccgtcccgcccccgcccgcaacgcgcgccgaaaacttaacccacataccccgcccccgacatacgcgcgcacgcaaaacgcgcgacccgaaaccgaacaattctacgtactcccgcgcacgcccgactaaccaaacgtcgatcacgtaatcccgaccccgcctatcgctattaatcaacttcacaaccgataaaaactacgaaccgcgctaccaatatccgaaaactaaatttacgaatcctaaaaaccgcgttcctaaatcttctccgctctctaccctcaaaacctcatttataaaactaacctccgactccaccctccccacgaacgaattaaaactattcccccgccgtaaaaaactaccgaataaccgtaaaataaaaaatttcccatcaaactttataaccatttccaactccaa

SEQ ID NO: 537 - DNA, 512 bp, Artificial Sequence
  chemically treated genomic DNA (Homo sapiens) CpG-island No: 537
ttttttcgtttacgttcggcggatttttcgtatcgcgcggtatcgtcgcgggcgtttcggtttatattcgtcggcggtattcgtagcggcgtcgcggcggcggttttatacgcgtttcgtttttcgtacgcgcgtatcgttagtagggtttagcgcggagtattcgtttttcgcggtaggtagcggcgcgcggcgtcgtacgacggtcgcgcgacgcggttcggcgcgcggttttagaggtttcgttttagtacgcgttcggcgtacgtattttcgacgcgtatacgcgttcggttatcggcgagttttttagttttggattcgcggcgtcgtttatcgttcggattaggttagtgagtattagttcgaggcgcgatggttgagcgggatttatcggtattcgggtgttatcgtcggcggtttattaagcgattaggatcggttattcgttattatttcgttgatatttttttgtgggtagtatttttttttattttagatggttttgtagt

SEQ ID NO: 538 - DNA, 512 bp, Artificial Sequence
  chemically treated genomic DNA (Homo sapiens) CpG-island No: 538
actacaaaaccatctaaaataaaaaaaaatactacccacaaaaaaatatcaacgaaataataacgaataaccgatcctaatcgcttaataaaccgccgacgataacacccgaataccgataaatcccgctcaaccatcgcgcctcgaactaatactcactaacctaatccgaacgataaacgacgccgcgaatccaaaactaaaaaactcgccgataaccgaacgcgtatacgcgtcgaaaatacgtacgccgaacgcgtactaaaacgaaacctctaaaaccgcgcgccgaaccgcgtcgcgcgaccgtcgtacgacgccgcgcgccgctacctaccgcgaaaaacgaatactccgcgctaaaccctactaacgatacgcgcgtacgaaaaacgaaacgcgtataaaaccgccgccgcgacgccgctacgaataccgccgacgaatataaaccgaaacgcccgcgacgataccgcgcgatacgaaaaatccgccgaacgtaaacgaaaaaa

SEQ ID NO: 539 - DNA, 512 bp, Artificial Sequence
  chemically treated genomic DNA (Homo sapiens) CpG-island No: 539
gttatagaattatttgaagtagaggggagtgttgtttataaggaagtattagcgaggtggtggcggatggtcggttttggtcgtttggtgagtcgtcgacggtgatattcgggtgtcggtggatttcgtttagttatcgcgtttcgaattagtgtttattggtttagttcgagcggtggacggcgtcgcgaatttagggttggaaggttcgtcggtggtcgggcgcgtgtgcgcgtcgggagtgcgtgcgtcgggcgcgtgttgaggcggggtttttggggtcgcgcgtcgggtcgcgtcgcgcgatcgtcgtgcggcgtcgcgcgtcgttgtttgtcgcggggggcgggtgtttcgcgttgagttttgttggcgatgcgcgcgtgcggggggcgggacgcgtgtggggtcgtcgtcgcggcgtcgttgcgggtgtcgtcggcgggtgtgggtcggggcgttcgcggcggtgtcgcgcggtgcggggggttcgtcgggcgtgggcgggggag

SEQ ID NO: 540 - DNA, 512 bp, Artificial Sequence
  chemically treated genomic DNA (Homo sapiens) CpG-island No: 540
ctcccccgcccacgcccgacgaaccccccgcaccgcgcgacaccgccgcgaacgccccgacccacacccgccgacgacacccgcaacgacgccgcgacgacgaccccacacgcgtcccgccccccgcacgcgcgcatcgccaacaaaactcaacgcgaaacacccgccccccgcgacaaacaacgacgcgcgacgccgcacgacgatcgcgcgacgcgacccgacgcgcgaccccaaaaaccccgcctcaacacgcgcccgacgcacgcactcccgacgcgcacacgcgcccgaccaccgacgaaccttccaaccctaaattcgcgacgccgtccaccgctcgaactaaaccaataaacactaattcgaaacgcgataactaaacgaaatccaccgacacccgaatatcaccgtcgacgactcaccaaacgaccaaaaccgaccatccgccaccacctcgctaatacttccttataaacaacactcccctctacttcaaataattctataac

SEQ ID NO: 541 - DNA, 648 bp, Artificial Sequence
  chemically treated genomic DNA (Homo sapiens) CpG-island No: 541
ggtgaacgggataggtatacgcgtggggtgggatggagtgtttatatatgtggtttgtgatatgtattgaggggacgtggggtatattcggatgaggggtttgtggatatattcgtggcgtatgtgggtatcgttggtgtttcgaggtggggagggagaatgcggagcgcgtgcgtgcggggggcgtttagtgtttttgaatttggcgtgtgggggttggagtttattgggaggcgagggaggtggttaggggagtcgggatcgtgcgtgtggttaggtcggtagcgtttagtaagttttattcgcgggcgtttttcgtgttttttcgtttttgaatttgtttttttttagtcggtttcgtcgcgttcgtcgggtgttttagtgttattaatattcggtcgtcgtcgttagtttggcgcgtatcgtcgttttcgttatcgtcgatagcgcgtatttttcgtgttttcgtttcgtcgttcgagtaggtatgacggcgaattttggttcgtattcggtttttcgcgcgttgttcggagtttttgcgcgcgcgtttttttttgtttaatttcggttcgcgagtttttgtttcggttttagttttttacgggagggcgtttgggtgtttgtttgaggcgtttgggattcggt

SEQ ID NO: 542 - DNA, 648 bp, Artificial Sequence
  chemically treated genomic DNA (Homo sapiens) CpG-island No: 542
accgaatcccaaacgcctcaaacaaacacccaaacgccctcccgtaaaaaactaaaaccgaaacaaaaactcgcgaaccgaaattaaacaaaaaaaaacgcgcgcgcaaaaactccgaacaacgcgcgaaaaaccgaatacgaaccaaaattcgccgtcatacctactcgaacgacgaaacgaaaacacgaaaaatacgcgctatcgacgataacgaaaacgacgatacgcgccaaactaacgacgacgaccgaatattaataacactaaaacacccgacgaacgcgacgaaaccgactaaaaaaaaacaaattcaaaaacgaaaaaacacgaaaaacgcccgcgaataaaacttactaaacgctaccgacctaaccacacgcacgatcccgactcccctaaccacctccctcgcctcccaataaactccaacccccacacgccaaattcaaaaacactaaacgccccccgcacgcacgcgctccgcattctccctccccacctcgaaacaccaacgatacccacatacgccacgaatatatccacaaacccctcatccgaatataccccacgtcccctcaatacatatcacaaaccacatatataaacactccatcccaccccacgcgtatacctatcccgttcacc

SEQ ID NO: 543 - DNA, 648 bp, Artificial Sequence
  chemically treated genomic DNA (Homo sapiens) CpG-island No: 543
gtcgggttttaggcgttttagataggtatttaagcgttttttcgtgggaaattgaggtcgggataggagttcgcgggtcggggttgggtaggagaaggcgcgcgcgtagggatttcgggtagcgcgcgggagatcgggtgcgagttagggttcgtcgttatatttgttcgggcggcggagcggggatacggaggatgcgcgttgtcggcggtggcggaggcggcggtgcgcgttaagttggcggcggcggtcgagtgttggtgatattgggatattcggcgagcgcggcgagatcgattgggagggagtaggtttaggggcggggaagtacggggagcgttcgcgggtggagtttattgggcgttatcggtttggttatacgtacggtttcggtttttttggttatttttttcgttttttaataagttttagtttttatacgttaggtttagggatattggacgtttttcgtacgtacgcgtttcgtattttttttttttatttcgggatattagcgatatttatatgcgttacgaatatgtttatagattttttattcgagtgtattttacgtttttttagtatatattataagttatatatatgaatattttattttattttacgcgtgtatttgtttcgtttatt

SEQ ID NO: 544 - DNA, 648 bp, Artificial Sequence
  chemically treated genomic DNA (Homo sapiens) CpG-island No: 544
aataaacgaaacaaatacacgcgtaaaataaaataaaatattcatatatataacttataatatatactaaaaaaacgtaaaatacactcgaataaaaaatctataaacatattcgtaacgcatataaatatcgctaatatcccgaaataaaaaaaaaaaatacgaaacgcgtacgtacgaaaaacgtccaatatccctaaacctaacgtataaaaactaaaacttattaaaaaacgaaaaaaataaccaaaaaaaccgaaaccgtacgtataaccaaaccgataacgcccaataaactccacccgcgaacgctccccgtacttccccgcccctaaacctactccctcccaatcgatctcgccgcgctcgccgaatatcccaatatcaccaacactcgaccgccgccgccaacttaacgcgcaccgccgcctccgccaccgccgacaacgcgcatcctccgtatccccgctccgccgcccgaacaaatataacgacgaaccctaactcgcacccgatctcccgcgcgctacccgaaatccctacgcgcgcgccttctcctacccaaccccgacccgcgaactcctatcccgacctcaatttcccacgaaaaaacgcttaaatacctatctaaaacgcctaaaacccgac

SEQ ID NO: 545 - DNA, 632 bp, Artificial Sequence
  chemically treated genomic DNA (Homo sapiens) CpG-island No: 545
gacgcgttaattatttacggaggtaagaaattgtagaaagtaaagggaaagggagtttagtgtcgggcggcgttgagtagtttttttagcggttatcgtcgttaatatttttgcgtaggggtttgtatcgtagcgcgtttttagatattaacggttgcgcggtttacgcgcgcgtatgcgttttgattaggggaatttttttttggggattcggaggcgagcgttggaaggcgggatagtggcgatttatacgtagtagttttcggcggcgcgtagttttgattggtggaatttgggagagggggcggggtatcggggaattcgaatgggagaggcgggtttaaggagggagtggaatggtcgcgggcggttcgacgtagtagaggcgacgcgagatggcggtagttttagcggcggcgattttaggtatttgagttcggtttgggtaaggcgggtatcgacgtttggagtttagtgggagttatgtgtcggagtgtggtttaggttttgcgggttgtcgcggagaggcggttatggcgtaggggcggggagagggggacggtgagagtgtggggtcgcgagtcggtcgtttcgtttggtttttgttttttttttgttttttgttttttttt

SEQ ID NO: 546 - DNA, 632 bp, Artificial Sequence
  chemically treated genomic DNA (Homo sapiens) CpG-island No: 546
aaaaaaaaacaaaaaacaaaaaaaaaacaaaaaccaaacgaaacgaccgactcgcgaccccacactctcaccgtccccctctccccgcccctacgccataaccgcctctccgcgacaacccgcaaaacctaaaccacactccgacacataactcccactaaactccaaacgtcgatacccgccttacccaaaccgaactcaaatacctaaaatcgccgccgctaaaactaccgccatctcgcgtcgcctctactacgtcgaaccgcccgcgaccattccactccctccttaaacccgcctctcccattcgaattccccgataccccgccccctctcccaaattccaccaatcaaaactacgcgccgccgaaaactactacgtataaatcgccactatcccgccttccaacgctcgcctccgaatccccaaaaaaaaattcccctaatcaaaacgcatacgcgcgcgtaaaccgcgcaaccgttaatatctaaaaacgcgctacgatacaaacccctacgcaaaaatattaacgacgataaccgctaaaaaaactactcaacgccgcccgacactaaactccctttccctttactttctacaatttcttacctccgtaaataattaacgcgtc

SEQ ID NO: 547 - DNA, 632 bp, Artificial Sequence
  chemically treated genomic DNA (Homo sapiens) CpG-island No: 547
aggggagagtaggaaatagggagaaggtaggagttaggcggggcgatcggttcgcgattttatatttttatcgttttttttttttcgtttttgcgttatggtcgttttttcgcgataattcgtagagtttggattatatttcgatatataatttttattaaattttagacgtcggtattcgttttgtttaggtcgggtttaagtatttgagatcgtcgtcgttgaagttgtcgttatttcgcgtcgtttttgttgcgtcgagtcgttcgcggttattttattttttttttgggttcgttttttttattcgaatttttcggtgtttcgtttttttttttaggttttattaattaagattacgcgtcgtcggaagttgttgcgtgtgggtcgttattatttcgttttttagcgttcgttttcgggtttttaagaaaaggtttttttggttaggacgtatgcgcgcgcgtgggtcgcgtagtcgttgatgtttggaagcgcgttgcgatataaatttttacgtagggatgttggcgacggtggtcgttgggggagttgtttagcgtcgttcggtattgggttttttttttttttattttttgtagttttttgttttcgtgggtggttggcgcgtt

SEQ ID NO: 548 - DNA, 632 bp, Artificial Sequence
  chemically treated genomic DNA (Homo sapiens) CpG-island No: 548
aacgcgccaaccacccacgaaaacaaaaaactacaaaaaataaaaaaaaaaaaaacccaataccgaacgacgctaaacaactcccccaacgaccaccgtcgccaacatccctacgtaaaaatttatatcgcaacgcgcttccaaacatcaacgactacgcgacccacgcgcgcgcatacgtcctaaccaaaaaaaccttttcttaaaaacccgaaaacgaacgctaaaaaacgaaataataacgacccacacgcaacaacttccgacgacgcgtaatcttaattaataaaacctaaaaaaaaaaacgaaacaccgaaaaattcgaataaaaaaaacgaacccaaaaaaaaaataaaataaccgcgaacgactcgacgcaacaaaaacgacgcgaaataacgacaacttcaacgacgacgatctcaaatacttaaacccgacctaaacaaaacgaataccgacgtctaaaatttaataaaaattatatatcgaaatataatccaaactctacgaattatcgcgaaaaaacgaccataacgcaaaaacgaaaaaaaaaaaacgataaaaatataaaatcgcgaaccgatcgccccgcctaactcctaccttctccctatttcctactctcccct

SEQ ID NO: 549 - DNA, 566 bp, Artificial Sequence
  chemically treated genomic DNA (Homo sapiens) CpG-island No: 549
gggcgggatcggggtgtgatcgtttcggggtgggtcgcgagtaaggtaggcgattttattgggcgttattttcggggaacgatttagcgtaggattgtaaatatatcgttggggtggggcggggaggacggtggtttgtaggacgtaaaaagcggaagtcgaagtatgaggtttgcgatcgttaggcgggcgcgcgtttagggattagtttcgtttcgttcgtgttttcggcgcgcgcgtttttttattttttcgttcggtaacgacggcggttttgtgcgcgtgcgcgcgaaataacggtcgttggcggagggagggggagtggaatcgttggcggggggaagaggagagaagtcgttttgtttttcgcgcgtttattatttgcgttatcgttagttaattagtagtcgttttaggggtttcgcgttcggggcgattcgggttgttgggtggttttttcgttttttttttcgttagagtttttttcgcgtttgtttttttcgttggttacgcgcgcgttcgcgttagcgttcgcgttcgttttagttttttgtgtgttttcgcgt

SEQ ID NO: 550 - DNA, 566 bp, Artificial Sequence
  chemically treated genomic DNA (Homo sapiens) CpG-island No: 550
acgcgaaaacacacaaaaaactaaaacgaacgcgaacgctaacgcgaacgcgcgcgtaaccaacgaaaaaaacaaacgcgaaaaaaactctaacgaaaaaaaaaacgaaaaaaccacccaacaacccgaatcgccccgaacgcgaaacccctaaaacgactactaattaactaacgataacgcaaataataaacgcgcgaaaaacaaaacgacttctctcctcttccccccgccaacgattccactccccctccctccgccaacgaccgttatttcgcgcgcacgcgcacaaaaccgccgtcgttaccgaacgaaaaaataaaaaaacgcgcgcgccgaaaacacgaacgaaacgaaactaatccctaaacgcgcgcccgcctaacgatcgcaaacctcatacttcgacttccgctttttacgtcctacaaaccaccgtcctccccgccccaccccaacgatatatttacaatcctacgctaaatcgttccccgaaaataacgcccaataaaatcgcctaccttactcgcgacccaccccgaaacgatcacaccccgatcccgccc

SEQ ID NO: 551 - DNA, 566 bp, Artificial Sequence
  chemically treated genomic DNA (Homo sapiens) CpG-island No: 551
gcgcgaggatatataagaggttggagcgggcgcgagcgttagcgcgagcgcgcgcgtggttagcgggaggggtaggcgcgagagggattttggcgggaggagggacgggggagttatttagtagttcgagtcgtttcgagcgcgagatttttgagacggttgttgattggttgacgatggcgtaggtggtgggcgcgcgggagatagggcggttttttttttttttttttcgttaacgattttatttttttttttttcgttagcggtcgttatttcgcgcgtacgcgtataaggtcgtcgtcgttgtcgagcgggagaatgggggagcgcgcgcgtcgggggtacggacggggcggggttaatttttgagcgcgcgttcgtttaacggtcgtaggttttatgtttcggttttcgttttttgcgttttgtaggttatcgtttttttcgttttattttagcggtgtatttataattttgcgttgagtcgtttttcgaagatggcgtttagtggagtcgtttgttttgttcgcggtttatttcgaggcggttatatttcggtttcgttt

SEQ ID NO: 552 - DNA, 566 bp, Artificial Sequence
  chemically treated genomic DNA (Homo sapiens) CpG-island No: 552
aaacgaaaccgaaatataaccgcctcgaaataaaccgcgaacaaaacaaacgactccactaaacgccatcttcgaaaaacgactcaacgcaaaattataaatacaccgctaaaataaaacgaaaaaaacgataacctacaaaacgcaaaaaacgaaaaccgaaacataaaacctacgaccgttaaacgaacgcgcgctcaaaaattaaccccgccccgtccgtacccccgacgcgcgcgctcccccattctcccgctcgacaacgacgacgaccttatacgcgtacgcgcgaaataacgaccgctaacgaaaaaaaaaaaaataaaatcgttaacgaaaaaaaaaaaaaaaaaaccgccctatctcccgcgcgcccaccacctacgccatcgtcaaccaatcaacaaccgtctcaaaaatctcgcgctcgaaacgactcgaactactaaataactcccccgtccctcctcccgccaaaatccctctcgcgcctacccctcccgctaaccacgcgcgcgctcgcgctaacgctcgcgcccgctccaacctcttatatatcctcgcgc

SEQ ID NO: 553 - DNA, 572 bp, Artificial Sequence
  chemically treated genomic DNA (Homo sapiens) CpG-island No: 553
ttgggagcgttcggggttcgcgaaggaggaggtggtttaggtgttagggcgtatcgtgggaatcggtttcgggggaggcgtggaaacgcggggtttgggattcgattagtttttttcgtgcggatcgtaaaatttcggagttgaaatagttcgttgttcgtagtttttttttgattcgttattttgtatattgttttttattcgttcgggtcgcgggtgggaggagaggtacgtcggggttttggagtttggtcgcgcgttaggtttgtggttttcgtttttttggggttattggggcggttacgttttttcggcgggaggagagaacgcgtgggttcgggtggttgtttcggttttttcgtttttagttcggttatggggtcgcgtagtttttacgtcgcggttattttcgacggggatagtattcggcgagagatcggttgtgagtgcgttcgcgtcggcggttgcggaggggacggggcgaatttaggcgtttggggttagggaaggggttgggttgaaggatggacgaatttataagtttggggttcggggtttttcggagttggaag

SEQ ID NO: 554 - DNA, 572 bp, Artificial Sequence
  chemically treated genomic DNA (Homo sapiens) CpG-island No: 554
cttccaactccgaaaaaccccgaaccccaaacttataaattcgtccatccttcaacccaaccccttccctaaccccaaacgcctaaattcgccccgtcccctccgcaaccgccgacgcgaacgcactcacaaccgatctctcgccgaatactatccccgtcgaaaataaccgcgacgtaaaaactacgcgaccccataaccgaactaaaaacgaaaaaaccgaaacaaccacccgaacccacgcgttctctcctcccgccgaaaaaacgtaaccgccccaataaccccaaaaaaacgaaaaccacaaacctaacgcgcgaccaaactccaaaaccccgacgtacctctcctcccacccgcgacccgaacgaataaaaaacaatatacaaaataacgaatcaaaaaaaaactacgaacaacgaactatttcaactccgaaattttacgatccgcacgaaaaaaactaatcgaatcccaaaccccgcgtttccacgcctcccccgaaaccgattcccacgatacgccctaacacctaaaccacctcctccttcgcgaaccccgaacgctcccaa

SEQ ID NO: 555 - DNA, 572 bp, Artificial Sequence
  chemically treated genomic DNA (Homo sapiens) CpG-island No: 555
tttttagtttcggggagtttcggattttagatttgtaagttcgtttattttttaatttaattttttttttagttttagacgtttgggttcgtttcgtttttttcgtagtcgtcgacgcgggcgtatttatagtcggtttttcgtcgaatattgttttcgtcgggaatgatcgcggcgtgggagttgcgcgattttatggtcgagttggaggcggaagggtcggagtagttattcggatttacgcgtttttttttttcgtcggagaggcgtggtcgttttagtggttttagggggacgaaggttataagtttggcgcgcggttaagttttagaatttcggcgtgtttttttttttattcgcgattcgggcgaatggaaaataatgtgtagggtggcgggttagagggaggttgcgaataacgggttgttttagtttcgagattttgcgattcgtacgggagaggttggtcgagttttaggtttcgcgtttttacgtttttttcggggtcggtttttacggtgcgttttgatatttgagttattttttttttcgcgggtttcgggcgtttttaa

SEQ ID NO: 556 - DNA, 572 bp, Artificial Sequence
  chemically treated genomic DNA (Homo sapiens) CpG-island No: 556
ttaaaaacgcccgaaacccgcgaaaaaaaaaataactcaaatatcaaaacgcaccgtaaaaaccgaccccgaaaaaaacgtaaaaacgcgaaacctaaaactcgaccaacctctcccgtacgaatcgcaaaatctcgaaactaaaacaacccgttattcgcaacctccctctaacccgccaccctacacattattttccattcgcccgaatcgcgaataaaaaaaaaaacacgccgaaattctaaaacttaaccgcgcgccaaacttataaccttcgtccccctaaaaccactaaaacgaccacgcctctccgacgaaaaaaaaaaacgcgtaaatccgaataactactccgacccttccgcctccaactcgaccataaaatcgcgcaactcccacgccgcgatcattcccgacgaaaacaatattcgacgaaaaaccgactataaatacgcccgcgtcgacgactacgaaaaaaacgaaacgaacccaaacgtctaaaactaaaaaaaaaattaaattaaaaaataaacgaacttacaaatctaaaatccgaaactccccgaaactaaaaa

SEQ ID NO: 557 - DNA, 813 bp, Artificial Sequence
  chemically treated genomic DNA (Homo sapiens) CpG-island No: 557
ttcggtttcgcgcgtcgcggtcgttagagtcggcgtaggggaagcgttcgcggtttcgggtgtagtagcggtcgtcgtttttcgcgttttttcggttcgtagttcgcggtttcgcggtttcggggtcggtatttttcgggtttcggtttttcgcgcgtaagatggttgattcggttgcggggtcgtcgtcgagcgagggcgaggagagtatcgtgcgtttcgttcgtaaaggcgtttttcggtagaagaacgtgtatgaggttaagaattataaatttatcgttcgtttttttaagtagtttattttttgtagttattgtatcgattttatttggtgagcgcgcgcgcgtagggtattttttcgggttttcgagggtagcgtcgcgttagggatttttttttcgcgttttttgcgtttttcgcgtttttcgtattttgggatttcgcgttttcggattttcggtttcggattttgttgttcgggattttcggatggatagttttgtcgttgttttgtttttattttggttttagacgggtcgtcgcggggcgttttttgtttttttttgtttttaggcgtttttagagcgtttaggggcggcgtcgcgggagtttttgttttatttgattaggagcgcgcggggtttgtgtttgttttggagggtagcgtttcgggtgtttttcgattcggggttttttattttttcgtttgttttcgggcgcgaggagttttcgttttttattttttgttttcggggggggcggcgttttgggtgtttttttttatttttttgcgggtatgggatatttttt

SEQ ID NO: 558 - DNA, 813 bp, Artificial Sequence
  chemically treated genomic DNA (Homo sapiens) CpG-island No: 558
aaaaaatatcccatacccgcaaaaaaataaaaaaaaacacccaaaacgccgccccccccgaaaacaaaaaataaaaaacgaaaactcctcgcgcccgaaaacaaacgaaaaaataaaaaaccccgaatcgaaaaacacccgaaacgctaccctccaaaacaaacacaaaccccgcgcgctcctaatcaaataaaacaaaaactcccgcgacgccgcccctaaacgctctaaaaacgcctaaaaacaaaaaaaaacaaaaaacgccccgcgacgacccgtctaaaaccaaaataaaaacaaaacaacgacaaaactatccatccgaaaatcccgaacaacaaaatccgaaaccgaaaatccgaaaacgcgaaatcccaaaatacgaaaaacgcgaaaaacgcaaaaaacgcgaaaaaaaaatccctaacgcgacgctaccctcgaaaacccgaaaaaataccctacgcgcgcgcgctcaccaaataaaatcgatacaataactacaaaaaataaactacttaaaaaaacgaacgataaatttataattcttaacctcatacacgttcttctaccgaaaaacgcctttacgaacgaaacgcacgatactctcctcgccctcgctcgacgacgaccccgcaaccgaatcaaccatcttacgcgcgaaaaaccgaaacccgaaaaataccgaccccgaaaccgcgaaaccgcgaactacgaaccgaaaaaacgcgaaaaacgacgaccgctactacacccgaaaccgcgaacgcttcccctacgccgactctaacgaccgcgacgcgcgaaaccgaa

SEQ ID NO: 559 - DNA, 813 bp, Artificial Sequence
  chemically treated genomic DNA (Homo sapiens) CpG-island No: 559
aaaggatgttttatgttcgtagggagatagagaaggatatttagggcgtcgtttttttcggaaataaggggtggggggcgagggtttttcgcgttcggaagtaggcggagagatagggaatttcgggtcggagagtattcgaggcgttgttttttagggtaggtatagatttcgcgcgtttttagttaggtggagtaaaggttttcgcgacgtcgtttttgggcgttttagaggcgtttgagagtaggagagggtaggaggcgtttcgcggcggttcgtttgggattagggtggggatagggtaacggtaggattgtttattcgggagtttcgggtagtagggttcggagtcgggagttcggagacgcggggttttagggtgcggagggcgcggagggcgtagagggcgcggagagggggtttttggcgcggcgttgttttcgggggttcgggaaggtgttttgcgcgcgcgcgtttattagatgaagtcggtgtagtggttgtagaaggtgggttgtttgaagaagcgggcggtgaatttgtggtttttgattttatgtacgtttttttgtcggagggcgtttttgcgggcgaagcgtacggtgtttttttcgttttcgttcggcggcggtttcgtagtcgggttagttattttgcgcgcggggagtcggagttcgagaggtgtcggtttcggggtcgcgggatcgcgggttgcgggtcggggaggcgcgggaggcggcggtcgttgttgtattcggggtcgcgggcgttttttttgcgtcggttttggcggtcgcggcgcgcggagtcggg

SEQ ID NO: 560 - DNA, 813 bp, Artificial Sequence
  chemically treated genomic DNA (Homo sapiens) CpG-island No: 560
cccgactccgcgcgccgcgaccgccaaaaccgacgcaaaaaaaacgcccgcgaccccgaatacaacaacgaccgccgcctcccgcgcctccccgacccgcaacccgcgatcccgcgaccccgaaaccgacacctctcgaactccgactccccgcgcgcaaaataactaacccgactacgaaaccgccgccgaacgaaaacgaaaaaaacaccgtacgcttcgcccgcaaaaacgccctccgacaaaaaaacgtacataaaatcaaaaaccacaaattcaccgcccgcttcttcaaacaacccaccttctacaaccactacaccgacttcatctaataaacgcgcgcgcgcaaaacaccttcccgaacccccgaaaacaacgccgcgccaaaaaccccctctccgcgccctctacgccctccgcgccctccgcaccctaaaaccccgcgtctccgaactcccgactccgaaccctactacccgaaactcccgaataaacaatcctaccgttaccctatccccaccctaatcccaaacgaaccgccgcgaaacgcctcctaccctctcctactctcaaacgcctctaaaacgcccaaaaacgacgtcgcgaaaacctttactccacctaactaaaaacgcgcgaaatctatacctaccctaaaaaacaacgcctcgaatactctccgacccgaaattccctatctctccgcctacttccgaacgcgaaaaaccctcgccccccaccccttatttccgaaaaaaacgacgccctaaatatccttctctatctccctacgaacataaaacatccttt

SEQ ID NO: 561 - DNA, 563 bp, Artificial Sequence
  chemically treated genomic DNA (Homo sapiens) CpG-island No: 561
atcgggttatttatcgtggggagcggttttatcgttgtttggagtgtggtcgggtttttacgtagcgttcggcgttgatttcgtatttgcgcgtttatatcggcgagaaattttatggttgcgtcgattgtggtcgtcgttttagttagagttttgttttttattagtatcggcgcgtgtatagcggcgagattttttttttttgttcggattgtggtcgcgttttcgtttatttttcggatttgcggcgttacgtgcgtatttatatcggcgagaagttttattcgtgttcggattgcgggcgttgttttcgttagagttcggagatggtagtttataggcgtatttatagcggcgagaagttttatttttgttcgtagtgcggtcgtcgttttggttagaagttagtcgtggttaaatattagtgggtttatcggttcggggtcgggggttataggggtcgggtcgtcgggcgtttgtttgtgattttgatttttggttacggagatttggattcgttcgtgggtttttagttgtattcggagatattttaggagtgtggg

SEQ ID NO: 562 - DNA, 563 bp, Artificial Sequence
  chemically treated genomic DNA (Homo sapiens) CpG-island No: 562
cccacactcctaaaatatctccgaatacaactaaaaacccacgaacgaatccaaatctccgtaaccaaaaatcaaaatcacaaacaaacgcccgacgacccgacccctataacccccgaccccgaaccgataaacccactaatatttaaccacgactaacttctaaccaaaacgacgaccgcactacgaacaaaaataaaacttctcgccgctataaatacgcctataaactaccatctccgaactctaacgaaaacaacgcccgcaatccgaacacgaataaaacttctcgccgatataaatacgcacgtaacgccgcaaatccgaaaaataaacgaaaacgcgaccacaatccgaacaaaaaaaaaaaatctcgccgctatacacgcgccgatactaataaaaaacaaaactctaactaaaacgacgaccacaatcgacgcaaccataaaatttctcgccgatataaacgcgcaaatacgaaatcaacgccgaacgctacgtaaaaacccgaccacactccaaacaacgataaaaccgctccccacgataaataacccgat

SEQ ID NO: 563 - DNA, 563 bp, Artificial Sequence
  chemically treated genomic DNA (Homo sapiens) CpG-island No: 563
tttatatttttggaatattttcgggtatagttggaagtttacgggcgggtttaggttttcgtggttaggggttagggttatagatagacgttcggcgattcggtttttgtggttttcggtttcgggtcgatgaatttattggtgtttggttacggttgatttttggttaaagcggcggtcgtattgcgggtaggggtagggtttttcgtcgttgtgggtgcgtttgtgggttgttattttcgagttttggcggaagtagcgttcgtagttcgggtacgggtagggtttttcgtcggtgtgggtgcgtacgtggcgtcgtaggttcgaggggtaggcgaaggcgcggttatagttcgggtaggggaagggggtttcgtcgttgtgtacgcgtcggtgttggtagagggtagagttttggttgaagcggcggttatagtcggcgtagttatagggtttttcgtcggtgtggacgcgtaggtgcgaagttagcgtcgagcgttgcgtgaaggttcggttatattttagatagcggtggggtcgttttttacgatggatggttcggt

SEQ ID NO: 564 - DNA, 563 bp, Artificial Sequence
  chemically treated genomic DNA (Homo sapiens) CpG-island No: 564
accgaaccatccatcgtaaaaaacgaccccaccgctatctaaaatataaccgaaccttcacgcaacgctcgacgctaacttcgcacctacgcgtccacaccgacgaaaaaccctataactacgccgactataaccgccgcttcaaccaaaactctaccctctaccaacaccgacgcgtacacaacgacgaaacccccttcccctacccgaactataaccgcgccttcgcctacccctcgaacctacgacgccacgtacgcacccacaccgacgaaaaaccctacccgtacccgaactacgaacgctacttccgccaaaactcgaaaataacaacccacaaacgcacccacaacgacgaaaaaccctacccctacccgcaatacgaccgccgctttaaccaaaaatcaaccgtaaccaaacaccaataaattcatcgacccgaaaccgaaaaccacaaaaaccgaatcgccgaacgtctatctataaccctaacccctaaccacgaaaacctaaacccgcccgtaaacttccaactatacccgaaaatattccaaaaatataaa

SEQ ID NO: 565 - DNA, 544 bp, Artificial Sequence
  chemically treated genomic DNA (Homo sapiens) CpG-island No: 565
gggcgcgcgtaggtgtcggggagcggagtttttggagggggttttaggtttaaggatttcggcgaggttaaggggagttcgtttcggttttcgaggcgttgtcggagttgattcggaggttcgggaggggagggagcgagatatcgttttcgttggcgtcgggaagcgtcgttttttttcgttgattttggtttcgtttgtcgtttcgtttttggttatacgtatcgacgacgcggggttcgggagatggatagacgggtttttggagggacggagatttagaatataggtatatatattgtttcggtagtttcgcgggtttcggggcgttcggtttttatttatttcgtggtcgggtttttttagtttagggttaatgttaacgagtttttatttttagcggtttttagagaggtcgcggcgcgagtcggcggggggatttggtcgcggacggatattttttgtgcgggggagggtgggggggtgttgggcggtcgttggatagtgtagtttagttcggggtcggggtttagaaggtgggggt

SEQ ID NO: 566 - DNA, 544 bp, Artificial Sequence
  chemically treated genomic DNA (Homo sapiens) CpG-island No: 566
acccccaccttctaaaccccgaccccgaactaaactacactatccaacgaccgcccaacacccccccaccctcccccgcacaaaaaatatccgtccgcgaccaaatccccccgccgactcgcgccgcgacctctctaaaaaccgctaaaaataaaaactcgttaacattaaccctaaactaaaaaaacccgaccacgaaataaataaaaaccgaacgccccgaaacccgcgaaactaccgaaacaatatatatacctatattctaaatctccgtccctccaaaaacccgtctatccatctcccgaaccccgcgtcgtcgatacgtataaccaaaaacgaaacgacaaacgaaaccaaaatcaacgaaaaaaaacgacgcttcccgacgccaacgaaaacgatatctcgctccctcccctcccgaacctccgaatcaactccgacaacgcctcgaaaaccgaaacgaactccccttaacctcgccgaaatccttaaacctaaaaccccctccaaaaactccgctccccgacacctacgcgcgccc

SEQ ID NO: 567 - DNA, 544 bp, Artificial Sequence
  chemically treated genomic DNA (Homo sapiens) CpG-island No: 567
gtttttattttttggatttcggtttcgggttgggttgtattgtttaacggtcgtttagtatttttttattttttttcgtataggaagtgttcgttcgcggttaggttttttcgtcggttcgcgtcgcggtttttttaggagtcgttggaggtggaaattcgttggtattaattttgggttggaggggttcggttacggggtgggtgaggatcggacgtttcggagttcgcggggttatcggggtagtgtgtgtgtttatgttttaggttttcgtttttttagaggttcgtttgtttatttttcgggtttcgcgtcgtcggtgcgtgtggttaagggcgaggcgataagcgagattaaggttagcgagaaggagcgacgtttttcggcgttagcgggggcggtgtttcgtttttttttttttcgggttttcgggttagtttcggtagcgtttcgggaatcgggacggattttttttggtttcgtcgaggtttttgagtttgggattttttttaggaatttcgtttttcggtatttgcgcgcgttt

SEQ ID NO: 568 - DNA, 544 bp, Artificial Sequence
  chemically treated genomic DNA (Homo sapiens) CpG-island No: 568
aaacgcgcgcaaataccgaaaaacgaaattcctaaaaaaaatcccaaactcaaaaacctcgacgaaaccaaaaaaaatccgtcccgattcccgaaacgctaccgaaactaacccgaaaacccgaaaaaaaaaaaaacgaaacaccgcccccgctaacgccgaaaaacgtcgctccttctcgctaaccttaatctcgcttatcgcctcgcccttaaccacacgcaccgacgacgcgaaacccgaaaaataaacaaacgaacctctaaaaaaacgaaaacctaaaacataaacacacacactaccccgataaccccgcgaactccgaaacgtccgatcctcacccaccccgtaaccgaacccctccaacccaaaattaataccaacgaatttccacctccaacgactcctaaaaaaaccgcgacgcgaaccgacgaaaaaacctaaccgcgaacgaacacttcctatacgaaaaaaaataaaaaaatactaaacgaccgttaaacaatacaacccaacccgaaaccgaaatccaaaaaataaaaac

SEQ ID NO: 569 - DNA, 527 bp, Artificial Sequence
  chemically treated genomic DNA (Homo sapiens) CpG-island No: 569
agcgggggtcgggggtcgtcggggtagtcgcgaagttttttattttcgaggtcgcgacgcgcgggggttagtgagggttacggggaggtcgagattttgggagggggcggggtcgcgggtaggggaggggttcggcgcgttggagaggcgcggggttaagacgttcggtttcgggggttcgggttgggtcgtcgagttttttgggcggcgttgagcgggcgggaggcgggggttcgcggttcggggtaatcgaggtcgggtcgcgggatcggtcgttatcgtcgtcgtcgttgtattgggagttcgcggggatggagcgggaggcgttgtcgtggggtttcgagttttaggatgtgtagagttttgacgaaatgaggagtttcgaagggtattttagaggtgaggagggagcgttcgttcgaggagtggatttgcgcgtaggagaaggggttgtggttttagggagggagcgagggttcggggttgggatatttgggattcgaaggaggggtcggcggggattgggg

SEQ ID NO: 570 - DNA, 527 bp, Artificial Sequence
  chemically treated genomic DNA (Homo sapiens) CpG-island No: 570
ccccaatccccgccgacccctccttcgaatcccaaatatcccaaccccgaaccctcgctccctccctaaaaccacaaccccttctcctacgcgcaaatccactcctcgaacgaacgctccctcctcacctctaaaatacccttcgaaactcctcatttcgtcaaaactctacacatcctaaaactcgaaaccccacgacaacgcctcccgctccatccccgcgaactcccaatacaacgacgacgacgataacgaccgatcccgcgacccgacctcgattaccccgaaccgcgaacccccgcctcccgcccgctcaacgccgcccaaaaaactcgacgacccaacccgaacccccgaaaccgaacgtcttaaccccgcgcctctccaacgcgccgaacccctcccctacccgcgaccccgccccctcccaaaatctcgacctccccgtaaccctcactaacccccgcgcgtcgcgacctcgaaaataaaaaacttcgcgactaccccgacgacccccgacccccgct

SEQ ID NO: 571 - DNA, 527 bp, Artificial Sequence
  chemically treated genomic DNA (Homo sapiens) CpG-island No: 571
ttttagttttcgtcggtttttttttcgagttttaggtgttttagtttcgggttttcgttttttttttggagttatagtttttttttttgcgcgtaagtttatttttcggacgggcgttttttttttatttttgaggtatttttcggggttttttatttcgttagaattttgtatattttggggttcgaggttttacggtaacgtttttcgttttattttcgcgggtttttagtgtagcggcggcggcgatggcggtcgatttcgcgattcggtttcggttgtttcgagtcgcgggttttcgtttttcgttcgtttagcgtcgtttaggggattcggcggtttagttcgggttttcgaggtcggacgttttgatttcgcgtttttttagcgcgtcgggttttttttttgttcgcggtttcgtttttttttaaggtttcggttttttcgtggtttttattggttttcgcgcgtcgcggtttcggggatgaggggtttcgcgattatttcggcggttttcggttttcgtt

SEQ ID NO: 572 - DNA, 527 bp, Artificial Sequence
  chemically treated genomic DNA (Homo sapiens) CpG-island No: 572
aacgaaaaccgaaaaccgccgaaataatcgcgaaacccctcatccccgaaaccgcgacgcgcgaaaaccaataaaaaccacgaaaaaaccgaaaccttaaaaaaaaacgaaaccgcgaacaaaaaaaaaacccgacgcgctaaaaaaacgcgaaatcaaaacgtccgacctcgaaaacccgaactaaaccgccgaatcccctaaacgacgctaaacgaacgaaaaacgaaaacccgcgactcgaaacaaccgaaaccgaatcgcgaaatcgaccgccatcgccgccgccgctacactaaaaacccgcgaaaataaaacgaaaaacgttaccgtaaaacctcgaaccccaaaatatacaaaattctaacgaaataaaaaaccccgaaaaatacctcaaaaataaaaaaaaaacgcccgtccgaaaaataaacttacgcgcaaaaaaaaaaactataactccaaaaaaaaaacgaaaacccgaaactaaaacacctaaaactcgaaaaaaaaaccgacgaaaactaaaa

SEQ ID NO: 573 - DNA, 755 bp, Artificial Sequence
  chemically treated genomic DNA (Homo sapiens) CpG-island No: 573
cggtcggcgttgtaggggtttattttttttttttattttgttttcgggatttgtgtaggagttcgatgagtattacggcggcgcggattttcgtttttcggtaatgtttttttttcgcgggttgggatatggcgaggtcgttcgcggtgttcgatttcgttcgttcgcgttttcgtagtttcggtttcgcgcgtttcgtattcggtttttgagttcgcgtttcggttttcggttttcgtttcgtatgggtttcgtttcgtttaggtgcgtttcgggggttaggtgatcgcgcgtttttttttttttttcggcgatttttagcgttttttcggggttcgcggggtagtcgtcgttcgttttttcggcgcgggtattttcgaggttcgttcggggcgcggttcgggtcggcggttttcggttttcgtttagacgcgtcgttcgcgtcgggattcgtttcggtttcgtttttcgcgtttcggtttcggtcgttcggatggtggaggacgcggggtatagggagcgggcgaagcgtaggaggaggcggatagcgttttcgggatttttttgttcggtttttaggcgtttttttcggtttcggttttgttttttttcgttcgttttttttggttttcgttcgtattttcgtcggcggtttcgagttttttttttaggtagaggcggttgtcgtttttttcggttcggtttcggatattttttcgatgttgttattgtttttaaaatagagggagagaaaa

SEQ ID NO: 574 - DNA, 755 bp, Artificial Sequence
  chemically treated genomic DNA (Homo sapiens) CpG-island No: 574
ttttctctccctctattttaaaaacaataacaacatcgaaaaaatatccgaaaccgaaccgaaaaaaacgacaaccgcctctacctaaaaaaaaaactcgaaaccgccgacgaaaatacgaacgaaaaccaaaaaaaacgaacgaaaaaaaacaaaaccgaaaccgaaaaaaacgcctaaaaaccgaacaaaaaaatcccgaaaacgctatccgcctcctcctacgcttcgcccgctccctataccccgcgtcctccaccatccgaacgaccgaaaccgaaacgcgaaaaacgaaaccgaaacgaatcccgacgcgaacgacgcgtctaaacgaaaaccgaaaaccgccgacccgaaccgcgccccgaacgaacctcgaaaatacccgcgccgaaaaaacgaacgacgactaccccgcgaaccccgaaaaaacgctaaaaatcgccgaaaaaaaaaaaaaaacgcgcgatcacctaacccccgaaacgcacctaaacgaaacgaaacccatacgaaacgaaaaccgaaaaccgaaacgcgaactcaaaaaccgaatacgaaacgcgcgaaaccgaaactacgaaaacgcgaacgaacgaaatcgaacaccgcgaacgacctcgccatatcccaacccgcgaaaaaaaaacattaccgaaaaacgaaaatccgcgccgccgtaatactcatcgaactcctacacaaatcccgaaaacaaaataaaaaaaaaaaataaacccctacaacgccgaccg

SEQ ID NO: 575 - DNA, 755 bp, Artificial Sequence
  chemically treated genomic DNA (Homo sapiens) CpG-island No: 575
ttttttttttttttgttttaaaagtagtgatagtatcggggaagtattcggggtcgggtcggggagggcggtagtcgtttttgtttggggagggagttcggggtcgtcggcgggagtgcgggcggggattagaaggagcgggcgaggggaggtagggtcggggtcggggagggcgtttgggagtcgggtaggggggtttcgggagcgttgttcgtttttttttgcgtttcgttcgttttttgtgtttcgcgttttttattattcgggcggtcgaggtcggggcgcgggaggcggggtcggggcgggtttcggcgcgggcggcgcgtttgagcgggagtcgggagtcgtcggttcgggtcgcgtttcgagcgagtttcggaaatgttcgcgtcgggggagcggacggcggttgtttcgcgggtttcgaggagacgttgaaggtcgtcgggagggaggggagagcgcgcggttatttgattttcggggcgtatttaggcggggcggggtttatgcgaggcggaggtcgggggtcggggcgcgggtttaggggtcgggtgcggagcgcgcggagtcggggttgcggggacgcgggcgggcgaggtcgggtatcgcgggcggtttcgttatgttttagttcgcggggaggaggtattgtcgaaaggcggggattcgcgtcgtcgtggtgtttatcggatttttgtataaatttcggaggtagaataaagagaaaaggtaaatttttgtagcgtcggtcg

SEQ ID NO: 576 - DNA, 755 bp, Artificial Sequence
  chemically treated genomic DNA (Homo sapiens) CpG-island No: 576
cgaccgacgctacaaaaatttaccttttctctttattctacctccgaaatttatacaaaaatccgataaacaccacgacgacgcgaatccccgcctttcgacaatacctcctccccgcgaactaaaacataacgaaaccgcccgcgatacccgacctcgcccgcccgcgtccccgcaaccccgactccgcgcgctccgcacccgacccctaaacccgcgccccgacccccgacctccgcctcgcataaaccccgccccgcctaaatacgccccgaaaatcaaataaccgcgcgctctcccctccctcccgacgaccttcaacgtctcctcgaaacccgcgaaacaaccgccgtccgctcccccgacgcgaacatttccgaaactcgctcgaaacgcgacccgaaccgacgactcccgactcccgctcaaacgcgccgcccgcgccgaaacccgccccgaccccgcctcccgcgccccgacctcgaccgcccgaataataaaaaacgcgaaacacaaaaaacgaacgaaacgcaaaaaaaaacgaacaacgctcccgaaacccccctacccgactcccaaacgccctccccgaccccgaccctacctcccctcgcccgctccttctaatccccgcccgcactcccgccgacgaccccgaactccctccccaaacaaaaacgactaccgccctccccgacccgaccccgaatacttccccgatactatcactacttttaaaacaaaaaaaaaaaaaa

SEQ ID NO: 577 - DNA, 533 bp, Artificial Sequence
  chemically treated genomic DNA (Homo sapiens) CpG-island No: 577
tttttcgtcgtgaaagggttaaggtcgacggcggttttcgttacgaaaaagagttttttttcggattttttttttttttcgaaaggaaggatagacggtcgcgttcggtagtttcgtcggaaggaagaggtttttttatttataattgacgatgtgggttggacgagaaaaaaagtaaggagggtttttatggaggggggcggggtcgggcggaaggattcgaaaggaggttgcgaagagattttgtgatttcgcgaaggaggtaaaaagaagggtcggcgcggcgggaggagttacgcgagagttcgagggggcggggcgggcggttacgtgattggcgggcgggaagacgcggcggagaggcgtaaataagttgcggcgtttgggtgtggttggagcgttttgtttttgtttttcgagtcgtttttgtttttcgtttgcgtggcgtttttcgagggtttttttgtgggcggttttagagtagcgattttgttttttaaggagttgttggggttcgcgtgggtgaagggttt

SEQ ID NO: 578 - DNA, 533 bp, Artificial Sequence
  chemically treated genomic DNA (Homo sapiens) CpG-island No: 578
aaacccttcacccacgcgaaccccaacaactccttaaaaaacaaaatcgctactctaaaaccgcccacaaaaaaaccctcgaaaaacgccacgcaaacgaaaaacaaaaacgactcgaaaaacaaaaacaaaacgctccaaccacacccaaacgccgcaacttatttacgcctctccgccgcgtcttcccgcccgccaatcacgtaaccgcccgccccgccccctcgaactctcgcgtaactcctcccgccgcgccgacccttctttttacctccttcgcgaaatcacaaaatctcttcgcaacctcctttcgaatccttccgcccgaccccgcccccctccataaaaaccctccttactttttttctcgtccaacccacatcgtcaattataaataaaaaaacctcttccttccgacgaaactaccgaacgcgaccgtctatccttcctttcgaaaaaaaaaaaaaatccgaaaaaaaactctttttcgtaacgaaaaccgccgtcgaccttaaccctttcacgacgaaaaa

SEQ ID NO: 579 - DNA, 533 bp, Artificial Sequence
  chemically treated genomic DNA (Homo sapiens) CpG-island No: 579
aggttttttatttacgcgggttttagtagttttttgggaaataggatcgttgttttgaggtcgtttatagagagattttcggagggcgttacgtaagcgaagggtagaaacgattcggggggtaggggtagggcgttttaattatatttaggcgtcgtagtttgtttacgttttttcgtcgcgttttttcgttcgttagttacgtgatcgttcgtttcgttttttcgggttttcgcgtggtttttttcgtcgcgtcggtttttttttttgtttttttcgcggagttataagattttttcgtagttttttttcggattttttcgttcggtttcgtttttttttataaaaattttttttattttttttttcgtttaatttatatcgttagttatgagtggaagagtttttttttttcggcggggttgtcgagcgcggtcgtttattttttttttcgagaaggaggggaggttcggagggggattttttttcgtggcggaggtcgtcgtcggttttggtttttttacgacggggga

SEQ ID NO: 580 - DNA, 533 bp, Artificial Sequence
  chemically treated genomic DNA (Homo sapiens) CpG-island No: 580
tcccccgtcgtaaaaaaaccaaaaccgacgacgacctccgccacgaaaaaaaatccccctccgaacctcccctccttctcgaaaaaaaaaataaacgaccgcgctcgacaaccccgccgaaaaaaaaaaactcttccactcataactaacgatataaattaaacgaaaaaaaaaataaaaaaaatttttataaaaaaaaacgaaaccgaacgaaaaaatccgaaaaaaaactacgaaaaaatcttataactccgcgaaaaaaacaaaaaaaaaaaccgacgcgacgaaaaaaaccacgcgaaaacccgaaaaaacgaaacgaacgatcacgtaactaacgaacgaaaaaacgcgacgaaaaaacgtaaacaaactacgacgcctaaatataattaaaacgccctacccctaccccccgaatcgtttctacccttcgcttacgtaacgccctccgaaaatctctctataaacgacctcaaaacaacgatcctatttcccaaaaaactactaaaacccgcgtaaataaaaaacct

SEQ ID NO: 581 - DNA, 916 bp, Artificial Sequence
  chemically treated genomic DNA (Homo sapiens) CpG-island No: 581
gaacgtgtatatttggtgacgtcggcgcgtcgatttagcggttttcgtttggttggggcgaggttggttttaggttttagcggggtggggagtattgagtaggcggttggggcggacggatacgtgagatcggtcgtatatggcgttgggagcgtggcgcgtgcgcgcggcgaagcggagtgacgtgtacgcgttgtttgcggtttcgcgtaggtttcgtgtgcgcgttcggttttggataataggttcggttgtttcgcggggggaatattcgcgtcggttcgcgggagggaggtttgagcgcgttttcgagcgcgttttcgagtttacgcggcggggcgcgtttttcgtatttgcgggcgggttggggcggggtcgcggttgttttcgtttattcgggttcgagttcggggagtcggggcggaatcgagcggcgaggttcgagcggtcggagcgcggcgcggcgtagataatgggagcggcgttggcggttgtcggggcggtttcgagggtcgtagagttttgggttcggcggggatcggaggtcgcgttatgagtttcgtagtcgggcgtatttttgcgcgcgcgcgggtttaggcgagcggtttttgcgagtttcgggtttcgttttggggtcggcgatgtgttatcgaggttgaggatgatggtagattgttaggtgagtgcgcgtcgtttttagtttcgcgtcgcgggtggagggaggatcgtatgttttagtttatatttatcggggggagggagttcggcgtcgcgtttacgttgagcgtgcgtttacgtagtttcgcgtttaatttcgttcgggatagtagggaaattgaggataggagaggggtagggattcgttcggggtatacgaagttggcggagtttagagatgaagggagggtttcggttt

SEQ ID NO: 582 - DNA, 916 bp, Artificial Sequence
  chemically treated genomic DNA (Homo sapiens) CpG-island No: 582
aaaccgaaaccctcccttcatctctaaactccgccaacttcgtataccccgaacgaatccctacccctctcctatcctcaatttccctactatcccgaacgaaattaaacgcgaaactacgtaaacgcacgctcaacgtaaacgcgacgccgaactccctccccccgataaatataaactaaaacatacgatcctccctccacccgcgacgcgaaactaaaaacgacgcgcactcacctaacaatctaccatcatcctcaacctcgataacacatcgccgaccccaaaacgaaacccgaaactcgcaaaaaccgctcgcctaaacccgcgcgcgcgcaaaaatacgcccgactacgaaactcataacgcgacctccgatccccgccgaacccaaaactctacgaccctcgaaaccgccccgacaaccgccaacgccgctcccattatctacgccgcgccgcgctccgaccgctcgaacctcgccgctcgattccgccccgactccccgaactcgaacccgaataaacgaaaacaaccgcgaccccgccccaacccgcccgcaaatacgaaaaacgcgccccgccgcgtaaactcgaaaacgcgctcgaaaacgcgctcaaacctccctcccgcgaaccgacgcgaatattccccccgcgaaacaaccgaacctattatccaaaaccgaacgcgcacacgaaacctacgcgaaaccgcaaacaacgcgtacacgtcactccgcttcgccgcgcgcacgcgccacgctcccaacgccatatacgaccgatctcacgtatccgtccgccccaaccgcctactcaatactccccaccccgctaaaacctaaaaccaacctcgccccaaccaaacgaaaaccgctaaatcgacgcgccgacgtcaccaaatatacacgttc

SEQ ID NO: 583 - DNA, 916 bp, Artificial Sequence
  chemically treated genomic DNA (Homo sapiens) CpG-island No: 583
aggtcggaattttttttttatttttggatttcgttaatttcgtgtgtttcgggcgagtttttgttttttttttgtttttagtttttttattgtttcgggcggggttggacgcggagttgcgtaagcgtacgtttagcgtggacgcggcgtcgggtttttttttttcggtgggtgtgggttggggtatacggttttttttttattcgcgacgcgaggttggggacggcgcgtatttatttggtaatttattattatttttagtttcggtggtatatcgtcggttttagggcgggattcggggttcgtagaggtcgttcgtttgggttcgcgcgcgcgtaggggtgcgttcggttgcggggtttatggcgcggttttcggttttcgtcgggtttaggattttgcggttttcggggtcgtttcggtagtcgttagcgtcgtttttattgtttgcgtcgcgtcgcgtttcggtcgttcgggtttcgtcgttcggtttcgtttcggtttttcgggttcgggttcgggtgggcggggatagtcgcggtttcgttttagttcgttcgtaggtgcgaggggcgcgtttcgtcgcgtgagttcggggacgcgttcgggggcgcgtttaggtttttttttcgcgggtcgacgcgggtgtttttttcgcggggtagtcgggtttgttgtttaaggtcgggcgcgtatacggggtttgcgcgggatcgtagatagcgcgtgtacgttatttcgtttcgtcgcgcgtacgcgttacgtttttagcgttatgtgcggtcgattttacgtgttcgttcgttttagtcgtttgtttagtattttttatttcgttaggatttagggttaatttcgttttagttaggcgggggtcgttgagtcggcgcgtcggcgttattaaatatatacgttt

SEQ ID NO: 584 - DNA, 916 bp, Artificial Sequence
  chemically treated genomic DNA (Homo sapiens) CpG-island No: 584
aaacgtatatatttaataacgccgacgcgccgactcaacgacccccgcctaactaaaacgaaattaaccctaaatcctaacgaaataaaaaatactaaacaaacgactaaaacgaacgaacacgtaaaatcgaccgcacataacgctaaaaacgtaacgcgtacgcgcgacgaaacgaaataacgtacacgcgctatctacgatcccgcgcaaaccccgtatacgcgcccgaccttaaacaacaaacccgactaccccgcgaaaaaaacacccgcgtcgacccgcgaaaaaaaaacctaaacgcgcccccgaacgcgtccccgaactcacgcgacgaaacgcgcccctcgcacctacgaacgaactaaaacgaaaccgcgactatccccgcccacccgaacccgaacccgaaaaaccgaaacgaaaccgaacgacgaaacccgaacgaccgaaacgcgacgcgacgcaaacaataaaaacgacgctaacgactaccgaaacgaccccgaaaaccgcaaaatcctaaacccgacgaaaaccgaaaaccgcgccataaaccccgcaaccgaacgcacccctacgcgcgcgcgaacccaaacgaacgacctctacgaaccccgaatcccgccctaaaaccgacgatataccaccgaaactaaaaataataataaattaccaaataaatacgcgccgtccccaacctcgcgtcgcgaataaaaaaaaaaccgtataccccaacccacacccaccgaaaaaaaaaaacccgacgccgcgtccacgctaaacgtacgcttacgcaactccgcgtccaaccccgcccgaaacaataaaaaaactaaaaacaaaaaaaaaacaaaaactcgcccgaaacacacgaaattaacgaaatccaaaaataaaaaaaaaattccgacct

SEQ ID NO: 585 - DNA, 915 bp, Artificial Sequence
  chemically treated genomic DNA (Homo sapiens) CpG-island No: 585
gaacgtgtatatttggtgacgtcggcgcgtcgatttagcggttttcgtttggttggggcgaggttggttttaggttttagcggggtggggagtattgagtaggcggttggggcggacggatacgtgagatcggtcgtatatggcgttgggagcggtggcgcggtgcgcggcgaagcggagtgacgtgtacgcgttgtttgcggtttcgcgtaggtttcgtgtgcgcgttcggttttggataataggttcggttgtttcgcggggggaatattcgcgtcggttcgcgggagggaggtttgagcgcgttttcgagcgcgttttcgagtttacgcggcggggcgcgtttttcgtatttgcgggcgggttggggcggggtcgcggttgttttcgttttaatcggttcgagttcggggagtcggggcggaatcgagcggcgaggttcgagcggtcggagcgcggcgcggcgtagataatgggagcggcgttggcggttggggttcggggttcgagggtcgtagagttttgggttcggcggggatcggaggtcgcgttatgagtttcgtagtcgggcgtatttttgcgcgcgcgcgggtttaggcgagcggtttttgcgagtttcgggtttcgttttggggtcggcgatgtgttatcgaggttgaggatgatggtagattgttaggtgagtgcgcgtcgtttttagtttcgcgtcgcgggtggagggaggatcgtatgttttagtttatatttatcggggggagggagttcggcgtcgcgtttacgttgagcgtgcgttttaacggttcgcgtttaatttcgttcgggatagtagggaaattgaggataggagaggggtagggattcgttcggggtatacgaagttggcggagtttagagatgaagggagggtttcgtttt

SEQ ID NO: 586 - DNA, 915 bp, Artificial Sequence
  chemically treated genomic DNA (Homo sapiens) CpG-island No: 586
aaaacgaaaccctcccttcatctctaaactccgccaacttcgtataccccgaacgaatccctacccctctcctatcctcaatttccctactatcccgaacgaaattaaacgcgaaccgttaaaacgcacgctcaacgtaaacgcgacgccgaactccctccccccgataaatataaactaaaacatacgatcctccctccacccgcgacgcgaaactaaaaacgacgcgcactcacctaacaatctaccatcatcctcaacctcgataacacatcgccgaccccaaaacgaaacccgaaactcgcaaaaaccgctcgcctaaacccgcgcgcgcgcaaaaatacgcccgactacgaaactcataacgcgacctccgatccccgccgaacccaaaactctacgaccctcgaaccccgaaccccaaccgccaacgccgctcccattatctacgccgcgccgcgctccgaccgctcgaacctcgccgctcgattccgccccgactccccgaactcgaaccgattaaaacgaaaacaaccgcgaccccgccccaacccgcccgcaaatacgaaaaacgcgccccgccgcgtaaactcgaaaacgcgctcgaaaacgcgctcaaacctccctcccgcgaaccgacgcgaatattccccccgcgaaacaaccgaacctattatccaaaaccgaacgcgcacacgaaacctacgcgaaaccgcaaacaacgcgtacacgtcactccgcttcgccgcgcaccgcgccaccgctcccaacgccatatacgaccgatctcacgtatccgtccgccccaaccgcctactcaatactccccaccccgctaaaacctaaaaccaacctcgccccaaccaaacgaaaaccgctaaatcgacgcgccgacgtcaccaaatatacacgttc

SEQ ID NO: 587 - DNA, 915 bp, Artificial Sequence
  chemically treated genomic DNA (Homo sapiens) CpG-island No: 587
gaggcggaattttttttttatttttggatttcgttaatttcgtgtgtttcgggcgagtttttgttttttttttgtttttagtttttttattgtttcgggcggggttggacgcggatcgttaaagcgtacgtttagcgtggacgcggcgtcgggtttttttttttcggtgggtgtgggttggggtatacggttttttttttattcgcgacgcgaggttggggacggcgcgtatttatttggtaatttattattatttttagtttcggtggtatatcgtcggttttagggcgggattcggggttcgtagaggtcgttcgtttgggttcgcgcgcgcgtaggggtgcgttcggttgcggggtttatggcgcggttttcggttttcgtcgggtttaggattttgcggttttcgggtttcgggttttagtcgttagcgtcgtttttattgtttgcgtcgcgtcgcgtttcggtcgttcgggtttcgtcgttcggtttcgtttcggtttttcgggttcgggtcggttggggcggggatagtcgcggtttcgttttagttcgttcgtaggtgcgaggggcgcgtttcgtcgcgtgagttcggggacgcgttcgggggcgcgtttaggtttttttttcgcgggtcgacgcgggtgtttttttcgcggggtagtcgggtttgttgtttaaggtcgggcgcgtatacggggtttgcgcgggatcgtagatagcgcgtgtacgttatttcgtttcgtcgcgtatcgcgttatcgtttttagcgttatgtgcggtcgattttacgtgttcgttcgttttagtcgtttgtttagtattttttatttcgttaggatttagggttaatttcgttttagttaggcgggggtcgttgagtcggcgcgtcggcgttattaaatatatacgttt

SEQ ID NO: 588 - DNA, 915 bp, Artificial Sequence
  chemically treated genomic DNA (Homo sapiens) CpG-island No: 588
aaacgtatatatttaataacgccgacgcgccgactcaacgacccccgcctaactaaaacgaaattaaccctaaatcctaacgaaataaaaaatactaaacaaacgactaaaacgaacgaacacgtaaaatcgaccgcacataacgctaaaaacgataacgcgatacgcgacgaaacgaaataacgtacacgcgctatctacgatcccgcgcaaaccccgtatacgcgcccgaccttaaacaacaaacccgactaccccgcgaaaaaaacacccgcgtcgacccgcgaaaaaaaaacctaaacgcgcccccgaacgcgtccccgaactcacgcgacgaaacgcgcccctcgcacctacgaacgaactaaaacgaaaccgcgactatccccgccccaaccgacccgaacccgaaaaaccgaaacgaaaccgaacgacgaaacccgaacgaccgaaacgcgacgcgacgcaaacaataaaaacgacgctaacgactaaaacccgaaacccgaaaaccgcaaaatcctaaacccgacgaaaaccgaaaaccgcgccataaaccccgcaaccgaacgcacccctacgcgcgcgcgaacccaaacgaacgacctctacgaaccccgaatcccgccctaaaaccgacgatataccaccgaaactaaaaataataataaattaccaaataaatacgcgccgtccccaacctcgcgtcgcgaataaaaaaaaaaccgtataccccaacccacacccaccgaaaaaaaaaaacccgacgccgcgtccacgctaaacgtacgctttaacgatccgcgtccaaccccgcccgaaacaataaaaaaactaaaaacaaaaaaaaaacaaaaactcgcccgaaacacacgaaattaacgaaatccaaaaataaaaaaaaaattccgcctc

SEQ ID NO: 589 - DNA, 502 bp, Artificial Sequence
  chemically treated genomic DNA (Homo sapiens) CpG-island No: 589
tttattttcgaacgtttttttagttgcgtagcgttagtgatttttttttttgggatgtttgcgttaggttagttttagtttttcgggtttttatcgcgcgttttcgttatttgcgcgtattttggggttttcgtcgcgtggttcgcggtttttattttcgcgttttagatttcgcgcgttttgggtcgttttattttttagttttttattgtttgttcgtattttcgggttttttacgtcgttcgttttagttatcgttcgtcgtgggtttcggagatgcgggtagcggcgcgacgtattgcggggtttttagggcggggttaggggtcgttgggtcgtgtttttatggtagcgtcgtaggtttggcgagtcgagcgtagaggttgggtaggcgtgtgcgacgagtttaagttatcgatcgtttcgcgaggaggggttgggttcgtttcgaataggaattggaagaggaggaggaggggttggaggaggaggggttggagga

SEQ ID NO: 590 - DNA, 502 bp, Artificial Sequence
  chemically treated genomic DNA (Homo sapiens) CpG-island No: 590
tcctccaacccctcctcctccaacccctcctcctcctcttccaattcctattcgaaacgaacccaacccctcctcgcgaaacgatcgataacttaaactcgtcgcacacgcctacccaacctctacgctcgactcgccaaacctacgacgctaccataaaaacacgacccaacgacccctaaccccgccctaaaaaccccgcaatacgtcgcgccgctacccgcatctccgaaacccacgacgaacgataactaaaacgaacgacgtaaaaaacccgaaaatacgaacaaacaataaaaaactaaaaaataaaacgacccaaaacgcgcgaaatctaaaacgcgaaaataaaaaccgcgaaccacgcgacgaaaaccccaaaatacgcgcaaataacgaaaacgcgcgataaaaacccgaaaaactaaaactaacctaacgcaaacatcccaaaaaaaaaaatcactaacgctacgcaactaaaaaaacgttcgaaaataaa

SEQ ID NO: 591 - DNA, 502 bp, Artificial Sequence
  chemically treated genomic DNA (Homo sapiens) CpG-island No: 591
ttttttagtttttttttttttagtttttttttttttttttttagtttttattcggggcgggtttagttttttttcgcggagcgatcgatggtttgggttcgtcgtatacgtttgtttagtttttgcgttcggttcgttaggtttgcggcgttgttatggagatacggtttagcggtttttggtttcgttttgggagtttcgtagtgcgtcgcgtcgttgttcgtattttcgaggtttacgacgagcggtgattggggcgggcgacgtgggggattcggggatgcgggtagataatagggggttggaggatggggcgatttagagcgcgcggggtttggggcgcggggatgggggtcgcgggttacgcgacggggattttagggtgcgcgtaggtggcggggacgcgcgatgggggttcgggaagttgaggttgatttagcgtaggtattttaggaggggaggttattgacgttgcgtagttgggaaggcgttcgggagtggg

SEQ ID NO: 592 - DNA, 502 bp, Artificial Sequence
  chemically treated genomic DNA (Homo sapiens) CpG-island No: 592
cccactcccgaacgccttcccaactacgcaacgtcaataacctcccctcctaaaatacctacgctaaatcaacctcaacttcccgaacccccatcgcgcgtccccgccacctacgcgcaccctaaaatccccgtcgcgtaacccgcgacccccatccccgcgccccaaaccccgcgcgctctaaatcgccccatcctccaaccccctattatctacccgcatccccgaatcccccacgtcgcccgccccaatcaccgctcgtcgtaaacctcgaaaatacgaacaacgacgcgacgcactacgaaactcccaaaacgaaaccaaaaaccgctaaaccgtatctccataacaacgccgcaaacctaacgaaccgaacgcaaaaactaaacaaacgtatacgacgaacccaaaccatcgatcgctccgcgaaaaaaaactaaacccgccccgaataaaaactaaaaaaaaaaaaaaaaaaactaaaaaaaaaaaaactaaaaaa

SEQ ID NO: 593 - DNA, 776 bp, Artificial Sequence
  chemically treated genomic DNA (Homo sapiens) CpG-island No: 593
  misc_feature (724)..(724): n is either a, c, g or t
ggtgcgggtcggcgtcgtagtttagtgcgcggtcgtaaggggtaggtgcgaggtcggttgttattcgggagtttcgcgttgtttttttttgcgtagttagggtttatttgggtcgttttcgtttcgtatttttgcgcgtttcgtttttatttttagttcggttttttattttgtttattcgagcgtttttttagttttttcgcgtcgcgttcgggtcgtttggtcggttttgcgggtcgtggcgcgacggcgtcgttatggtaatcgggcggcgggttgggcggtgttttcgggatcggaagtggcgtacgcggttttcggggttgtttcgtacgtgttaggttttcgcggttgcggttacgttcgggatcgggttttgttagtttcgggttcgtacgtgggcgaatcgcggttatcgtgagttcggtttcgcgattttttttcggggtttttatgatcgggggtgcgtgggatttgcggtttgcgggggtggagggtcgggagttttttcgggtttgtttcgagggtcgcgggattcgtttttgcgagtttcgattgcgtacggaaggatttggggtcggttaggtttgggggatgggacgggtttcgaggagagcgggtgttaggggcgagattcgtcgttttttttcggtttggtttcgcgttttttgattttttcgttttacgttttttattttgttttttatttttttttttgtttcgnttttcgttttgttcgggtttaggaggttattagatgttagattcggttcggg

SEQ ID NO: 594 - DNA, 776 bp, Artificial Sequence
  chemically treated genomic DNA (Homo sapiens) CpG-island No: 594
  misc_feature (53)..(53): n is either a, c, g or t
cccgaaccgaatctaacatctaataacctcctaaacccgaacaaaacgaaaancgaaacaaaaaaaaaaataaaaaacaaaataaaaaacgtaaaacgaaaaaatcaaaaaacgcgaaaccaaaccgaaaaaaaacgacgaatctcgcccctaacacccgctctcctcgaaacccgtcccatcccccaaacctaaccgaccccaaatccttccgtacgcaatcgaaactcgcaaaaacgaatcccgcgaccctcgaaacaaacccgaaaaaactcccgaccctccacccccgcaaaccgcaaatcccacgcacccccgatcataaaaaccccgaaaaaaaatcgcgaaaccgaactcacgataaccgcgattcgcccacgtacgaacccgaaactaacaaaacccgatcccgaacgtaaccgcaaccgcgaaaacctaacacgtacgaaacaaccccgaaaaccgcgtacgccacttccgatcccgaaaacaccgcccaacccgccgcccgattaccataacgacgccgtcgcgccacgacccgcaaaaccgaccaaacgacccgaacgcgacgcgaaaaaactaaaaaaacgctcgaataaacaaaataaaaaaccgaactaaaaataaaaacgaaacgcgcaaaaatacgaaacgaaaacgacccaaataaaccctaactacgcaaaaaaaaacaacgcgaaactcccgaataacaaccgacctcgcacctaccccttacgaccgcgcactaaactacgacgccgacccgcacc

SEQ ID NO: 595 - DNA, 776 bp, Artificial Sequence
  chemically treated genomic DNA (Homo sapiens) CpG-island No: 595
  misc_feature (53)..(53): n is either a, c, g or t
ttcgaatcgggtttgatatttagtggttttttgggttcgggtagggcgagggncggggtagggaagaaggtggagggtagaatgggaggcgtggagcgagaaaattaggaagcgcgggattaagtcggggaagggcggcgggtttcgtttttggtattcgtttttttcggggttcgttttattttttaggtttggtcgattttaggttttttcgtgcgtagtcggggttcgtaaggacgaatttcgcggttttcgaggtaggttcgggggagttttcggttttttattttcgtaggtcgtagattttacgtattttcgattatgggggtttcggagggaggtcgcgaggtcgggtttacggtggtcgcggttcgtttacgtgcgggttcggagttggtagggttcggtttcgagcgtggtcgtaatcgcggggatttggtacgtgcggggtagtttcgggggtcgcgtacgttattttcggtttcggagatatcgtttagttcgtcgttcggttgttatggcgacgtcgtcgcgttacggttcgtagaatcggttaagcgattcgggcgcggcgcggggaggttgaagggacgttcgggtaggtaaggtaggaggtcgggttgggggtgggagcggagcgcgtaggggtgcggggcgggggcggtttaggtgagttttgattgcgtagggagggatagcgcggggttttcgagtagtagtcggtttcgtatttgttttttgcggtcgcgtattggattgcggcgtcgattcgtatt

SEQ ID NO: 596 - DNA, 776 bp, Artificial Sequence
  chemically treated genomic DNA (Homo sapiens) CpG-island No: 596
  misc_feature (724)..(724): n is either a, c, g or t
aatacgaatcgacgccgcaatccaatacgcgaccgcaaaaaacaaatacgaaaccgactactactcgaaaaccccgcgctatccctccctacgcaatcaaaactcacctaaaccgcccccgccccgcacccctacgcgctccgctcccacccccaacccgacctcctaccttacctacccgaacgtcccttcaacctccccgcgccgcgcccgaatcgcttaaccgattctacgaaccgtaacgcgacgacgtcgccataacaaccgaacgacgaactaaacgatatctccgaaaccgaaaataacgtacgcgacccccgaaactaccccgcacgtaccaaatccccgcgattacgaccacgctcgaaaccgaaccctaccaactccgaacccgcacgtaaacgaaccgcgaccaccgtaaacccgacctcgcgacctccctccgaaacccccataatcgaaaatacgtaaaatctacgacctacgaaaataaaaaaccgaaaactcccccgaacctacctcgaaaaccgcgaaattcgtccttacgaaccccgactacgcacgaaaaaacctaaaatcgaccaaacctaaaaaataaaacgaaccccgaaaaaaacgaataccaaaaacgaaacccgccgcccttccccgacttaatcccgcgcttcctaattttctcgctccacgcctcccattctaccctccaccttcttccctaccccgnccctcgccctacccgaacccaaaaaaccactaaatatcaaacccgattcgaa

SEQ ID NO: 597 - DNA, 842 bp, Artificial Sequence
  chemically treated genomic DNA (Homo sapiens) CpG-island No: 597
  misc_feature (4)..(4): n is either a, c, g or t
  misc_feature (6)..(6): n is either a, c, g or t
  misc_feature (32)..(32): n is either a, c, g or t
  misc_feature (36)..(36): n is either a, c, g or t
  misc_feature (54)..(54): n is either a, c, g or t
  misc_feature (116)..(116): n is either a, c, g or t
  misc_feature (243)..(243): n is either a, c, g or t
  misc_feature (269)..(269): n is either a, c, g or t
  misc_feature (271)..(271): n is either a, c, g or t
  misc_feature (289)..(289): n is either a, c, g or t
  misc_feature (301)..(301): n is either a, c, g or t
  misc_feature (369)..(369): n is either a, c, g or t
  misc_feature (421)..(421): n is either a, c, g or t
  misc_feature (423)..(423): n is either a, c, g or t
  misc_feature (504)..(504): n is either a, c, g or t
  misc_feature (512)..(513): n is either a, c, g or t
  misc_feature (525)..(525): n is either a, c, g or t
ggtntncgcgtttttgttcggggcgggttagngaantttcggttcgcgtcgttnggggattttggagcggaggaggaagcgcggcggggcgggggcgggggtgtgtcgggttttantaattcgtagggcggtcgcggcgtaggagaaggggtagagtcgagtatcgcgtatcgcgttatgggggtcgtttcgggtcgtcgggggtcggggttgttgttgtcgttgtcgttgttgttgttgttngtcgtcgtagttcgttttggcgttgngnatttcgggttgtagtttngaaatttttttngttgacgaggtcggggcgtagtttttcgcgtagagttataattttagcgtcgaataggtgttgttttnagagcgtggtcgttagttgggcgtacgatattaatattatcgcggagaatgntnaaggttaggtggcgttcgggttcgggcgggggcggggcgggtcgcggcggttaattatagtacgcggtcggtttgtggggncgggtagnntggcgttttcgnattcgaattttatttcgatttcggattttcgtttcgatagttagtcgcggggttcgagcgtcgggttgcgcgtacggtttgcgtttttagtatgtacgagttggatggatgagggtggttgtttttaggtcgcgttcgttttcgtcgaaggtgttgggtttggttttggggttttcgcgttttcgggtagttgtttttttattttcggacgttgtcgttgttatcgttatcgtattgtattgtttatttattttttattcgttcggttttttttttggttttaatttttgttttattatttttatgaggtagatttt

SEQ ID NO: 598 - DNA, 842 bp, Artificial Sequence
  chemically treated genomic DNA (Homo sapiens) CpG-island No: 598
  misc_feature (318)..(318): n is either a, c, g or t
  misc_feature (330)..(331): n is either a, c, g or t
  misc_feature (339)..(339): n is either a, c, g or t
  misc_feature (420)..(420): n is either a, c, g or t
  misc_feature (422)..(422): n is either a, c, g or t
  misc_feature (474)..(474): n is either a, c, g or t
  misc_feature (542)..(542): n is either a, c, g or t
  misc_feature (554)..(554): n is either a, c, g or t
  misc_feature (572)..(572): n is either a, c, g or t
  misc_feature (574)..(574): n is either a, c, g or t
  misc_feature (600)..(600): n is either a, c, g or t
  misc_feature (727)..(727): n is either a, c, g or t
  misc_feature (789)..(789): n is either a, c, g or t
  misc_feature (807)..(807): n is either a, c, g or t
  misc_feature (811)..(811): n is either a, c, g or t
  misc_feature (837)..(837): n is either a, c, g or t
  misc_feature (839)..(839): n is either a, c, g or t
aaaatctacctcataaaaataataaaacaaaaattaaaaccaaaaaaaaaaccgaacgaataaaaaataaataaacaatacaatacgataacgataacaacgacaacgtccgaaaataaaaaaacaactacccgaaaacgcgaaaaccccaaaaccaaacccaacaccttcgacgaaaacgaacgcgacctaaaaacaaccaccctcatccatccaactcgtacatactaaaaacgcaaaccgtacgcgcaacccgacgctcgaaccccgcgactaactatcgaaacgaaaatccgaaatcgaaataaaattcgaatncgaaaacgccannctacccgnccccacaaaccgaccgcgtactataattaaccgccgcgacccgccccgcccccgcccgaacccgaacgccacctaaccttnancattctccgcgataatattaatatcgtacgcccaactaacgaccacgctctnaaaacaacacctattcgacgctaaaattataactctacgcgaaaaactacgccccgacctcgtcaacnaaaaaaatttcnaaactacaacccgaaatncncaacgccaaaacgaactacgacgacnaacaacaacaacaacgacaacgacaacaacaaccccgacccccgacgacccgaaacgacccccataacgcgatacgcgatactcgactctaccccttctcctacgccgcgaccgccctacgaattantaaaacccgacacacccccgcccccgccccgccgcgcttcctcctccgctccaaaatccccnaacgacgcgaaccgaaanttcnctaacccgccccgaacaaaaacgcgnanacc

SEQ ID NO: 599 - DNA, 842 bp, Artificial Sequence
  chemically treated genomic DNA (Homo sapiens) CpG-island No: 599
  misc_feature (318)..(318): n is either a, c, g or t
  misc_feature (330)..(331): n is either a, c, g or t
  misc_feature (339)..(339): n is either a, c, g or t
  misc_feature (420)..(420): n is either a, c, g or t
  misc_feature (422)..(422): n is either a, c, g or t
  misc_feature (474)..(474): n is either a, c, g or t
  misc_feature (542)..(542): n is either a, c, g or t
  misc_feature (554)..(554): n is either a, c, g or t
  misc_feature (572)..(572): n is either a, c, g or t
  misc_feature (574)..(574): n is either a, c, g or t
  misc_feature (600)..(600): n is either a, c, g or t
  misc_feature (727)..(727): n is either a, c, g or t
  misc_feature (789)..(789): n is either a, c, g or t
  misc_feature (807)..(807): n is either a, c, g or t
  misc_feature (811)..(811): n is either a, c, g or t
  misc_feature (837)..(837): n is either a, c, g or t
  misc_feature (839)..(839): n is either a, c, g or t
ggaatttgttttatgggaatggtggagtagaaattgggattagaaaagaggtcgggcgagtggagggtggatggatagtgtagtgcggtgacggtgatagcgatagcgttcggaggtgagaaggtagttgttcgagagcgcgggggttttagagttaagtttagtattttcggcgaaggcgggcgcggtttgggagtagttatttttatttatttaattcgtgtatgttgggagcgtaggtcgtgcgcgtagttcggcgttcgggtttcgcggttgattgtcggggcgagggttcggggtcggggtggggttcgggtncgggggcgttannttgttcgnttttataagtcggtcgcgtgttgtgattggtcgtcgcggttcgtttcgttttcgttcgggttcgggcgttatttggttttngntatttttcgcggtgatgttggtgtcgtgcgtttagttggcggttacgttttnggaatagtatttgttcggcgttggagttgtagttttgcgcgaagagttgcgtttcggtttcgttagtnagaaaagttttngggttgtagttcggggtntntaacgttagggcgggttgcggcggtnagtagtaatagtagcggtagcggtagtagtagtttcggttttcggcggttcgaggcggtttttatgacgcggtgcgcggtgttcggttttgtttttttttttgcgtcgcggtcgttttgcgggttantaaaattcgatatattttcgttttcgtttcgtcgcgttttttttttcgttttaaagtttttnagcggcgcgggtcgaggntttnttggttcgtttcgggtaggggcgcgngngtt

SEQ ID NO: 600 - DNA, 842 bp, Artificial Sequence
  chemically treated genomic DNA (Homo sapiens) CpG-island No: 600
  misc_feature (4)..(4): n is either a, c, g or t
  misc_feature (6)..(6): n is either a, c, g or t
  misc_feature (32)..(32): n is either a, c, g or t
  misc_feature (36)..(36): n is either a, c, g or t
  misc_feature (54)..(54): n is either a, c, g or t
  misc_feature (116)..(116): n is either a, c, g or t
  misc_feature (243)..(243): n is either a, c, g or t
  misc_feature (269)..(269): n is either a, c, g or t
  misc_feature (271)..(271): n is either a, c, g or t
  misc_feature (289)..(289): n is either a, c, g or t
  misc_feature (301)..(301): n is either a, c, g or t
  misc_feature (369)..(369): n is either a, c, g or t
  misc_feature (421)..(421): n is either a, c, g or t
  misc_feature (423)..(423): n is either a, c, g or t
  misc_feature (504)..(504): n is either a, c, g or t
  misc_feature (512)..(513): n is either a, c, g or t
  misc_feature (525)..(525): n is either a, c, g or t
aacncncgcgcccctacccgaaacgaaccaanaaancctcgacccgcgccgctnaaaaactttaaaacgaaaaaaaaaacgcgacgaaacgaaaacgaaaatatatcgaattttantaacccgcaaaacgaccgcgacgcaaaaaaaaaaacaaaaccgaacaccgcgcaccgcgtcataaaaaccgcctcgaaccgccgaaaaccgaaactactactaccgctaccgctactattactactnaccgccgcaacccgccctaacgttananaccccgaactacaacccnaaaacttttctnactaacgaaaccgaaacgcaactcttcgcgcaaaactacaactccaacgccgaacaaatactattccnaaaacgtaaccgccaactaaacgcacgacaccaacatcaccgcgaaaaatancnaaaaccaaataacgcccgaacccgaacgaaaacgaaacgaaccgcgacgaccaatcacaacacgcgaccgacttataaaancgaacaanntaacgcccccgnacccgaaccccaccccgaccccgaaccctcgccccgacaatcaaccgcgaaacccgaacgccgaactacgcgcacgacctacgctcccaacatacacgaattaaataaataaaaataactactcccaaaccgcgcccgccttcgccgaaaatactaaacttaactctaaaacccccgcgctctcgaacaactaccttctcacctccgaacgctatcgctatcaccgtcaccgcactacactatccatccaccctccactcgcccgacctcttttctaatcccaatttctactccaccattcccataaaacaaattcc

SEQ ID NO: 601 - DNA, 816 bp, Artificial Sequence
  chemically treated genomic DNA (Homo sapiens) CpG-island No: 601
tacgattaaagcgggggtttttagcgtttggggtcgttttgtttcggtttagtcgcgtatttggatttttaaggtagtttttttttcggcgtttcgttgtttcgcggtttcgtagtatcgtttagttcgcgttagattcgtttttagtcgtagggaattatttatcgtgcgtcggtttttgggttgaaaggtttttgattacgggttatgtaatagcgttattaacgagcgggacggatagagcgatttttttcgattttcggaggaagcggaacgttatcggaaatcgcggggagggttaaaggagattcggttttcgaggtttatggcgatgttggttttagtattcggacgagttatgcggtttttgggtggttaattttggcgttttttgtttcgcggattcgagttttggggtttagtcgaggggattgcgagagttttgttgaggtagttttgcgcgcggtaagcggaggcgtggcgtgtttcggggcgttttggttattgtttgggaattcggttttttagtattgcgaggtcgttattttcgtggtcgtagaagggtttcggagattttacgcgtttttcgaagttcggggtgagtgtatatttggaatttttttggtgttcgtcgcggttgtcggttagtttagcggttatattttatttggtcgtaattttagatattatttcgttttttttaaagttgtttttagtttgcgcgttttatttgggttatggaattttattttatatttttcgtgttttgcgggtagttttagttttttatagagaatttgagattttatatttttt

SEQ ID NO: 602 - DNA, 816 bp, Artificial Sequence
  chemically treated genomic DNA (Homo sapiens) CpG-island No: 602
aaaaaatataaaatctcaaattctctataaaaaactaaaactacccgcaaaacacgaaaaatataaaataaaattccataacccaaataaaacgcgcaaactaaaaacaactttaaaaaaaacgaaataatatctaaaattacgaccaaataaaatataaccgctaaactaaccgacaaccgcgacgaacaccaaaaaaattccaaatatacactcaccccgaacttcgaaaaacgcgtaaaatctccgaaacccttctacgaccacgaaaataacgacctcgcaatactaaaaaaccgaattcccaaacaataaccaaaacgccccgaaacacgccacgcctccgcttaccgcgcgcaaaactacctcaacaaaactctcgcaatcccctcgactaaaccccaaaactcgaatccgcgaaacaaaaaacgccaaaattaaccacccaaaaaccgcataactcgtccgaatactaaaaccaacatcgccataaacctcgaaaaccgaatctcctttaaccctccccgcgatttccgataacgttccgcttcctccgaaaatcgaaaaaaatcgctctatccgtcccgctcgttaataacgctattacataacccgtaatcaaaaacctttcaacccaaaaaccgacgcacgataaataattccctacgactaaaaacgaatctaacgcgaactaaacgatactacgaaaccgcgaaacaacgaaacgccgaaaaaaaaactaccttaaaaatccaaatacgcgactaaaccgaaacaaaacgaccccaaacgctaaaaacccccgctttaatcgta

SEQ ID NO: 603 - DNA, 816 bp, Artificial Sequence
  chemically treated genomic DNA (Homo sapiens) CpG-island No: 603
agagggtgtaaagttttaagttttttgtggagaattgggattattcgtaaggtacgggaaatgtaggatgaaattttatgatttaggtaaggcgcgtaagttaaggataattttaggggaggcggagtagtgtttgaggttacgattaagtgggatgtggtcgttgggttggtcgatagtcgcgacgagtattagaagggttttaggtgtgtatttatttcgggtttcgaggggcgcgtggagttttcggggtttttttgcgattacgggggtggcggtttcgtagtgttgaggggtcgggtttttaggtaatagttagggcgtttcgaggtacgttacgttttcgtttgtcgcgcgtagaattgttttagtaagattttcgtagttttttcggttgggttttaaaattcgagttcgcgaggtaagaagcgttaaagttggttatttagaggtcgtataattcgttcgggtattaggattagtatcgttatgagtttcggagatcgggttttttttgatttttttcgcgattttcggtagcgtttcgtttttttcggaagtcggaaggagtcgttttgttcgtttcgttcgttggtggcgttgttatatagttcgtagttagaggttttttagtttaggggtcggcgtacggtaggtagttttttgcggttggaggcgggtttggcgcgggttgggcggtgttgcggggtcgcgggatagcggagcgtcgggaagggggttgttttaggggtttaggtgcgcggttgggtcgaggtaaggcggttttaagcgttgggggttttcgttttggtcgtg

SEQ ID NO: 604 - DNA, 816 bp, Artificial Sequence
  chemically treated genomic DNA (Homo sapiens) CpG-island No: 604
cacgaccaaaacgaaaacccccaacgcttaaaaccgccttacctcgacccaaccgcgcacctaaacccctaaaacaacccccttcccgacgctccgctatcccgcgaccccgcaacaccgcccaacccgcgccaaacccgcctccaaccgcaaaaaactacctaccgtacgccgacccctaaactaaaaaacctctaactacgaactatataacaacgccaccaacgaacgaaacgaacaaaacgactccttccgacttccgaaaaaaacgaaacgctaccgaaaatcgcgaaaaaaatcaaaaaaaacccgatctccgaaactcataacgatactaatcctaatacccgaacgaattatacgacctctaaataaccaactttaacgcttcttacctcgcgaactcgaattttaaaacccaaccgaaaaaactacgaaaatcttactaaaacaattctacgcgcgacaaacgaaaacgtaacgtacctcgaaacgccctaactattacctaaaaacccgacccctcaacactacgaaaccgccacccccgtaatcgcaaaaaaaccccgaaaactccacgcgcccctcgaaacccgaaataaatacacacctaaaacccttctaatactcgtcgcgactatcgaccaacccaacgaccacatcccacttaatcgtaacctcaaacactactccgcctcccctaaaattatccttaacttacgcgccttacctaaatcataaaatttcatcctacatttcccgtaccttacgaataatcccaattctccacaaaaaacttaaaactttacaccctct

SEQ ID NO: 605 - DNA, 633 bp, Artificial Sequence
  chemically treated genomic DNA (Homo sapiens) CpG-island No: 605
  misc_feature (549)..(549): n is either a, c, g or t
  misc_feature (572)..(572): n is either a, c, g or t
  misc_feature (576)..(576): n is either a, c, g or t
gattcgttggtttcgtgggtcggtttcgagggattagaaggcggtttaggcggaggattttaaggatcgggtgttggaggaggagtttacgttaatttttaggggttcggggcggggagcgtaggattcgcggtgtaggggtagggatttagtcggaattttcggggagggggagggatttagtcgatttcgagggcgggcgtgagggggaggttcggggagttagaggagggcgggagcgagtttagagtttcggggcgggggttagcgcggattttaggagggaaggcgggggtgaggggaggtttcgagggacgtttagtagtcgggagggtcggatttttggtttcgcgcgttagggtcggttcgtttcgcgtttattttagttcgagagtgatgattcgtcggcggagtagtcgtagtattttcgcgcgttatcgcgtcgtcgtttttttcgttttttgtcgagagagcggcgtatatttttcgttcgtatttttcgttcgtattcgtttgttcgttcgtttttcggagaatggggggattggnagatggtgggaagaggcgggagnggantagacggatagatggacgtagcgggttagggtagggtggagatattttttcggattt

SEQ ID NO: 606 - DNA, 633 bp, Artificial Sequence
  chemically treated genomic DNA (Homo sapiens) CpG-island No: 606
  misc_feature (58)..(58): n is either a, c, g or t
  misc_feature (62)..(62): n is either a, c, g or t
  misc_feature (85)..(85): n is either a, c, g or t
aaatccgaaaaaatatctccaccctaccctaacccgctacgtccatctatccgtctantccnctcccgcctcttcccaccatctnccaatccccccattctccgaaaaacgaacgaacaaacgaatacgaacgaaaaatacgaacgaaaaatatacgccgctctctcgacaaaaaacgaaaaaaacgacgacgcgataacgcgcgaaaatactacgactactccgccgacgaatcatcactctcgaactaaaataaacgcgaaacgaaccgaccctaacgcgcgaaaccaaaaatccgaccctcccgactactaaacgtccctcgaaacctcccctcacccccgccttccctcctaaaatccgcgctaacccccgccccgaaactctaaactcgctcccgccctcctctaactccccgaacctccccctcacgcccgccctcgaaatcgactaaatccctccccctccccgaaaattccgactaaatccctacccctacaccgcgaatcctacgctccccgccccgaacccctaaaaattaacgtaaactcctcctccaacacccgatccttaaaatcctccgcctaaaccgccttctaatccctcgaaaccgacccacgaaaccaacgaatc

SEQ ID NO: 607 - DNA, 633 bp, Artificial Sequence
  chemically treated genomic DNA (Homo sapiens) CpG-island No: 607
  misc_feature (58)..(58): n is either a, c, g or t
  misc_feature (62)..(62): n is either a, c, g or t
  misc_feature (85)..(85): n is either a, c, g or t
agattcgggggaatgtttttattttgttttggttcgttacgtttatttgttcgtttgntttnttttcgtttttttttattatttnttaatttttttatttttcggagggcgggcgggtaggcgggtgcgagcggggggtgcgagcggggggtgtgcgtcgttttttcggtagggggcgggggaggcggcggcgcggtgacgcgcggggatgttgcggttgtttcgtcggcggattattattttcgggttgggatggacgcggggcgggtcggttttggcgcgcggagttaggagttcggttttttcggttgttgagcgtttttcgaagtttttttttattttcgtttttttttttaggattcgcgttgattttcgtttcggggttttggattcgttttcgtttttttttgatttttcggattttttttttacgttcgttttcgggatcgattagattttttttttttttcgaggatttcggttggatttttgtttttgtatcgcggattttgcgtttttcgtttcgggtttttggggattaacgtggattttttttttagtattcgatttttaggatttttcgtttggatcgttttttggtttttcgaagtcggtttacggaattagcggatt

SEQ ID NO: 608 - DNA, 633 bp, Artificial Sequence
  chemically treated genomic DNA (Homo sapiens) CpG-island No: 608
  misc_feature (549)..(549): n is either a, c, g or t
  misc_feature (572)..(572): n is either a, c, g or t
  misc_feature (576)..(576): n is either a, c, g or t
aatccgctaattccgtaaaccgacttcgaaaaaccaaaaaacgatccaaacgaaaaatcctaaaaatcgaatactaaaaaaaaaatccacgttaatccccaaaaacccgaaacgaaaaacgcaaaatccgcgatacaaaaacaaaaatccaaccgaaatcctcgaaaaaaaaaaaaaatctaatcgatcccgaaaacgaacgtaaaaaaaaaatccgaaaaatcaaaaaaaaacgaaaacgaatccaaaaccccgaaacgaaaatcaacgcgaatcctaaaaaaaaaaacgaaaataaaaaaaaacttcgaaaaacgctcaacaaccgaaaaaaccgaactcctaactccgcgcgccaaaaccgacccgccccgcgtccatcccaacccgaaaataataatccgccgacgaaacaaccgcaacatccccgcgcgtcaccgcgccgccgcctcccccgccccctaccgaaaaaacgacgcacaccccccgctcgcaccccccgctcgcacccgcctacccgcccgccctccgaaaaataaaaaaattaanaaataataaaaaaaaacgaaaanaaancaaacgaacaaataaacgtaacgaaccaaaacaaaataaaaacattcccccgaatct

SEQ ID NO: 609 - DNA, 602 bp, Artificial Sequence
  chemically treated genomic DNA (Homo sapiens) CpG-island No: 609
  misc_feature (177)..(177): n is either a, c, g or t
  misc_feature (225)..(225): n is either a, c, g or t
  misc_feature (246)..(246): n is either a, c, g or t
  misc_feature (258)..(258): n is either a, c, g or t
  misc_feature (261)..(261): n is either a, c, g or t
  misc_feature (393)..(393): n is either a, c, g or t
  misc_feature (419)..(419): n is either a, c, g or t
  misc_feature (441)..(441): n is either a, c, g or t
  misc_feature (514)..(514): n is either a, c, g or t
  misc_feature (520)..(520): n is either a, c, g or t
gtcggttcgttggtttttgagtcggtttttttttatatggtgttcggtggcggtatcgagcggtcgtgcgttttcgtttggtagttttgttttgttcgttagagttggcgtttaaagcggtaatattagcgtcgttgttgtaggttacgcggcggtttaggcgttattgttcggttnggtggtcgggattcgggcggcggcgtttaattttttgcggacgttgtntgtattgggcgtgcgagcggnttgtttgcgttnttnatttggcgcggttagaaaatgcgggcgtttgttgtttcgggttgttagacgagttcggtcgagtgttcgaggtcgggacgttgttttattattttttgaacggtcgatagtttcgtacgggggacgattttnttgcgttgttcggagaattggttcgntttcgcggggattcggttcggntttttcgtgtcgcggtggaggaggttaaagtggttcgtaaggggggcggtttggcgggcgtgggggcggggtnttattnaaagacgttgtttttattagtggaaagtgtttttgtgggcgagcgggacgtggggggttttgttcgtttttcgttaggggga

SEQ ID NO: 610 - DNA, 602 bp, Artificial Sequence
  chemically treated genomic DNA (Homo sapiens) CpG-island No: 610
  misc_feature (83)..(83): n is either a, c, g or t
  misc_feature (89)..(89): n is either a, c, g or t
  misc_feature (162)..(162): n is either a, c, g or t
  misc_feature (184)..(184): n is either a, c, g or t
  misc_feature (210)..(210): n is either a, c, g or t
  misc_feature (342)..(342): n is either a, c, g or t
  misc_feature (345)..(345): n is either a, c, g or t
  misc_feature (357)..(357): n is either a, c, g or t
  misc_feature (378)..(378): n is either a, c, g or t
  misc_feature (426)..(426): n is either a, c, g or t
tccccctaacgaaaaacgaacaaaaccccccacgtcccgctcgcccacaaaaacactttccactaataaaaacaacgtctttnaataanaccccgcccccacgcccgccaaaccgccccccttacgaaccactttaacctcctccaccgcgacacgaaaaanccgaaccgaatccccgcgaaancgaaccaattctccgaacaacgcaanaaaatcgtcccccgtacgaaactatcgaccgttcaaaaaataataaaacaacgtcccgacctcgaacactcgaccgaactcgtctaacaacccgaaacaacaaacgcccgcattttctaaccgcgccaaatnaanaacgcaaacaanccgctcgcacgcccaatacanacaacgtccgcaaaaaattaaacgccgccgcccgaatcccgaccaccnaaccgaacaataacgcctaaaccgccgcgtaacctacaacaacgacgctaatattaccgctttaaacgccaactctaacgaacaaaacaaaactaccaaacgaaaacgcacgaccgctcgataccgccaccgaacaccatataaaaaaaaaccgactcaaaaaccaacgaaccgac

SEQ ID NO: 611 - DNA, 602 bp, Artificial Sequence
  chemically treated genomic DNA (Homo sapiens) CpG-island No: 611
  misc_feature (83)..(83): n is either a, c, g or t
  misc_feature (89)..(89): n is either a, c, g or t
  misc_feature (162)..(162): n is either a, c, g or t
  misc_feature (184)..(184): n is either a, c, g or t
  misc_feature (210)..(210): n is either a, c, g or t
  misc_feature (342)..(342): n is either a, c, g or t
  misc_feature (345)..(345): n is either a, c, g or t
  misc_feature (357)..(357): n is either a, c, g or t
  misc_feature (378)..(378): n is either a, c, g or t
  misc_feature (426)..(426): n is either a, c, g or t
tttttttggcgaggggcgagtagggttttttacgtttcgttcgtttatagaggtattttttattggtaggaatagcgtttttnaatggngtttcgtttttacgttcgttaaatcgttttttttgcgggttattttggttttttttatcgcggtacggagggntcgggtcgggttttcgcggagncgggttaatttttcgagtagcgtagngaagtcgtttttcgtacggagttgtcggtcgtttagaaaatagtgaggtaacgtttcggtttcgagtattcggtcgagttcgtttagtagttcgaggtagtaggcgttcgtattttttggtcgcgttaggtnagnagcgtaggtagntcgttcgtacgtttagtatangtagcgttcgtaggaggttaggcgtcgtcgttcgggtttcggttattnagtcgggtagtagcgtttgggtcgtcgcgtggtttgtagtagcggcgttggtattgtcgttttgagcgttagttttggcgggtaaaatagagttgttaggcggaggcgtacggtcgttcggtgtcgttatcgggtattatgtagaaggaagtcgatttagaggttagcggatcggt

SEQ ID NO: 612 - DNA, 602 bp, Artificial Sequence
  chemically treated genomic DNA (Homo sapiens) CpG-island No: 612
  misc_feature (177)..(177): n is either a, c, g or t
  misc_feature (225)..(225): n is either a, c, g or t
  misc_feature (246)..(246): n is either a, c, g or t
  misc_feature (258)..(258): n is either a, c, g or t
  misc_feature (261)..(261): n is either a, c, g or t
  misc_feature (393)..(393): n is either a, c, g or t
  misc_feature (419)..(419): n is either a, c, g or t
  misc_feature (441)..(441): n is either a, c, g or t
  misc_feature (514)..(514): n is either a, c, g or t
  misc_feature (520)..(520): n is either a, c, g or t
accgatccgctaacctctaaatcgacttccttctacataatacccgataacgacaccgaacgaccgtacgcctccgcctaacaactctattttacccgccaaaactaacgctcaaaacgacaataccaacgccgctactacaaaccacgcgacgacccaaacgctactacccgactnaataaccgaaacccgaacgacgacgcctaacctcctacgaacgctacntatactaaacgtacgaacganctacctacgctnctnacctaacgcgaccaaaaaatacgaacgcctactacctcgaactactaaacgaactcgaccgaatactcgaaaccgaaacgttacctcactattttctaaacgaccgacaactccgtacgaaaaacgacttcnctacgctactcgaaaaattaacccgnctccgcgaaaacccgacccganccctccgtaccgcgataaaaaaaaccaaaataacccgcaaaaaaaacgatttaacgaacgtaaaaacgaaacnccattnaaaaacgctattcctaccaataaaaaatacctctataaacgaacgaaacgtaaaaaaccctactcgcccctcgccaaaaaaa

SEQ ID NO: 613 - DNA, 664 bp, Artificial Sequence
  chemically treated genomic DNA (Homo sapiens) CpG-island No: 613
tcggaatacgttagtggagcggaagatggcggcggcggcggcggtcgttgtagtcgggattttagttgggttgaggcggaggagtcgtcgtttttgatttcgttttggtttcggtgcgcgcggttgagcgcgtgcgaggtttcgcgcgtcgggtaggggcggcggcggttattgcgcgtcgttttgaggagcgttttagcggcggcgcgattgcggttgaggagagagtcggtttcgggttttcgcgtttttttgttttttcggtttttcgttttttcgggggggcggcggcggcgatgttttcggttttttcgtacgggcggttggtggttcgcgtcgtgttcggcggtttttcgtagatcgattttagggtcggcggcggcggcggcggcgattacggattggtgacggtcggttgcggtttcgggaaggattttcgtaagggtttttttaagaagggcgcgtgttacggggacgacgcgtgtttcgtggttcggtatcgtttcgcggacgtgttcggtgagttttcgattcggtttttttgttttagtttcggattcgtttttcggggatttttcgcgcggggtttttttagtttttttcggcggcgaaaggagttagagcgtttatatggagggagcgtttattatgcgttaggcgtcgt

SEQ ID NO: 614 - DNA, 664 bp, Artificial Sequence
  chemically treated genomic DNA (Homo sapiens) CpG-island No: 614
acgacgcctaacgcataataaacgctccctccatataaacgctctaactcctttcgccgccgaaaaaaactaaaaaaaccccgcgcgaaaaatccccgaaaaacgaatccgaaactaaaacaaaaaaaccgaatcgaaaactcaccgaacacgtccgcgaaacgataccgaaccacgaaacacgcgtcgtccccgtaacacgcgcccttcttaaaaaaacccttacgaaaatccttcccgaaaccgcaaccgaccgtcaccaatccgtaatcgccgccgccgccgccgccgaccctaaaatcgatctacgaaaaaccgccgaacacgacgcgaaccaccaaccgcccgtacgaaaaaaccgaaaacatcgccgccgccgcccccccgaaaaaacgaaaaaccgaaaaaacaaaaaaacgcgaaaacccgaaaccgactctctcctcaaccgcaatcgcgccgccgctaaaacgctcctcaaaacgacgcgcaataaccgccgccgcccctacccgacgcgcgaaacctcgcacgcgctcaaccgcgcgcaccgaaaccaaaacgaaatcaaaaacgacgactcctccgcctcaacccaactaaaatcccgactacaacgaccgccgccgccgccgccatcttccgctccactaacgtattccga

SEQ ID NO: 615 - DNA, 664 bp, Artificial Sequence
  chemically treated genomic DNA (Homo sapiens) CpG-island No: 615
acggcgtttggcgtatagtaagcgttttttttatgtgagcgttttggtttttttcgtcgtcgggaggaattggggaagtttcgcgcggggagttttcgggaggcggattcgaggttggggtaagggaatcgggtcggggatttatcgagtacgttcgcggaacggtgtcgggttacgaagtacgcgtcgttttcgtagtacgcgttttttttgaggaggtttttacggaagtttttttcgaagtcgtagtcggtcgttattagttcgtagtcgtcgtcgtcgtcgtcgtcggttttggggtcggtttgcgagaggtcgtcgagtacggcgcgggttattagtcgttcgtacgagaggatcgagaatatcgtcgtcgtcgttttttcgaggaggcggggggtcgggggagtaggaggacgcggaggttcggagtcggttttttttttagtcgtagtcgcgtcgtcgttggggcgttttttagggcggcgcgtagtggtcgtcgtcgtttttgttcgacgcgcggggtttcgtacgcgtttagtcgcgcgtatcggagttagagcgaggttagaagcggcggttttttcgttttagtttaattgaagtttcggttgtagcggtcgtcgtcgtcgtcgttatttttcgttttattagcgtgtttcgg

SEQ ID NO: 616 - DNA, 664 bp, Artificial Sequence
  chemically treated genomic DNA (Homo sapiens) CpG-island No: 616
ccgaaacacgctaataaaacgaaaaataacgacgacgacgacgaccgctacaaccgaaacttcaattaaactaaaacgaaaaaaccgccgcttctaacctcgctctaactccgatacgcgcgactaaacgcgtacgaaaccccgcgcgtcgaacaaaaacgacgacgaccactacgcgccgccctaaaaaacgccccaacgacgacgcgactacgactaaaaaaaaaaccgactccgaacctccgcgtcctcctactcccccgaccccccgcctcctcgaaaaaacgacgacgacgatattctcgatcctctcgtacgaacgactaataacccgcgccgtactcgacgacctctcgcaaaccgaccccaaaaccgacgacgacgacgacgacgactacgaactaataacgaccgactacgacttcgaaaaaaacttccgtaaaaacctcctcaaaaaaaacgcgtactacgaaaacgacgcgtacttcgtaacccgacaccgttccgcgaacgtactcgataaatccccgacccgattcccttaccccaacctcgaatccgcctcccgaaaactccccgcgcgaaacttccccaattcctcccgacgacgaaaaaaaccaaaacgctcacataaaaaaaacgcttactatacgccaaacgccgt

SEQ ID NO: 617 - DNA, 731 bp, Artificial Sequence
  chemically treated genomic DNA (Homo sapiens) CpG-island No: 617
ttcgttagtatcgttattacgatgatgacgtcgcgtattatttgttggaaaaaggagttaatatcgagtagtattagatcgttatcgattagcgtaattattagtatattaagtaatgtatcgaatagggaatcgcgatcgtcggaaagtgtcgtatcgtcgattacgatcgcggcgatgacgttaaattttagatcgtttgcggtatttgcgttattagaatcgaggcgcgtcgttaataaaatgtcggttatcgtcgttaataatttcgaaagggtaaagataagaatgcgtattcgacgaacgttgatgtcgtataattgcgtcgtcgtagtattatcgttaacggtaaaaatcgagcgttcgaagcggttttgcggttgatgaatataaatagcgtaaataatataattatgattagcgcggatatcggtatatcgagaaattgttcgtttagttagtttagtatttcgtttttattaatcggtattggtagtgcgttcgttataaatagttttatttcgcgtagggcgttttatagttttagtgtggtaacgaaatttggtatattaaatacgtcgcgtagatttcggttagcgtttttattagcgcgtttaatagtaatattagtaggtacgttatcgttagcggaattttaaattgtagtaaaaattgttaggtatatcgagataaaagttatattcggttacgttgatatttattttattgag

SEQ ID NO: 618 - DNA, 731 bp, Artificial Sequence
  chemically treated genomic DNA (Homo sapiens) CpG-island No: 618
ctcaataaaataaatatcaacgtaaccgaatataacttttatctcgatatacctaacaatttttactacaatttaaaattccgctaacgataacgtacctactaatattactattaaacgcgctaataaaaacgctaaccgaaatctacgcgacgtatttaatataccaaatttcgttaccacactaaaactataaaacgccctacgcgaaataaaactatttataacgaacgcactaccaataccgattaataaaaacgaaatactaaactaactaaacgaacaatttctcgatataccgatatccgcgctaatcataattatattatttacgctatttatattcatcaaccgcaaaaccgcttcgaacgctcgatttttaccgttaacgataatactacgacgacgcaattatacgacatcaacgttcgtcgaatacgcattcttatctttaccctttcgaaattattaacgacgataaccgacattttattaacgacgcgcctcgattctaataacgcaaataccgcaaacgatctaaaatttaacgtcatcgccgcgatcgtaatcgacgatacgacactttccgacgatcgcgattccctattcgatacattacttaatatactaataattacgctaatcgataacgatctaatactactcgatattaactcctttttccaacaaataatacgcgacgtcatcatcgtaataacgatactaacgaa

SEQ ID NO: 619 - DNA, 731 bp, Artificial Sequence
  chemically treated genomic DNA (Homo sapiens) CpG-island No: 619
tttagtgaaatgaatgttagcgtggtcgaatgtggtttttgtttcggtgtgtttggtaatttttgttgtaatttgaagtttcgttggcggtggcgtgtttgttggtgttgttgttaggcgcgttgatgggaacgttggtcggggtttgcgcggcgtgtttaatgtattaagtttcgttgttatattggggttgtggagcgttttgcgcggaatggggttgtttatgacgaacgtattgttagtgtcgattgatgaaaacgaggtgttggattggttgggcggataatttttcggtgtgtcggtattcgcgttgattatgattgtgttgtttgcgttgtttgtgtttattagtcgtaaaatcgtttcgggcgttcggtttttgtcgttggcggtaatgttacggcggcgtagttgtgcggtattaacgttcgtcgggtgcgtatttttatttttattttttcgggattattagcggcggtgatcggtattttgttggcggcgcgtttcggttttggtaacgtaggtgtcgtaaacggtttggagtttgacgttatcgtcgcggtcgtggtcggcggtacggtatttttcggcggtcgcggttttttgttcggtatattgtttggtgtgttggtgattacgttaatcggtaacggtttggtgttgttcggtattaatttttttttttagtaggtggtacgcggcgttattatcgtggtggcggtgttggcgaa

SEQ ID NO: 620 - DNA, 731 bp, Artificial Sequence
  chemically treated genomic DNA (Homo sapiens) CpG-island No: 620
ttcgccaacaccgccaccacgataataacgccgcgtaccacctactaaaaaaaaaaattaataccgaacaacaccaaaccgttaccgattaacgtaatcaccaacacaccaaacaatataccgaacaaaaaaccgcgaccgccgaaaaataccgtaccgccgaccacgaccgcgacgataacgtcaaactccaaaccgtttacgacacctacgttaccaaaaccgaaacgcgccgccaacaaaataccgatcaccgccgctaataatcccgaaaaaataaaaataaaaatacgcacccgacgaacgttaataccgcacaactacgccgccgtaacattaccgccaacgacaaaaaccgaacgcccgaaacgattttacgactaataaacacaaacaacgcaaacaacacaatcataatcaacgcgaataccgacacaccgaaaaattatccgcccaaccaatccaacacctcgttttcatcaatcgacactaacaatacgttcgtcataaacaaccccattccgcgcaaaacgctccacaaccccaatataacaacgaaacttaatacattaaacacgccgcgcaaaccccgaccaacgttcccatcaacgcgcctaacaacaacaccaacaaacacgccaccgccaacgaaacttcaaattacaacaaaaattaccaaacacaccgaaacaaaaaccacattcgaccacgctaacattcatttcactaaa

SEQ ID NO: 621 - DNA, 793 bp, Artificial Sequence
  chemically treated genomic DNA (Homo sapiens) CpG-island No: 621
  misc_feature (713)..(714): n is either a, c, g or t
  misc_feature (748)..(748): n is either a, c, g or t
tttgaataaattggcgtcggtgatgacgttgattcgttttgatgtcgacgtttttgtcgaaaaggtagtttgatatgtacgtttatttttattgttttttttattcgtcgttggtggggtatgtcgattcggcgtaagaggtgttcgatgaggttaatggcgtgattgttagcgttcgcgagcgtattgcggtatttttttttgaattggtggtgttgtttgcgttagattattataacggttttttttatgacgtgatgttatcgttttgtttaggcgttggagcgacggtaattggtgatttcggtagtgcggtaggagagttgttcgtgtttgtggagttggcggaggtttgtgcgtatgtcgttatgaagagcgggatcgattttgtcgttttttattgtatgtaggtggattacgggttcgtttagtcgttggagtttttgttcggtgggttggataaggtgttagttttgtttgtgtttattaacggtgtcgttacgtcgttgttcggtttttagcgtattcgtatgttgggtgaagtattggacgttttattagtatttttaataaacgcgtgttgtttttgggtttcggtgggtttttttattagtcgtcggtgttcgaattggcgaaagcgatgtttatatgcgcgatcgtttgttggggagcggaaagatttattcgttagtgagcgcgaattgcgttaagtnngggtgattagcgtcgttgtagaagtttgttgagngattagagaacgttttatcggtttaatttcgatttggggtaatta

SEQ ID NO: 622 - DNA, 793 bp, Artificial Sequence
  chemically treated genomic DNA (Homo sapiens) CpG-island No: 622
  misc_feature (46)..(46): n is either a, c, g or t
  misc_feature (80)..(81): n is either a, c, g or t
taattaccccaaatcgaaattaaaccgataaaacgttctctaatcnctcaacaaacttctacaacgacgctaatcacccnnacttaacgcaattcgcgctcactaacgaataaatctttccgctccccaacaaacgatcgcgcatataaacatcgctttcgccaattcgaacaccgacgactaataaaaaaacccaccgaaacccaaaaacaacacgcgtttattaaaaatactaataaaacgtccaatacttcacccaacatacgaatacgctaaaaaccgaacaacgacgtaacgacaccgttaataaacacaaacaaaactaacaccttatccaacccaccgaacaaaaactccaacgactaaacgaacccgtaatccacctacatacaataaaaaacgacaaaatcgatcccgctcttcataacgacatacgcacaaacctccgccaactccacaaacacgaacaactctcctaccgcactaccgaaatcaccaattaccgtcgctccaacgcctaaacaaaacgataacatcacgtcataaaaaaaaccgttataataatctaacgcaaacaacaccaccaattcaaaaaaaaataccgcaatacgctcgcgaacgctaacaatcacgccattaacctcatcgaacacctcttacgccgaatcgacataccccaccaacgacgaataaaaaaaacaataaaaataaacgtacatatcaaactaccttttcgacaaaaacgtcgacatcaaaacgaatcaacgtcatcaccgacgccaatttattcaaa

SEQ ID NO: 623 - DNA, 793 bp, Artificial Sequence
  chemically treated genomic DNA (Homo sapiens) CpG-island No: 623
  misc_feature (46)..(46): n is either a, c, g or t
  misc_feature (80)..(81): n is either a, c, g or t
tggttattttaaatcggggttgagtcgatgaagcgttttttgattntttaataaatttttatagcggcgttaattatttnngtttaacgtaattcgcgtttattggcgggtaaattttttcgttttttaatagacggtcgcgtatatgggtatcgttttcgttagttcgggtatcggcggttgatgggaaagtttatcggaatttaggaatagtacgcgtttattgagagtgttggtgaaacgtttaatgttttatttaatatgcgggtacgttggaaatcgggtagcggcgtggcgatatcgttgatgaatataggtagaattggtattttatttagtttatcgagtaggaattttagcggttgggcgaattcgtggtttatttgtatatagtaagaaacggtaagatcgatttcgttttttatgacggtatgcgtataggttttcgttagttttataggtacgggtagtttttttgtcgtattgtcgaaattattaattgtcgtcgttttaacgtttaaatagaacggtggtattacgttatagaaaaagtcgttgtagtgatttggcgtaaatagtattattagtttaggggagaatgtcgtaatacgttcgcgggcgttggtaattacgttattgattttatcgagtattttttgcgtcgggtcgatatattttattagcggcgagtgggaaagatagtgaagataagcgtgtatattaggttattttttcgatagaaacgtcggtattagggcgggttagcgttattatcgacgttagtttatttagg

SEQ ID NO: 624 - DNA, 793 bp, Artificial Sequence
  chemically treated genomic DNA (Homo sapiens) CpG-island No: 624
  misc_feature (713)..(714): n is either a, c, g or t
  misc_feature (748)..(748): n is either a, c, g or t
cctaaataaactaacgtcgataataacgctaacccgccctaataccgacgtttctatcgaaaaaataacctaatatacacgcttatcttcactatctttcccactcgccgctaataaaatatatcgacccgacgcaaaaaatactcgataaaatcaataacgtaattaccaacgcccgcgaacgtattacgacattctcccctaaactaataatactatttacgccaaatcactacaacgactttttctataacgtaataccaccgttctatttaaacgttaaaacgacgacaattaataatttcgacaatacgacaaaaaaactacccgtacctataaaactaacgaaaacctatacgcataccgtcataaaaaacgaaatcgatcttaccgtttcttactatatacaaataaaccacgaattcgcccaaccgctaaaattcctactcgataaactaaataaaataccaattctacctatattcatcaacgatatcgccacgccgctacccgatttccaacgtacccgcatattaaataaaacattaaacgtttcaccaacactctcaataaacgcgtactattcctaaattccgataaactttcccatcaaccgccgatacccgaactaacgaaaacgatacccatatacgcgaccgtctattaaaaaacgaaaaaatttacccgccaataaacgcgaattacgttaaacnnaaataattaacgccgctataaaaatttattaaanaatcaaaaaacgcttcatcgactcaaccccgatttaaaataacca

SEQ ID NO: 625 - DNA, 622 bp, Artificial Sequence
  chemically treated genomic DNA (Homo sapiens) CpG-island No: 625
  misc_feature (595)..(595): n is either a, c, g or t
ttatcgtcgttggcgtaatttatagcgcggtagatattttttttgtttggttgttggcgggcgttatcggtttcggtaaaacggaggtttattttagcgtattggaaaacgtgttcgtttagggtaaataggcgttggtgatggtgtcggaaatcggtttgatatcgtaaattatcgttcgttttcgtgaacgttttaatgttttcgtggaagttttgtatttcggtttgaacgatagcgagcgtttttcggcgtggttgaaacgaaaaatggtgaggcggcgattgtgatcggtattcgtttcgcgttgtttacgtcgtttaaaaatttcggcgtgattgttattgatgaagagtacgatagtttttataagtagtaggaaggttggcgttattatgttcgcgatttggcggtgtatcgtgcgtatagcgagtaaatttcgattatttttggtttcgtaacgttcgcgttggaaacgttatgtaacgtttagtagaaaaaatatcgtttgttgcgtttgattcgtcgggtagggaatgcgcgttcggtaatttaatatgtgttggatttaatataaaggggggtttttttaaanggggaaaaaaaaagggggggggttttt

SEQ ID NO: 626 - DNA, 622 bp, Artificial Sequence
  chemically treated genomic DNA (Homo sapiens) CpG-island No: 626
  misc_feature (28)..(28): n is either a, c, g or t
aaaaaccccccccctttttttttccccntttaaaaaaacccccctttatattaaatccaacacatattaaattaccgaacgcgcattccctacccgacgaatcaaacgcaacaaacgatattttttctactaaacgttacataacgtttccaacgcgaacgttacgaaaccaaaaataatcgaaatttactcgctatacgcacgatacaccgccaaatcgcgaacataataacgccaaccttcctactacttataaaaactatcgtactcttcatcaataacaatcacgccgaaatttttaaacgacgtaaacaacgcgaaacgaataccgatcacaatcgccgcctcaccatttttcgtttcaaccacgccgaaaaacgctcgctatcgttcaaaccgaaatacaaaacttccacgaaaacattaaaacgttcacgaaaacgaacgataatttacgatatcaaaccgatttccgacaccatcaccaacgcctatttaccctaaacgaacacgttttccaatacgctaaaataaacctccgttttaccgaaaccgataacgcccgccaacaaccaaacaaaaaaaatatctaccgcgctataaattacgccaacgacgataa

SEQ ID NO: 627 - DNA, 622 bp, Artificial Sequence
  chemically treated genomic DNA (Homo sapiens) CpG-island No: 627
  misc_feature (28)..(28): n is either a, c, g or t
aaaaattttttttttttttttttttttntttgggaaaatttttttttatgttaaatttagtatatgttgaattgtcggacgcgtattttttgttcgacgggttaggcgtagtaggcggtattttttttgttggacgttgtataacgtttttagcgcgggcgttgcggagttaagaataatcgggatttgttcgttgtgcgtacgatatatcgttaggtcgcgggtatgatagcgttagtttttttgttgtttgtaggagttgtcgtgttttttattaatgataattacgtcgagatttttaaacggcgtaaatagcgcggagcgggtgtcgattataatcgtcgttttattatttttcgttttagttacgtcgaaagacgttcgttgtcgtttaggtcggaatgtagaatttttacgggggtattaaaacgtttacgaaaacgggcgatagtttgcggtgttaggtcgattttcggtattattattagcgtttgtttgttttgagcgagtacgttttttagtacgttgagataaattttcgttttatcggaatcggtaacgttcgttagtagttaggtagaaaaagtatttgtcgcgttatgaattgcgttaacggcggtgg

SEQ ID NO: 628 - DNA, 622 bp, Artificial Sequence
  chemically treated genomic DNA (Homo sapiens) CpG-island No: 628
  misc_feature (595)..(595): n is either a, c, g or t
ccaccgccgttaacgcaattcataacgcgacaaatactttttctacctaactactaacgaacgttaccgattccgataaaacgaaaatttatctcaacgtactaaaaaacgtactcgctcaaaacaaacaaacgctaataataataccgaaaatcgacctaacaccgcaaactatcgcccgttttcgtaaacgttttaatacccccgtaaaaattctacattccgacctaaacgacaacgaacgtctttcgacgtaactaaaacgaaaaataataaaacgacgattataatcgacacccgctccgcgctatttacgccgtttaaaaatctcgacgtaattatcattaataaaaaacacgacaactcctacaaacaacaaaaaaactaacgctatcatacccgcgacctaacgatatatcgtacgcacaacgaacaaatcccgattattcttaactccgcaacgcccgcgctaaaaacgttatacaacgtccaacaaaaaaaataccgcctactacgcctaacccgtcgaacaaaaaatacgcgtccgacaattcaacatatactaaatttaacataaaaaaaaattttcccaaanaaaaaaaaaaaaaaaaaaaaaattttt

SEQ ID NO: 629 - DNA, 816 bp, Artificial Sequence
  chemically treated genomic DNA (Homo sapiens) CpG-island No: 629
tgtttgcgcgtttttaggtttcgttttttatgttaataagcgttcgttttttttgggagtaagtcgtcgtaaattgcgagttttcgttttttacgttaatgacgttcgtttttttcgggtatattttttcgatgtttgcgagtttcgtttcgtatgttaacgagttttttatttttagtttttcgtcgtagtttgcgggtttcgttttttataataatgagtatttatttttttttaaacgtttttagtcgcggtatgagggtttcgtttattatgttaatgagtattcgttttttttcgggcgcgtttcgtcgtagtttgaaagtttcgttttttatgttaatatgtttttttttttataaggtagcgcgtcggttcggacgcggtcggttatcgagttttttgtgagggttgtgagttgcgtttgacggtggtattatgagtagtttaggtggggcgttcggggcgttcgttagttttgcgtcgttcgcgtaggaagagggtatgacgtggtggtatcgttggttgtgtcgtttgtttggggtgttgggggtagtttgtgagtatttagtcggggagaggggtcggtttcgtcgcgtatgcgtttttcgttttgttttgtttcgtttcgtttcggcggttttaggggaaaggattcgttgggggtcgggggtttgtcgggcgtttttcggggcggaggaatggcggggtcgtcgggagtcggcgttttggggttgttatggttattcgttcgggtttgggcgttttggtatttcgggttgggttgggttggcgtttttgggaatattttcggag

SEQ ID NO: 630 - DNA, 816 bp, Artificial Sequence
  chemically treated genomic DNA (Homo sapiens) CpG-island No: 630
ctccgaaaatattcccaaaaacgccaacccaacccaacccgaaataccaaaacgcccaaacccgaacgaataaccataacaaccccaaaacgccgactcccgacgaccccgccattcctccgccccgaaaaacgcccgacaaacccccgacccccaacgaatcctttcccctaaaaccgccgaaacgaaacgaaacaaaacaaaacgaaaaacgcatacgcgacgaaaccgacccctctccccgactaaatactcacaaactacccccaacaccccaaacaaacgacacaaccaacgataccaccacgtcataccctcttcctacgcgaacgacgcaaaactaacgaacgccccgaacgccccacctaaactactcataataccaccgtcaaacgcaactcacaaccctcacaaaaaactcgataaccgaccgcgtccgaaccgacgcgctaccttataaaaaaaaaaacatattaacataaaaaacgaaactttcaaactacgacgaaacgcgcccgaaaaaaaacgaatactcattaacataataaacgaaaccctcataccgcgactaaaaacgtttaaaaaaaaataaatactcattattataaaaaacgaaacccgcaaactacgacgaaaaactaaaaataaaaaactcgttaacatacgaaacgaaactcgcaaacatcgaaaaaatatacccgaaaaaaacgaacgtcattaacgtaaaaaacgaaaactcgcaatttacgacgacttactcccaaaaaaaacgaacgcttattaacataaaaaacgaaacctaaaaacgcgcaaaca

SEQ ID NO: 631 - DNA, 816 bp, Artificial Sequence
  chemically treated genomic DNA (Homo sapiens) CpG-island No: 631
tttcgggaatgtttttagaagcgttagtttagtttagttcggggtattaaggcgtttaggttcgagcgggtaattatggtaattttaggacgtcggttttcggcggtttcgttattttttcgtttcgggaggcgttcggtagattttcgatttttagcgggtttttttttttggggtcgtcggggcggggcggggtagggtagggcgaggagcgtatgcgcggcggggtcggttttttttttcgattggatatttatagattgtttttagtattttagataggcgatatagttagcggtattattacgttatgttttttttttgcgcgggcggcgtagagttggcggacgtttcgggcgttttatttgagttgtttatggtgttatcgttaggcgtagtttatagtttttataaagggttcggtagtcggtcgcgttcgagtcggcgcgttgttttgtgggagagggagtatattagtatagggggcggggtttttaggttgcggcgaggcgcgttcgaagggaggcgggtgtttattaatatagtgagcgggatttttatgtcgcgattaggggcgtttgaggggaggtaggtgtttattattgtagggggcgggattcgtaggttgcggcgaggagttgggggtggggagttcgttagtatacggggcggggttcgtaggtatcggagaggtgtgttcgaggggggcgggcgttattagcgtagggggcgggggttcgtagtttgcggcgatttgtttttaaaggaggcgggcgtttattagtatagggggcggggtttggaggcgcgtagata

SEQ ID NO: 632 - DNA, 816 bp, Artificial Sequence
  chemically treated genomic DNA (Homo sapiens) CpG-island No: 632
tatctacgcgcctccaaaccccgccccctatactaataaacgcccgcctcctttaaaaacaaatcgccgcaaactacgaacccccgccccctacgctaataacgcccgcccccctcgaacacacctctccgatacctacgaaccccgccccgtatactaacgaactccccacccccaactcctcgccgcaacctacgaatcccgccccctacaataataaacacctacctcccctcaaacgcccctaatcgcgacataaaaatcccgctcactatattaataaacacccgcctcccttcgaacgcgcctcgccgcaacctaaaaaccccgccccctatactaatatactccctctcccacaaaacaacgcgccgactcgaacgcgaccgactaccgaaccctttataaaaactataaactacgcctaacgataacaccataaacaactcaaataaaacgcccgaaacgtccgccaactctacgccgcccgcgcaaaaaaaaaacataacgtaataataccgctaactatatcgcctatctaaaatactaaaaacaatctataaatatccaatcgaaaaaaaaaaccgaccccgccgcgcatacgctcctcgccctaccctaccccgccccgccccgacgaccccaaaaaaaaaaacccgctaaaaatcgaaaatctaccgaacgcctcccgaaacgaaaaaataacgaaaccgccgaaaaccgacgtcctaaaattaccataattacccgctcgaacctaaacgccttaataccccgaactaaactaaactaacgcttctaaaaacattcccgaaa

SEQ ID NO: 633 - DNA, 1320 bp, Artificial Sequence
  chemically treated genomic DNA (Homo sapiens) CpG-island No: 633
ggtcgcgttcgtagttcgggtagggcgtcgtttttttcgttcgtttttttttacgcgggggttcgggggcggattgacgcggcggcgtttattttggtttttatgcggtttttcgaggtcggaggaaggtggcggagcgggagggagagagcgaggagcgcgcggagagggaggacggcggagggggaggagtaagcggaggggtgggggtggggtcgaggagtcgagcgtcgaggaggatttcgagggagattgggggcggagtagtcggcgacggagaggcgcggaggacgcggggtcgggggaggcggagtagcgggagtgggtggaaaagtagaggcggcgggaggagcgggagttttcgtgggagattcgggaggagtagtcggcgtgggtggagtcgtcggcgtgggaggagtcgcggggtttgggtgagaacggggcgggacggtcggaggcggggtttgcgaacgttttgtttttgttcgttcgggtcgcgtcgaggaacgaagatggtcgggcgcgtcgcgggaacggaggggcggtcggtagcggcggcggcggcggcggcggttttcgggttgtgatttcgcgcgcggcggttattcgggttatttgaacggagtgggcggcgcgggtagcggtttgttagggcgggcgggcggacgtcggtgtacgggcgtcgggcggaggatgcgttaggagcggcgggcggtttttcgcggtcgttttcgcgtttcgggcgtcgggttttagtgttggcggaggaggcggcgcgcgcggggcggtcgggcggcggcggggttcgcgtcgttatgttttggttgagcggcggtcggcggcgacggcggggatagtcgcgcgaggtttcgcgggagtcgtcgttttttgcgtagttttagcgggaatcgcgtcgtcggcgtttttcgtcgcggtttttacgtttttagtttttttcgcgtcgtcgtcgcgggttcgggagagcgtcgagttgtcgttgttcgtcggttgggaggaggcgcgagattacgacggtcgcgttttttatattgattataatacgcgttagacgtcgtggatcgattttcgcgatcggtaagcgggtcggttgggggcgttagattcggcgcgggcgttacgattcgggtcgtcggtcggcgttatcgcggatgcgttggggatacgtttcgtttagcgcggggtcgtcgtcgagagttttcgggttcgggtagagttcggagcgtttttattttcggaattaggggattttttggagtgtttcggtttaggttacgatcgaggcgtttttattttttgggt

SEQ ID NO: 634 - DNA, 1320 bp, Artificial Sequence
  chemically treated genomic DNA (Homo sapiens) CpG-island No: 634
acccaaaaaataaaaacgcctcgatcgtaacctaaaccgaaacactccaaaaaatcccctaattccgaaaataaaaacgctccgaactctacccgaacccgaaaactctcgacgacgaccccgcgctaaacgaaacgtatccccaacgcatccgcgataacgccgaccgacgacccgaatcgtaacgcccgcgccgaatctaacgcccccaaccgacccgcttaccgatcgcgaaaatcgatccacgacgtctaacgcgtattataatcaatataaaaaacgcgaccgtcgtaatctcgcgcctcctcccaaccgacgaacaacgacaactcgacgctctcccgaacccgcgacgacgacgcgaaaaaaactaaaaacgtaaaaaccgcgacgaaaaacgccgacgacgcgattcccgctaaaactacgcaaaaaacgacgactcccgcgaaacctcgcgcgactatccccgccgtcgccgccgaccgccgctcaaccaaaacataacgacgcgaaccccgccgccgcccgaccgccccgcgcgcgccgcctcctccgccaacactaaaacccgacgcccgaaacgcgaaaacgaccgcgaaaaaccgcccgccgctcctaacgcatcctccgcccgacgcccgtacaccgacgtccgcccgcccgccctaacaaaccgctacccgcgccgcccactccgttcaaataacccgaataaccgccgcgcgcgaaatcacaacccgaaaaccgccgccgccgccgccgccgctaccgaccgcccctccgttcccgcgacgcgcccgaccatcttcgttcctcgacgcgacccgaacgaacaaaaacaaaacgttcgcaaaccccgcctccgaccgtcccgccccgttctcacccaaaccccgcgactcctcccacgccgacgactccacccacgccgactactcctcccgaatctcccacgaaaactcccgctcctcccgccgcctctacttttccacccactcccgctactccgcctcccccgaccccgcgtcctccgcgcctctccgtcgccgactactccgcccccaatctccctcgaaatcctcctcgacgctcgactcctcgaccccacccccacccctccgcttactcctccccctccgccgtcctccctctccgcgcgctcctcgctctctccctcccgctccgccaccttcctccgacctcgaaaaaccgcataaaaaccaaaataaacgccgccgcgtcaatccgcccccgaacccccgcgtaaaaaaaaacgaacgaaaaaaacgacgccctacccgaactacgaacgcgacc

SEQ ID NO: 635 - DNA, 1320 bp, Artificial Sequence
  chemically treated genomic DNA (Homo sapiens) CpG-island No: 635
gtttaagggatgggggcgtttcgatcgtagtttggatcggagtattttagggagttttttggtttcggggatggaggcgtttcgagttttgttcgggttcgggggttttcggcggcggtttcgcgttgggcggggcgtgtttttagcgtattcgcggtggcgtcggtcggcggttcgggtcgtagcgttcgcgtcgggtttggcgtttttagtcggttcgtttatcggtcgcgggggtcgatttacgacgtttggcgcgtgttgtggttaatgtaaaagacgcgatcgtcgtagtttcgcgtttttttttagtcggcgggtagcggtagttcggcgttttttcgggttcgcggcggcggcgcggaaggagttgggggcgtggggatcgcggcggggggcgtcggcggcgcggttttcgttggggttgcgtagaaggcggcggttttcgcggggtttcgcgcggttgttttcgtcgtcgtcgtcggtcgtcgtttagttaaggtatgacggcgcgggtttcgtcgtcgttcggtcgtttcgcgcgcgtcgtttttttcgttagtattaaggttcggcgttcggggcgcgggggcggtcgcggggagtcgttcgtcgtttttggcgtatttttcgttcggcgttcgtgtatcggcgttcgttcgttcgttttagtaagtcgttgttcgcgtcgtttatttcgtttaggtagttcgggtggtcgtcgcgcgcgaagttatagttcgggagtcgtcgtcgtcgtcgtcgtcgttgtcggtcgttttttcgttttcgcggcgcgttcggttattttcgtttttcggcgcggttcgggcgagtaggggtagggcgttcgtaggtttcgttttcggtcgtttcgtttcgtttttatttaggtttcgcggttttttttacgtcggcggttttatttacgtcggttgtttttttcgaattttttacggaggttttcgtttttttcgtcgtttttgtttttttatttattttcgttgtttcgtttttttcggtttcgcgtttttcgcgttttttcgtcgtcggttgtttcgtttttagtttttttcggggtttttttcggcgttcggtttttcgattttatttttattttttcgtttgttttttttttttcgtcgtttttttttttcgcgcgtttttcgttttttttttttcgtttcgttattttttttcggtttcgggaaatcgtatggaggttaggatgggcgtcgtcgcgttagttcgttttcgggttttcgcgtagaggaaggcgggcggggaggacgacgttttattcggattgcgggcgcggtt

SEQ ID NO: 636 - DNA, 1320 bp, Artificial Sequence
  chemically treated genomic DNA (Homo sapiens) CpG-island No: 636
aaccgcgcccgcaatccgaataaaacgtcgtcctccccgcccgccttcctctacgcgaaaacccgaaaacgaactaacgcgacgacgcccatcctaacctccatacgatttcccgaaaccgaaaaaaaataacgaaacgaaaaaaaaaaaacgaaaaacgcgcgaaaaaaaaaaacgacgaaaaaaaaaaaacaaacgaaaaaataaaaataaaatcgaaaaaccgaacgccgaaaaaaaccccgaaaaaaactaaaaacgaaacaaccgacgacgaaaaaacgcgaaaaacgcgaaaccgaaaaaaacgaaacaacgaaaataaataaaaaaacaaaaacgacgaaaaaaacgaaaacctccgtaaaaaattcgaaaaaaacaaccgacgtaaataaaaccgccgacgtaaaaaaaaccgcgaaacctaaataaaaacgaaacgaaacgaccgaaaacgaaacctacgaacgccctacccctactcgcccgaaccgcgccgaaaaacgaaaataaccgaacgcgccgcgaaaacgaaaaaacgaccgacaacgacgacgacgacgacgacgactcccgaactataacttcgcgcgcgacgaccacccgaactacctaaacgaaataaacgacgcgaacaacgacttactaaaacgaacgaacgaacgccgatacacgaacgccgaacgaaaaatacgccaaaaacgacgaacgactccccgcgaccgcccccgcgccccgaacgccgaaccttaatactaacgaaaaaaacgacgcgcgcgaaacgaccgaacgacgacgaaacccgcgccgtcataccttaactaaacgacgaccgacgacgacgacgaaaacaaccgcgcgaaaccccgcgaaaaccgccgccttctacgcaaccccaacgaaaaccgcgccgccgacgccccccgccgcgatccccacgcccccaactccttccgcgccgccgccgcgaacccgaaaaaacgccgaactaccgctacccgccgactaaaaaaaaacgcgaaactacgacgatcgcgtcttttacattaaccacaacacgcgccaaacgtcgtaaatcgacccccgcgaccgataaacgaaccgactaaaaacgccaaacccgacgcgaacgctacgacccgaaccgccgaccgacgccaccgcgaatacgctaaaaacacgccccgcccaacgcgaaaccgccgccgaaaacccccgaacccgaacaaaactcgaaacgcctccatccccgaaaccaaaaaactccctaaaatactccgatccaaactacgatcgaaacgcccccatcccttaaac

SEQ ID NO: 637 - DNA, 662 bp, Artificial Sequence
  chemically treated genomic DNA (Homo sapiens) CpG-island No: 637
tcggggatgataacgtgtttgttttatgtcgcggtttttagttgtttaggtttcgttttttgtgagtgtgtaagtgtgtgatgttgtcgcggtcgtcgtcgtcgtttgtgtagtcgttgtcgtcgtcgtcgtcgtcgtcgtcgtcgtcgtcgtcgtcgtcgtcgttgtcgtttcggttgtcgcgtcgcgtcgttgtttttgtttcggtcgttttcgtcgtcgttgtcgtcgtcggttcgtagttagttaggcgggcggtttagttcgtttgagttcgtagcggttgtcgtcgtagcgtcgggtcgttgggtgcgcgggttatcgcggatcgagcggattcgagtgggcgattaggcgtttgttcgtttagtgttattgtcgtcgttttttcgtcggagtataggattagatatttttagcgttcgttgttgttgtcgatgcggttcggatatttttagttgggcgggagggttggagagtcgggggtcgtcgagaatcgttagcgagttgtgtcgagagtcgcgtcgattcgttgcgattagggataggcgttcgttcgtcgtcgtcgtttggtcgttatggatttattcgatttttttagagattgggatttggagtagtagtggtaggtgttgatttttgtttttttttttgatgagcga

SEQ ID NO: 638 - DNA, 662 bp, Artificial Sequence
  chemically treated genomic DNA (Homo sapiens) CpG-island No: 638
tcgctcatcaaaaaaaaaaacaaaaatcaacacctaccactactactccaaatcccaatctctaaaaaaatcgaataaatccataacgaccaaacgacgacgacgaacgaacgcctatccctaatcgcaacgaatcgacgcgactctcgacacaactcgctaacgattctcgacgacccccgactctccaaccctcccgcccaactaaaaatatccgaaccgcatcgacaacaacaacgaacgctaaaaatatctaatcctatactccgacgaaaaaacgacgacaataacactaaacgaacaaacgcctaatcgcccactcgaatccgctcgatccgcgataacccgcgcacccaacgacccgacgctacgacgacaaccgctacgaactcaaacgaactaaaccgcccgcctaactaactacgaaccgacgacgacaacgacgacgaaaacgaccgaaacaaaaacaacgacgcgacgcgacaaccgaaacgacaacgacgacgacgacgacgacgacgacgacgacgacgacgacgacgacaacgactacacaaacgacgacgacgaccgcgacaacatcacacacttacacactcacaaaaaacgaaacctaaacaactaaaaaccgcgacataaaacaaacacgttatcatccccga

SEQ ID NO: 639 - DNA, 662 bp, Artificial Sequence
  chemically treated genomic DNA (Homo sapiens) CpG-island No: 639
tcgtttattaaaggagaaggtaaaaattaatatttattattgttgttttaagttttagtttttgaaaaagtcgaatagatttatagcggttaggcggcggcggcgggcgggcgtttgtttttgatcgtagcgggtcggcgcggttttcggtatagttcgttggcggttttcggcggttttcggttttttagttttttcgtttagttaaaagtgttcgggtcgtatcggtagtagtagcgggcgttggaggtgtttggttttgtgtttcggcgaggaagcggcggtagtggtattgggcgggtaagcgtttggtcgtttattcgggttcgttcggttcgcggtagttcgcgtatttagcgattcgacgttgcggcggtagtcgttgcgggtttaggcgggttgggtcgttcgtttggttggttgcgggtcggcggcggtagcggcggcgggggcggtcggggtagaggtagcggcgcggcgcggtagtcggggcggtagcggcggcggcggcggcggcggcggcggcggcggcggcggcggcggtagcggttgtataggcggcggcggcggtcgcggtagtattatatatttatatatttatagggggcggagtttggatagttagaagtcgcgatatggagtaggtacgttattattttcgg

SEQ ID NO: 640 - DNA, 662 bp, Artificial Sequence
  chemically treated genomic DNA (Homo sapiens) CpG-island No: 640
ccgaaaataataacgtacctactccatatcgcgacttctaactatccaaactccgccccctataaatatataaatatataatactaccgcgaccgccgccgccgcctatacaaccgctaccgccgccgccgccgccgccgccgccgccgccgccgccgccgccgctaccgccccgactaccgcgccgcgccgctacctctaccccgaccgcccccgccgccgctaccgccgccgacccgcaaccaaccaaacgaacgacccaacccgcctaaacccgcaacgactaccgccgcaacgtcgaatcgctaaatacgcgaactaccgcgaaccgaacgaacccgaataaacgaccaaacgcttacccgcccaataccactaccgccgcttcctcgccgaaacacaaaaccaaacacctccaacgcccgctactactaccgatacgacccgaacacttttaactaaacgaaaaaactaaaaaaccgaaaaccgccgaaaaccgccaacgaactataccgaaaaccgcgccgacccgctacgatcaaaaacaaacgcccgcccgccgccgccgcctaaccgctataaatctattcgactttttcaaaaactaaaacttaaaacaacaataataaatattaatttttaccttctcctttaataaacga

SEQ ID NO: 641 - DNA, 633 bp, Artificial Sequence
  chemically treated genomic DNA (Homo sapiens) CpG-island No: 641
agtcgtcggtggttttttaagcgttttttttcggtagtttttgtttatagaaattttagtatacgtcgttgggcgtttagtcgtcgttgtaaagatagttttttagcgtcgcggtaacgttaggcgttttttttttcgcgttttcgcgtatcgtttatatagagtcggcgtttttttgtcgtttagtaatcgtcggcgtaggggcggagttttttggagggcggggtttgcgtttattcgttgttcgggcgcgacgcgttgcggtttagcgacgcggtttttagaatcgggtgattgaattaaattttcgtcgtatcgagtttgtagtacggtcgttattcgtatcgttgtttgtttgcggttggagaaattaaggttttatcgggttttcgtagttatttttttatagtgggcgtggtcgaggtcggggtgattttgtcggagttttcgttgttagcgatatgtttaaggtgagagcgtggagtcgagttatagttgttatcgttttttttcggtcgttcgagtttttttcgcgtttttttggggtttttttgtagttaggtttggtttatttcgaggtttttttcgttattgggtcggttgcgtttcggtttcgcggtttatttattggtt

SEQ ID NO: 642 - DNA, 633 bp, Artificial Sequence
  chemically treated genomic DNA (Homo sapiens) CpG-island No: 642
aaccaataaataaaccgcgaaaccgaaacgcaaccgacccaataacgaaaaaaacctcgaaataaaccaaacctaactacaaaaaaaccccaaaaaaacgcgaaaaaaactcgaacgaccgaaaaaaaacgataacaactataactcgactccacgctctcaccttaaacatatcgctaacaacgaaaactccgacaaaatcaccccgacctcgaccacgcccactataaaaaaataactacgaaaacccgataaaaccttaatttctccaaccgcaaacaaacaacgatacgaataacgaccgtactacaaactcgatacgacgaaaatttaattcaatcacccgattctaaaaaccgcgtcgctaaaccgcaacgcgtcgcgcccgaacaacgaataaacgcaaaccccgccctccaaaaaactccgcccctacgccgacgattactaaacgacaaaaaaacgccgactctatataaacgatacgcgaaaacgcgaaaaaaaaaacgcctaacgttaccgcgacgctaaaaaactatctttacaacgacgactaaacgcccaacgacgtatactaaaatttctataaacaaaaactaccgaaaaaaaacgcttaaaaaaccaccgacgact

SEQ ID NO: 643 - DNA, 633 bp, Artificial Sequence
  chemically treated genomic DNA (Homo sapiens) CpG-island No: 643
gattagtgaatgaatcgcggggtcgggacgtagtcggtttagtggcgggaaaagtttcggggtgagttaggtttggttgtagagaggttttaagagagcgcggggagggttcgggcggtcgggagggggcggtgatagttgtgattcgattttacgtttttattttgaatatgtcgttggtagcggaggtttcggtagggttatttcggtttcggttacgtttattatagagaggtgattacggaggttcggtagggttttgatttttttaatcgtaagtaggtagcggtgcgggtgacggtcgtattgtaaattcggtgcggcgaaggtttagtttaattattcggttttagaagtcgcgtcgttgagtcgtagcgcgtcgcgttcgggtagcgggtgaacgtaaatttcgttttttaggaggtttcgtttttgcgtcggcggttgttaggcggtaagaaagcgtcggttttgtgtggacggtacgcggaggcgcgaggagggaggcgtttggcgttgtcgcggcgttgggaaattgtttttgtagcggcgattgggcgtttagcggcgtgtattgggatttttgtgagtagaggttgtcgagagggggcgtttggagggttatcggcggtt

SEQ ID NO: 644 - DNA, 633 bp, Artificial Sequence
  chemically treated genomic DNA (Homo sapiens) CpG-island No: 644
aaccgccgataaccctccaaacgccccctctcgacaacctctactcacaaaaatcccaatacacgccgctaaacgcccaatcgccgctacaaaaacaatttcccaacgccgcgacaacgccaaacgcctccctcctcgcgcctccgcgtaccgtccacacaaaaccgacgctttcttaccgcctaacaaccgccgacgcaaaaacgaaacctcctaaaaaacgaaatttacgttcacccgctacccgaacgcgacgcgctacgactcaacgacgcgacttctaaaaccgaataattaaactaaaccttcgccgcaccgaatttacaatacgaccgtcacccgcaccgctacctacttacgattaaaaaaatcaaaaccctaccgaacctccgtaatcacctctctataataaacgtaaccgaaaccgaaataaccctaccgaaacctccgctaccaacgacatattcaaaataaaaacgtaaaatcgaatcacaactatcaccgccccctcccgaccgcccgaaccctccccgcgctctcttaaaacctctctacaaccaaacctaactcaccccgaaacttttcccgccactaaaccgactacgtcccgaccccgcgattcattcactaatc

SEQ ID NO: 645 - DNA, 602 bp, Artificial Sequence
  chemically treated genomic DNA (Homo sapiens) CpG-island No: 645
attattttgttttttatcgaggttttttcgattattttgttttttatcgaggtttttttgattattttgttttttatcgagttttttttgattattcggttttttatcgatgttttttcgattattttgttttttatcgaggttttttcgattattcggttttttatcgagttttttttgattagtcggttttttatcgagtttttttcgattattttgtattttatcgaggttttttagattattcggtattttatcgaggttttttcgattattcggttttttatcgaggttttttcgattattcggtattttatcgagtttttttcgattattcggttttttattaaggttttttcgattattcggttttttatcgagtttttttcgattattcggttttttatcgaggttttttcgattattcggttttttatcgaggttttttcgattattatgttttttatcgaggtttttttgattattcggttttttatcgagttttttttgattattcggttttttattaaggttttttcgattattcggttttttatcgaggttttttcgattattttatttttatcgatgaagatattatt

SEQ ID NO: 646 - DNA, 602 bp, Artificial Sequence
  chemically treated genomic DNA (Homo sapiens) CpG-island No: 646
aataatatcttcatcgataaaaataaaataatcgaaaaaacctcgataaaaaaccgaataatcgaaaaaaccttaataaaaaaccgaataatcaaaaaaaactcgataaaaaaccgaataatcaaaaaaacctcgataaaaaacataataatcgaaaaaacctcgataaaaaaccgaataatcgaaaaaacctcgataaaaaaccgaataatcgaaaaaaactcgataaaaaaccgaataatcgaaaaaaccttaataaaaaaccgaataatcgaaaaaaactcgataaaataccgaataatcgaaaaaacctcgataaaaaaccgaataatcgaaaaaacctcgataaaataccgaataatctaaaaaacctcgataaaatacaaaataatcgaaaaaaactcgataaaaaaccgactaatcaaaaaaaactcgataaaaaaccgaataatcgaaaaaacctcgataaaaaacaaaataatcgaaaaaacatcgataaaaaaccgaataatcaaaaaaaactcgataaaaaacaaaataatcaaaaaaacctcgataaaaaacaaaataatcgaaaaaacctcgataaaaaacaaaataat

SEQ ID NO: 647 - DNA, 602 bp, Artificial Sequence
  chemically treated genomic DNA (Homo sapiens) CpG-island No: 647
ggtagtatttttatcgatgggaatagggtggtcggggaagtttcgatgggaggtcgggtggtcggggaagttttgatgagaggtcgggtggttagggaaggttcgatgagaggtcgggtggttagggaagtttcgatgggaggtatggtggtcggggaagtttcgatgagaggtcgggtggtcggggaagtttcgatgggaggtcgggtggtcggggaaggttcgatgagaggtcgggtggtcggggaagttttgatgagaggtcgggtggtcggggaaggttcgatgagatgtcgggtggtcggggaagtttcgatgagaggtcgggtggtcggggaagtttcgatgggatgtcgggtggtttgggaagtttcgatgggatgtagggtggtcggggaaggttcgatgggaggtcggttggttagggaaggttcgatgagaggtcgggtggtcggggaagtttcgatgggaggtagggtggtcggggaagtatcgatgagaggtcgggtggttagggaaggttcgatgagaggtagggtggttagggaagtttcgatgagaggtagggtggtcggggaagtttcgatgggaggtagggtggt

SEQ ID NO: 648 - DNA, 602 bp, Artificial Sequence
  chemically treated genomic DNA (Homo sapiens) CpG-island No: 648
accaccctacctcccatcgaaacttccccgaccaccctacctctcatcgaaacttccctaaccaccctacctctcatcgaaccttccctaaccacccgacctctcatcgatacttccccgaccaccctacctcccatcgaaacttccccgaccacccgacctctcatcgaaccttccctaaccaaccgacctcccatcgaaccttccccgaccaccctacatcccatcgaaacttcccaaaccacccgacatcccatcgaaacttccccgaccacccgacctctcatcgaaacttccccgaccacccgacatctcatcgaaccttccccgaccacccgacctctcatcaaaacttccccgaccacccgacctctcatcgaaccttccccgaccacccgacctcccatcgaaacttccccgaccacccgacctctcatcgaaacttccccgaccaccatacctcccatcgaaacttccctaaccacccgacctctcatcgaaccttccctaaccacccgacctctcatcaaaacttccccgaccacccgacctcccatcgaaacttccccgaccaccctattcccatcgataaaaatactacc

SEQ ID NO: 649 - DNA, 682 bp, Artificial Sequence
  chemically treated genomic DNA (Homo sapiens) CpG-island No: 649
tttacgtcgatgggtttatggtgaaataaaaaatagtgtttacggttgcgtttcgtatttttgcgtcggttagggcgggttttgattcgggtttgaggttcgttttatttttattcgatcgtttgcgtttacgggcgaggggtcgcgttcgattttaagtcgggttttattttaggagatcgggatcgcgatggtagcggtagaggtttcgtatggtcggaagttattttttaaagcgttgggtcggtagcggtgggatttagggtcggttacgggttttttgacgttattgggcgcgacgtttcgcgtcgggattattgtttttagaaggtcgcgcgcgggttttcgttagttaggtgggtgttaggttttggtcgtggcgaaagagtcggcggagtcggagattcgttttcggagacgtcgtttcgcgattttcgcgcgggcgggatcgggcggtcggtattatgattttgttttatttcgggaattgtttcgtttttgtttattttttttattttattatttataagtgtagcggtttgtgagtgcgggaagggcgcggggcggagagggcgcggggttcgggtcgatttttatttttcgtttttttaggttcgagtataacgttttttggaaatgcgtttaggttggagttatttatttttttgtttaattttgtaag

SEQ ID NO: 650 - DNA, 682 bp, Artificial Sequence
  chemically treated genomic DNA (Homo sapiens) CpG-island No: 650
cttacaaaattaaacaaaaaaataaataactccaacctaaacgcatttccaaaaaacgttatactcgaacctaaaaaaacgaaaaataaaaatcgacccgaaccccgcgccctctccgccccgcgcccttcccgcactcacaaaccgctacacttataaataataaaataaaaaaaataaacaaaaacgaaacaattcccgaaataaaacaaaatcataataccgaccgcccgatcccgcccgcgcgaaaatcgcgaaacgacgtctccgaaaacgaatctccgactccgccgactctttcgccacgaccaaaacctaacacccacctaactaacgaaaacccgcgcgcgaccttctaaaaacaataatcccgacgcgaaacgtcgcgcccaataacgtcaaaaaacccgtaaccgaccctaaatcccaccgctaccgacccaacgctttaaaaaataacttccgaccatacgaaacctctaccgctaccatcgcgatcccgatctcctaaaataaaacccgacttaaaatcgaacgcgacccctcgcccgtaaacgcaaacgatcgaataaaaataaaacgaacctcaaacccgaatcaaaacccgccctaaccgacgcaaaaatacgaaacgcaaccgtaaacactattttttatttcaccataaacccatcgacgtaaa

SEQ ID NO: 651 - DNA, 682 bp, Artificial Sequence
  chemically treated genomic DNA (Homo sapiens) CpG-island No: 651
tttgtagagttggataaagaggtaggtgattttagtttggacgtatttttagaaggcgttgtattcggatttggagaagcgggaggtgagggtcggttcgggtttcgcgtttttttcgtttcgcgtttttttcgtatttataggtcgttgtatttgtaggtgatgaagtaggggaagtaggtaagagcgaagtagttttcgaagtgaaatagggttatgatgtcggtcgttcggtttcgttcgcgcggggatcgcgaggcggcgttttcgggagcgggttttcggtttcgtcggttttttcgttacggttagggtttggtatttatttgattggcgggggttcgcgcgcgattttttgggagtagtagtttcggcgcggggcgtcgcgtttagtgacgttagagagttcgtggtcggttttgggttttatcgttgtcggtttagcgttttggggagtgattttcggttatgcggggtttttatcgttgttatcgcggtttcggttttttgaagtggaattcggtttggagtcgagcgcgatttttcgttcgtgggcgtaggcgatcgagtaagggtggggcgggttttaaattcggattagaattcgttttgatcggcgtagagatacgggacgtagtcgtgagtattgttttttattttattatggatttatcggcgtggg

SEQ ID NO: 652 - DNA, 682 bp, Artificial Sequence
  chemically treated genomic DNA (Homo sapiens) CpG-island No: 652
cccacgccgataaatccataataaaataaaaaacaatactcacgactacgtcccgtatctctacgccgatcaaaacgaattctaatccgaatttaaaacccgccccacccttactcgatcgcctacgcccacgaacgaaaaatcgcgctcgactccaaaccgaattccacttcaaaaaaccgaaaccgcgataacaacgataaaaaccccgcataaccgaaaatcactccccaaaacgctaaaccgacaacgataaaacccaaaaccgaccacgaactctctaacgtcactaaacgcgacgccccgcgccgaaactactactcccaaaaaatcgcgcgcgaacccccgccaatcaaataaataccaaaccctaaccgtaacgaaaaaaccgacgaaaccgaaaacccgctcccgaaaacgccgcctcgcgatccccgcgcgaacgaaaccgaacgaccgacatcataaccctatttcacttcgaaaactacttcgctcttacctacttcccctacttcatcacctacaaatacaacgacctataaatacgaaaaaaacgcgaaacgaaaaaaacgcgaaacccgaaccgaccctcacctcccgcttctccaaatccgaatacaacgccttctaaaaatacgtccaaactaaaatcacctacctctttatccaactctacaaa

SEQ ID NO: 653 - DNA, 510 bp, Artificial Sequence
  chemically treated genomic DNA (Homo sapiens) CpG-island No: 653
gggtgcgggcgcggtttagtttttttttatttggttgcggttggcggtggggtttgggtcgacgttggtgcggtttggatggataggacgttttcgggggatagcgcggacgttacggtagtcggatttacgttaggcggtaggcggtagcgacggtggaattcgcgcgcgacgaattcgtgtttattttggaggggagggaggtttgagcggtttcgttttttcggttcggcggcgagcgtattcgttttagtttcgttttacgtcgcggtttatcgggcgtttttcgtggcgcgcgtgtatttttacgtgttcgtttattattttgatagtaatttttttcggcgagaagtgttttacgtttagtagtatcgaaaagtggtcggggttcgtcggtatttgagcgtagcgggcgcgggcgggattgttattgggttgggttaggttttaggatttatttagggagattttattttcgtcggtttcgtgtcgcggtttattttggttttt

SEQ ID NO: 654 - DNA, 510 bp, Artificial Sequence
  chemically treated genomic DNA (Homo sapiens) CpG-island No: 654
aaaaaccaaaataaaccgcgacacgaaaccgacgaaaataaaatctccctaaataaatcctaaaacctaacccaacccaataacaatcccgcccgcgcccgctacgctcaaataccgacgaaccccgaccacttttcgatactactaaacgtaaaacacttctcgccgaaaaaaattactatcaaaataataaacgaacacgtaaaaatacacgcgcgccacgaaaaacgcccgataaaccgcgacgtaaaacgaaactaaaacgaatacgctcgccgccgaaccgaaaaaacgaaaccgctcaaacctccctcccctccaaaataaacacgaattcgtcgcgcgcgaattccaccgtcgctaccgcctaccgcctaacgtaaatccgactaccgtaacgtccgcgctatcccccgaaaacgtcctatccatccaaaccgcaccaacgtcgacccaaaccccaccgccaaccgcaaccaaataaaaaaaaactaaaccgcgcccgcaccc

SEQ ID NO: 655 - DNA, 510 bp, Artificial Sequence
  chemically treated genomic DNA (Homo sapiens) CpG-island No: 655
ggaggttagagtgagtcgcggtacggaatcgacgggggtggggtttttttgggtgggttttggagtttggtttagtttaatgatagtttcgttcgcgttcgttgcgtttaggtgtcgacggatttcggttatttttcggtgttgttagacgtgaagtatttttcgtcggaggaaattgttgttaaggtggtgggcgaatacgtggaggtgtacgcgcgttacgaggagcgttcggtgagtcgcggcgtggggcggggttggagcgggtacgttcgtcgtcgggtcggaggggcggggtcgtttaagttttttttttttttaggatgagtacggattcgtcgcgcgcgagttttatcgtcgttatcgtttgtcgtttggcgtggattcggttgtcgtgacgttcgcgttgtttttcgagggcgttttgtttatttaggtcgtattagcgtcggtttaggttttatcgttagtcgtagttaagtaggagggggttgggtcgcgttcgtattt

SEQ ID NO: 656 - DNA, 510 bp, Artificial Sequence
  chemically treated genomic DNA (Homo sapiens) CpG-island No: 656
aaatacgaacgcgacccaaccccctcctacttaactacgactaacgataaaacctaaaccgacgctaatacgacctaaataaacaaaacgccctcgaaaaacaacgcgaacgtcacgacaaccgaatccacgccaaacgacaaacgataacgacgataaaactcgcgcgcgacgaatccgtactcatcctaaaaaaaaaaaaaacttaaacgaccccgcccctccgacccgacgacgaacgtacccgctccaaccccgccccacgccgcgactcaccgaacgctcctcgtaacgcgcgtacacctccacgtattcgcccaccaccttaacaacaatttcctccgacgaaaaatacttcacgtctaacaacaccgaaaaataaccgaaatccgtcgacacctaaacgcaacgaacgcgaacgaaactatcattaaactaaaccaaactccaaaacccacccaaaaaaaccccacccccgtcgattccgtaccgcgactcactctaacctcc

SEQ ID NO: 657 - DNA, 570 bp, Artificial Sequence
  chemically treated genomic DNA (Homo sapiens) CpG-island No: 657
cgttgttaaatttcgaggggcgggatcgaggatatagagtcggggcggagtttaaggtgaaattaatgagaagttttcgggtgggcggggtatcggtttaaggttaagggcggagttaatgagaagtagcgtcgcgttttcgttgtttttcgttttcgtggggcgcgcgtcggagttacgggtagtcgttaggggcggggtttgtagtcgttcgcgcgcggttcgcgtttttttttttgtgtcgttatggcggcggtagcggcgacgagaacggcgagcgaggggtcgagcgcggtcggggtttgaggaggttacgcgattatggtggtaagggttttacgcggtcgttagtttgttcgttcggatgttagtttgttcgtgcgtagtttcgtttcgcgcgtttcgttttcggtttcgttcgatttcgcggtttgtgttttagtcgtggtttttttcgttttgcggttttatttcgggttttagttcgtatttcgatttcgttttttaagcgcgtattttcgttttttacgttttggatggggtgatagggatttagggtttgggttggga

SEQ ID NO: 658 - DNA, 570 bp, Artificial Sequence
  chemically treated genomic DNA (Homo sapiens) CpG-island No: 658
tcccaacccaaaccctaaatccctatcaccccatccaaaacgtaaaaaacgaaaatacgcgcttaaaaaacgaaatcgaaatacgaactaaaacccgaaataaaaccgcaaaacgaaaaaaaccacgactaaaacacaaaccgcgaaatcgaacgaaaccgaaaacgaaacgcgcgaaacgaaactacgcacgaacaaactaacatccgaacgaacaaactaacgaccgcgtaaaacccttaccaccataatcgcgtaacctcctcaaaccccgaccgcgctcgacccctcgctcgccgttctcgtcgccgctaccgccgccataacgacacaaaaaaaaaaacgcgaaccgcgcgcgaacgactacaaaccccgcccctaacgactacccgtaactccgacgcgcgccccacgaaaacgaaaaacaacgaaaacgcgacgctacttctcattaactccgcccttaaccttaaaccgataccccgcccacccgaaaacttctcattaatttcaccttaaactccgccccgactctatatcctcgatcccgcccctcgaaatttaacaacg

SEQ ID NO: 659 - DNA, 570 bp, Artificial Sequence
  chemically treated genomic DNA (Homo sapiens) CpG-island No: 659
ttttagtttaggttttaggtttttgttattttatttagggcgtggaagacggggatgcgcgtttagggggcggggtcgaggtacgggttgggattcgggatggggtcgtaggacgggagggattacggttgaagtataggtcgcgggatcgggcggggtcgggggcggggcgcgcggggcggggttgcgtacggatagattgatattcggacggataggttgacggtcgcgtgggatttttattattatggtcgcgtagtttttttaggtttcggtcgcgttcgatttttcgttcgtcgttttcgtcgtcgttgtcgtcgttatggcgatataaaggggagggcgcgagtcgcgcgcgggcggttgtagatttcgtttttaacggttgttcgtggtttcggcgcgcgttttacgggggcggggggtagcgggaacgcggcgttgttttttattggtttcgtttttggttttaggtcgatgtttcgtttattcggaggttttttattggttttattttgggtttcgtttcggttttgtgttttcggtttcgtttttcgaagtttgatagcg

SEQ ID NO: 660 - DNA, 570 bp, Artificial Sequence
  chemically treated genomic DNA (Homo sapiens) CpG-island No: 660
cgctatcaaacttcgaaaaacgaaaccgaaaacacaaaaccgaaacgaaacccaaaataaaaccaataaaaaacctccgaataaacgaaacatcgacctaaaaccaaaaacgaaaccaataaaaaacaacgccgcgttcccgctaccccccgcccccgtaaaacgcgcgccgaaaccacgaacaaccgttaaaaacgaaatctacaaccgcccgcgcgcgactcgcgccctcccctttatatcgccataacgacgacaacgacgacgaaaacgacgaacgaaaaatcgaacgcgaccgaaacctaaaaaaactacgcgaccataataataaaaatcccacgcgaccgtcaacctatccgtccgaatatcaatctatccgtacgcaaccccgccccgcgcgccccgcccccgaccccgcccgatcccgcgacctatacttcaaccgtaatccctcccgtcctacgaccccatcccgaatcccaacccgtacctcgaccccgccccctaaacgcgcatccccgtcttccacgccctaaataaaataacaaaaacctaaaacctaaactaaaa

SEQ ID NO: 661 - DNA, 979 bp, Artificial Sequence
  chemically treated genomic DNA (Homo sapiens) CpG-island No: 661
gtggtttcgatttggttagtcgtttgttgaagcgggggagcggggagtaggggtatgcgaattcggttttttttattatgatgaagacggagttacgggggttcgggggtttttttcggagcgttttttcgtatcgtagcgtttacgaggcgggtatttaggcgttgaagtcgttcgacgcgttcgggttcgacgaggtatttaagggggtttattataagaaatatggttttaacgtttatcgtattaaaagtatgtttttgtagatgggtacgacggcggggttttcgggcgaggcgggcggcggcgcgggtttggtcgaggttttacgggcgttcgagcgcggcgtgcgtttgtcgttgtcgcgggttagtagtttgaacgagaacgtggattatagcgttttgttgaagttgggtattagcgtgtcggagcgcgtgagtcgtttcgattttaagttcgcgtttttcgcgtagtttgcgtcgtcgtcgtattcgtcgtttcggttgtaggagacgcggaagttgttcgaacggagcgttttagcgcgtaggcggcgataaggagcgcggcgcggcggttgttgaggtaggagcgcgtcggtttgtaggatcggaagttggacgtcgtggtgcgttttaacggtagtatcgaggcgttggataagttggacgttgacgtcgtgttttttacggttagttagtttagcgtcgttttcgagaaggtcgattcgaggatcggtttttatcgcgggttcgggttttttagggtcgtaggggttttttaggttaattcgaagttggttagtaagcggtttcgggtgttttagttttcgtcgtcgtcgtcgttcgtttcgtcgggggatgtttcggtcgagaaagagcgatgtttcgtagggtagtagttttcgtagtatcgagtggtttttgttcggtcgttttttaagtttcgggaggtgcgtaagattaagtcggtggag

SEQ ID NO: 662 - DNA, 979 bp, Artificial Sequence
  chemically treated genomic DNA (Homo sapiens) CpG-island No: 662
ctccaccgacttaatcttacgcacctcccgaaacttaaaaaacgaccgaacaaaaaccactcgatactacgaaaactactaccctacgaaacatcgctctttctcgaccgaaacatcccccgacgaaacgaacgacgacgacgacgaaaactaaaacacccgaaaccgcttactaaccaacttcgaattaacctaaaaaacccctacgaccctaaaaaacccgaacccgcgataaaaaccgatcctcgaatcgaccttctcgaaaacgacgctaaactaactaaccgtaaaaaacacgacgtcaacgtccaacttatccaacgcctcgatactaccgttaaaacgcaccacgacgtccaacttccgatcctacaaaccgacgcgctcctacctcaacaaccgccgcgccgcgctccttatcgccgcctacgcgctaaaacgctccgttcgaacaacttccgcgtctcctacaaccgaaacgacgaatacgacgacgacgcaaactacgcgaaaaacgcgaacttaaaatcgaaacgactcacgcgctccgacacgctaatacccaacttcaacaaaacgctataatccacgttctcgttcaaactactaacccgcgacaacgacaaacgcacgccgcgctcgaacgcccgtaaaacctcgaccaaacccgcgccgccgcccgcctcgcccgaaaaccccgccgtcgtacccatctacaaaaacatacttttaatacgataaacgttaaaaccatatttcttataataaacccccttaaatacctcgtcgaacccgaacgcgtcgaacgacttcaacgcctaaatacccgcctcgtaaacgctacgatacgaaaaaacgctccgaaaaaaacccccgaacccccgtaactccgtcttcatcataataaaaaaaaccgaattcgcatacccctactccccgctcccccgcttcaacaaacgactaaccaaatcgaaaccac

SEQ ID NO: 663 - DNA, 979 bp, Artificial Sequence
  chemically treated genomic DNA (Homo sapiens) CpG-island No: 663
ttttatcggtttaattttgcgtatttttcggggtttggggggcggtcgggtaggggttattcggtgttgcgggggttgttgttttgcggggtatcgttttttttcggtcggggtatttttcgacggggcgggcggcggcggcggcgggggttggaatattcgggatcgtttgttgattagtttcgagttgatttggggaatttttgcggttttggggagttcgggttcgcggtggaggtcggttttcgagtcggttttttcgaagacggcgttgagttggttgatcgtgggggatacggcgttagcgtttagtttgtttagcgtttcggtgttgtcgttgaagcgtattacgacgtttagttttcggttttgtaggtcggcgcgtttttgttttagtagtcgtcgcgtcgcgttttttgtcgtcgtttgcgcgttggggcgtttcgttcgaatagttttcgcgttttttgtagtcgggacggcgggtgcggcggcggcgtaggttgcgcggagggcgcgggtttggagtcgaagcggtttacgcgtttcgatacgttggtgtttagttttagtagggcgttgtggtttacgttttcgtttaggttgttggttcgcggtagcgataggcgtacgtcgcgttcggacgttcgtggggtttcggttaggttcgcgtcgtcgttcgtttcgttcgagggtttcgtcgtcgtgtttatttgtaggaatatatttttgatgcggtggacgttggagttatattttttgtggtgggtttttttgggtgtttcgtcgggttcgggcgcgtcgggcggttttagcgtttggatgttcgtttcgtaggcgttgcggtgcggggaggcgtttcggaggggattttcgggttttcgtggtttcgtttttattatggtggggggagtcgggttcgtatgtttttgtttttcgttttttcgttttaataggcggttggttaagtcgggattat

SEQ ID NO: 664 - DNA, 979 bp, Artificial Sequence
  chemically treated genomic DNA (Homo sapiens) CpG-island No: 664
ataatcccgacttaaccaaccgcctattaaaacgaaaaaacgaaaaacaaaaacatacgaacccgactccccccaccataataaaaacgaaaccacgaaaacccgaaaatcccctccgaaacgcctccccgcaccgcaacgcctacgaaacgaacatccaaacgctaaaaccgcccgacgcgcccgaacccgacgaaacacccaaaaaaacccaccacaaaaaatataactccaacgtccaccgcatcaaaaatatattcctacaaataaacacgacgacgaaaccctcgaacgaaacgaacgacgacgcgaacctaaccgaaaccccacgaacgtccgaacgcgacgtacgcctatcgctaccgcgaaccaacaacctaaacgaaaacgtaaaccacaacgccctactaaaactaaacaccaacgtatcgaaacgcgtaaaccgcttcgactccaaacccgcgccctccgcgcaacctacgccgccgccgcacccgccgtcccgactacaaaaaacgcgaaaactattcgaacgaaacgccccaacgcgcaaacgacgacaaaaaacgcgacgcgacgactactaaaacaaaaacgcgccgacctacaaaaccgaaaactaaacgtcgtaatacgcttcaacgacaacaccgaaacgctaaacaaactaaacgctaacgccgtatcccccacgatcaaccaactcaacgccgtcttcgaaaaaaccgactcgaaaaccgacctccaccgcgaacccgaactccccaaaaccgcaaaaattccccaaatcaactcgaaactaatcaacaaacgatcccgaatattccaacccccgccgccgccgccgcccgccccgtcgaaaaataccccgaccgaaaaaaaacgataccccgcaaaacaacaacccccgcaacaccgaataacccctacccgaccgccccccaaaccccgaaaaatacgcaaaattaaaccgataaaa

SEQ ID NO: 665 - DNA, 578 bp, Artificial Sequence
  chemically treated genomic DNA (Homo sapiens) CpG-island No: 665
ggagtcggaggtcgagtcggcgttcggggaggtgatttaggtcgaggttacggtttacgcggttttggagaatggtagtatcgtggtaattgtagttagtttcgcgttcgaggagttaaaggtttaagcggtttcggagaaggaggcggcggcggtagcgtcgttagagaggggggtgggtaatggtcgggtttcggacgtggtttttgaggaggtagatgaatttaagaaggaggatttttcggaggcggatttggtggacgtgagcgtttatagtgggttcggggaggattttgcgggtagtgttttggaggaggacgacgaagacgacgaggaggatggggagtttttttacgagttcgagtcggggtgcgtggagatttcggggttgtcggaggaggaggatttagtttcgagtcggaagatttattttagtacggcgtttatttaagtaagtgagttttttcgttttgttttcgcgtcgtttttgttacgtgtacgcggtcgttttcgttcgttagttagttagtcgggtttggtaggttgagttagtttttgttatttagttttttttttag

SEQ ID NO: 666 - DNA, 578 bp, Artificial Sequence
  chemically treated genomic DNA (Homo sapiens) CpG-island No: 666
ctaaaaaaaaaactaaataacaaaaactaactcaacctaccaaacccgactaactaactaacgaacgaaaacgaccgcgtacacgtaacaaaaacgacgcgaaaacaaaacgaaaaaactcacttacttaaataaacgccgtactaaaataaatcttccgactcgaaactaaatcctcctcctccgacaaccccgaaatctccacgcaccccgactcgaactcgtaaaaaaactccccatcctcctcgtcgtcttcgtcgtcctcctccaaaacactacccgcaaaatcctccccgaacccactataaacgctcacgtccaccaaatccgcctccgaaaaatcctccttcttaaattcatctacctcctcaaaaaccacgtccgaaacccgaccattacccacccccctctctaacgacgctaccgccgccgcctccttctccgaaaccgcttaaacctttaactcctcgaacgcgaaactaactacaattaccacgatactaccattctccaaaaccgcgtaaaccgtaacctcgacctaaatcacctccccgaacgccgactcgacctccgactcc

SEQ ID NO: 667 - DNA, 578 bp, Artificial Sequence
  chemically treated genomic DNA (Homo sapiens) CpG-island No: 667
ttgggaagggggttgggtggtaggggttgatttagtttgttaaattcggttggttggttggcgagcgggggcggtcgcgtgtacgtggtaggggcggcgcgggggtagggcgggggggtttatttatttggatgggcgtcgtgttgaaatggatttttcggttcggggttgggtttttttttttcgatagtttcgggatttttacgtatttcgattcgggttcgtaggggggttttttatttttttcgtcgttttcgtcgtttttttttagggtattgttcgtagagtttttttcgagtttattgtaggcgtttacgtttattaagttcgttttcgagaagtttttttttttggatttatttatttttttaggggttacgttcggggttcggttattgtttatttttttttttggcggcgttatcgtcgtcgttttttttttcggggtcgtttgggtttttggtttttcgggcgcggggttggttgtagttgttacggtgttgttattttttagggtcgcgtggatcgtaatttcggtttggattattttttcgggcgtcgattcggttttcgatttt

SEQ ID NO: 668 - DNA, 578 bp, Artificial Sequence
  chemically treated genomic DNA (Homo sapiens) CpG-island No: 668
aaaatcgaaaaccgaatcgacgcccgaaaaaataatccaaaccgaaattacgatccacgcgaccctaaaaaataacaacaccgtaacaactacaaccaaccccgcgcccgaaaaaccaaaaacccaaacgaccccgaaaaaaaaaacgacgacgataacgccgccaaaaaaaaaaataaacaataaccgaaccccgaacgtaacccctaaaaaaataaataaatccaaaaaaaaaaacttctcgaaaacgaacttaataaacgtaaacgcctacaataaactcgaaaaaaactctacgaacaataccctaaaaaaaaacgacgaaaacgacgaaaaaaataaaaaacccccctacgaacccgaatcgaaatacgtaaaaatcccgaaactatcgaaaaaaaaaaacccaaccccgaaccgaaaaatccatttcaacacgacgcccatccaaataaataaacccccccgccctacccccgcgccgcccctaccacgtacacgcgaccgcccccgctcgccaaccaaccaaccgaatttaacaaactaaatcaacccctaccacccaacccccttcccaa

SEQ ID NO: 669 - DNA, 763 bp, Artificial Sequence
  chemically treated genomic DNA (Homo sapiens) CpG-island No: 669
cgtttcggagtcgtttttattcgcgtagatttcggtgcgtcgcgtttttcgcgggtagagaagtagttgtaatttcgtttttcggttttagtcgtttttttttcgtcgttttttttcgttttcgttttttcgttttttttcgttttttgttttttgggcgttcggttttttcgttacgcgttttttatttcgacgtttttttttcggagattttcgcggatttttgtcgacgcgacgtcgcgcgaatcggttttgttaggcgggggtttcgcgttcggttaggtttggcgggcggtaggggcggggagggaggtggcgttcgtttttcgtttttttttttttttttttttttgttatatatatatatacgtatacgtatacgtatatatatacggagtattttttcgttaggttttttggtttagtttcgttcgcgttttttgtttttagcgaatttgttttttttttttatatttttcgttttttatttttttcggttttgggatttttttcgtcgattttatttttattttcgggatggagcggttcgagttcgttcggagtttttcgcggtcggggtgacggtttttttattttttttttgttcggttttcgtttcgagtattatgggtttgaggggttttcggggcgttagacgttgaagatgatcgatgtcggaggtgaggggtcgggcgttttggggtggatcgggaattggggttagggttattcgggttcgcggtgggattttgagtggggttgg

SEQ ID NO: 670 - DNA, 763 bp, Artificial Sequence
  chemically treated genomic DNA (Homo sapiens) CpG-island No: 670
ccaaccccactcaaaatcccaccgcgaacccgaataaccctaaccccaattcccgatccaccccaaaacgcccgacccctcacctccgacatcgatcatcttcaacgtctaacgccccgaaaacccctcaaacccataatactcgaaacgaaaaccgaacaaaaaaaaaataaaaaaaccgtcaccccgaccgcgaaaaactccgaacgaactcgaaccgctccatcccgaaaataaaaataaaatcgacgaaaaaaatcccaaaaccgaaaaaaataaaaaacgaaaaatataaaaaaaaaaaacaaattcgctaaaaacaaaaaacgcgaacgaaactaaaccaaaaaacctaacgaaaaaatactccgtatatatatacgtatacgtatacgtatatatatatataacaaaaaaaaaaaaaaaaaaaaaaacgaaaaacgaacgccacctccctccccgcccctaccgcccgccaaacctaaccgaacgcgaaacccccgcctaacaaaaccgattcgcgcgacgtcgcgtcgacaaaaatccgcgaaaatctccgaaaaaaaaacgtcgaaataaaaaacgcgtaacgaaaaaaccgaacgcccaaaaaacaaaaaacgaaaaaaaacgaaaaaacgaaaacgaaaaaaaacgacgaaaaaaaaacgactaaaaccgaaaaacgaaattacaactacttctctacccgcgaaaaacgcgacgcaccgaaatctacgcgaataaaaacgactccgaaacg

SEQ ID NO: 671 - DNA, 763 bp, Artificial Sequence
  chemically treated genomic DNA (Homo sapiens) CpG-island No: 671
ttaattttatttagggttttatcgcgggttcgagtggttttagttttagttttcggtttattttagggcgttcggttttttattttcggtatcggttatttttagcgtttggcgtttcgggaattttttaggtttatggtgttcgaggcgggggtcgggtaggagaggggtggggggatcgttatttcggtcgcggggggtttcgggcgggttcgagtcgttttatttcgggggtgggggtgaggtcggcgggaagggttttagagtcgggggagatggagggcgggggatgtggggagagggaataggttcgttggaagtaggaggcgcgggcggggttggattaggagatttgacgggaggatgtttcgtgtgtgtgtgcgtgtgcgtgtgcgtgtgtgtgtgtgtgatagagagagagagagagagaagagcgaagagcgagcgttattttttttttcgtttttgtcgttcgttaggtttggtcggacgcggggttttcgtttggtagggtcgattcgcgcggcgtcgcgtcggtaggggttcgcgggggttttcggggaaggggcgtcggggtggggggcgcgtggcggagaagtcgggcgtttaggagataaagagcgggagggagcgagggggcgggggcgggggagggcggcggggaggaggcggttggggtcggggagcggagttgtagttatttttttgttcgcgggagacgcggcgtatcggagtttgcgcgggtgggagcggtttcggggcg

SEQ ID NO: 672 - DNA, 763 bp, Artificial Sequence
  chemically treated genomic DNA (Homo sapiens) CpG-island No: 672
cgccccgaaaccgctcccacccgcgcaaactccgatacgccgcgtctcccgcgaacaaaaaaataactacaactccgctccccgaccccaaccgcctcctccccgccgccctcccccgcccccgccccctcgctccctcccgctctttatctcctaaacgcccgacttctccgccacgcgccccccaccccgacgccccttccccgaaaacccccgcgaacccctaccgacgcgacgccgcgcgaatcgaccctaccaaacgaaaaccccgcgtccgaccaaacctaacgaacgacaaaaacgaaaaaaaaaataacgctcgctcttcgctcttctctctctctctctctctatcacacacacacacacgcacacgcacacgcacacacacacgaaacatcctcccgtcaaatctcctaatccaaccccgcccgcgcctcctacttccaacgaacctattccctctccccacatcccccgccctccatctcccccgactctaaaacccttcccgccgacctcacccccacccccgaaataaaacgactcgaacccgcccgaaaccccccgcgaccgaaataacgatccccccacccctctcctacccgacccccgcctcgaacaccataaacctaaaaaattcccgaaacgccaaacgctaaaaataaccgataccgaaaataaaaaaccgaacgccctaaaataaaccgaaaactaaaactaaaaccactcgaacccgcgataaaaccctaaataaaattaa

SEQ ID NO: 673 - DNA, 825 bp, Artificial Sequence
  chemically treated genomic DNA (Homo sapiens) CpG-island No: 673
tattttttcgtttttattttatattttttagttttatttataggtagcgttgttgtcgttttgtttgtcgatggagggcgatcgagtagtcgaagaggttgttcgggttttcggttttttttattattaggaatcgggtatttaggttgaaggcggagacgacgtagtcgtcggtcgttattattaaggcgagcgtatagagtattaggcgtggggcgcggggcgcgcggttggggtcggggtttatggttgttagcggaagcggggtttcggcgagagcgcgtgagggcgcggagttgggcgtgaggatttgtttatttgtttttcgcgtcgtcggaggatattggaattcgtcggtcgttgcgtttcgtagcgttgatcggtttcgtgtttttagttttagttagttttatagttgcgttttcggatttttttttaagattcgtgggtttatttttttgtttttttagcggtcgggtcgtcgtcgtttttgtttcgggtaatcggtttttagtttgtttcggtcgcgtttttttggtcgcgttgtcgttttcgatttcggtttcgcggcggatttggtaagcgtatcggtcgatcgtaaggaggataggagggaggggtttttcggcgcgcgtttcgtttttttacgtttagtttcgtatttttttattttgcgagtttagttcgggttgcgtttttttttcggggaaagagaaaaagatttcggttcggtcgtttttttttaaaggggtagtatcgtttttttttttttattttttttattttagtttcgtttttttttttaaatatttgtcggtaattttt

SEQ ID NO: 674 - DNA, 825 bp, Artificial Sequence
  chemically treated genomic DNA (Homo sapiens) CpG-island No: 674
aaaaattaccgacaaatatttaaaaaaaaaaacgaaactaaaataaaaaaaataaaaaaaaaaaaacgatactacccctttaaaaaaaaacgaccgaaccgaaatctttttctctttccccgaaaaaaaaacgcaacccgaactaaactcgcaaaataaaaaaatacgaaactaaacgtaaaaaaacgaaacgcgcgccgaaaaacccctccctcctatcctccttacgatcgaccgatacgcttaccaaatccgccgcgaaaccgaaatcgaaaacgacaacgcgaccaaaaaaacgcgaccgaaacaaactaaaaaccgattacccgaaacaaaaacgacgacgacccgaccgctaaaaaaacaaaaaaataaacccacgaatcttaaaaaaaaatccgaaaacgcaactataaaactaactaaaactaaaaacacgaaaccgatcaacgctacgaaacgcaacgaccgacgaattccaatatcctccgacgacgcgaaaaacaaataaacaaatcctcacgcccaactccgcgccctcacgcgctctcgccgaaaccccgcttccgctaacaaccataaaccccgaccccaaccgcgcgccccgcgccccacgcctaatactctatacgctcgccttaataataacgaccgacgactacgtcgtctccgccttcaacctaaatacccgattcctaataataaaaaaaaccgaaaacccgaacaacctcttcgactactcgatcgccctccatcgacaaacaaaacgacaacaacgctacctataaataaaactaaaaaatataaaataaaaacgaaaaaata

SEQ ID NO: 675 - DNA, 825 bp, Artificial Sequence
  chemically treated genomic DNA (Homo sapiens) CpG-island No: 675
gggggttgtcgataggtgtttgggggagaaggcggagttggggtagggaggatgaggagggaggggcggtgttgtttttttaagaggaggcggtcgagtcgggattttttttttttttttcggaaggaaagcgtagttcgggttgggttcgtaaggtggggaggtgcgggattgggcgtggggaggcggggcgcgcgtcgggggattttttttttttgttttttttgcggtcgatcggtgcgtttgttagattcgtcgcgaagtcgggatcgaaggcgatagcgcggttaagggggcgcggtcgggataagttgggggtcggttgttcggggtagggacggcggcgattcggtcgttggggaggtaggaagatagatttacggattttaggaagggattcgagagcgtagttgtgaaattggttggggttgggggtacgaaatcgattagcgttacggagcgtagcggtcggcgggttttagtgtttttcggcggcgcggggagtaggtgaataggtttttacgtttagtttcgcgtttttacgcgttttcgtcgggatttcgttttcgttggtagttatgggtttcggttttagtcgcgcgtttcgcgttttacgtttgatgttttgtgcgttcgttttgatggtggcggtcggcggttgcgtcgttttcgtttttaatttggatattcgatttttggtagtgaaggaggtcgggaattcgggtagttttttcggttattcggtcgttttttatcggtagatagagcggtagtagcgttatttgtaagtgaagttggagggtgtggggtgggagcgagagagtg

SEQ ID NO: 676 - DNA, 825 bp, Artificial Sequence
  chemically treated genomic DNA (Homo sapiens) CpG-island No: 676
cactctctcgctcccaccccacaccctccaacttcacttacaaataacgctactaccgctctatctaccgataaaaaacgaccgaataaccgaaaaaactacccgaattcccgacctccttcactaccaaaaatcgaatatccaaattaaaaacgaaaacgacgcaaccgccgaccgccaccatcaaaacgaacgcacaaaacatcaaacgtaaaacgcgaaacgcgcgactaaaaccgaaacccataactaccaacgaaaacgaaatcccgacgaaaacgcgtaaaaacgcgaaactaaacgtaaaaacctattcacctactccccgcgccgccgaaaaacactaaaacccgccgaccgctacgctccgtaacgctaatcgatttcgtacccccaaccccaaccaatttcacaactacgctctcgaatcccttcctaaaatccgtaaatctatcttcctacctccccaacgaccgaatcgccgccgtccctaccccgaacaaccgacccccaacttatcccgaccgcgcccccttaaccgcgctatcgccttcgatcccgacttcgcgacgaatctaacaaacgcaccgatcgaccgcaaaaaaaacaaaaaaaaaaaatcccccgacgcgcgccccgcctccccacgcccaatcccgcacctccccaccttacgaacccaacccgaactacgctttccttccgaaaaaaaaaaaaaaaatcccgactcgaccgcctcctcttaaaaaaacaacaccgcccctccctcctcatcctccctaccccaactccgccttctcccccaaacacctatcgacaaccccc

SEQ ID NO: 677 - DNA, 1454 bp, Artificial Sequence
  chemically treated genomic DNA (Homo sapiens) CpG-island No: 677
gaaacggtttcggcgttcgggcggcggcggtggtcgtttgcggtagtttagttgaaacgtagcggaaattgtagttagttacggggttgcgggaggtaaggtaggaaggtggcgttgtcgtcgagcgtttggagttcgagcgtttattatggcggtaagggtaatggtcgttacggggagcgagtacgttttttcgcgcgtatacgtcgtcgcgtcgggttttcggggttcgttatcggcgtcgttgtcgtcgtcgttcgtttttttatttttttttacgggttgtagcggaattttttttttagatatcgtttttaagatggcggttttttttttcggtaattttttttatcgttttttgtagtaggcgtcgagtcgtcgttattttgtttttcgttttttttttttttttatcgatatttatatagcgaaaatcggttcggtcggtttgcggtttttattttacgtttgtagttttcgttttttcgttaggttttatttcggcgcggtgttttaggtcggtcgcggagtcgattcggggtttttcgatcgttttcggtataatcgggcgatttttttttaattttcgttcgtttacggagcgcgttttcgtcgtcgttcggggtagtcgggttttttttcgggtttaattgcggttttttcggggtttgttcggcgtcgcgcgttacgtcgttcggtttagcgcgggagggcgttttgcgggtcgtcgattaggtcgagattaggtcgttgtgcgcgtattaggtttcgcggtcgcggcggtattcgggatttatcggacggacgtgcgggcggtcggcgacggtggcgggtgttgtaggtcggtttttttttggagtattgggtcgggtttcggttggtggggcgggcggagggagggaggaggggtcgagttcggagttgataaaaagcggtttagtttttcggtacgggttcgtcgttagtacgttacgttatcgttcgggagagagatttaggaaaatgcggaagggtagataggttttttttttcgttcggtgggtttttttggtatttcgtgtcggcgtcgttttcgtttcgcgatcggggagtttagtggtttcgttgcggcggggttttcggcggtcggagttttcgtgatagcgttttttttttttttatttttttcgcgttttcgttcgtcgtcgttatatacgcgtcgttgtcgtcgtcgtttcggtcgtaaagttcgcgcggggtcgcggtcggtcgatttcgcggagaggtaggcggttcggtcgttttttattatgtttcgtgggtcgcggtcgtttttcgggggtttttttggagatttatcgtttttcgcgtcggttttggtcgaggttttagttcgagttgtttgtaggtttttagattttcgttcgtagtaaatgtgttttttttattttcgtggttggggaggaagataaatt

SEQ ID NO: 678 - DNA, 1454 bp, Artificial Sequence
  chemically treated genomic DNA (Homo sapiens) CpG-island No: 678
aatttatcttcctccccaaccacgaaaataaaaaaaacacatttactacgaacgaaaatctaaaaacctacaaacaactcgaactaaaacctcgaccaaaaccgacgcgaaaaacgataaatctccaaaaaaacccccgaaaaacgaccgcgacccacgaaacataataaaaaacgaccgaaccgcctacctctccgcgaaatcgaccgaccgcgaccccgcgcgaactttacgaccgaaacgacgacgacaacgacgcgtatataacgacgacgaacgaaaacgcgaaaaaaataaaaaaaaaaaaaacgctatcacgaaaactccgaccgccgaaaaccccgccgcaacgaaaccactaaactccccgatcgcgaaacgaaaacgacgccgacacgaaataccaaaaaaacccaccgaacgaaaaaaaaaacctatctacccttccgcattttcctaaatctctctcccgaacgataacgtaacgtactaacgacgaacccgtaccgaaaaactaaaccgctttttatcaactccgaactcgacccctcctccctccctccgcccgccccaccaaccgaaacccgacccaatactccaaaaaaaaaccgacctacaacacccgccaccgtcgccgaccgcccgcacgtccgtccgataaatcccgaataccgccgcgaccgcgaaacctaatacgcgcacaacgacctaatctcgacctaatcgacgacccgcaaaacgccctcccgcgctaaaccgaacgacgtaacgcgcgacgccgaacaaaccccgaaaaaaccgcaattaaacccgaaaaaaaacccgactaccccgaacgacgacgaaaacgcgctccgtaaacgaacgaaaattaaaaaaaaatcgcccgattataccgaaaacgatcgaaaaaccccgaatcgactccgcgaccgacctaaaacaccgcgccgaaataaaacctaacgaaaaaacgaaaactacaaacgtaaaataaaaaccgcaaaccgaccgaaccgattttcgctatataaatatcgataaaaaaaaaaaaaaaacgaaaaacaaaataacgacgactcgacgcctactacaaaaaacgataaaaaaaattaccgaaaaaaaaaaccgccatcttaaaaacgatatctaaaaaaaaaattccgctacaacccgtaaaaaaaaataaaaaaacgaacgacgacgacaacgacgccgataacgaaccccgaaaacccgacgcgacgacgtatacgcgcgaaaaaacgtactcgctccccgtaacgaccattacccttaccgccataataaacgctcgaactccaaacgctcgacgacaacgccaccttcctaccttacctcccgcaaccccgtaactaactacaatttccgctacgtttcaactaaactaccgcaaacgaccaccgccgccgcccgaacgccgaaaccgtttc

SEQ ID NO: 679 - DNA, 1454 bp, Artificial Sequence
  chemically treated genomic DNA (Homo sapiens) CpG-island No: 679
aatttatttttttttttagttacggggatgaagaaaatatatttattgcgggcgggggtttgagggtttgtaaataattcgagttggagtttcggttaggatcggcgcgagaggcggtaggtttttagggaggttttcggggggcggtcgcggtttacgggatatggtggggggcggtcgggtcgtttgttttttcgcggggtcggtcgatcgcggtttcgcgcgggttttacggtcgaggcggcggcggtagcggcgcgtgtgtggcggcggcgggcgggagcgcggaggaggtggaaagaaggggggcgttgttacggagatttcggtcgtcggagatttcgtcgtagcgaggttattgggtttttcggtcgcggggcgggagcggcgtcgatacggggtgttaggaggatttatcgggcggaggagggggtttgtttattttttcgtatttttttgggtttttttttcgggcggtgacgtgacgtgttgacggcgggttcgtgtcggggagttgggtcgttttttgttagtttcgagttcggtttttttttttttttttcgttcgttttattagtcggagttcggtttagtgttttagagaaaggtcggtttgtagtattcgttatcgtcgtcggtcgttcgtacgttcgttcggtgagtttcgggtgtcgtcgcggtcgcggggtttagtgcgcgtatagcggtttggtttcggtttggtcggcggttcgtaaggcgttttttcgcgttaggtcgggcggcgtggcgcgcggcgtcgagtaggtttcgaggaggtcgtagttaggttcggggaggagttcggttgtttcgagcggcggcggaggcgcgtttcgtaagcgggcgggggttgggggagggtcgttcggttgtgtcggaggcggtcgaggggtttcgggtcggtttcgcggtcgatttggggtatcgcgtcggggtgaggtttggcgaggaggcgaaggttgtaggcgtgaggtgaaggtcgtaggtcggtcgggtcgattttcgttatgtaaatatcggtgagggggggggagggacgggggataagatggcggcggttcggcgtttgttgtaggggacgatagagggggttgtcgggagggggagtcgttattttggaggcggtgtttggagagaaaatttcgttatagttcgtgagggggggtgggagagcgggcggcggcggtagcggcgtcggtgacgggtttcggaggttcggcgcggcggcgtgtgcgcgcggaggggcgtgttcgtttttcgtggcggttattgtttttgtcgttatgatgagcgttcgggttttaggcgttcggcggtagcgttatttttttgttttgtttttcgtagtttcgtgattggttgtagttttcgttgcgttttagttgagttgtcgtaggcggttatcgtcgtcgttcggacgtcgggatcgtttt

SEQ ID NO: 680 - DNA, 1454 bp, Artificial Sequence
  chemically treated genomic DNA (Homo sapiens) CpG-island No: 680
aaaacgatcccgacgtccgaacgacgacgataaccgcctacgacaactcaactaaaacgcaacgaaaactacaaccaatcacgaaactacgaaaaacaaaacaaaaaaataacgctaccgccgaacgcctaaaacccgaacgctcatcataacgacaaaaacaataaccgccacgaaaaacgaacacgcccctccgcgcgcacacgccgccgcgccgaacctccgaaacccgtcaccgacgccgctaccgccgccgcccgctctcccaccccccctcacgaactataacgaaattttctctccaaacaccgcctccaaaataacgactccccctcccgacaaccccctctatcgtcccctacaacaaacgccgaaccgccgccatcttatcccccgtccctccccccccctcaccgatatttacataacgaaaatcgacccgaccgacctacgaccttcacctcacgcctacaaccttcgcctcctcgccaaacctcaccccgacgcgataccccaaatcgaccgcgaaaccgacccgaaacccctcgaccgcctccgacacaaccgaacgaccctcccccaacccccgcccgcttacgaaacgcgcctccgccgccgctcgaaacaaccgaactcctccccgaacctaactacgacctcctcgaaacctactcgacgccgcgcgccacgccgcccgacctaacgcgaaaaaacgccttacgaaccgccgaccaaaccgaaaccaaaccgctatacgcgcactaaaccccgcgaccgcgacgacacccgaaactcaccgaacgaacgtacgaacgaccgacgacgataacgaatactacaaaccgacctttctctaaaacactaaaccgaactccgactaataaaacgaacgaaaaaaaaaaaaaaaaaccgaactcgaaactaacaaaaaacgacccaactccccgacacgaacccgccgtcaacacgtcacgtcaccgcccgaaaaaaaaacccaaaaaaatacgaaaaaataaacaaaccccctcctccgcccgataaatcctcctaacaccccgtatcgacgccgctcccgccccgcgaccgaaaaacccaataacctcgctacgacgaaatctccgacgaccgaaatctccgtaacaacgccccccttctttccacctcctccgcgctcccgcccgccgccgccacacacgcgccgctaccgccgccgcctcgaccgtaaaacccgcgcgaaaccgcgatcgaccgaccccgcgaaaaaacaaacgacccgaccgccccccaccatatcccgtaaaccgcgaccgccccccgaaaacctccctaaaaacctaccgcctctcgcgccgatcctaaccgaaactccaactcgaattatttacaaaccctcaaacccccgcccgcaataaatatattttcttcatccccgtaactaaaaaaaaaaataaatt

SEQ ID NO: 681 - DNA, 672 bp, Artificial Sequence
  chemically treated genomic DNA (Homo sapiens) CpG-island No: 681
tttagtcgggtaatttgatcgcgttagttgtattattgattcggatatcgttttgtgagaagtagttagcgtatagggcgttaaggtcggttttcgtttcgttagtgagaacggtcgaaatgtgttcgttttggtatcgtttggttttgagttagttttcgtatcggtttcggttggtattgttttagtttgcgtaaatttcgtcggttggtggttcggtaatcggcgagatttttttttgatcgacggtttagttcggtgtagggtttagtggcgtattcgtttcgttttagattttattattagggtacgtagtttgtttcgttttagggtgattcgtcgtttattaggcggttggtattcgacgttgcgtattagcgagattaagttcgttatcgtcgttgtgtcgttaattattaattcggatcgtttgcgggcggcgtcggttttttgtttgtcgtcgatagtcgtcgttcgttgtttagatgatcggttaatgtttgaagtgttgtttttacggcgttcgtaagtgtgacgatttattgttcgttacgcgtacggttgtcgtgtttgatggtcgttataggtgcgttttgtcgttttttgatttggcgtttacgttgtttttcgttgtatcgttttggtttttgtttcgggtcgtttttgcgtttt

SEQ ID NO: 682 - DNA, 672 bp, Artificial Sequence
  chemically treated genomic DNA (Homo sapiens) CpG-island No: 682
aaaacgcaaaaacgacccgaaacaaaaaccaaaacgatacaacgaaaaacaacgtaaacgccaaatcaaaaaacgacaaaacgcacctataacgaccatcaaacacgacaaccgtacgcgtaacgaacaataaatcgtcacacttacgaacgccgtaaaaacaacacttcaaacattaaccgatcatctaaacaacgaacgacgactatcgacgacaaacaaaaaaccgacgccgcccgcaaacgatccgaattaataattaacgacacaacgacgataacgaacttaatctcgctaatacgcaacgtcgaataccaaccgcctaataaacgacgaatcaccctaaaacgaaacaaactacgtaccctaataataaaatctaaaacgaaacgaatacgccactaaaccctacaccgaactaaaccgtcgatcaaaaaaaaatctcgccgattaccgaaccaccaaccgacgaaatttacgcaaactaaaacaataccaaccgaaaccgatacgaaaactaactcaaaaccaaacgataccaaaacgaacacatttcgaccgttctcactaacgaaacgaaaaccgaccttaacgccctatacgctaactacttctcacaaaacgatatccgaatcaataatacaactaacgcgatcaaattacccgactaaa

SEQ ID NO: 683 - DNA, 672 bp, Artificial Sequence
  chemically treated genomic DNA (Homo sapiens) CpG-island No: 683
aaaacgtagaaacggttcgaagtagagattaggacgatgtaacgaggaatagcgtagacgttaggttaaaggacgatagaacgtatttgtagcgattattaagtacggtagtcgtacgcgtgacgagtaatggatcgttatatttgcgagcgtcgtagagatagtattttaggtattagtcgattatttgagtagcggacgacgattgtcgacggtaagtagagaatcggcgtcgttcgtaagcgattcgagttagtgattgacggtataacggcgatagcgaatttgatttcgttgatgcgtaacgtcgagtgttaatcgtttgatagacggcgagttattttgagacggagtagattacgtgttttaatagtggagtttggaacgaaacgggtacgttattgaattttatatcggattaagtcgtcgattaagaagagatttcgtcgattatcgaattattagtcgacgggatttacgtaggttggagtaatgttagtcgagatcgatgcgggaattgatttagggttaggcggtgttagggcgaatatatttcggtcgtttttattggcgaaacggaaatcgattttggcgttttatgcgttagttgttttttatagggcgatgttcgagttaataatgtagttggcgcgattaggttattcggttgga

SEQ ID NO: 684 - DNA, 672 bp, Artificial Sequence
  chemically treated genomic DNA (Homo sapiens) CpG-island No: 684
tccaaccgaataacctaatcgcgccaactacattattaactcgaacatcgccctataaaaaacaactaacgcataaaacgccaaaatcgatttccgtttcgccaataaaaacgaccgaaatatattcgccctaacaccgcctaaccctaaatcaattcccgcatcgatctcgactaacattactccaacctacgtaaatcccgtcgactaataattcgataatcgacgaaatctcttcttaatcgacgacttaatccgatataaaattcaataacgtacccgtttcgttccaaactccactattaaaacacgtaatctactccgtctcaaaataactcgccgtctatcaaacgattaacactcgacgttacgcatcaacgaaatcaaattcgctatcgccgttataccgtcaatcactaactcgaatcgcttacgaacgacgccgattctctacttaccgtcgacaatcgtcgtccgctactcaaataatcgactaatacctaaaatactatctctacgacgctcgcaaatataacgatccattactcgtcacgcgtacgactaccgtacttaataatcgctacaaatacgttctatcgtcctttaacctaacgtctacgctattcctcgttacatcgtcctaatctctacttcgaaccgtttctacgtttt

SEQ ID NO: 685 - DNA, 509 bp, Artificial Sequence
  chemically treated genomic DNA (Homo sapiens) CpG-island No: 685
tttcgcgcgttgttcgttattttttaatcgtattttggtattttgttttttttaagtttcgttcgtttcgtttttttttatttaattagttaattttatcggattatagttgttttaacgaagggttttttttttgtttagttattcgttcgggaaatcgcgcgcgggatttagtttcggttcgtttttcgtaggtggagagcgcggggatttcgtacgggtcgtttttttcgggtgttttttttatacgtatatttagtgttttagcgcgtagttcgagcgtttcggggtcgggtgcgagcgtagtttttcgcggagttagaaggggaagagaagtgagaaaaagcgtttattaaatggattaaggtcgcgagcgtatattttattttaaagcgtttttgtttagagcgacgcggggttacgagtttttttgttattatttgaggagcgtttcgtttttttggttttttgttcgtagttatatttttgggaaaagttcgtttttttgt

SEQ ID NO: 686 - DNA, 509 bp, Artificial Sequence
  chemically treated genomic DNA (Homo sapiens) CpG-island No: 686
acaaaaaaacgaacttttcccaaaaatataactacgaacaaaaaaccaaaaaaacgaaacgctcctcaaataataacaaaaaaactcgtaaccccgcgtcgctctaaacaaaaacgctttaaaataaaatatacgctcgcgaccttaatccatttaataaacgctttttctcacttctcttccccttctaactccgcgaaaaactacgctcgcacccgaccccgaaacgctcgaactacgcgctaaaacactaaatatacgtataaaaaaaacacccgaaaaaaacgacccgtacgaaatccccgcgctctccacctacgaaaaacgaaccgaaactaaatcccgcgcgcgatttcccgaacgaataactaaacaaaaaaaaaacccttcgttaaaacaactataatccgataaaattaactaattaaataaaaaaaaacgaaacgaacgaaacttaaaaaaaacaaaataccaaaatacgattaaaaaataacgaacaacgcgcgaaa

SEQ ID NO: 687 - DNA, 509 bp, Artificial Sequence
  chemically treated genomic DNA (Homo sapiens) CpG-island No: 687
gtagaggggcgggttttttttagggatatagttacggatagagggttaaggggacggagcgttttttaagtggtggtagggaggttcgtggtttcgcgtcgttttggataggggcgttttggggtgagatgtgcgttcgcggttttgatttatttagtggacgtttttttttattttttttttttttttggtttcgcgggagattgcgttcgtattcggtttcggagcgttcgagttgcgcgttgggatattgggtatacgtgtggaggggatattcggagagggcggttcgtgcgggattttcgcgttttttatttgcgaggggcgggtcggagttgggtttcgcgcgcggtttttcgagcgggtggttgggtaagaagggagtttttcgttggggtagttgtgattcggtagagttgattggttgggtgggaggggacggagcgggcgggatttgagaaaagtaaagtattagagtgcggttgaggggtagcgggtagcgcgcggga

SEQ ID NO: 688 - DNA, 509 bp, Artificial Sequence
  chemically treated genomic DNA (Homo sapiens) CpG-island No: 688
tcccgcgcgctacccgctacccctcaaccgcactctaatactttacttttctcaaatcccgcccgctccgtcccctcccacccaaccaatcaactctaccgaatcacaactaccccaacgaaaaactcccttcttacccaaccacccgctcgaaaaaccgcgcgcgaaacccaactccgacccgcccctcgcaaataaaaaacgcgaaaatcccgcacgaaccgccctctccgaatatcccctccacacgtatacccaatatcccaacgcgcaactcgaacgctccgaaaccgaatacgaacgcaatctcccgcgaaaccaaaaaaaaaaaaaaaataaaaaaaaacgtccactaaataaatcaaaaccgcgaacgcacatctcaccccaaaacgcccctatccaaaacgacgcgaaaccacgaacctccctaccaccacttaaaaaacgctccgtccccttaaccctctatccgtaactatatccctaaaaaaaacccgcccctctac

SEQ ID NO: 689 - DNA, 503 bp, Artificial Sequence
  chemically treated genomic DNA (Homo sapiens) CpG-island No: 689
atttcggcgtttttcgaaagttataaaagaggggtacggaaattttaagttcgtcgtgttaattcggagaacgtaaattcgaggtagagcgtgcgtcgtgcggggatgtgggtgtcgaggatttcgaagcgttcggtttttttcgcgatttttattttttttagattttggttagatatttatttagtttacgtttagagggcgggggttatttcgatttatttcggaagtcgttaattttagaaattttttttgttaggttcgcgaaacgaaggtatttcgttatttcggcggggtaagttcggattttattagggtaggttcgggaggttatttagggtagacgattcgaggtagagcgttttaaaattttgtcgtcgtacgtttagttagagcgtcgagcgcgtttgtttttttttcgttattttttagttttttattcgtcgattaaatttttgggggattatatttttaagttttgggagtttcgggtaaagtttttt

SEQ ID NO: 690 - DNA, 503 bp, Artificial Sequence
  chemically treated genomic DNA (Homo sapiens) CpG-island No: 690
aaaaaactttacccgaaactcccaaaacttaaaaatataatcccccaaaaatttaatcgacgaataaaaaactaaaaaataacgaaaaaaaaacaaacgcgctcgacgctctaactaaacgtacgacgacaaaattttaaaacgctctacctcgaatcgtctaccctaaataacctcccgaacctaccctaataaaatccgaacttaccccgccgaaataacgaaataccttcgtttcgcgaacctaacaaaaaaaatttctaaaattaacgacttccgaaataaatcgaaataacccccgccctctaaacgtaaactaaataaatatctaaccaaaatctaaaaaaaataaaaatcgcgaaaaaaaccgaacgcttcgaaatcctcgacacccacatccccgcacgacgcacgctctacctcgaatttacgttctccgaattaacacgacgaacttaaaatttccgtacccctcttttataactttcgaaaaacgccgaaat

SEQ ID NO: 691 - DNA, 503 bp, Artificial Sequence
  chemically treated genomic DNA (Homo sapiens) CpG-island No: 691
gggagattttattcggaatttttaaggtttggagatgtgattttttaaaagtttagtcggcgaatgggagattgaagggtgacgggaagggggtaggcgcgttcggcgttttgattgggcgtgcggcggtaggattttaaagcgttttgtttcggatcgtttgttttgggtgatttttcggatttgttttggtggaattcggatttgtttcgtcgagatgacgaggtattttcgtttcgcgaatttaataggagggatttttgaagttagcggttttcgggatgagtcggggtaattttcgttttttgagcgtgggttggatggatgtttaattaggatttagggaggatgggggtcgcgggggaagtcgggcgtttcggggttttcgatatttatattttcgtacggcgtacgttttgtttcgagtttgcgtttttcgagttagtacggcgagtttgggattttcgtgttttttttttgtggttttcgagaaacgtcggagt

SEQ ID NO: 692 - DNA, 503 bp, Artificial Sequence
  chemically treated genomic DNA (Homo sapiens) CpG-island No: 692
actccgacgtttctcgaaaaccacaaaaaaaaaacacgaaaatcccaaactcgccgtactaactcgaaaaacgcaaactcgaaacaaaacgtacgccgtacgaaaatataaatatcgaaaaccccgaaacgcccgacttcccccgcgacccccatcctccctaaatcctaattaaacatccatccaacccacgctcaaaaaacgaaaattaccccgactcatcccgaaaaccgctaacttcaaaaatccctcctattaaattcgcgaaacgaaaatacctcgtcatctcgacgaaacaaatccgaattccaccaaaacaaatccgaaaaatcacccaaaacaaacgatccgaaacaaaacgctttaaaatcctaccgccgcacgcccaatcaaaacgccgaacgcgcctacccccttcccgtcacccttcaatctcccattcgccgactaaacttttaaaaaatcacatctccaaaccttaaaaattccgaataaaatctccc

SEQ ID NO: 693 - DNA, 645 bp, Artificial Sequence
  chemically treated genomic DNA (Homo sapiens) CpG-island No: 693
aagtcgcgcggtttttttgtaaagtttgtttggcgtcgcgcggcggtttcgttatttgtttcgtttcgcggttttggcgattgtttttttatttttcgttttcgagggtttgagggacgcgtgtaatagagtttttagggttcgaggtattatatagcgcggttcgttgcgggtattgcgtaggaaggggtatgggtggttatcgggacggttattttattgagatgatttaaggagtcgtagacgcggggtaggaaatttcgggggagtcgtgttcgggttttgtagggaaatttcgggatttttttcgtatgtcgtatgcggaaatttgtcgggttcgacgtgtatagtttagcgtttttttttattagttattgtttaggtttttcgattttgtattcgtcggaatgagagaaagtagtttttcgtcgtttagttttcgggtagttgtttcggtcgggttttgcgttggtgagaaagttttatttagaggcggtcgcgcgtaattgtaggcggcgttttaggttcgggcgagttagggagagcggggcgcggggggagagggggtagtttaggagataaggaggatggagaaggacgggagagatttcgaaaaggtaagttttagattttcgttcggtattt

SEQ ID NO: 694 - DNA, 645 bp, Artificial Sequence
  chemically treated genomic DNA (Homo sapiens) CpG-island No: 694
aaataccgaacgaaaatctaaaacttaccttttcgaaatctctcccgtccttctccatcctccttatctcctaaactaccccctctccccccgcgccccgctctccctaactcgcccgaacctaaaacgccgcctacaattacgcgcgaccgcctctaaataaaactttctcaccaacgcaaaacccgaccgaaacaactacccgaaaactaaacgacgaaaaactactttctctcattccgacgaatacaaaatcgaaaaacctaaacaataactaataaaaaaaaacgctaaactatacacgtcgaacccgacaaatttccgcatacgacatacgaaaaaaatcccgaaatttccctacaaaacccgaacacgactcccccgaaatttcctaccccgcgtctacgactccttaaatcatctcaataaaataaccgtcccgataaccacccataccccttcctacgcaatacccgcaacgaaccgcgctatataatacctcgaaccctaaaaactctattacacgcgtccctcaaaccctcgaaaacgaaaaataaaaaaacaatcgccaaaaccgcgaaacgaaacaaataacgaaaccgccgcgcgacgccaaacaaactttacaaaaaaaccgcgcgactt

SEQ ID NO: 695 - DNA, 645 bp, Artificial Sequence
  chemically treated genomic DNA (Homo sapiens) CpG-island No: 695
agatgtcgaacgggggtttagagtttgttttttcggggtttttttcgtttttttttattttttttattttttgggttgtttttttttttttcgcgtttcgttttttttggttcgttcgggtttagggcgtcgtttgtagttgcgcgcggtcgtttttagatggaatttttttattaacgtaaggttcggtcggagtagttattcgggagttgggcggcgaggggttatttttttttatttcggcgggtgtaggatcggggggtttgggtagtaattagtggggaggagcgttggattgtgtacgtcgagttcggtaggttttcgtatgcggtatgcgaagggaatttcgaggtttttttgtagaattcgagtacggttttttcggagttttttgtttcgcgtttgcggttttttgaattattttaataaaatgatcgtttcggtagttatttatgtttttttttgcgtagtgttcgtagcggatcgcgttgtgtggtatttcgagttttggggattttgttgtacgcgttttttagattttcgggggcggggagtggggagataatcgttagagtcgcggggcgggataaatggcggaatcgtcgcgcggcgttaggtaaattttgtaagggaatcgcgcggttt

SEQ ID NO: 696 - DNA, 645 bp, Artificial Sequence
  chemically treated genomic DNA (Homo sapiens) CpG-island No: 696
aaaccgcgcgattcccttacaaaatttacctaacgccgcgcgacgattccgccatttatcccgccccgcgactctaacgattatctccccactccccgcccccgaaaatctaaaaaacgcgtacaacaaaatccccaaaactcgaaataccacacaacgcgatccgctacgaacactacgcaaaaaaaaacataaataactaccgaaacgatcattttattaaaataattcaaaaaaccgcaaacgcgaaacaaaaaactccgaaaaaaccgtactcgaattctacaaaaaaacctcgaaattcccttcgcataccgcatacgaaaacctaccgaactcgacgtacacaatccaacgctcctccccactaattactacccaaaccccccgatcctacacccgccgaaataaaaaaaaataacccctcgccgcccaactcccgaataactactccgaccgaaccttacgttaataaaaaaattccatctaaaaacgaccgcgcgcaactacaaacgacgccctaaacccgaacgaaccaaaaaaaacgaaacgcgaaaaaaaaaaaaacaacccaaaaaataaaaaaaataaaaaaaaacgaaaaaaaccccgaaaaaacaaactctaaacccccgttcgacatct

SEQ ID NO: 697 - DNA, 619 bp, Artificial Sequence
  chemically treated genomic DNA (Homo sapiens) CpG-island No: 697
gaagttgcgttcgtgtcgagtttagcgtgtcgttgttttttattttcgtcggggatggaagtacgtaagcgtagatttcgagcggtcgggcgtagggttcgtttttttcgagtttcggtttcgtttttttttttcgtttttatttttacgagtttcgtttttttttcgtttagagcgcgtgcgtatcgtttttagagcgtcgttttagggaggtcgggagtcgcggcgcggagggaggatttagtttttcgttttcgcgtttcgtcggaggttttaggttacggttcgtcgttatttatcgagttcgggataaaataagttcgtcgggttggaaattgcgacgaggggagtaggcgcgtttttcgaattttttttcggagtttgcggatgattatagatttgcgttcgaagattggcggtacgtcgagaatcgtatacgttttttttttttttatgagcgtagtcgcgcgcggaggattttgtacgtatgcgtagtcgtttttttgtgacgtgattcgttgtttcgtgggaaatgtagtttttatttggtatatcgtttcggtttttggcggaattttaatttaattaattaaagtgtttgtgcgtttttagcgttttt

SEQ ID NO: 698 - DNA, 619 bp, Artificial Sequence
  chemically treated genomic DNA (Homo sapiens) CpG-island No: 698
aaaaacgctaaaaacgcacaaacactttaattaattaaattaaaattccgccaaaaaccgaaacgatataccaaataaaaactacatttcccacgaaacaacgaatcacgtcacaaaaaaacgactacgcatacgtacaaaatcctccgcgcgcgactacgctcataaaaaaaaaaaaaacgtatacgattctcgacgtaccgccaatcttcgaacgcaaatctataatcatccgcaaactccgaaaaaaaattcgaaaaacgcgcctactcccctcgtcgcaatttccaacccgacgaacttattttatcccgaactcgataaataacgacgaaccgtaacctaaaacctccgacgaaacgcgaaaacgaaaaactaaatcctccctccgcgccgcgactcccgacctccctaaaacgacgctctaaaaacgatacgcacgcgctctaaacgaaaaaaaaacgaaactcgtaaaaataaaaacgaaaaaaaaaaacgaaaccgaaactcgaaaaaaacgaaccctacgcccgaccgctcgaaatctacgcttacgtacttccatccccgacgaaaataaaaaacaacgacacgctaaactcgacacgaacgcaacttc

SEQ ID NO: 699 - DNA, 619 bp, Artificial Sequence
  chemically treated genomic DNA (Homo sapiens) CpG-island No: 699
gaaaacgttgaaaacgtataagtattttggttggttaaattagggtttcgttaagagtcggagcggtgtgttaagtgaaaattatattttttacggggtagcgggttacgttatagaggaacgattacgtatgcgtgtaaggtttttcgcgcgcgattacgtttataaaaggaaaaaaagcgtgtgcggttttcgacgtgtcgttaattttcgaacgtaggtttgtgattattcgtagatttcgaaaaagggttcgaggaacgcgtttgtttttttcgtcgtagtttttagttcgacgagtttgttttgtttcggattcggtaggtggcgacgggtcgtggtttgagattttcggcgaaacgcgggagcgaagggttgagtttttttttcgcgtcgcggttttcgatttttttgaggcggcgttttaggggcggtgcgtacgcgttttgggcgggaggggggcggggttcgtgggggtgggggcgggagaggagggcggggtcggggttcggggagggcgggttttgcgttcggtcgttcgaggtttgcgtttgcgtgtttttattttcggcgagggtgggaaatagcgatacgttgggttcggtacggacgtagtttt

SEQ ID NO: 700 - DNA, 619 bp, Artificial Sequence
  chemically treated genomic DNA (Homo sapiens) CpG-island No: 700
aaaactacgtccgtaccgaacccaacgtatcgctatttcccaccctcgccgaaaataaaaacacgcaaacgcaaacctcgaacgaccgaacgcaaaacccgccctccccgaaccccgaccccgccctcctctcccgcccccacccccacgaaccccgcccccctcccgcccaaaacgcgtacgcaccgcccctaaaacgccgcctcaaaaaaatcgaaaaccgcgacgcgaaaaaaaaactcaacccttcgctcccgcgtttcgccgaaaatctcaaaccacgacccgtcgccacctaccgaatccgaaacaaaacaaactcgtcgaactaaaaactacgacgaaaaaaacaaacgcgttcctcgaaccctttttcgaaatctacgaataatcacaaacctacgttcgaaaattaacgacacgtcgaaaaccgcacacgctttttttccttttataaacgtaatcgcgcgcgaaaaaccttacacgcatacgtaatcgttcctctataacgtaacccgctaccccgtaaaaaatataattttcacttaacacaccgctccgactcttaacgaaaccctaatttaaccaaccaaaatacttatacgttttcaacgttttc

SEQ ID NO: 701 - DNA, 695 bp, Artificial Sequence
  chemically treated genomic DNA (Homo sapiens) CpG-island No: 701
aggtttattttatcgaagagttagacgcgcggtttatggggtggtcgggtgggcgttcggtattgtagaaatttagtttagcgagaaagcggacgttcgggggttgcgagtttttattggcggttcgagttaggtttcgtttatttcggtttcgggggcggtcgggttcgggtcgcgggaggggtcgttttagggggcgtttagtcgttcgagatcgtttcgacgtggtttagggcgcgagcgtacgtttttcgggtttaaagagcgagtttatttcgttttacgtcgttatcgtcggcggtgttttcgcgatattcgaaaaatgtgttatttttaaagggttttcgcgcgtgtttagcgttcgcgggtcgggttaaggtgttggagttcggtcgttcggtcggcgtaggaatacgttcgagcgaggtcggtttcgcgtattggaggtataggagcgtttaggtacgggggttcgcgtagatcgtagtcgtttaaggtttcgtttcgtttggtttcgtttcgcgttcgttttttaaaggtcgttttttttagtaggtcgcggcgatggcgtttatttggcgtagtattaagttacgtacggcgatttgagattttagtcgtttttttcgtaggggcggcggtttcgggagcgttttttaggtggtatgtgggaggttttttgtttgttggttttt

SEQ ID NO: 702 - DNA, 695 bp, Artificial Sequence
  chemically treated genomic DNA (Homo sapiens) CpG-island No: 702
aaaaaccaacaaacaaaaaacctcccacataccacctaaaaaacgctcccgaaaccgccgcccctacgaaaaaaacgactaaaatctcaaatcgccgtacgtaacttaatactacgccaaataaacgccatcgccgcgacctactaaaaaaaacgacctttaaaaaacgaacgcgaaacgaaaccaaacgaaacgaaaccttaaacgactacgatctacgcgaacccccgtacctaaacgctcctatacctccaatacgcgaaaccgacctcgctcgaacgtattcctacgccgaccgaacgaccgaactccaacaccttaacccgacccgcgaacgctaaacacgcgcgaaaaccctttaaaaataacacatttttcgaatatcgcgaaaacaccgccgacgataacgacgtaaaacgaaataaactcgctctttaaacccgaaaaacgtacgctcgcgccctaaaccacgtcgaaacgatctcgaacgactaaacgccccctaaaacgacccctcccgcgacccgaacccgaccgcccccgaaaccgaaataaacgaaacctaactcgaaccgccaataaaaactcgcaacccccgaacgtccgctttctcgctaaactaaatttctacaataccgaacgcccacccgaccaccccataaaccgcgcgtctaactcttcgataaaataaacct

SEQ ID NO: 703 - DNA, 695 bp, Artificial Sequence
  chemically treated genomic DNA (Homo sapiens) CpG-island No: 703
gaagattagtaggtaggaagttttttatatgttatttaaggggcgttttcggaatcgtcgtttttgcgggaggagcggttggggttttagatcgtcgtgcgtgatttggtgttgcgttaggtgggcgttatcgtcgcggtttgttgggggaggcggtttttgaggagcgggcgcgaggcggggttaggcggggcggggttttgggcggttgcggtttgcgcggattttcgtgtttaggcgtttttgtgtttttagtgcgcggagtcggtttcgttcgggcgtgtttttgcgtcgatcggacggtcggattttagtattttggttcggttcgcgaacgttgagtacgcgcggaaattttttaaaggtagtatatttttcgggtgtcgcgggggtatcgtcggcggtggcgacgtggggcggaatgggttcgttttttgggttcgggaggcgtgcgttcgcgttttgggttacgtcggggcggtttcgggcggttgagcgttttttggagcgatttttttcgcggttcgggttcggtcgttttcgaagtcggggtgagcggggtttggttcgggtcgttagtgaggattcgtagttttcgggcgttcgttttttcgttgggttgggtttttgtagtgtcgggcgtttattcggttattttatgagtcgcgcgtttggtttttcggtggagtgagttt

SEQ ID NO: 704 - DNA, 695 bp, Artificial Sequence
  chemically treated genomic DNA (Homo sapiens) CpG-island No: 704
aaactcactccaccgaaaaaccaaacgcgcgactcataaaataaccgaataaacgcccgacactacaaaaacccaacccaacgaaaaaacgaacgcccgaaaactacgaatcctcactaacgacccgaaccaaaccccgctcaccccgacttcgaaaacgaccgaacccgaaccgcgaaaaaaatcgctccaaaaaacgctcaaccgcccgaaaccgccccgacgtaacccaaaacgcgaacgcacgcctcccgaacccaaaaaacgaacccattccgccccacgtcgccaccgccgacgatacccccgcgacacccgaaaaatatactacctttaaaaaatttccgcgcgtactcaacgttcgcgaaccgaaccaaaatactaaaatccgaccgtccgatcgacgcaaaaacacgcccgaacgaaaccgactccgcgcactaaaaacacaaaaacgcctaaacacgaaaatccgcgcaaaccgcaaccgcccaaaaccccgccccgcctaaccccgcctcgcgcccgctcctcaaaaaccgcctcccccaacaaaccgcgacgataacgcccacctaacgcaacaccaaatcacgcacgacgatctaaaaccccaaccgctcctcccgcaaaaacgacgattccgaaaacgccccttaaataacatataaaaaacttcctacctactaatcttc

SEQ ID NO: 705 - DNA, 649 bp, Artificial Sequence
  chemically treated genomic DNA (Homo sapiens) CpG-island No: 705
cggagagtttcgggtttacggaacgtttcgggggtgcgaagtcgggttcggttgggatttcggcgtcgttttcggttcgcgtttatattagtttcgcgttcgtttcgggaattcggttatcgtcgttttcgtcgcggttttcgtcgcgtttttcggggttcgggataagtcgggttcgtagttcgcgtcgttcgtcgttatttttttgttttagcggattcgaatgcgagttcggagtcgcggtttcggatttagtcgttttcgcgcgggcggtatttaattcgttgttgttcgggacgcgggcgtttggagtcgggagtcgggagtcgcggtatttttttcgtttttcgttatcgttttcgtcgtttaattcgttgcgcgtcggagcgtttcgtttcggtttcgtttcgcgtttcgcgtttcgcgttcggtggcgttagtcgcgggttcgtggaggtgcgagaaatgggcgtacgatttggtttcgttgcggttttgcgcggggattggggattaaagattacggaagaggtgaaggtagaaagcgttcgaggagcgttgtatttcgtagaattttaattaagtcggagaaattcgtgtatagattagattaaatgttaggttttttgaatttgaattttttgaaaga

SEQ ID NO: 706 - DNA, 649 bp, Artificial Sequence
  chemically treated genomic DNA (Homo sapiens) CpG-island No: 706
tctttcaaaaaattcaaattcaaaaaacctaacatttaatctaatctatacacgaatttctccgacttaattaaaattctacgaaatacaacgctcctcgaacgctttctaccttcacctcttccgtaatctttaatccccaatccccgcgcaaaaccgcaacgaaaccaaatcgtacgcccatttctcgcacctccacgaacccgcgactaacgccaccgaacgcgaaacgcgaaacgcgaaacgaaaccgaaacgaaacgctccgacgcgcaacgaattaaacgacgaaaacgataacgaaaaacgaaaaaaataccgcgactcccgactcccgactccaaacgcccgcgtcccgaacaacaacgaattaaataccgcccgcgcgaaaacgactaaatccgaaaccgcgactccgaactcgcattcgaatccgctaaaacaaaaaaataacgacgaacgacgcgaactacgaacccgacttatcccgaaccccgaaaaacgcgacgaaaaccgcgacgaaaacgacgataaccgaattcccgaaacgaacgcgaaactaatataaacgcgaaccgaaaacgacgccgaaatcccaaccgaacccgacttcgcacccccgaaacgttccgtaaacccgaaactctccg

SEQ ID NO: 707 - DNA, 649 bp, Artificial Sequence
  chemically treated genomic DNA (Homo sapiens) CpG-island No: 707
ttttttagagaatttagatttaggaggtttgatatttaatttggtttgtgtacggattttttcggtttggttggggttttgcggaatgtaacgtttttcgggcgttttttgtttttatttttttcgtggtttttgatttttagttttcgcgtagggtcgtagcggagttaggtcgtgcgtttatttttcgtatttttacgagttcgcggttggcgttatcgggcgcgggacgcggggcgcggggcgggatcgaggcggggcgtttcggcgcgtagcgggttaagcggcgagggcggtggcgaggggcggagggagtgtcgcggttttcggttttcggttttaggcgttcgcgtttcggatagtagcgggttaagtgtcgttcgcgcggagacggttgagttcggagtcgcggtttcgagttcgtattcggattcgttagagtaggaagatggcgacggacggcgcgagttgcgagttcgatttgtttcgggtttcggaggacgcggcgggggtcgcggcggaggcggcggtaatcgagttttcggggcgggcgcggggttagtgtagacgcgggtcgggggcggcgtcggggttttagtcggattcgatttcgtattttcggggcgtttcgtaagttcgggatttttcg

SEQ ID NO: 708 - DNA, 649 bp, Artificial Sequence
  chemically treated genomic DNA (Homo sapiens) CpG-island No: 708
cgaaaaatcccgaacttacgaaacgccccgaaaatacgaaatcgaatccgactaaaaccccgacgccgcccccgacccgcgtctacactaaccccgcgcccgccccgaaaactcgattaccgccgcctccgccgcgacccccgccgcgtcctccgaaacccgaaacaaatcgaactcgcaactcgcgccgtccgtcgccatcttcctactctaacgaatccgaatacgaactcgaaaccgcgactccgaactcaaccgtctccgcgcgaacgacacttaacccgctactatccgaaacgcgaacgcctaaaaccgaaaaccgaaaaccgcgacactccctccgcccctcgccaccgccctcgccgcttaacccgctacgcgccgaaacgccccgcctcgatcccgccccgcgccccgcgtcccgcgcccgataacgccaaccgcgaactcgtaaaaatacgaaaaataaacgcacgacctaactccgctacgaccctacgcgaaaactaaaaatcaaaaaccacgaaaaaaataaaaacaaaaaacgcccgaaaaacgttacattccgcaaaaccccaaccaaaccgaaaaaatccgtacacaaaccaaattaaatatcaaacctcctaaatctaaattctctaaaaaa

SEQ ID NO: 709 - DNA, 565 bp, Artificial Sequence
  chemically treated genomic DNA (Homo sapiens) CpG-island No: 709
gggagcgaggatgtagattttgaaattggtgttgttgggttgaggcggaggtaggggagttgtagcgcgcgaggtttcgtgagtgtgttttttgcgcgttgagaggcggggggaggcggaggattaggaggaggaggaggaggaggaggagggggagaatgttcggagtcgtcgtcgttgtcgtcgtcgtcgtcgtcgcgatgttttcggtttaggaggttgttaagttgtattatattaattatgtgcggaattcgcgggttatcggcgtgttgtgggttatttttattatttgttttgttatcgttaacgtggtgtgttttatttagttttattggataggcgacggcgtggatatttcgtaagtcggttatttcgggtttttttattattgtatcggtaacggtttttttcgggagttgatttgtaggggtagttttacggatttttttacgttgttttcgggcgtttttaaagtcgtttttttttttatcggtttttttatgatgtttattattgtttgtattatttgttttatttttttttttttttgtaatacggttat

SEQ ID NO: 710 - DNA, 565 bp, Artificial Sequence
  chemically treated genomic DNA (Homo sapiens) CpG-island No: 710
ataaccgtattacaaaaaaaaaaaaaaataaaacaaataatacaaacaataataaacatcataaaaaaaccgataaaaaaaaaaacgactttaaaaacgcccgaaaacaacgtaaaaaaatccgtaaaactacccctacaaatcaactcccgaaaaaaaccgttaccgatacaataataaaaaaacccgaaataaccgacttacgaaatatccacgccgtcgcctatccaataaaactaaataaaacacaccacgttaacgataacaaaacaaataataaaaataacccacaacacgccgataacccgcgaattccgcacataattaatataatacaacttaacaacctcctaaaccgaaaacatcgcgacgacgacgacgacgacaacgacgacgactccgaacattctccccctcctcctcctcctcctcctcctcctaatcctccgcctccccccgcctctcaacgcgcaaaaaacacactcacgaaacctcgcgcgctacaactcccctacctccgcctcaacccaacaacaccaatttcaaaatctacatcctcgctccc

SEQ ID NO: 711 - DNA, 565 bp, Artificial Sequence
  chemically treated genomic DNA (Homo sapiens) CpG-island No: 711
gtggtcgtgttgtagaagaagaagagggtaaagtaaatgatgtaggtaatgatgagtattatggagaggtcgataaagaaggaggcggttttgaaggcgttcgagggtagcgtggagaagttcgtgaagttgtttttgtaggttagttttcgggagaagtcgttgtcgatgtagtagtggaagagttcgaaatagtcggtttgcggggtgtttacgtcgtcgtttatttagtagggttggatgaagtatattacgttgacgatggtaaagtagatggtgaagatggtttatagtacgtcgatggttcgcgagtttcgtatatagttggtgtggtatagtttggtagttttttgagtcgggagtatcgcggcggcggcggcggcggtagcggcggcggtttcgggtattttttttttttttttttttttttttttttttttggtttttcgttttttttcgttttttagcgcgtaggagatatatttacggagtttcgcgcgttgtaatttttttgttttcgttttagtttagtagtattagttttagagtttgtattttcgttttt

SEQ ID NO: 712 - DNA, 565 bp, Artificial Sequence
  chemically treated genomic DNA (Homo sapiens) CpG-island No: 712
aaaaacgaaaatacaaactctaaaactaatactactaaactaaaacgaaaacaaaaaaattacaacgcgcgaaactccgtaaatatatctcctacgcgctaaaaaacgaaaaaaaacgaaaaaccaaaaaaaaaaaaaaaaaaaaaaaaaaaaaaaaaatacccgaaaccgccgccgctaccgccgccgccgccgccgcgatactcccgactcaaaaaactaccaaactataccacaccaactatatacgaaactcgcgaaccatcgacgtactataaaccatcttcaccatctactttaccatcgtcaacgtaatatacttcatccaaccctactaaataaacgacgacgtaaacaccccgcaaaccgactatttcgaactcttccactactacatcgacaacgacttctcccgaaaactaacctacaaaaacaacttcacgaacttctccacgctaccctcgaacgccttcaaaaccgcctccttctttatcgacctctccataatactcatcattacctacatcatttactttaccctcttcttcttctacaacacgaccac

SEQ ID NO: 713 - DNA, 690 bp, Artificial Sequence
  chemically treated genomic DNA (Homo sapiens) CpG-island No: 713
tcggcgtcgttgagcgagttagcgttgcgtagtacgaagcgggtcgtttttattttgacgtttattcggtttggcggggattgtggttggtttgaggggcgaaggttgttcggagtagagtttggtttcgagggggcgcggcgcgttcgggcgaggattgtaggtgcgttggttggtttgtgcgtttcggtttgggttggggtttgagggtgtcgcggagtgaagagtttgggtagagtcggagatgtagtggttcgagatttaagtttaagtttttttattagtcgtcgtcgttcgaggttttatttgttttttcgtatttttttttcgagttttaaataggaggagttattggaatttggaaacgcgttttgaattttaggtcgcgttaattagattagagaaagaattatgggtttcgtttttttagtcgcggttattatagaatggtttggtacggtgattacggagtgttttggtatcggtgttcgcggttgtgacggaaaaagggtgggaagaatagggaagaggaagtagaaataggtatttggggtaacgtgggtttaagattagttttttgggacggggtttcgagtcgcgtgggttggggtttcgtttaggttcgtttttgtttataattcggaggttgttttaatgttaagtatttttggttataaattgtttttaaga

SEQ ID NO: 714 - DNA, 690 bp, Artificial Sequence
  chemically treated genomic DNA (Homo sapiens) CpG-island No: 714
tcttaaaaacaatttataaccaaaaatacttaacattaaaacaacctccgaattataaacaaaaacgaacctaaacgaaaccccaacccacgcgactcgaaaccccgtcccaaaaaactaatcttaaacccacgttaccccaaatacctatttctacttcctcttccctattcttcccaccctttttccgtcacaaccgcgaacaccgataccaaaacactccgtaatcaccgtaccaaaccattctataataaccgcgactaaaaaaacgaaacccataattctttctctaatctaattaacgcgacctaaaattcaaaacgcgtttccaaattccaataactcctcctatttaaaactcgaaaaaaaaatacgaaaaaacaaataaaacctcgaacgacgacgactaataaaaaaacttaaacttaaatctcgaaccactacatctccgactctacccaaactcttcactccgcgacaccctcaaaccccaacccaaaccgaaacgcacaaaccaaccaacgcacctacaatcctcgcccgaacgcgccgcgccccctcgaaaccaaactctactccgaacaaccttcgcccctcaaaccaaccacaatccccgccaaaccgaataaacgtcaaaataaaaacgacccgcttcgtactacgcaacgctaactcgctcaacgacgccga

SEQ ID NO: 715 - DNA, 690 bp, Artificial Sequence
  chemically treated genomic DNA (Homo sapiens) CpG-island No: 715
ttttggaaatagtttgtggttaggagtatttgatattgagatagttttcgagttgtaaataagggcgagtttgggcgggattttagtttacgcgattcggagtttcgttttaagaggttaattttaagtttacgttgttttagatatttgtttttgtttttttttttttgttttttttatttttttttcgttatagtcgcgggtatcggtgttagggtatttcgtggttatcgtgttaggttattttgtgatgatcgcggttggaggggcggagtttatagttttttttttgatttgattggcgcgatttggagtttaggacgcgtttttaagttttagtgattttttttgtttgggattcggggggagagtgcggggagataaataaaatttcgggcggcggcggttggtgggaagatttgaatttgaatttcgaattattgtattttcgattttgtttagattttttatttcgcggtatttttaaattttagtttaggtcggggcgtataagttagttagcgtatttgtagttttcgttcggacgcgtcgcgttttttcggaattaggttttgtttcgagtagttttcgttttttaagttagttatagttttcgttaggtcgggtgggcgttaagatgaaggcggttcgtttcgtgttgcgtagcgttggttcgtttaacggcgtcgg

SEQ ID NO: 716 - DNA, 690 bp, Artificial Sequence
  chemically treated genomic DNA (Homo sapiens) CpG-island No: 716
ccgacgccgttaaacgaaccaacgctacgcaacacgaaacgaaccgccttcatcttaacgcccacccgacctaacgaaaactataactaacttaaaaaacgaaaactactcgaaacaaaacctaattccgaaaaaacgcgacgcgtccgaacgaaaactacaaatacgctaactaacttatacgccccgacctaaactaaaatttaaaaataccgcgaaataaaaaatctaaacaaaatcgaaaatacaataattcgaaattcaaattcaaatcttcccaccaaccgccgccgcccgaaattttatttatctccccgcactctccccccgaatcccaaacaaaaaaaatcactaaaacttaaaaacgcgtcctaaactccaaatcgcgccaatcaaatcaaaaaaaaaactataaactccgcccctccaaccgcgatcatcacaaaataacctaacacgataaccacgaaataccctaacaccgatacccgcgactataacgaaaaaaaaataaaaaaaacaaaaaaaaaaaaacaaaaacaaatatctaaaacaacgtaaacttaaaattaacctcttaaaacgaaactccgaatcgcgtaaactaaaatcccgcccaaactcgcccttatttacaactcgaaaactatctcaatatcaaatactcctaaccacaaactatttccaaaa

SEQ ID NO: 717 - DNA, 1131 bp, Artificial Sequence
  chemically treated genomic DNA (Homo sapiens) CpG-island No: 717
tattttacgttagtttcgttggtagttgtatggttggtgttaggaacgcggcgggggcgtaggtcgaggggagcgggcgttgggggggtcgggggtagcgcgttatttattaatgcgattgaaatttttcgataaagtttttcgtaatttttttattttgtcgattttttcggtcggttgcggtttaatgaggttatatatttgggcgacgcggagtttcgataatttttttaaattggtttaggtatagtttagataacggcgagggcgcgcgtcgcggggaaagcggcgtttttttttttattattttttcggcgggtcgggaagcgacgcgtaggtttagggaggcgagtagtaggtaggcggaggacggtaggtttcgtttcggtttgggtcgtagttgggcgggcgggggcggtttacgtggtgtcgggggcggtcgcgttcgtcgtcgtcgtggtggtttcgcgtcgcgtcgtcgtcgttcggtttatttttttttttttgtaacggagagaagcgcggtcggtagggggagtggtgcggtcgaaggaggaggcggggcgggtcgggtataaggtgcgggagtcgtttggcgtcgagtgcgcggggcgagggcgagtgggtcggcgggagaagtttttagtttagagttgcgggcgtagcgtagaaggagtcgcggcgcggaatcgttagtttgatagtttttgttgtttttttgttgtcgtcgttacgtttttttttcgacgaaggtttttgggcgcgggattttagtacgatttcggtttttcgttcgtttttcgcgtttttcgcggttttttgtgtttggttcgcgtttcggcggcgttttttttcggtcgcgtttttttcggtcgttttcgcgtttttttttcgtttcgttcgcgcgcgggaggattacgaagggatcggggtgggagcgggtagcgtttggggatagcgtgttgggttgtggggaggttatcgaaaggaaacgggtcgagtttagttgtttgagcggttttttttttttacgagcgtgtgtgaaaaagcgcggagttcggtggagggtagttgttaggattgttttttggattgggtgcggtaaggttttagggatgtatttagatgtag

SEQ ID NO: 718 - DNA, 1131 bp, Artificial Sequence
  chemically treated genomic DNA (Homo sapiens) CpG-island No: 718
ctacatctaaatacatccctaaaaccttaccgcacccaatccaaaaaacaatcctaacaactaccctccaccgaactccgcgctttttcacacacgctcgtaaaaaaaaaaaaccgctcaaacaactaaactcgacccgtttcctttcgataacctccccacaacccaacacgctatccccaaacgctacccgctcccaccccgatcccttcgtaatcctcccgcgcgcgaacgaaacgaaaaaaaaacgcgaaaacgaccgaaaaaaacgcgaccgaaaaaaaacgccgccgaaacgcgaaccaaacacaaaaaaccgcgaaaaacgcgaaaaacgaacgaaaaaccgaaatcgtactaaaatcccgcgcccaaaaaccttcgtcgaaaaaaaaacgtaacgacgacaacaaaaaaacaacaaaaactatcaaactaacgattccgcgccgcgactccttctacgctacgcccgcaactctaaactaaaaacttctcccgccgacccactcgccctcgccccgcgcactcgacgccaaacgactcccgcaccttatacccgacccgccccgcctcctccttcgaccgcaccactccccctaccgaccgcgcttctctccgttacaaaaaaaaaaaaataaaccgaacgacgacgacgcgacgcgaaaccaccacgacgacgacgaacgcgaccgcccccgacaccacgtaaaccgcccccgcccgcccaactacgacccaaaccgaaacgaaacctaccgtcctccgcctacctactactcgcctccctaaacctacgcgtcgcttcccgacccgccgaaaaaataataaaaaaaaaaacgccgctttccccgcgacgcgcgccctcgccgttatctaaactatacctaaaccaatttaaaaaaattatcgaaactccgcgtcgcccaaatatataacctcattaaaccgcaaccgaccgaaaaaatcgacaaaataaaaaaattacgaaaaactttatcgaaaaatttcaatcgcattaataaataacgcgctacccccgacccccccaacgcccgctcccctcgacctacgcccccgccgcgttcctaacaccaaccatacaactaccaacgaaactaacgtaaaata

SEQ ID NO: 719 - DNA, 1131 bp, Artificial Sequence
  chemically treated genomic DNA (Homo sapiens) CpG-island No: 719
ttatatttgaatgtatttttaaggttttatcgtatttagtttaggaggtagttttggtagttgttttttatcgaatttcgcgtttttttatatacgttcgtggaaggagaaaatcgtttaaataattggattcggttcgttttttttcggtaatttttttatagtttaatacgttgtttttagacgttgttcgtttttatttcggttttttcgtgattttttcgcgcgcgggcggggcgggggaggagcgcgggggcggtcgggaggggcgcggtcgggagggggcgtcgtcggggcgcgagttagatatagagggtcgcggaggacgcgggaggcgagcggggagtcgaggtcgtgttaggatttcgcgtttaggggttttcgtcgagggaggggcgtggcggcggtagtaggagggtagtaggagttgttaggttggcggtttcgcgtcgcggttttttttgcgttgcgttcgtaattttgggttgagaatttttttcgtcggtttattcgttttcgtttcgcgtattcggcgttaggcgattttcgtattttgtattcggttcgtttcgttttttttttcggtcgtattattttttttgtcggtcgcgttttttttcgttataaaggagggaaaatgagtcgggcggcggcggcgcggcgcggggttattacggcggcggcgagcgcggtcgttttcggtattacgtaaatcgttttcgttcgtttagttgcggtttaggtcggagcggagtttgtcgtttttcgtttgtttgttgttcgtttttttagatttgcgcgtcgtttttcggttcgtcgaggaggtggtggaggaggaggcgtcgtttttttcgcggcgcgcgttttcgtcgttgtttgagttgtgtttggattagtttggggaagttgtcggggtttcgcgtcgtttagatgtgtgattttattgagtcgtagtcggtcgagaagatcggtaagatgaagaagttgcggagaattttgtcggagagttttagtcgtattggtgagtagcgcgttgttttcggtttttttagcgttcgtttttttcggtttgcgttttcgtcgcgtttttggtattagttatgtagttgttagcggggttggcgtggggtg

SEQ ID NO: 720 - DNA, 1131 bp, Artificial Sequence
  chemically treated genomic DNA (Homo sapiens) CpG-island No: 720
caccccacgccaaccccgctaacaactacataactaataccaaaaacgcgacgaaaacgcaaaccgaaaaaaacgaacgctaaaaaaaccgaaaacaacgcgctactcaccaatacgactaaaactctccgacaaaattctccgcaacttcttcatcttaccgatcttctcgaccgactacgactcaataaaatcacacatctaaacgacgcgaaaccccgacaacttccccaaactaatccaaacacaactcaaacaacgacgaaaacgcgcgccgcgaaaaaaacgacgcctcctcctccaccacctcctcgacgaaccgaaaaacgacgcgcaaatctaaaaaaacgaacaacaaacaaacgaaaaacgacaaactccgctccgacctaaaccgcaactaaacgaacgaaaacgatttacgtaataccgaaaacgaccgcgctcgccgccgccgtaataaccccgcgccgcgccgccgccgcccgactcattttccctcctttataacgaaaaaaaacgcgaccgacaaaaaaaataatacgaccgaaaaaaaaaacgaaacgaaccgaatacaaaatacgaaaatcgcctaacgccgaatacgcgaaacgaaaacgaataaaccgacgaaaaaaattctcaacccaaaattacgaacgcaacgcaaaaaaaaccgcgacgcgaaaccgccaacctaacaactcctactaccctcctactaccgccgccacgcccctccctcgacgaaaacccctaaacgcgaaatcctaacacgacctcgactccccgctcgcctcccgcgtcctccgcgaccctctatatctaactcgcgccccgacgacgccccctcccgaccgcgcccctcccgaccgcccccgcgctcctcccccgccccgcccgcgcgcgaaaaaatcacgaaaaaaccgaaataaaaacgaacaacgtctaaaaacaacgtattaaactataaaaaaattaccgaaaaaaaacgaaccgaatccaattatttaaacgattttctccttccacgaacgtatataaaaaaacgcgaaattcgataaaaaacaactaccaaaactacctcctaaactaaatacgataaaaccttaaaaatacattcaaatataa

SEQ ID NO: 721 - DNA, 659 bp, Artificial Sequence
  chemically treated genomic DNA (Homo sapiens) CpG-island No: 721
tttttaggcgtcggggtttttttcgagcgtggcgatttcgtagatatggtgttaagagttagggtgggcggcggggcgggtgggagagcggcggcgttgggggcgagggtattatgcgatcgcgggcgtcgggattatagcgcgtcgggaaggaggtcgaggcggtaggaaaaaagtcgaagatatttggggggatcgaggggttaagcgacggagggaggaatagaatatagtttcgcgttggtttcgagtattgggacgcgcggggagagtaggaggtcgggcggggaggttcggggcggggcgcgttattcgtagttttcggagttcggttaattcggcgtttagtgtacggtcgtattatggggtttcgttatttcgaggggatttatgattacgtggggtatttcggtaggtatgggggaggggtttcgcggcgttacgcgggaggcggcgtcgaggggtttgttttttttcgttgcggcggggttttcgcgcggcgttcgcgattcgaaaatatttttattttttttttatttcgcgtagtcgggatacgggcgtttagacgtcggtttttagttgggttttttttttaggtttttggtagcgggatttggtatggtgagtagaggcgttgggttcgttcggagtgcgtttgt

SEQ ID NO: 722 - DNA, 659 bp, Artificial Sequence
  chemically treated genomic DNA (Homo sapiens) CpG-island No: 722
acaaacgcactccgaacgaacccaacgcctctactcaccataccaaatcccgctaccaaaaacctaaaaaaaaaacccaactaaaaaccgacgtctaaacgcccgtatcccgactacgcgaaataaaaaaaaaataaaaatattttcgaatcgcgaacgccgcgcgaaaaccccgccgcaacgaaaaaaaacaaacccctcgacgccgcctcccgcgtaacgccgcgaaacccctcccccatacctaccgaaataccccacgtaatcataaatcccctcgaaataacgaaaccccataatacgaccgtacactaaacgccgaattaaccgaactccgaaaactacgaataacgcgccccgccccgaacctccccgcccgacctcctactctccccgcgcgtcccaatactcgaaaccaacgcgaaactatattctattcctccctccgtcgcttaacccctcgatccccccaaatatcttcgacttttttcctaccgcctcgacctccttcccgacgcgctataatcccgacgcccgcgatcgcataataccctcgcccccaacgccgccgctctcccacccgccccgccgcccaccctaactcttaacaccatatctacgaaatcgccacgctcgaaaaaaaccccgacgcctaaaaa

SEQ ID NO: 723 - DNA, 659 bp, Artificial Sequence
  chemically treated genomic DNA (Homo sapiens) CpG-island No: 723
ataggcgtatttcgagcgagtttagcgtttttgtttattatgttaggtttcgttgttagaggtttagaggagaagtttagttaggggtcggcgtttggacgttcgtgtttcgattgcgcggggtgaggaggaagtggagatgttttcggatcgcgagcgtcgcgcgagaatttcgtcgtaacggaaagaaatagatttttcggcgtcgtttttcgcgtggcgtcgcggggttttttttttatatttgtcgaagtgttttacgtggttataaattttttcgaagtggcgggattttatggtgcggtcgtgtattgggcgtcgagttagtcgagtttcggggattgcgggtagcgcgtttcgtttcgaattttttcgttcggttttttgtttttttcgcgcgttttagtgttcgggattagcgcgaggttgtattttgttttttttttcgtcgtttggtttttcggtttttttaagtattttcggttttttttttgtcgtttcggtttttttttcggcgcgttgtggtttcggcgttcgcggtcgtatggtgttttcgtttttagcgtcgtcgtttttttattcgtttcgtcgtttattttggtttttggtattatgtttgcggggtcgttacgttcgagggaagtttcgacgtttgggaa

SEQ ID NO: 724 - DNA, 659 bp, Artificial Sequence
  chemically treated genomic DNA (Homo sapiens) CpG-island No: 724
ttcccaaacgtcgaaacttccctcgaacgtaacgaccccgcaaacataataccaaaaaccaaaataaacgacgaaacgaataaaaaaacgacgacgctaaaaacgaaaacaccatacgaccgcgaacgccgaaaccacaacgcgccgaaaaaaaaaccgaaacgacaaaaaaaaaaccgaaaatacttaaaaaaaccgaaaaaccaaacgacgaaaaaaaaaacaaaatacaacctcgcgctaatcccgaacactaaaacgcgcgaaaaaaacaaaaaaccgaacgaaaaaattcgaaacgaaacgcgctacccgcaatccccgaaactcgactaactcgacgcccaatacacgaccgcaccataaaatcccgccacttcgaaaaaatttataaccacgtaaaacacttcgacaaatataaaaaaaaaaccccgcgacgccacgcgaaaaacgacgccgaaaaatctatttctttccgttacgacgaaattctcgcgcgacgctcgcgatccgaaaacatctccacttcctcctcaccccgcgcaatcgaaacacgaacgtccaaacgccgacccctaactaaacttctcctctaaacctctaacaacgaaacctaacataataaacaaaaacgctaaactcgctcgaaatacgcctat

SEQ ID NO: 725 - DNA, 582 bp, Artificial Sequence
  chemically treated genomic DNA (Homo sapiens) CpG-island No: 725
gggcgttatgcgtgtttagagtagaagcgtttagtttcgggagcgtttcgttacggtcgtcggcgtttcgtcgcgttttcgtttttcgttcgcgtttgcgacgagtggcgagattcgttgataaagttttaaacgatgggtttagcgagcgataaaggttagttcggatcgtttcgtttatagtttaattttttaggcgtagcgagcgtttgtagttcgaaagttttgcgcgtttttcgcgcgtttcgttcgttttgttttttttcgggcgtagtcgagggagggggtgttgcgtttggcgggggtggggagaaacgcggggttttagatacgggtgtatgaaatgatggtaagagatgtttggggatgaggtgaggcggggaagggggaatatcgttgtatggttacgagtatacgcgaatataggaatttttagggaagttttaggttaaagagtattcgtgggttttcggagcgtgcgtttcggattgtcgaggttattcgttggtaaataagtttttgagcgtgtaatgtgaggaaacgaggaagggggttaggggataaggagattattatgtatgg

SEQ ID NO: 726 - DNA, 582 bp, Artificial Sequence
  chemically treated genomic DNA (Homo sapiens) CpG-island No: 726
ccatacataataatctccttatcccctaacccccttcctcgtttcctcacattacacgctcaaaaacttatttaccaacgaataacctcgacaatccgaaacgcacgctccgaaaacccacgaatactctttaacctaaaacttccctaaaaattcctatattcgcgtatactcgtaaccatacaacgatattcccccttccccgcctcacctcatccccaaacatctcttaccatcatttcatacacccgtatctaaaaccccgcgtttctccccacccccgccaaacgcaacaccccctccctcgactacgcccgaaaaaaaacaaaacgaacgaaacgcgcgaaaaacgcgcaaaactttcgaactacaaacgctcgctacgcctaaaaaattaaactataaacgaaacgatccgaactaacctttatcgctcgctaaacccatcgtttaaaactttatcaacgaatctcgccactcgtcgcaaacgcgaacgaaaaacgaaaacgcgacgaaacgccgacgaccgtaacgaaacgctcccgaaactaaacgcttctactctaaacacgcataacgccc

SEQ ID NO: 727 - DNA, 582 bp, Artificial Sequence
  chemically treated genomic DNA (Homo sapiens) CpG-island No: 727
ttatgtatagtaatttttttattttttggttttttttttcgtttttttatattgtacgtttagggatttgtttgttagcggatggtttcggtaattcggaacgtacgtttcgagagtttacggatgttttttggtttggagtttttttaaaggtttttgtattcgcgtgtgttcgtaattatgtagcgatgttttttttttttcgttttattttatttttagatattttttgttattattttatgtattcgtgtttaaaatttcgcgtttttttttattttcgttaggcgtagtattttttttttcggttgcgttcggaggggagtagagcggacggggcgcgcgggaggcgcgtagagttttcgggttgtaggcgttcgttgcgtttggggaattgggttgtgggcgaggcggttcgggttggtttttatcgttcgttgggtttatcgtttgaaattttattagcgagtttcgttattcgtcgtagacgcgagcggggggcgggggcgcggcgaggcgtcggcggtcgtgacgaggcgttttcggagttgagcgtttttgttttgggtacgtatggcgttt

SEQ ID NO: 728 - DNA, 582 bp, Artificial Sequence
  chemically treated genomic DNA (Homo sapiens) CpG-island No: 728
aaacgccatacgtacccaaaacaaaaacgctcaactccgaaaacgcctcgtcacgaccgccgacgcctcgccgcgcccccgccccccgctcgcgtctacgacgaataacgaaactcgctaataaaatttcaaacgataaacccaacgaacgataaaaaccaacccgaaccgcctcgcccacaacccaattccccaaacgcaacgaacgcctacaacccgaaaactctacgcgcctcccgcgcgccccgtccgctctactcccctccgaacgcaaccgaaaaaaaaaatactacgcctaacgaaaataaaaaaaaacgcgaaattttaaacacgaatacataaaataataacaaaaaatatctaaaaataaaataaaacgaaaaaaaaaaaacatcgctacataattacgaacacacgcgaatacaaaaacctttaaaaaaactccaaaccaaaaaacatccgtaaactctcgaaacgtacgttccgaattaccgaaaccatccgctaacaaacaaatccctaaacgtacaatataaaaaaacgaaaaaaaaaaccaaaaaataaaaaaattactatacataa

SEQ ID NO: 729 - DNA, 518 bp, Artificial Sequence
  chemically treated genomic DNA (Homo sapiens) CpG-island No: 729
ggcggcgacgaataagttgtatgtttatggagttacggaaagagggaatagcggagggggtgcggcgggggtgatagtaggggggtgtgcgggttggggtgaaagaggggggtgttgaggtaaggtcggaaggtgggagcgagggaagggaggggcggaggcgggagggggagattggaggaagtgcgaaggggggttggtgaggttgggttcggaggggaggcgagagggagagaatgggggagagtttgcgagaagattagtagagagggggagggattagagtgaggggagagaagcgagtgggggaggagaggcgaaggaaagggagagagcggaggagcgagtagataaaaagatgggtataaggtgaggaagataggtagagggggaaagcgcgagcgagttatacgagagggggttacggagggaggagttaggtagatggggaacgggagagtgagatatacggggtgagggaagagtagtatggaaggagagtagagggataagagagg

SEQ ID NO: 730 - DNA, 518 bp, Artificial Sequence
  chemically treated genomic DNA (Homo sapiens) CpG-island No: 730
cctctcttatccctctactctccttccatactactcttccctcaccccgtatatctcactctcccgttccccatctacctaactcctccctccgtaaccccctctcgtataactcgctcgcgctttccccctctacctatcttcctcaccttatacccatctttttatctactcgctcctccgctctctccctttccttcgcctctcctcccccactcgcttctctcccctcactctaatccctccccctctctactaatcttctcgcaaactctcccccattctctccctctcgcctcccctccgaacccaacctcaccaaccccccttcgcacttcctccaatctccccctcccgcctccgcccctcccttccctcgctcccaccttccgaccttacctcaacacccccctctttcaccccaacccgcacacccccctactatcacccccgccgcaccccctccgctattccctctttccgtaactccataaacatacaacttattcgtcgccgcc

SEQ ID NO: 731 - DNA, 518 bp, Artificial Sequence
  chemically treated genomic DNA (Homo sapiens) CpG-island No: 731
ttttttttgtttttttattttttttttatattattttttttttatttcgtgtgttttattttttcgttttttatttgtttggttttttttttcgtgattttttttcgtgtgattcgttcgcgttttttttttttgtttgttttttttattttatgtttatttttttatttgttcgttttttcgttttttttttttttttcgtttttttttttttattcgtttttttttttttattttagtttttttttttttttattagttttttcgtaaatttttttttattttttttttttcgtttttttttcggatttaattttattagttttttttcgtattttttttaatttttttttttcgttttcgttttttttttttttcgtttttatttttcggttttgttttaatattttttttttttattttaattcgtatatttttttgttattattttcgtcgtatttttttcgttatttttttttttcgtggttttatggatatgtagtttgttcgtcgtcgtt

SEQ ID NO: 732 - DNA, 518 bp, Artificial Sequence
  chemically treated genomic DNA (Homo sapiens) CpG-island No: 732
aacgacgacgaacaaactacatatccataaaaccacgaaaaaaaaaaataacgaaaaaaatacgacgaaaataataacaaaaaaatatacgaattaaaataaaaaaaaaaaatattaaaacaaaaccgaaaaataaaaacgaaaaaaaaaaaaaacgaaaacgaaaaaaaaaaattaaaaaaaatacgaaaaaaaactaataaaattaaatccgaaaaaaaaacgaaaaaaaaaaaataaaaaaaaatttacgaaaaaactaataaaaaaaaaaaaaaactaaaataaaaaaaaaaaaacgaataaaaaaaaaaaaacgaaaaaaaaaaaaaaaacgaaaaaacgaacaaataaaaaaataaacataaaataaaaaaaacaaacaaaaaaaaaaaacgcgaacgaatcacacgaaaaaaaatcacgaaaaaaaaaaccaaacaaataaaaaacgaaaaaataaaacacacgaaataaaaaaaaaataatataaaaaaaaaataaaaaaacaaaaaaaa

SEQ ID NO: 733 - DNA, 899 bp, Artificial Sequence
  chemically treated genomic DNA (Homo sapiens) CpG-island No: 733
cggagcgtcggtagtatttggagcggttagggttattttgtcgtcgtcgttttcgcggttttcgtcgtcgttgttttcgtcgcggttcgtgcgcgcgggcgttagtgtagttaggagcgcgtgcgttaggcggaagggcgcgaaggttcggtgcgtttagttgtgtttttcgatgatcgcgtagtacgaggttagtattcggttgatgagaatggtgttttgggtcgtgagcggcgcgtaggcgttcgcggttttttcgtttagggttacgttgtgtatagcggcgggtaggagtcggcggttttcgttacgttcggttattacgtatacgcgttggttcgggcgtacgcggttggcgaatagcgttcgaggttttagtgcgttttcggaaggcggtttcgagttcgaggacgtttcgggtttttcggtggtcgagtcgttgtgcggcgttataaagagtaggtgcgcggcggtgagtagtaggcgttcgcgcggttttcgcgtttcgattacgtagaagatttttttggcgtcgtcgtcgcggtttaggaaagtgaggaagtcgttgtagagtagtcggttttggtcgttcgtcgttagtacgcggttttcggggtttaggttttttattagtttggtgtcgttttgttttaggtgtatcgtggtcgagttcgggaagtagtttttcgatttggtcgttatcgagttttttgcgggtgaggagaagggaaagaagagaggatagggtattgagtttcgagagggaggcgcgtttcggggaggagggcgtacgtttggtgttcgcgtttttaggttaggggtgcgtaaggcgcggggcggggcgattgattttaggcgggtttcgtatatattttttttttttaattttattgttttag

SEQ ID NO: 734 - DNA, 899 bp, Artificial Sequence
  chemically treated genomic DNA (Homo sapiens) CpG-island No: 734
ctaaaacaataaaattaaaaaaaaaaaatatatacgaaacccgcctaaaatcaatcgccccgccccgcgccttacgcacccctaacctaaaaacgcgaacaccaaacgtacgccctcctccccgaaacgcgcctccctctcgaaactcaataccctatcctctcttctttcccttctcctcacccgcaaaaaactcgataacgaccaaatcgaaaaactacttcccgaactcgaccacgatacacctaaaacaaaacgacaccaaactaataaaaaacctaaaccccgaaaaccgcgtactaacgacgaacgaccaaaaccgactactctacaacgacttcctcactttcctaaaccgcgacgacgacgccaaaaaaatcttctacgtaatcgaaacgcgaaaaccgcgcgaacgcctactactcaccgccgcgcacctactctttataacgccgcacaacgactcgaccaccgaaaaacccgaaacgtcctcgaactcgaaaccgccttccgaaaacgcactaaaacctcgaacgctattcgccaaccgcgtacgcccgaaccaacgcgtatacgtaataaccgaacgtaacgaaaaccgccgactcctacccgccgctatacacaacgtaaccctaaacgaaaaaaccgcgaacgcctacgcgccgctcacgacccaaaacaccattctcatcaaccgaatactaacctcgtactacgcgatcatcgaaaaacacaactaaacgcaccgaaccttcgcgcccttccgcctaacgcacgcgctcctaactacactaacgcccgcgcgcacgaaccgcgacgaaaacaacgacgacgaaaaccgcgaaaacgacgacgacaaaataaccctaaccgctccaaatactaccgacgctccg

SEQ ID NO: 735 - DNA, 899 bp, Artificial Sequence
  chemically treated genomic DNA (Homo sapiens) CpG-island No: 735
ttggggtagtggggttgggggagggaggtgtgtgcgggattcgtttggaattaatcgtttcgtttcgcgttttgcgtatttttggtttaggagcgcgggtattaagcgtgcgttttttttttcgagacgcgtttttttttcggaatttaatgttttgttttttttttttttttttttttttattcgtagagaattcggtggcggttaaatcgggaggttgtttttcgggttcggttacggtgtatttggagtagggcggtattaagttggtgaaggatttgagtttcggggatcgcgtgttggcggcggacgattagggtcggttgttttatagcgatttttttatttttttggatcgcgacgacggcgttaagaaggttttttacgtgatcgagacgcgggagtcgcgcgagcgtttgttgtttatcgtcgcgtatttgttttttgtggcgtcgtataacgattcggttatcggggagttcgaggcgttttcgggttcggggtcgtttttcgggggcgtattggggtttcgggcgttgttcgttagtcgcgtgcgttcgggttagcgcgtgtacgtggtggtcgagcgtgacggggatcgtcggtttttgttcgtcgttgtgtatagcgtgattttaagcgaggaggtcgcgggcgtttacgcgtcgtttacggtttagggtattatttttattaatcgggtgttggtttcgtgttacgcggttatcgaggagtatagttgggcgtatcgggttttcgcgttttttcgtttggcgtacgcgtttttggttgtattggcgttcgcgcgtacggatcgcggcggggatagcggcggcggggatcgcgggggcggcggcggtagagtagttttaatcgttttaggtgttgtcgacgtttcg

SEQ ID NO: 736 - DNA, 899 bp, Artificial Sequence
  chemically treated genomic DNA (Homo sapiens) CpG-island No: 736
cgaaacgtcgacaacacctaaaacgattaaaactactctaccgccgccgcccccgcgatccccgccgccgctatccccgccgcgatccgtacgcgcgaacgccaatacaaccaaaaacgcgtacgccaaacgaaaaaacgcgaaaacccgatacgcccaactatactcctcgataaccgcgtaacacgaaaccaacacccgattaataaaaataataccctaaaccgtaaacgacgcgtaaacgcccgcgacctcctcgcttaaaatcacgctatacacaacgacgaacaaaaaccgacgatccccgtcacgctcgaccaccacgtacacgcgctaacccgaacgcacgcgactaacgaacaacgcccgaaaccccaatacgcccccgaaaaacgaccccgaacccgaaaacgcctcgaactccccgataaccgaatcgttatacgacgccacaaaaaacaaatacgcgacgataaacaacaaacgctcgcgcgactcccgcgtctcgatcacgtaaaaaaccttcttaacgccgtcgtcgcgatccaaaaaaataaaaaaatcgctataaaacaaccgaccctaatcgtccgccgccaacacgcgatccccgaaactcaaatccttcaccaacttaataccgccctactccaaatacaccgtaaccgaacccgaaaaacaacctcccgatttaaccgccaccgaattctctacgaataaaaaaaaaaaaaaaaaaaaaaaacaaaacattaaattccgaaaaaaaaacgcgtctcgaaaaaaaaaacgcacgcttaatacccgcgctcctaaaccaaaaatacgcaaaacgcgaaacgaaacgattaattccaaacgaatcccgcacacacctccctcccccaaccccactaccccaa

SEQ ID NO: 737 - DNA, 647 bp, Artificial Sequence
  chemically treated genomic DNA (Homo sapiens) CpG-island No: 737
cgaggtcgagttgtatttgtcgtttaagttgcggcgtttgtacggttcgggcgggggtcgttttttttagggtgcggtagcggcggcggcggcggcggcggcggcggcggtagcggtcgttacggttacggcgggtttacgcggggaggttttttcgtcgttatcgttaatcgcgcggttcggggaacggtcggacggcgtaggggtcgtcgcggtagtcgcggtcgcggtcgtcgcggtttgggatacgtttaagattagttaggcgtcgtaggtgagtattagtcgtagtaagtcgtatcgcgagaacggggcgtttttcgtgtcgtcgtcgttcgcgttggacgagttgggcggttcggggggcgttacgtattcggaggagcgtttcggcgtggtcggcggttcgggtagcgtttcggttgcgggtggtggtatcggtatcgaggacgacgaggaggagttgttggaggacgaagaagatgaggacgaggaagaggaattgttggaggacgacgaggaggagttgttggaggacgacgttcgcgcgttgtttaaggagtttcggcgttgttttgtggtcgttattggcgtcgtggtcgtagtagttgtcgttgtagtggttatagagggcggggagttgttat

SEQ ID NO: 738 - DNA, 647 bp, Artificial Sequence
  chemically treated genomic DNA (Homo sapiens) CpG-island No: 738
ataacaactccccgccctctataaccactacaacgacaactactacgaccacgacgccaataacgaccacaaaacaacgccgaaactccttaaacaacgcgcgaacgtcgtcctccaacaactcctcctcgtcgtcctccaacaattcctcttcctcgtcctcatcttcttcgtcctccaacaactcctcctcgtcgtcctcgataccgataccaccacccgcaaccgaaacgctacccgaaccgccgaccacgccgaaacgctcctccgaatacgtaacgccccccgaaccgcccaactcgtccaacgcgaacgacgacgacacgaaaaacgccccgttctcgcgatacgacttactacgactaatactcacctacgacgcctaactaatcttaaacgtatcccaaaccgcgacgaccgcgaccgcgactaccgcgacgacccctacgccgtccgaccgttccccgaaccgcgcgattaacgataacgacgaaaaaacctccccgcgtaaacccgccgtaaccgtaacgaccgctaccgccgccgccgccgccgccgccgccgccgctaccgcaccctaaaaaaaacgacccccgcccgaaccgtacaaacgccgcaacttaaacgacaaatacaactcgacctcg

SEQ ID NO: 739 - DNA, 647 bp, Artificial Sequence
  chemically treated genomic DNA (Homo sapiens) CpG-island No: 739
gtgatagtttttcgttttttgtggttattgtagcggtagttgttgcggttacggcgttagtggcggttataggatagcgtcggggttttttgagtagcgcgcgggcgtcgttttttagtagttttttttcgtcgttttttagtagtttttttttttcgtttttatttttttcgttttttagtagttttttttcgtcgttttcggtgtcggtgttattattcgtagtcggggcgttgttcgggtcgtcggttacgtcgaggcgttttttcgggtgcgtgacgtttttcgggtcgtttagttcgtttagcgcgggcggcggcggtacgaagggcgtttcgttttcgcggtacgatttgttgcggttgatgtttatttgcggcgtttggttgattttgagcgtgttttaggtcgcggcggtcgcggtcgcggttgtcgcggcggtttttgcgtcgttcggtcgtttttcgggtcgcgcggttggcggtggcggcggaggggttttttcgcgtggattcgtcgtggtcgtggcggtcgttgtcgtcgtcgtcgtcgtcgtcgtcgtcgtcgttgtcgtattttgaaggaggcggttttcgttcgggtcgtataggcgtcgtagtttgggcggtaggtgtagttcggtttcg

SEQ ID NO: 740 - DNA, 647 bp, Artificial Sequence
  chemically treated genomic DNA (Homo sapiens) CpG-island No: 740
cgaaaccgaactacacctaccgcccaaactacgacgcctatacgacccgaacgaaaaccgcctccttcaaaatacgacaacgacgacgacgacgacgacgacgacgacgacaacgaccgccacgaccacgacgaatccacgcgaaaaaacccctccgccgccaccgccaaccgcgcgacccgaaaaacgaccgaacgacgcaaaaaccgccgcgacaaccgcgaccgcgaccgccgcgacctaaaacacgctcaaaatcaaccaaacgccgcaaataaacatcaaccgcaacaaatcgtaccgcgaaaacgaaacgcccttcgtaccgccgccgcccgcgctaaacgaactaaacgacccgaaaaacgtcacgcacccgaaaaaacgcctcgacgtaaccgacgacccgaacaacgccccgactacgaataataacaccgacaccgaaaacgacgaaaaaaaactactaaaaaacgaaaaaaataaaaacgaaaaaaaaaaactactaaaaaacgacgaaaaaaaactactaaaaaacgacgcccgcgcgctactcaaaaaaccccgacgctatcctataaccgccactaacgccgtaaccgcaacaactaccgctacaataaccacaaaaaacgaaaaactatcac

SEQ ID NO: 741 - DNA, 817 bp, Artificial Sequence
  chemically treated genomic DNA (Homo sapiens) CpG-island No: 741
tggatgcgcggatagtcgttgttggttttttggatgtcgacggatttgtattgtcggtagaatttcgcgaggtcgtttagttttaggtagtagttgaattaattcgcgaggggatcgagttcggggtgggcgaagaattttagtatgagattttcgcgttggaggattatttagtcggcgtttcggaaaacgatttcgaagtttaattttttatagaaggcggcggtggaatcgaaatttcgtgatggtaggttgggcgtcgtttggtcggttatttcgaattttagagtttcgtttagaagaattcgttaagaaggcgatagaaggcgatgcgttgcgaatcgggagcggcgatatcgtaaagtacgaggaagcggttagtttattcgtcgttaagttttttagtaatattacgggtagttaacgttatgttttgatagcggttcgttatatttagtcggttatagtcgatgaatttagaaaagcggttattttttattatgatattcggtaagtaggtatcgttatgggttacgacgagattttcgtcgtcgggtatgcgcgttttgagtttggcgaatagttcggtggcgcgagtttttgatgtttttcgtttagattattttgatcgataagatcggtttttattcgagtacgtgttcgttcgatgcgatgtttcgtttggtggtcgaatgggtaggtagtcggattaagcgtatgtagtcgtcgtattgtattagttatgatggatattttttcggtaggagtaagttgagatgataggagattttgtttcggtattcgtttaatagtagtt

SEQ ID NO: 742 - DNA, 817 bp, Artificial Sequence
  chemically treated genomic DNA (Homo sapiens) CpG-island No: 742
aactactattaaacgaataccgaaacaaaatctcctatcatctcaacttactcctaccgaaaaaatatccatcataactaatacaatacgacgactacatacgcttaatccgactacctacccattcgaccaccaaacgaaacatcgcatcgaacgaacacgtactcgaataaaaaccgatcttatcgatcaaaataatctaaacgaaaaacatcaaaaactcgcgccaccgaactattcgccaaactcaaaacgcgcatacccgacgacgaaaatctcgtcgtaacccataacgatacctacttaccgaatatcataataaaaaataaccgcttttctaaattcatcgactataaccgactaaatataacgaaccgctatcaaaacataacgttaactacccgtaatattactaaaaaacttaacgacgaataaactaaccgcttcctcgtactttacgatatcgccgctcccgattcgcaacgcatcgccttctatcgccttcttaacgaattcttctaaacgaaactctaaaattcgaaataaccgaccaaacgacgcccaacctaccatcacgaaatttcgattccaccgccgccttctataaaaaattaaacttcgaaatcgttttccgaaacgccgactaaataatcctccaacgcgaaaatctcatactaaaattcttcgcccaccccgaactcgatcccctcgcgaattaattcaactactacctaaaactaaacgacctcgcgaaattctaccgacaatacaaatccgtcgacatccaaaaaaccaacaacgactatccgcgcatcca

SEQ ID NO: 743 - DNA, 817 bp, Artificial Sequence
  chemically treated genomic DNA (Homo sapiens) CpG-island No: 743
ggttgttattgggcgaatgtcggggtaggattttttgttattttaatttgtttttgtcgagaaagtatttattatggttgatgtaatgcggcggttgtatacgtttgattcggttatttgtttattcgattattaagcgaaatatcgtatcgagcgagtacgtattcggatggaagtcggttttgtcgattaggatgatttggacgaagagtattaggggttcgcgttatcgaattgttcgttaggtttaaggcgcgtatgttcgacggcgaggatttcgtcgtgatttatggcgatgtttgtttgtcgaatattatggtggaaaatggtcgtttttttggatttatcgattgtggtcggttgggtgtggcggatcgttattaggatatagcgttggttattcgtgatattgttgaagagtttggcggcgaatgggttgatcgttttttcgtgttttacggtatcgtcgttttcgattcgtagcgtatcgttttttatcgtttttttgacgagtttttttgagcgggattttggggttcgaaatgatcgattaagcgacgtttaatttgttattacgagatttcgattttatcgtcgttttttatgaaaggttgggtttcggaatcgtttttcgggacgtcggttggatgattttttagcgcggggattttatgttggagtttttcgtttatttcgggttcgattttttcgcgagttggtttagttgttgtttgaggttggacgatttcgcggagttttatcggtagtgtaaattcgtcggtatttaggaaattagtagcggttattcgcgtattta

SEQ ID NO: 744 - DNA, 817 bp, Artificial Sequence
  chemically treated genomic DNA (Homo sapiens) CpG-island No: 744
taaatacgcgaataaccgctactaatttcctaaataccgacgaatttacactaccgataaaactccgcgaaatcgtccaacctcaaacaacaactaaaccaactcgcgaaaaaatcgaacccgaaataaacgaaaaactccaacataaaatccccgcgctaaaaaatcatccaaccgacgtcccgaaaaacgattccgaaacccaacctttcataaaaaacgacgataaaatcgaaatctcgtaataacaaattaaacgtcgcttaatcgatcatttcgaaccccaaaatcccgctcaaaaaaactcgtcaaaaaaacgataaaaaacgatacgctacgaatcgaaaacgacgataccgtaaaacacgaaaaaacgatcaacccattcgccgccaaactcttcaacaatatcacgaataaccaacgctatatcctaataacgatccgccacacccaaccgaccacaatcgataaatccaaaaaaacgaccattttccaccataatattcgacaaacaaacatcgccataaatcacgacgaaatcctcgccgtcgaacatacgcgccttaaacctaacgaacaattcgataacgcgaacccctaatactcttcgtccaaatcatcctaatcgacaaaaccgacttccatccgaatacgtactcgctcgatacgatatttcgcttaataatcgaataaacaaataaccgaatcaaacgtatacaaccgccgcattacatcaaccataataaatactttctcgacaaaaacaaattaaaataacaaaaaatcctaccccgacattcgcccaataacaacc

SEQ ID NO: 745 - DNA, 800 bp, Artificial Sequence
  chemically treated genomic DNA (Homo sapiens) CpG-island No: 745
tttatcgcggtattggttaggttgggtcggacgaacgaggcggcgtcggcggtgcggggggtggtgggtgggttttcggttcgttgggggcggagcgcgggtcggtttatttggcgggtttttcggcgatgagcgcgtcggtcgttcgttcggttttcggggttgaggttgcggggggaaggtggggaattaaacgcgcgttaacgcgggcgcgggttcggggtagatttcgttcgggtcggttttgttcgtattttttttaagcgaattcggtagtttcgtttgttcggttggttttggagttttgagttcgtgggtgtcgcgattcggtttgagatacggcgggggcggggcgggcgttcggagtcgcggtgagttagggtttcgcgttcgtcgatttatttttgtcgtttcggttcgggagcgcgatttgtaatgtaaagttatttcgtttttagtattttaatttgttttaggattcgttagtattagagattttaacggttcgacggtcgttttttttttttcgtttatttttttttcgtcggcggttgagtcgcgaggggaagttttgtaatttcggataaataaacgtcggttttgtacgggtttgaaaaattttgggggaaatgaagagtgagcgaaatcgaagttatcgttcgggtttggcgttcggtttcgcgggtttttgggggcgcgattcgtcgggtttgtttatttcgtttttttatttcggttttcggtttttttttttttttgtttttcggttgttattttataggtcgagggcgtttagtagt

SEQ ID NO: 746 - DNA, 800 bp, Artificial Sequence
  chemically treated genomic DNA (Homo sapiens) CpG-island No: 746
actactaaacgccctcgacctataaaataacaaccgaaaaacaaaaaaaaaaaaaaaccgaaaaccgaaataaaaaaacgaaataaacaaacccgacgaatcgcgcccccaaaaacccgcgaaaccgaacgccaaacccgaacgataacttcgatttcgctcactcttcatttcccccaaaatttttcaaacccgtacaaaaccgacgtttatttatccgaaattacaaaacttcccctcgcgactcaaccgccgacgaaaaaaaaataaacgaaaaaaaaaaaacgaccgtcgaaccgttaaaatctctaatactaacgaatcctaaaacaaattaaaatactaaaaacgaaataactttacattacaaatcgcgctcccgaaccgaaacgacaaaaataaatcgacgaacgcgaaaccctaactcaccgcgactccgaacgcccgccccgcccccgccgtatctcaaaccgaatcgcgacacccacgaactcaaaactccaaaaccaaccgaacaaacgaaactaccgaattcgcttaaaaaaaatacgaacaaaaccgacccgaacgaaatctaccccgaacccgcgcccgcgttaacgcgcgtttaattccccaccttccccccgcaacctcaaccccgaaaaccgaacgaacgaccgacgcgctcatcgccgaaaaacccgccaaataaaccgacccgcgctccgcccccaacgaaccgaaaacccacccaccaccccccgcaccgccgacgccgcctcgttcgtccgacccaacctaaccaataccgcgataaa

SEQ ID NO: 747 - DNA, 800 bp, Artificial Sequence
  chemically treated genomic DNA (Homo sapiens) CpG-island No: 747
gttattgagcgttttcgatttatgaggtaatagtcgggaggtagggaggagggagggtcgggggtcggggtggagggacggggtgggtaggttcggcgggtcgcgtttttaggagttcgcggagtcgagcgttaggttcgagcgatggtttcgatttcgtttattttttattttttttaaagttttttaagttcgtgtaagatcggcgtttgtttgttcgggattgtaaaattttttttcgcggtttagtcgtcgacgagggaggggtagacgaggggaggggagcggtcgtcgggtcgttgaggtttttagtgttggcggattttggggtagattggggtgttggaggcggggtgattttgtattgtaaatcgcgttttcgggtcggggcggtagaaatgagtcggcgggcgcggagttttgatttatcgcggtttcgagcgttcgtttcgttttcgtcgtgttttagatcgagtcgcggtatttacggatttaagattttaaaattaatcgagtaaacgaaattgtcgagttcgtttgggggaggtgcgggtagggtcggttcgggcggggtttgtttcgggttcgcgttcgcgttgacgcgcgtttggttttttatttttttttcgtagttttagtttcggaagtcgagcgagcggtcggcgcgtttatcgtcggggagttcgttaggtggatcggttcgcgtttcgtttttagcgagtcggggatttatttattatttttcgtatcgtcgacgtcgtttcgttcgttcggtttagtttgattaatgtcgcggtgga

SEQ ID NO: 748 - DNA, 800 bp, Artificial Sequence
  chemically treated genomic DNA (Homo sapiens) CpG-island No: 748
tccaccgcgacattaatcaaactaaaccgaacgaacgaaacgacgtcgacgatacgaaaaataataaataaatccccgactcgctaaaaacgaaacgcgaaccgatccacctaacgaactccccgacgataaacgcgccgaccgctcgctcgacttccgaaactaaaactacgaaaaaaaaataaaaaaccaaacgcgcgtcaacgcgaacgcgaacccgaaacaaaccccgcccgaaccgaccctacccgcacctcccccaaacgaactcgacaatttcgtttactcgattaattttaaaatcttaaatccgtaaataccgcgactcgatctaaaacacgacgaaaacgaaacgaacgctcgaaaccgcgataaatcaaaactccgcgcccgccgactcatttctaccgccccgacccgaaaacgcgatttacaatacaaaatcaccccgcctccaacaccccaatctaccccaaaatccgccaacactaaaaacctcaacgacccgacgaccgctcccctcccctcgtctacccctccctcgtcgacgactaaaccgcgaaaaaaaattttacaatcccgaacaaacaaacgccgatcttacacgaacttaaaaaactttaaaaaaaataaaaaataaacgaaatcgaaaccatcgctcgaacctaacgctcgactccgcgaactcctaaaaacgcgacccgccgaacctacccaccccgtccctccaccccgacccccgaccctccctcctccctacctcccgactattacctcataaatcgaaaacgctcaataac

SEQ ID NO: 749 - DNA, 1629 bp, Artificial Sequence
  chemically treated genomic DNA (Homo sapiens) CpG-island No: 749
tagttcgcgtttcgtaggatttagcgcgttttcgtagtcgttgtcgttcgacgagtaggcggaacgcggggagtcgggtttcgagttgttttcgcggttcggggacgaagaagcgcgggagggcgaggcggcgatcggggtggtttttggcggttcgcggggcgtagacggtcgtacggtttgcggttttagttttttcgttagcgcgttgcgtacggcgtcgtgttcggttagtaggcgttgtagcgcgcggatgtattttacggttgagcgtagcgtttttattttgtttagttttttgttggcgtcgtcgtgcggtacgtgttgtcgtagcgtttggaagtttaagtttattagttttacgcggttgcgttcgcgtttattgcgtcgcgttacggtcgttgcgtcgttttcggtttttgcggtggtcggtcgtcgtcgtcggttgtagcgtaatagtttcggggacgcgggttttcgtcgggtagcgtagtcgatagggacggggggcgtagggggcgcggatttgggtagtgtgtcgtcgtttatcgcgtttgtatttattcgttcgttttaggtttcggcgcgtcgtaggaaggtgtaggtagaggaatcggaggcgacggggaaaattgtggcgttttaagggggtttttggtacggcgtcgttaggtaattttttagggtacgcgttttaggtcgtttggagttcggggataggaggtttagtggtggtaggtcgtacgcgttagggagcgtgggacgttcgtgtttcgcgcgtgcggtcggatttttttaggttttcgtaggcgcggcgtaggcggttggtttttaaatgtatagataattttttttcgcgtcgtcgtcgtcgttttttttacgttttttttttttcgtttcgttttttcgttacgtttcgttttttttttcgcgcgattatattttgtaaggtttaaagcgtgcgtatgtttttttagtttatttttcggacgtagtttatagatttttagtgcgtttaattggcgaaatttgcgagttttcggtgcgttttttgttttcggtaggtgtttagtgcgtttttaaagtaaggtacgtaggttttgggttgagttttttcgtatttttattttaatttcgcgcgtagtttcgttagttttaagagtcgttagattttcgtacgcgtagcgcgcgttgtgggagggaaggcgcggttttggcgataatacggttgttcgggaggcgcgtaagattttcgggggtagtacgcgtcgcgtagtttatatttacgttttatttttttggggtcgaggaggcgggggttagggttttagttaatcgtgggttattcgtttggttaatcgcgtagggcgcggttttacgttcggttttattgaggaagcgcgtacgcgtggcgcgtggtttacggggagtatcgttaataaagttgggtttttgttgggtttcgttttgtttttcgttttcgcgattgggttgggcgcgttgttttttagcgtagttatgtttcgagcgcgtttttatttgtgcgttaatttattgggaatgggggtggattgcgttttatttggggcggggtggggtttaaggagtggtcgagattgaggcggggtg

SEQ ID NO: 750 - DNA, 1629 bp, Artificial Sequence
  chemically treated genomic DNA (Homo sapiens) CpG-island No: 750
caccccgcctcaatctcgaccactccttaaaccccaccccgccccaaataaaacgcaatccacccccattcccaataaattaacgcacaaataaaaacgcgctcgaaacataactacgctaaaaaacaacgcgcccaacccaatcgcgaaaacgaaaaacaaaacgaaacccaacaaaaacccaactttattaacgatactccccgtaaaccacgcgccacgcgtacgcgcttcctcaataaaaccgaacgtaaaaccgcgccctacgcgattaaccaaacgaataacccacgattaactaaaaccctaacccccgcctcctcgaccccaaaaaaataaaacgtaaatataaactacgcgacgcgtactacccccgaaaatcttacgcgcctcccgaacaaccgtattatcgccaaaaccgcgccttccctcccacaacgcgcgctacgcgtacgaaaatctaacgactcttaaaactaacgaaactacgcgcgaaattaaaataaaaatacgaaaaaactcaacccaaaacctacgtaccttactttaaaaacgcactaaacacctaccgaaaacaaaaaacgcaccgaaaactcgcaaatttcgccaattaaacgcactaaaaatctataaactacgtccgaaaaataaactaaaaaaacatacgcacgctttaaaccttacaaaatataatcgcgcgaaaaaaaaaacgaaacgtaacgaaaaaacgaaacgaaaaaaaaaaaacgtaaaaaaaacgacgacgacgacgcgaaaaaaaattatctatacatttaaaaaccaaccgcctacgccgcgcctacgaaaacctaaaaaaatccgaccgcacgcgcgaaacacgaacgtcccacgctccctaacgcgtacgacctaccaccactaaacctcctatccccgaactccaaacgacctaaaacgcgtaccctaaaaaattacctaacgacgccgtaccaaaaacccccttaaaacgccacaattttccccgtcgcctccgattcctctacctacaccttcctacgacgcgccgaaacctaaaacgaacgaataaatacaaacgcgataaacgacgacacactacccaaatccgcgccccctacgccccccgtccctatcgactacgctacccgacgaaaacccgcgtccccgaaactattacgctacaaccgacgacgacgaccgaccaccgcaaaaaccgaaaacgacgcaacgaccgtaacgcgacgcaataaacgcgaacgcaaccgcgtaaaactaataaacttaaacttccaaacgctacgacaacacgtaccgcacgacgacgccaacaaaaaactaaacaaaataaaaacgctacgctcaaccgtaaaatacatccgcgcgctacaacgcctactaaccgaacacgacgccgtacgcaacgcgctaacgaaaaaactaaaaccgcaaaccgtacgaccgtctacgccccgcgaaccgccaaaaaccaccccgatcgccgcctcgccctcccgcgcttcttcgtccccgaaccgcgaaaacaactcgaaacccgactccccgcgttccgcctactcgtcgaacgacaacgactacgaaaacgcgctaaatcctacgaaacgcgaacta

SEQ ID NO: 751 - DNA, 1629 bp, Artificial Sequence
  chemically treated genomic DNA (Homo sapiens) CpG-island No: 751
tatttcgttttagtttcgattattttttaagttttatttcgttttaggtaaggcgtagtttatttttatttttagtagattaacgtataggtgggggcgcgttcgggatatagttgcgttaggggatagcgcgtttagtttagtcgcgggggcgaggagtagggcggggtttagtaggaatttagttttgttagcgatgtttttcgtgagttacgcgttacgcgtacgcgtttttttaatggggtcgggcgtggagtcgcgttttgcgcgattggttaaacgggtggtttacgattggttgagattttggttttcgttttttcggttttaggagggtggggcgtgggtgtgggttgcgcggcgcgtgttgttttcggggattttgcgcgtttttcgaatagtcgtgttgtcgttagggtcgcgtttttttttttatagcgcgcgttgcgcgtgcgaaggtttggcggtttttgggattggcggggttgcgcgcggggttagggtgggggtacgggaaggtttaatttaggatttgcgtattttgttttgggggcgtattaagtatttgtcgggagtagggggcgtatcgggaattcgtagatttcgttagttgggcgtattggggatttgtggattgcgttcgggggatgggttagggggatatgcgtacgttttgggttttatagaatgtgatcgcgcgagggggagggcgaagcgtggcgggagggcgaggcgaaggaaggagggcgtgagaaaggcgacggcggcggcgcggaggagggttatttatatatttaaaaattagtcgtttgcgtcgcgtttgcggagatttgggagagttcggtcgtacgcgcgggatacgagcgttttacgttttttggcgcgtacggtttgttattattaggttttttattttcgggttttagacgatttaggacgcgtgttttggggagttgtttggcggcgtcgtgttagaagtttttttggggcgttatagtttttttcgtcgttttcggtttttttgtttgtatttttttgcggcgcgtcgggatttggagcgggcgggtggatgtaggcgcgatggacggcggtatattgtttaggttcgcgttttttgcgtttttcgtttttgtcggttgcgttgttcggcggagattcgcgttttcggaattgttgcgttgtagtcggcggcggcgatcggttatcgtagagatcggaggcggcgtagcggtcgtagcgcggcgtaatgagcgcgagcgtaatcgcgtgaagttggtgaatttgggtttttaggcgttgcggtagtacgtgtcgtacggcggcgttagtaagaagttgagtaaggtggagacgttgcgtttagtcgtggagtatattcgcgcgttgtagcgtttgttggtcgagtacgacgtcgtgcgtaacgcgttggcgggagggttgaggtcgtaggtcgtgcggtcgtttgcgtttcgcgggtcgttagggattatttcggtcgtcgtttcgttttttcgcgttttttcgttttcgggtcgcgggggtagttcggagttcggtttttcgcgtttcgtttattcgtcggacgatagcggttgcgaaggcgcgttgagttttgcggagcgcgagtta

SEQ ID NO: 752 - DNA, 1629 bp, Artificial Sequence
  chemically treated genomic DNA (Homo sapiens) CpG-island No: 752
taactcgcgctccgcaaaactcaacgcgccttcgcaaccgctatcgtccgacgaataaacgaaacgcgaaaaaccgaactccgaactacccccgcgacccgaaaacgaaaaaacgcgaaaaaacgaaacgacgaccgaaataatccctaacgacccgcgaaacgcaaacgaccgcacgacctacgacctcaaccctcccgccaacgcgttacgcacgacgtcgtactcgaccaacaaacgctacaacgcgcgaatatactccacgactaaacgcaacgtctccaccttactcaacttcttactaacgccgccgtacgacacgtactaccgcaacgcctaaaaacccaaattcaccaacttcacgcgattacgctcgcgctcattacgccgcgctacgaccgctacgccgcctccgatctctacgataaccgatcgccgccgccgactacaacgcaacaattccgaaaacgcgaatctccgccgaacaacgcaaccgacaaaaacgaaaaacgcaaaaaacgcgaacctaaacaatataccgccgtccatcgcgcctacatccacccgcccgctccaaatcccgacgcgccgcaaaaaaatacaaacaaaaaaaccgaaaacgacgaaaaaaactataacgccccaaaaaaacttctaacacgacgccgccaaacaactccccaaaacacgcgtcctaaatcgtctaaaacccgaaaataaaaaacctaataataacaaaccgtacgcgccaaaaaacgtaaaacgctcgtatcccgcgcgtacgaccgaactctcccaaatctccgcaaacgcgacgcaaacgactaatttttaaatatataaataaccctcctccgcgccgccgccgtcgcctttctcacgccctccttccttcgcctcgccctcccgccacgcttcgccctccccctcgcgcgatcacattctataaaacccaaaacgtacgcatatccccctaacccatcccccgaacgcaatccacaaatccccaatacgcccaactaacgaaatctacgaattcccgatacgccccctactcccgacaaatacttaatacgcccccaaaacaaaatacgcaaatcctaaattaaaccttcccgtacccccaccctaaccccgcgcgcaaccccgccaatcccaaaaaccgccaaaccttcgcacgcgcaacgcgcgctataaaaaaaaaaacgcgaccctaacgacaacacgactattcgaaaaacgcgcaaaatccccgaaaacaacacgcgccgcgcaacccacacccacgccccaccctcctaaaaccgaaaaaacgaaaaccaaaatctcaaccaatcgtaaaccacccgtttaaccaatcgcgcaaaacgcgactccacgcccgaccccattaaaaaaacgcgtacgcgtaacgcgtaactcacgaaaaacatcgctaacaaaactaaattcctactaaaccccgccctactcctcgcccccgcgactaaactaaacgcgctatcccctaacgcaactatatcccgaacgcgcccccacctatacgttaatctactaaaaataaaaataaactacgccttacctaaaacgaaataaaacttaaaaaataatcgaaactaaaacgaaata

SEQ ID NO: 753 - DNA, 668 bp, Artificial Sequence
  chemically treated genomic DNA (Homo sapiens) CpG-island No: 753
gttattcgtagtatttttaaaaataatttttcgttttagtatatttatagaggcgtgttattcgtagtatttttaaaaataatttttcgttttatttatagaggcgtgttattcgtagtatttttaaaaataattttttattttattcgtagaggtgtgtttttcgtagtatttttaaaaataatttttcgttttagtatatttatagaggcgtgttattcgtagtatttttaaaaataatttttcgttttagtatatttagaggcgtgttattcgtagtatttttaaaaataatttttcgttttagtatatttagaggcgtgttattcgtagtatttttaaaaataatttttcgttttagtatatttatagaggcgtgttattcgtagtatttttaaaaataatttttcgttttagtatatttagaggcgtgttttttttagtatttttaaaaataatttttcgttttagtatatttatagaggcgtgttattcgtagtatttttaaaaataattttttattttagtatatttatagaggcgtgttattcgtagtatttttaaaaataatttttcgttttagtatatttatagaggcgtgttttttttagtatttttaaaaataatttttcgttttagtatttttatagaggcgtgttattcgtagt

SEQ ID NO: 754 - DNA, 668 bp, Artificial Sequence
  chemically treated genomic DNA (Homo sapiens) CpG-island No: 754
actacgaataacacgcctctataaaaatactaaaacgaaaaattatttttaaaaatactaaaaaaaacacgcctctataaatatactaaaacgaaaaattatttttaaaaatactacgaataacacgcctctataaatatactaaaataaaaaattatttttaaaaatactacgaataacacgcctctataaatatactaaaacgaaaaattatttttaaaaatactaaaaaaaacacgcctctaaatatactaaaacgaaaaattatttttaaaaatactacgaataacacgcctctataaatatactaaaacgaaaaattatttttaaaaatactacgaataacacgcctctaaatatactaaaacgaaaaattatttttaaaaatactacgaataacacgcctctaaatatactaaaacgaaaaattatttttaaaaatactacgaataacacgcctctataaatatactaaaacgaaaaattatttttaaaaatactacgaaaaacacacctctacgaataaaataaaaaattatttttaaaaatactacgaataacacgcctctataaataaaacgaaaaattatttttaaaaatactacgaataacacgcctctataaatatactaaaacgaaaaattatttttaaaaatactacgaataac

SEQ ID NO: 755 - DNA, 668 bp, Artificial Sequence
  chemically treated genomic DNA (Homo sapiens) CpG-island No: 755
gttgcgggtggtacgtttttgtgaaaatattaaagcggggagttgtttttgggggtgttgagggaggtacgtttttgtgaatatattaaagcggggagttgtttttgggggtgttgcgggtggtacgtttttgtgaatatattgaagtagggagttgtttttgggggtgttgcgggtggtacgtttttgtgaatatattgaagcggggagttgtttttgggggtgttgagggaggtacgtttttgaatatattaaagcggggagttgtttttgggggtgttgcgggtggtacgtttttgtgaatatattaaagcggggagttgtttttgggggtgttgcgggtggtacgtttttgaatatattaaagcggggagttgtttttgggggtgttgcgggtggtacgtttttgaatatattaaagcggggagttgtttttgggggtgttgcgggtggtacgtttttgtgaatatattaaagcggggagttgtttttgggggtgttgcgggaggtatatttttgcgaataaagtggggagttgtttttgggggtgttgcgggtggtacgtttttgtgaataaagcggggagttgtttttgggggtgttgcgggtggtacgtttttgtgaatatattgaagcggggagttgtttttgggggtgttgcgggtggt

SEQ ID NO: 756 - DNA, 668 bp, Artificial Sequence
  chemically treated genomic DNA (Homo sapiens) CpG-island No: 756
accacccgcaacacccccaaaaacaactccccgcttcaatatattcacaaaaacgtaccacccgcaacacccccaaaaacaactccccgctttattcacaaaaacgtaccacccgcaacacccccaaaaacaactccccactttattcgcaaaaatatacctcccgcaacacccccaaaaacaactccccgctttaatatattcacaaaaacgtaccacccgcaacacccccaaaaacaactccccgctttaatatattcaaaaacgtaccacccgcaacacccccaaaaacaactccccgctttaatatattcaaaaacgtaccacccgcaacacccccaaaaacaactccccgctttaatatattcacaaaaacgtaccacccgcaacacccccaaaaacaactccccgctttaatatattcaaaaacgtacctccctcaacacccccaaaaacaactccccgcttcaatatattcacaaaaacgtaccacccgcaacacccccaaaaacaactccctacttcaatatattcacaaaaacgtaccacccgcaacacccccaaaaacaactccccgctttaatatattcacaaaaacgtacctccctcaacacccccaaaaacaactccccgctttaatattttcacaaaaacgtaccacccgcaac

SEQ ID NO: 757 - DNA, 1012 bp, Artificial Sequence
  chemically treated genomic DNA (Homo sapiens) CpG-island No: 757
ggtcgaaacgcgttaagttgggggtaggtgtagcgattttatatttttcggttgcgcgttttggcggtaggaggcggggtcgggggcggggcgtgagttggtcgggggcggggtttatggaggggcgggatcgcggcgttttataagtattgcggagcgtaggcgcgcgttcggttagagagcgagcgcgtaacggcggcgacggcggcgattttatcgtatattttgttaggttttcggcgtttagggcgtacggcgcgttttcgtgtcggcggtttttgcgtttattttttggcgttttcgttcggtcggttcgttaggtttttttgtcggttattagttaggtttcgcgtcggttcgttcgtcgtttaggatcggttcgcgtttcgtaggtcgttcgtcgttcgcgtcgttatgggagtggagggttgtattaagtgtattaagtatttgtttttcgtttttaatttcgttttttgggtaagggttgcgtcgggggtcggggcgggagggggtaggtatatattttacgttgggtaggtttcgcggtagcgtgttaggtttcgcgggcgtagcgcgggtcgcgaagttgtggggttatttgtgggttttaggagcggggtggggggtcgttcggggttatcgcgtttttcgatattggggttgagggttgcgagtcgagtttcggggtttttgtgttcgggggtttatttttgcggtcgggtcggggtttttgggggtcgtcgggtagttttcgttgtggtggtgatgggtgcggtggtcgcgggtcgggattcgagtattcggtcgttttttagttaaggaggggtttgcgcgggtttttggtcgcggatttcggattgttgtttcgcggggacgaggggggggttcgcgggcgggatttttggcgtttcgtttttatgagtttattaagagtcgtcgtttttggatggtggggcgggggcgtatattttgtcggaggttgggggcgattcgttttatttttttttta

SEQ ID NO: 758 - DNA, 1012 bp, Artificial Sequence
  chemically treated genomic DNA (Homo sapiens) CpG-island No: 758
taaaaaaaaaataaaacgaatcgcccccaacctccgacaaaatatacgcccccgccccaccatccaaaaacgacgactcttaataaactcataaaaacgaaacgccaaaaatcccgcccgcgaacccccccctcgtccccgcgaaacaacaatccgaaatccgcgaccaaaaacccgcgcaaacccctccttaactaaaaaacgaccgaatactcgaatcccgacccgcgaccaccgcacccatcaccaccacaacgaaaactacccgacgacccccaaaaaccccgacccgaccgcaaaaataaacccccgaacacaaaaaccccgaaactcgactcgcaaccctcaaccccaatatcgaaaaacgcgataaccccgaacgaccccccaccccgctcctaaaacccacaaataaccccacaacttcgcgacccgcgctacgcccgcgaaacctaacacgctaccgcgaaacctacccaacgtaaaatatatacctaccccctcccgccccgacccccgacgcaacccttacccaaaaaacgaaattaaaaacgaaaaacaaatacttaatacacttaatacaaccctccactcccataacgacgcgaacgacgaacgacctacgaaacgcgaaccgatcctaaacgacgaacgaaccgacgcgaaacctaactaataaccgacaaaaaaacctaacgaaccgaccgaacgaaaacgccaaaaaataaacgcaaaaaccgccgacacgaaaacgcgccgtacgccctaaacgccgaaaacctaacaaaatatacgataaaatcgccgccgtcgccgccgttacgcgctcgctctctaaccgaacgcgcgcctacgctccgcaatacttataaaacgccgcgatcccgcccctccataaaccccgcccccgaccaactcacgccccgcccccgaccccgcctcctaccgccaaaacgcgcaaccgaaaaatataaaatcgctacacctacccccaacttaacgcgtttcgacc

SEQ ID NO: 759 - DNA, 1012 bp, Artificial Sequence
  chemically treated genomic DNA (Homo sapiens) CpG-island No: 759
tggggaaagagtgaggcggatcgtttttaattttcggtaaagtgtgcgttttcgttttattatttaggggcggcggtttttgatgagtttatgggggcggggcgttaggagtttcgttcgcgagtttttttttcgttttcgcgaagtagtagttcggaattcgcggttagggattcgcgtaggtttttttttagttgaggggcggtcgggtattcgggtttcgattcgcgattatcgtatttattattattatagcgggaattgttcggcggtttttagaagtttcggttcggtcgtagaggtgggttttcgagtatagaggtttcgaaattcggttcgtagtttttagttttaatgtcggggggcgcggtggtttcgggcgattttttatttcgtttttggagtttataggtggttttataatttcgcggttcgcgttgcgttcgcggggtttagtacgttgtcgcgggatttgtttaacgtggagtgtgtgtttgttttttttcgtttcggttttcggcgtagtttttatttagaagacgaaattgaagacgaagagtaggtatttgatgtatttggtgtagttttttatttttatggcggcgcgggcggcgggcggtttgcggggcgcgggtcggttttgggcggcgggcgggtcggcgcggggtttggttggtggtcggtaaaggggtttggcgggtcgatcgggcgggggcgttaagaaatgggcgtaggggtcgtcggtacgggggcgcgtcgtgcgttttgggcgtcggaggtttggtaggatgtgcggtggggtcgtcgtcgtcgtcgtcgttgcgcgttcgttttttggtcgggcgcgcgtttgcgtttcgtagtatttatagggcgtcgcggtttcgtttttttataggtttcgttttcggttagtttacgtttcgttttcggtttcgttttttgtcgttagggcgcgtagtcgaggggtatggggtcgttgtatttatttttaatttggcgcgtttcggtt

SEQ ID NO: 760 - DNA, 1012 bp, Artificial Sequence
  chemically treated genomic DNA (Homo sapiens) CpG-island No: 760
aaccgaaacgcgccaaattaaaaataaatacaacgaccccatacccctcgactacgcgccctaacgacaaaaaacgaaaccgaaaacgaaacgtaaactaaccgaaaacgaaacctataaaaaaacgaaaccgcgacgccctataaatactacgaaacgcaaacgcgcgcccgaccaaaaaacgaacgcgcaacgacgacgacgacgacgaccccaccgcacatcctaccaaacctccgacgcccaaaacgcacgacgcgcccccgtaccgacgacccctacgcccatttcttaacgcccccgcccgatcgacccgccaaacccctttaccgaccaccaaccaaaccccgcgccgacccgcccgccgcccaaaaccgacccgcgccccgcaaaccgcccgccgcccgcgccgccataaaaataaaaaactacaccaaatacatcaaatacctactcttcgtcttcaatttcgtcttctaaataaaaactacgccgaaaaccgaaacgaaaaaaaacaaacacacactccacgttaaacaaatcccgcgacaacgtactaaaccccgcgaacgcaacgcgaaccgcgaaattataaaaccacctataaactccaaaaacgaaataaaaaatcgcccgaaaccaccgcgccccccgacattaaaactaaaaactacgaaccgaatttcgaaacctctatactcgaaaacccacctctacgaccgaaccgaaacttctaaaaaccgccgaacaattcccgctataataataataaatacgataatcgcgaatcgaaacccgaatacccgaccgcccctcaactaaaaaaaaacctacgcgaatccctaaccgcgaattccgaactactacttcgcgaaaacgaaaaaaaaactcgcgaacgaaactcctaacgccccgcccccataaactcatcaaaaaccgccgcccctaaataataaaacgaaaacgcacactttaccgaaaattaaaaacgatccgcctcactctttcccca

SEQ ID NO: 761 - DNA, 710 bp, Artificial Sequence
  chemically treated genomic DNA (Homo sapiens) CpG-island No: 761
  misc_feature (16)..(16): n is either a, c, g or t
  misc_feature (213)..(214): n is either a, c, g or t
aagcgtttcggggcgnacgcggggaagtttcggggcggtatttgttgggcgtggtttcggttagttttttcggtacggttggtagtggtcgcggtaggcgtagttgagagtcggatttaggttacgtggtagttatagaagtcgcgtaggtagcggtgtagtttcgcggcggtcgttacgttcgtggagtcgcgtattcgtacgcgcgtcgtnncgtcgtcgtttaggttgtaggtgtttaagttcggtttggtagttagagcgcgttttatcgatacggagaagtcggtcgcggggtttggttttagtagtcgggttacgagcgttcgtacggtcgtcgtttttcgggtttcgtcgtttgtcgcgttttcggtttcggttaggagaaggatttttatcgtcgcggttatcgttatcgtttttatggttttagttttgcgggtttcgcgacggttagggggtggggcggttcgcgtttaattagttgtcggttttcggttacgtggattcgaaggttaagttcgggtttagggttaggagtcgcggttttcgggtattaggatatttttttgggggcgtttcgtgatcgtacgcggtggggagcgtgtgatttcggttttagggtcgaaggggattcgttggtttttatagagcgttttcgggtaaaacgcgtttttatacgtaaataatttttatttaattatttaata

SEQ ID NO: 762 - DNA, 710 bp, Artificial Sequence
  chemically treated genomic DNA (Homo sapiens) CpG-island No: 762
  misc_feature (497)..(498): n is either a, c, g or t
  misc_feature (695)..(695): n is either a, c, g or t
tattaaataattaaataaaaattatttacgtataaaaacgcgttttacccgaaaacgctctataaaaaccaacgaatccccttcgaccctaaaaccgaaatcacacgctccccaccgcgtacgatcacgaaacgcccccaaaaaaatatcctaatacccgaaaaccgcgactcctaaccctaaacccgaacttaaccttcgaatccacgtaaccgaaaaccgacaactaattaaacgcgaaccgccccaccccctaaccgtcgcgaaacccgcaaaactaaaaccataaaaacgataacgataaccgcgacgataaaaatccttctcctaaccgaaaccgaaaacgcgacaaacgacgaaacccgaaaaacgacgaccgtacgaacgctcgtaacccgactactaaaaccaaaccccgcgaccgacttctccgtatcgataaaacgcgctctaactaccaaaccgaacttaaacacctacaacctaaacgacgacgnnacgacgcgcgtacgaatacgcgactccacgaacgtaacgaccgccgcgaaactacaccgctacctacgcgacttctataactaccacgtaacctaaatccgactctcaactacgcctaccgcgaccactaccaaccgtaccgaaaaaactaaccgaaaccacgcccaacaaataccgccccgaaacttccccgcgtncgccccgaaacgctt

SEQ ID NO: 763 - DNA, 710 bp, Artificial Sequence
  chemically treated genomic DNA (Homo sapiens) CpG-island No: 763
  misc_feature (497)..(498): n is either a, c, g or t
  misc_feature (695)..(695): n is either a, c, g or t
tattagatggttggatggaagttatttgcgtgtgaaagcgcgttttattcgaaggcgttttgtgagggttagcgggtttttttcggttttggagtcggggttatacgttttttatcgcgtgcggttacgagacgtttttaagggagtattttggtattcggaagtcgcgatttttggttttgagttcgggtttagttttcgggtttacgtggtcggaggtcggtagttgattggacgcgggtcgttttattttttggtcgtcgcgggattcgtaggattgagattatggaggcggtggcggtggtcgcggcggtgggggttttttttttggtcggggtcgggggcgcggtaggcgacgaggttcgggaggcggcggtcgtgcgggcgttcgtggttcggttgttggggttaggtttcgcggtcgattttttcgtgtcggtggagcgcgttttggttgttaagtcgggtttggatatttatagtttgggcggcggcgnngcggcgcgcgtgcgggtgcgcggttttacgggcgtggcggtcgtcgcggggttgtatcgttatttgcgcgatttttgtggttgttacgtggtttgagttcggtttttagttgcgtttgtcgcggttattgttagtcgtgtcgggggagttgatcgaggttacgtttaataggtatcgtttcgaagttttttcgcgtncgtttcgaggcgttt

SEQ ID NO: 764 - DNA, 710 bp, Artificial Sequence
  chemically treated genomic DNA (Homo sapiens) CpG-island No: 764
  misc_feature (16)..(16): n is either a, c, g or t
  misc_feature (213)..(214): n is either a, c, g or t
aaacgcctcgaaacgnacgcgaaaaaacttcgaaacgatacctattaaacgtaacctcgatcaactcccccgacacgactaacaataaccgcgacaaacgcaactaaaaaccgaactcaaaccacgtaacaaccacaaaaatcgcgcaaataacgatacaaccccgcgacgaccgccacgcccgtaaaaccgcgcacccgcacgcgcgccgcnncgccgccgcccaaactataaatatccaaacccgacttaacaaccaaaacgcgctccaccgacacgaaaaaatcgaccgcgaaacctaaccccaacaaccgaaccacgaacgcccgcacgaccgccgcctcccgaacctcgtcgcctaccgcgcccccgaccccgaccaaaaaaaaaacccccaccgccgcgaccaccgccaccgcctccataatctcaatcctacgaatcccgcgacgaccaaaaaataaaacgacccgcgtccaatcaactaccgacctccgaccacgtaaacccgaaaactaaacccgaactcaaaaccaaaaatcgcgacttccgaataccaaaatactcccttaaaaacgtctcgtaaccgcacgcgataaaaaacgtataaccccgactccaaaaccgaaaaaaacccgctaaccctcacaaaacgccttcgaataaaacgcgctttcacacgcaaataacttccatccaaccatctaata

SEQ ID NO: 765 - DNA, 570 bp, Artificial Sequence
  chemically treated genomic DNA (Homo sapiens) CpG-island No: 765
tttggcgtttttttttttcgtttcgtcggttgttggggaagcggcgggcgtttagtgtttggaggtcgttttttcgttttttttggttgcgggaacggagaggcggcggcggtcggagtagggtgggcggtttgagtcgagagttcggtcggttttcgcgaggaatatggcgatttgcggcgatcggagtagtagcggcgttagttgttgtatcgtcgattttttggagtagcgaaagcgattcgcgagaagacgtcgttaagtggaattcgggttttgcggttttgggagggggtagtatcgatatagttatgaagtttcgggcgcggcgttgggcgttaacgagagttacggtaatttttagacggcgttatagtaatttttaggtagtgtttatattagtttataggtggcgtttttcgtattgtatttgtcgcggtcgtttcgggtgtgaattgcgttgttagtagggtcgcgttgatacgggtggtttaggttcgtagtagtcgaggagtttaggggtattgttcggggtgacgagaaggagaagacggtgttttagaaaaaggt

SEQ ID NO: 766 - DNA, 570 bp, Artificial Sequence
  chemically treated genomic DNA (Homo sapiens) CpG-island No: 766
acctttttctaaaacaccgtcttctccttctcgtcaccccgaacaatacccctaaactcctcgactactacgaacctaaaccacccgtatcaacgcgaccctactaacaacgcaattcacacccgaaacgaccgcgacaaatacaatacgaaaaacgccacctataaactaatataaacactacctaaaaattactataacgccgtctaaaaattaccgtaactctcgttaacgcccaacgccgcgcccgaaacttcataactatatcgatactaccccctcccaaaaccgcaaaacccgaattccacttaacgacgtcttctcgcgaatcgctttcgctactccaaaaaatcgacgatacaacaactaacgccgctactactccgatcgccgcaaatcgccatattcctcgcgaaaaccgaccgaactctcgactcaaaccgcccaccctactccgaccgccgccgcctctccgttcccgcaaccaaaaaaaacgaaaaaacgacctccaaacactaaacgcccgccgcttccccaacaaccgacgaaacgaaaaaaaaaaacgccaaa

SEQ ID NO: 767 - DNA, 570 bp, Artificial Sequence
  chemically treated genomic DNA (Homo sapiens) CpG-island No: 767
gtttttttttggggtatcgttttttttttttcgttatttcgggtagtgtttttgggtttttcggttgttgcgggtttgggttattcgtgttagcgcggttttgttgatagcgtagtttatattcggggcggtcgcggtaggtgtagtgcgaggggcgttatttgtaggttggtgtgggtattgtttagaggttgttgtggcgtcgtttggaggttgtcgtggttttcgttggcgtttagcgtcgcgttcggggttttatggttgtgtcggtgttgtttttttttagggtcgtagggttcgggttttatttggcggcgttttttcgcgagtcgttttcgttgttttaagaagtcggcggtgtagtaattgacgtcgttgttgtttcggtcgtcgtaggtcgttatatttttcgcgggggtcggtcgggttttcggtttaggtcgtttattttgtttcggtcgtcgtcgttttttcgttttcgtagttagaggaggcgagggagcgatttttaggtattgggcgttcgtcgtttttttagtagtcggcggggcggggaagaaagacgttagg

SEQ ID NO: 768 - DNA, 570 bp, Artificial Sequence
  chemically treated genomic DNA (Homo sapiens) CpG-island No: 768
cctaacgtctttcttccccgccccgccgactactaaaaaaacgacgaacgcccaatacctaaaaatcgctccctcgcctcctctaactacgaaaacgaaaaaacgacgacgaccgaaacaaaataaacgacctaaaccgaaaacccgaccgacccccgcgaaaaatataacgacctacgacgaccgaaacaacaacgacgtcaattactacaccgccgacttcttaaaacaacgaaaacgactcgcgaaaaaacgccgccaaataaaacccgaaccctacgaccctaaaaaaaaacaacaccgacacaaccataaaaccccgaacgcgacgctaaacgccaacgaaaaccacgacaacctccaaacgacgccacaacaacctctaaacaatacccacaccaacctacaaataacgcccctcgcactacacctaccgcgaccgccccgaatataaactacgctatcaacaaaaccgcgctaacacgaataacccaaacccgcaacaaccgaaaaacccaaaaacactacccgaaataacgaaaaaaaaaaaacgataccccaaaaaaaaac

SEQ ID NO: 769 - DNA, 509 bp, Artificial Sequence
  chemically treated genomic DNA (Homo sapiens) CpG-island No: 769
ataaggacgattcggattcgttgttcgaatcggtggtgaaaaatcgcgatatggcgacggcgcggaggtgttacggtcggatttgcgggggagttaaggcgttatcggttacgcgaagaggttcgagttaatatttttcgacgtttaattttttatcggttttattcggatttcgatttgggttttttattacgaagtacgaggtttaaaaaatattaattagttgagttcgcgagttatatcgtaggttttgatagcggaaacgtcgagagagaaggcgggttttcgcgttattttcgggaagcgtcgattaattatattgggagattataatttttagtggttttcgcgttataagggggcggggataagtttgagggaatcgggcgttgagattttggttgtaggcgtcgcgaattttatcgcgcgttggtgtcgggatttaaaatacgaagatcggcggggcgtagtggtttacgcgtgtaattatagtattaataggtattaat

SEQ ID NO: 770 - DNA, 509 bp, Artificial Sequence
  chemically treated genomic DNA (Homo sapiens) CpG-island No: 770
attaatacctattaatactataattacacgcgtaaaccactacgccccgccgatcttcgtattttaaatcccgacaccaacgcgcgataaaattcgcgacgcctacaaccaaaatctcaacgcccgattccctcaaacttatccccgcccccttataacgcgaaaaccactaaaaattataatctcccaatataattaatcgacgcttcccgaaaataacgcgaaaacccgccttctctctcgacgtttccgctatcaaaacctacgatataactcgcgaactcaactaattaatattttttaaacctcgtacttcgtaataaaaaacccaaatcgaaatccgaataaaaccgataaaaaattaaacgtcgaaaaatattaactcgaacctcttcgcgtaaccgataacgccttaactcccccgcaaatccgaccgtaacacctccgcgccgtcgccatatcgcgatttttcaccaccgattcgaacaacgaatccgaatcgtccttat

SEQ ID NO: 771 - DNA, 509 bp, Artificial Sequence
  chemically treated genomic DNA (Homo sapiens) CpG-island No: 771
attaatgtttattaatgttgtaattatacgcgtgagttattgcgtttcgtcgattttcgtgttttaaatttcgatattaacgcgcggtaggattcgcgacgtttgtagttaaggttttagcgttcggtttttttaggtttgttttcgtttttttatggcgcgaaggttattgggagttgtagttttttagtgtagttagtcggcgtttttcggaagtgacgcgaggattcgttttttttttcggcgttttcgttgttagggtttgcggtgtgattcgcgggtttagttggttggtattttttgggtttcgtgtttcgtggtgggagatttaggtcgaggttcgggtggggtcggtgaggggttgggcgtcgggaggtgttggttcgggttttttcgcgtggtcggtgacgttttggttttttcgtaggttcggtcgtagtattttcgcgtcgtcgttatgtcgcggttttttattatcggttcggatagcgagttcgagtcgtttttgt

SEQ ID NO: 772 - DNA, 509 bp, Artificial Sequence
  chemically treated genomic DNA (Homo sapiens) CpG-island No: 772
acaaaaacgactcgaactcgctatccgaaccgataataaaaaaccgcgacataacgacgacgcgaaaatactacgaccgaacctacgaaaaaaccaaaacgtcaccgaccacgcgaaaaaacccgaaccaacacctcccgacgcccaacccctcaccgaccccacccgaacctcgacctaaatctcccaccacgaaacacgaaacccaaaaaataccaaccaactaaacccgcgaatcacaccgcaaaccctaacaacgaaaacgccgaaaaaaaaaacgaatcctcgcgtcacttccgaaaaacgccgactaactacactaaaaaactacaactcccaataaccttcgcgccataaaaaaacgaaaacaaacctaaaaaaaccgaacgctaaaaccttaactacaaacgtcgcgaatcctaccgcgcgttaatatcgaaatttaaaacacgaaaatcgacgaaacgcaataactcacgcgtataattacaacattaataaacattaat

SEQ ID NO: 773 - DNA, 892 bp, Artificial Sequence
  chemically treated genomic DNA (Homo sapiens) CpG-island No: 773
gttgtatacgtttgattcggttatttgtttattcgattattaagcgaaatatcgtatcgagcgagtacgtattcggatggaagtcggttttgtcgattaggatgatttggacgaagagtattaggggttcgcgttagtcgaattgttcgttaggtttaaggcgcgtatgttcgacggcgaggatttcgtcgtgatttatggcgatgtttgtttgtcgaatattatggtggaaaatggtcgtttttttggatttatcgattgtggtcggttgggtgtggcggatcgttattaggatatagcgttggttattcgtgatattgttgaagagtttggcggcgaatgggttgatcgttttttcgtgttttacggtatcgtcgttttcgattcgtagcgtatcgttttttatcgtttttttgacgagtttttttgagcgggattttggggttcgaaatgatcgattaagcgacgtttaatttgttattacgagatttcgattttatcgtcgttttttatgaaaggttgggtttcggaatcgtttttcgggacgtcggttggatgattttttagcgcggggattttatgttggagtttttcgtttatttcgggttcgattttttcgcgagttggtttagttgttgtttgaggttggacgatttcgcggagttttatcggtagtgtaaattcgtcggtatttaggaaattagtagcggttattcgcgtatttatgttttcgaattgtaggagtggggaggtacgatggtcgttttggtttcggattaattcgcgcgatcggatcgattcgggtaacgttgttgttattgttgtagggggggggggggggggttttattgtttattttacggataaaaatagagaaaggaaacgatagagg

SEQ ID NO: 774 - DNA, 892 bp, Artificial Sequence
  chemically treated genomic DNA (Homo sapiens) CpG-island No: 774
cctctatcgtttcctttctctatttttatccgtaaaataaacaataaaaccccccccccccccccctacaacaataacaacaacgttacccgaatcgatccgatcgcgcgaattaatccgaaaccaaaacgaccatcgtacctccccactcctacaattcgaaaacataaatacgcgaataaccgctactaatttcctaaataccgacgaatttacactaccgataaaactccgcgaaatcgtccaacctcaaacaacaactaaaccaactcgcgaaaaaatcgaacccgaaataaacgaaaaactccaacataaaatccccgcgctaaaaaatcatccaaccgacgtcccgaaaaacgattccgaaacccaacctttcataaaaaacgacgataaaatcgaaatctcgtaataacaaattaaacgtcgcttaatcgatcatttcgaaccccaaaatcccgctcaaaaaaactcgtcaaaaaaacgataaaaaacgatacgctacgaatcgaaaacgacgataccgtaaaacacgaaaaaacgatcaacccattcgccgccaaactcttcaacaatatcacgaataaccaacgctatatcctaataacgatccgccacacccaaccgaccacaatcgataaatccaaaaaaacgaccattttccaccataatattcgacaaacaaacatcgccataaatcacgacgaaatcctcgccgtcgaacatacgcgccttaaacctaacgaacaattcgactaacgcgaacccctaatactcttcgtccaaatcatcctaatcgacaaaaccgacttccatccgaatacgtactcgctcgatacgatatttcgcttaataatcgaataaacaaataaccgaatcaaacgtatacaac

SEQ ID NO: 775 - DNA, 892 bp, Artificial Sequence
  chemically treated genomic DNA (Homo sapiens) CpG-island No: 775
tttttgtcgttttttttttttgtttttgttcgtggaatgaataatggaattttttttttttttttttgtagtaatggtaataacgttgttcggatcgattcggtcgcgcgaattgattcgggattaaagcggttatcgtgtttttttatttttgtagttcgggggtatggatgcgcggatagtcgttgttggttttttggatgtcgacggatttgtattgtcggtagaatttcgcgaggtcgtttagttttaggtagtagttgaattaattcgcgaggggatcgagttcggggtgggcgaagaattttagtatgagattttcgcgttggaggattatttagtcggcgtttcggaaaacgatttcgaagtttaattttttatagaaggcggcggtggaatcgaaatttcgtgatggtaggttgggcgtcgtttggtcggttatttcgaattttagagtttcgtttagaagaattcgttaagaaggcgatagaaggcgatgcgttgcgaatcgggagcggcgatatcgtaaagtacgaggaagcggttagtttattcgtcgttaagttttttagtaatattacgggtagttaacgttatgttttgatagcggttcgttatatttagtcggttatagtcgatgaatttagaaaagcggttattttttattatgatattcggtaagtaggtatcgttatgggttacgacgagattttcgtcgtcgggtatgcgcgttttgagtttggcgaatagttcggttggcgcgagtttttgatgtttttcgtttagattattttgatcgataagatcggtttttattcgagtacgtgttcgttcgatgcgatgtttcgtttggtggtcgaatgggtaggtagtcggattaagcgtatgtagt

SEQ ID NO: 776 - DNA, 892 bp, Artificial Sequence
  chemically treated genomic DNA (Homo sapiens) CpG-island No: 776
actacatacgcttaatccgactacctacccattcgaccaccaaacgaaacatcgcatcgaacgaacacgtactcgaataaaaaccgatcttatcgatcaaaataatctaaacgaaaaacatcaaaaactcgcgccaaccgaactattcgccaaactcaaaacgcgcatacccgacgacgaaaatctcgtcgtaacccataacgatacctacttaccgaatatcataataaaaaataaccgcttttctaaattcatcgactataaccgactaaatataacgaaccgctatcaaaacataacgttaactacccgtaatattactaaaaaacttaacgacgaataaactaaccgcttcctcgtactttacgatatcgccgctcccgattcgcaacgcatcgccttctatcgccttcttaacgaattcttctaaacgaaactctaaaattcgaaataaccgaccaaacgacgcccaacctaccatcacgaaatttcgattccaccgccgccttctataaaaaattaaacttcgaaatcgttttccgaaacgccgactaaataatcctccaacgcgaaaatctcatactaaaattcttcgcccaccccgaactcgatcccctcgcgaattaattcaactactacctaaaactaaacgacctcgcgaaattctaccgacaatacaaatccgtcgacatccaaaaaaccaacaacgactatccgcgcatccatacccccgaactacaaaaataaaaaaacacgataaccgctttaatcccgaatcaattcgcgcgaccgaatcgatccgaacaacgttattaccattactacaaaaaaaaaaaaaaaaaattccattattcattccacgaacaaaaacaaaaaaaaaaaacgacaaaaa

SEQ ID NO: 777 - DNA, 562 bp, Artificial Sequence
  chemically treated genomic DNA (Homo sapiens) CpG-island No: 777
tgcggttttacggcgtaatttcgtattagtaagcgtattggttcgtatgttttgatataggttggtaattagttagtagtgcgcgtttgatttttacggataagatttcgtattcggatataggtttcgttttcggtaatattcgtaaattatattaattagttcgttgacgtttggtagttcggcggtaacggatgttttttttcggtattatgtaataaattgttcgggtgatggtagaaatggtcgattttgtcgacgggttacgcgtatttttgcgttaatttgttttatcgtggtgatttcgttttttcgaaaagttagaatttattggcgacggatttcgtttatttcgttttggttacggttagttaggttcgtcgggaaagttgttagtaattggttgaatatatcgttgatgatttgcgttatttgttgtatttgcggtttttcgtcgtattgtttcggtatgttgttggcgattcgacgtatttgtttacggttaaagttaattatttgtgcggcgatgttttttatagatttatttcgtaaatttagtttg

SEQ ID NO: 778 - DNA, 562 bp, Artificial Sequence
  chemically treated genomic DNA (Homo sapiens) CpG-island No: 778
caaactaaatttacgaaataaatctataaaaaacatcgccgcacaaataattaactttaaccgtaaacaaatacgtcgaatcgccaacaacataccgaaacaatacgacgaaaaaccgcaaatacaacaaataacgcaaatcatcaacgatatattcaaccaattactaacaactttcccgacgaacctaactaaccgtaaccaaaacgaaataaacgaaatccgtcgccaataaattctaacttttcgaaaaaacgaaatcaccacgataaaacaaattaacgcaaaaatacgcgtaacccgtcgacaaaatcgaccatttctaccatcacccgaacaatttattacataataccgaaaaaaaacatccgttaccgccgaactaccaaacgtcaacgaactaattaatataatttacgaatattaccgaaaacgaaacctatatccgaatacgaaatcttatccgtaaaaatcaaacgcgcactactaactaattaccaacctatatcaaaacatacgaaccaatacgcttactaatacgaaattacgccgtaaaaccgca

SEQ ID NO: 779 - DNA, 562 bp, Artificial Sequence
  chemically treated genomic DNA (Homo sapiens) CpG-island No: 779
tagattggatttacggggtggatttatgaaaaatatcgtcgtatagatggttaattttgatcgtgagtagatgcgtcggatcgttaataatatgtcggaatagtacgacgaaaagtcgtaggtatagtaggtagcgtagattattaacggtgtgtttagttagttattggtaattttttcggcgagtttggttaatcgtgattagaacgaagtgaacgaaattcgtcgttagtgggttttggtttttcgggaaaacgggattattacgatggaataggttaacgtaggaatgcgcgtagttcgtcggtagaatcgattatttttgttattattcgggtagtttgttgtatggtgtcgggaagaagtattcgttatcgtcggattgttaaacgttagcgagttggttgatatggtttacgagtattgtcggaagcgaggtttgtattcggatgcggagttttattcgtggaaattaaacgcgtattattggttggttattaatttgtattagaatatgcgggttaatgcgtttattgatgcggaattacgtcgtaaggtcgta

SEQ ID NO: 780 - DNA, 562 bp, Artificial Sequence
  chemically treated genomic DNA (Homo sapiens) CpG-island No: 780
tacgaccttacgacgtaattccgcatcaataaacgcattaacccgcatattctaatacaaattaataaccaaccaataatacgcgtttaatttccacgaataaaactccgcatccgaatacaaacctcgcttccgacaatactcgtaaaccatatcaaccaactcgctaacgtttaacaatccgacgataacgaatacttcttcccgacaccatacaacaaactacccgaataataacaaaaataatcgattctaccgacgaactacgcgcattcctacgttaacctattccatcgtaataatcccgttttcccgaaaaaccaaaacccactaacgacgaatttcgttcacttcgttctaatcacgattaaccaaactcgccgaaaaaattaccaataactaactaaacacaccgttaataatctacgctacctactatacctacgacttttcgtcgtactattccgacatattattaacgatccgacgcatctactcacgatcaaaattaaccatctatacgacgatatttttcataaatccaccccgtaaatccaatcta

SEQ ID NO: 781 - DNA, 643 bp, Artificial Sequence
  chemically treated genomic DNA (Homo sapiens) CpG-island No: 781
atagtgggcgttttttaaacgcggttttcgttcggtcgttcgggtttcgtttttttcggttagtttaggttttttatttttgtagatttgtttttatagatttttgtttgacggttcggtgatttgttacgacgagataggtagttcgcgggacgcgagagatacggtgggtatcggcgttcgggtgaacgacgagtttgtagagtagttgggtttgaggcgtattatgtggttggggatttgtcgcggtgtcgttatggtcgcggtttttacggtaatcgcgttcgtcggaaggtcgcgattcggaagaagtcggaattcgagagggtgggtcggcgattcgaagtggattttcgggttacggcggagttggtttttacgtggaggcggggaaatttcgtttatcggtgagtgttagggcgcgttgtaggcgggtcggcgcggggtgtggagattgtattagaggaagtgcgcggcggggaagatggggaaatgcggtttatttatatttttgaattcgatttttttagtcggtgtgcgttcgtttcggtttgaggtcgtcgtttttagaaagttttttcgttttagagtcggttttgggattttacgtaattttttttagtttgttgatgcggaggtttgg

SEQ ID NO: 782 - DNA, 643 bp, Artificial Sequence
  chemically treated genomic DNA (Homo sapiens) CpG-island No: 782
ccaaacctccgcatcaacaaactaaaaaaaattacgtaaaatcccaaaaccgactctaaaacgaaaaaactttctaaaaacgacgacctcaaaccgaaacgaacgcacaccgactaaaaaaatcgaattcaaaaatataaataaaccgcatttccccatcttccccgccgcgcacttcctctaatacaatctccacaccccgcgccgacccgcctacaacgcgccctaacactcaccgataaacgaaatttccccgcctccacgtaaaaaccaactccgccgtaacccgaaaatccacttcgaatcgccgacccaccctctcgaattccgacttcttccgaatcgcgaccttccgacgaacgcgattaccgtaaaaaccgcgaccataacgacaccgcgacaaatccccaaccacataatacgcctcaaacccaactactctacaaactcgtcgttcacccgaacgccgatacccaccgtatctctcgcgtcccgcgaactacctatctcgtcgtaacaaatcaccgaaccgtcaaacaaaaatctataaaaacaaatctacaaaaataaaaaacctaaactaaccgaaaaaaacgaaacccgaacgaccgaacgaaaaccgcgtttaaaaaacgcccactat

SEQ ID NO: 783 - DNA, 643 bp, Artificial Sequence
  chemically treated genomic DNA (Homo sapiens) CpG-island No: 783
ttaagttttcgtattaatagattgggagggattacgtggggttttagggtcggttttgaggcgggaaaattttttggaggcggcggttttaggtcggagcgggcgtatatcgattggaggggtcggatttagggatgtgggtggatcgtatttttttatttttttcgtcgcgtattttttttggtgtaatttttatatttcgcgtcggttcgtttgtaacgcgttttggtatttatcggtgggcgaaattttttcgtttttacgtgagagttagtttcgtcgtgattcggaagtttatttcgagtcgtcggtttattttttcgggtttcggtttttttcgggtcgcggtttttcggcgaacgcggttatcgtggaaatcgcggttatggcggtatcgcggtaaatttttagttatatagtgcgttttaagtttagttgttttatagattcgtcgtttattcggacgtcggtgtttatcgtgtttttcgcgtttcgcgagttgtttgtttcgtcgtggtaggttatcgagtcgttaagtaagaatttgtgggagtagatttgtaagggtaggaaatttgggttggtcgagaggggcgggattcgggcggtcggacgggggtcgcgtttggggagcgtttattgt

SEQ ID NO: 784 - DNA, 643 bp, Artificial Sequence
  chemically treated genomic DNA (Homo sapiens) CpG-island No: 784
acaataaacgctccccaaacgcgacccccgtccgaccgcccgaatcccgcccctctcgaccaacccaaatttcctacccttacaaatctactcccacaaattcttacttaacgactcgataacctaccacgacgaaacaaacaactcgcgaaacgcgaaaaacacgataaacaccgacgtccgaataaacgacgaatctataaaacaactaaacttaaaacgcactatataactaaaaatttaccgcgataccgccataaccgcgatttccacgataaccgcgttcgccgaaaaaccgcgacccgaaaaaaaccgaaacccgaaaaaataaaccgacgactcgaaataaacttccgaatcacgacgaaactaactctcacgtaaaaacgaaaaaatttcgcccaccgataaataccaaaacgcgttacaaacgaaccgacgcgaaatataaaaattacaccaaaaaaaatacgcgacgaaaaaaataaaaaaatacgatccacccacatccctaaatccgacccctccaatcgatatacgcccgctccgacctaaaaccgccgcctccaaaaaattttcccgcctcaaaaccgaccctaaaaccccacgtaatccctcccaatctattaatacgaaaacttaa

SEQ ID NO: 785 - DNA, 640 bp, Artificial Sequence
  chemically treated genomic DNA (Homo sapiens) CpG-island No: 785
cgggttttgcgttcgttcgttcgttcgttaggttaggtcgttcgttgatcggttttggagttgtaggtcgggtcgttttcgaggttttttatagaagttgatgttcgggtgcgtggcgagggttcgttagagaaatttttgcgtgtagggttttaaaggtagcgggaagggcggtattcgcgtttttagtcggttttatagcgttggtagatataggttatcgagtttttttagagcgatttcgtttaataacgattttagcgcgtttattgttattttagtcggcggcgttcggggcgtatgcgtaacgtatcgttaagggttttggtttatcgcgtttgcgtataacgattcggggttcggggaggtgggttagatttagggttcggaggaggagttttagcgcgtcggtatgacgttatttttcgggggcgggtttagtaagtggagttttatcgttattggttcggggtttcgtagtaattaggggaattgtaaatagtgtagaggtcgttttcggttcgagttttcggaatcgtcgtttttagggatggacggtgagtgtttgtgggttttttcgggaggtcgggttgttatttttttatttttttcgatcgcgttttgggtagaattttaggtt

SEQ ID NO: 786 - DNA, 640 bp, Artificial Sequence
  chemically treated genomic DNA (Homo sapiens) CpG-island No: 786
aacctaaaattctacccaaaacgcgatcgaaaaaaataaaaaaataacaacccgacctcccgaaaaaacccacaaacactcaccgtccatccctaaaaacgacgattccgaaaactcgaaccgaaaacgacctctacactatttacaattcccctaattactacgaaaccccgaaccaataacgataaaactccacttactaaacccgcccccgaaaaataacgtcataccgacgcgctaaaactcctcctccgaaccctaaatctaacccacctccccgaaccccgaatcgttatacgcaaacgcgataaaccaaaacccttaacgatacgttacgcatacgccccgaacgccgccgactaaaataacaataaacgcgctaaaatcgttattaaacgaaatcgctctaaaaaaactcgataacctatatctaccaacgctataaaaccgactaaaaacgcgaataccgcccttcccgctacctttaaaaccctacacgcaaaaatttctctaacgaaccctcgccacgcacccgaacatcaacttctataaaaaacctcgaaaacgacccgacctacaactccaaaaccgatcaacgaacgacctaacctaacgaacgaacgaacgaacgcaaaacccg

SEQ ID NO: 787 - DNA, 640 bp, Artificial Sequence
  chemically treated genomic DNA (Homo sapiens) CpG-island No: 787
ggtttaggattttgtttaaagcgcggtcgggagggatgggagaataatagttcgatttttcggaggggtttatagatatttatcgtttatttttagaggcggcggtttcgggagttcgaatcggaagcggtttttatattgtttgtagtttttttggttattgcggggtttcggattaatgacggtggagttttatttattgagttcgttttcggggagtgacgttatgtcggcgcgttggaatttttttttcgaattttgggtttgatttattttttcgggtttcggatcgttgtgcgtaggcgcgatggattaaggtttttggcggtgcgttgcgtatgcgtttcgggcgtcgtcgattgaagtagtaatggacgcgttggagtcgttgttggacgaagtcgttttggaggggttcgatggtttgtgtttgttagcgttgtggagtcggttggagacgcgagtgtcgtttttttcgttgtttttggaattttgtacgtaggagtttttttggcgggttttcgttacgtattcgggtattagtttttatgaggagtttcgggagcgattcgatttatagttttaggatcggttagcgggcggtttggtttggcgggcgggcgggcgggcgtagggttcg

SEQ ID NO: 788 - DNA, 640 bp, Artificial Sequence
  chemically treated genomic DNA (Homo sapiens) CpG-island No: 788
cgaaccctacgcccgcccgcccgcccgccaaaccaaaccgcccgctaaccgatcctaaaactataaatcgaatcgctcccgaaactcctcataaaaactaatacccgaatacgtaacgaaaacccgccaaaaaaactcctacgtacaaaattccaaaaacaacgaaaaaaacgacactcgcgtctccaaccgactccacaacgctaacaaacacaaaccatcgaacccctccaaaacgacttcgtccaacaacgactccaacgcgtccattactacttcaatcgacgacgcccgaaacgcatacgcaacgcaccgccaaaaaccttaatccatcgcgcctacgcacaacgatccgaaacccgaaaaaataaatcaaacccaaaattcgaaaaaaaaattccaacgcgccgacataacgtcactccccgaaaacgaactcaataaataaaactccaccgtcattaatccgaaaccccgcaataaccaaaaaaactacaaacaatataaaaaccgcttccgattcgaactcccgaaaccgccgcctctaaaaataaacgataaatatctataaacccctccgaaaaatcgaactattattctcccatccctcccgaccgcgctttaaacaaaatcctaaacc

SEQ ID NO: 789 - DNA, 724 bp, Artificial Sequence
  chemically treated genomic DNA (Homo sapiens) CpG-island No: 789
  misc_feature (96)..(96): n is either a, c, g or t
  misc_feature (237)..(237): n is either a, c, g or t
ttgtagtagtaagcgtcgtatatttcggggcgggggtagggagggggcgtcggggtcgggcgggggttatttatcgggcgtggggagtagcgatanagtagagtcgcgaacgtttagcgtcgtagtagttttatggttcgtttatttttttcggttcgggggttgcggttgttagcggcgcggggagggcgggaatagggacgggggtggggaggcgttattgcggagtcggggcgngggcgcggggtcgggcgggggtcgcggagaggtgggggcggtagggacggcgtcggggtttagcgcgtttcggtcgcggttatttcggcggggcggcggggcgggtttaagagttgagtagcgagtacgtgagtttagggttcgtttttcgttttttcgtcgtttttcggtttttttagtttcgtagtttcgggtcgtcgtcgcgagggataaaagaggcgtcgttcggggttttttttcgtatttcgaagttttttcggtaggtgcggggcggtggcgtttcgcgtatttatttcgcggttttttttcggttatttttgtttgagtattttcgaggattcgtagatttgtaggggagggaagtaggggacggggtattttcggggtcgattcggcgattgtttgtttggggttcgggggtaggggcgtggttgcggcgtttacgttcgtttttttgtcgtggtattttagagaggttgttttagtt

SEQ ID NO: 790 - DNA, 724 bp, Artificial Sequence
  chemically treated genomic DNA (Homo sapiens) CpG-island No: 790
  misc_feature (488)..(488): n is either a, c, g or t
  misc_feature (629)..(629): n is either a, c, g or t
aactaaaacaacctctctaaaataccacgacaaaaaaacgaacgtaaacgccgcaaccacgcccctacccccgaaccccaaacaaacaatcgccgaatcgaccccgaaaataccccgtcccctacttccctcccctacaaatctacgaatcctcgaaaatactcaaacaaaaataaccgaaaaaaaaccgcgaaataaatacgcgaaacgccaccgccccgcacctaccgaaaaaacttcgaaatacgaaaaaaaaccccgaacgacgcctcttttatccctcgcgacgacgacccgaaactacgaaactaaaaaaaccgaaaaacgacgaaaaaacgaaaaacgaaccctaaactcacgtactcgctactcaactcttaaacccgccccgccgccccgccgaaataaccgcgaccgaaacgcgctaaaccccgacgccgtccctaccgcccccacctctccgcgacccccgcccgaccccgcgcccncgccccgactccgcaataacgcctccccacccccgtccctattcccgccctccccgcgccgctaacaaccgcaacccccgaaccgaaaaaaataaacgaaccataaaactactacgacgctaaacgttcgcgactctactntatcgctactccccacgcccgataaataacccccgcccgaccccgacgccccctccctacccccgccccgaaatatacgacgcttactactacaa

SEQ ID NO: 791 - DNA, 724 bp, Artificial Sequence
  chemically treated genomic DNA (Homo sapiens) CpG-island No: 791
  misc_feature (488)..(488): n is either a, c, g or t
  misc_feature (629)..(629): n is either a, c, g or t
ggttggggtagtttttttggggtattacgatagaggggcgaacgtgggcgtcgtagttacgtttttgttttcgggttttagataggtagtcgtcgggtcgatttcgggggtatttcgttttttgttttttttttttataaatttacgagttttcggagatgtttaggtagaggtggtcgaggagaggtcgcgggataagtacgcggagcgttatcgtttcgtatttgtcgaggagatttcgaggtgcgaggagggatttcgggcggcgttttttttgtttttcgcggcggcggttcggggttgcggggttgggggggtcggggggcggcgggagagcggagggcgggttttgggtttacgtgttcgttgtttagtttttaaattcgtttcgtcgtttcgtcgggatggtcgcggtcggagcgcgttgagtttcggcgtcgtttttgtcgtttttattttttcgcgattttcgttcggtttcgcgtttncgtttcggtttcgtagtggcgtttttttattttcgtttttgttttcgtttttttcgcgtcgttggtagtcgtagttttcggatcgggaggaatgagcgagttatgaggttgttgcggcgttgggcgttcgcggttttgttntgtcgttgttttttacgttcggtgagtgattttcgttcggtttcggcgttttttttttgttttcgtttcgggatgtgcggcgtttgttgttgtag

SEQ ID NO: 792 - DNA, 724 bp, Artificial Sequence
  chemically treated genomic DNA (Homo sapiens) CpG-island No: 792
  misc_feature (96)..(96): n is either a, c, g or t
  misc_feature (237)..(237): n is either a, c, g or t
ctacaacaacaaacgccgcacatcccgaaacgaaaacaaaaaaaaaacgccgaaaccgaacgaaaatcactcaccgaacgtaaaaaacaacgacanaacaaaaccgcgaacgcccaacgccgcaacaacctcataactcgctcattcctcccgatccgaaaactacgactaccaacgacgcgaaaaaaacgaaaacaaaaacgaaaataaaaaaacgccactacgaaaccgaaacgnaaacgcgaaaccgaacgaaaatcgcgaaaaaataaaaacgacaaaaacgacgccgaaactcaacgcgctccgaccgcgaccatcccgacgaaacgacgaaacgaatttaaaaactaaacaacgaacacgtaaacccaaaacccgccctccgctctcccgccgccccccgacccccccaaccccgcaaccccgaaccgccgccgcgaaaaacaaaaaaaacgccgcccgaaatccctcctcgcacctcgaaatctcctcgacaaatacgaaacgataacgctccgcgtacttatcccgcgacctctcctcgaccacctctacctaaacatctccgaaaactcgtaaatttataaaaaaaaaaaacaaaaaacgaaatacccccgaaatcgacccgacgactacctatctaaaacccgaaaacaaaaacgtaactacgacgcccacgttcgcccctctatcgtaataccccaaaaaaactaccccaacc

SEQ ID NO: 793 - DNA, 568 bp, Artificial Sequence
  chemically treated genomic DNA (Homo sapiens) CpG-island No: 793
ttagttttcgaacgaatttttttttaattttcgggaggtaggagttttagcggggagatgcgggaagttttagacgagttcgtacgtcgtcggagacgtagggatcgaggtcggggagataaagagtagttcgcgaagagttcgggcggcgaggggcggttcggtttcgttttgcgtttttaatcgttcgggtagttgtcggtatcgcggggcgtcgtcgagtgcgcgtcgtttttgttcgggtttttcgatcgtcgttcgatattttcgcggtttaggatattttcgagtcgtttttttttcgatttgggagtcgcgcgtttggggataaagagggagggtgcgtcggggatagtggtaggacgcgggtcggcgacgtttttcggattcggcgggaattttcggcggcgttttttttttttttcgttttggtcgcgttttttcggattcggagttttttcggttttttcggcgtttaagagttttcgtttttttggattcgtttggtcgtttgggattataagtatgagttaatacgtttagttttttggatttttttttttttttt

SEQ ID NO: 794 - DNA, 568 bp, Artificial Sequence
  chemically treated genomic DNA (Homo sapiens) CpG-island No: 794
aaaaaaaaaaaaaaaatccaaaaaactaaacgtattaactcatacttataatcccaaacgaccaaacgaatccaaaaaaacgaaaactcttaaacgccgaaaaaaccgaaaaaactccgaatccgaaaaaacgcgaccaaaacgaaaaaaaaaaaaaacgccgccgaaaattcccgccgaatccgaaaaacgtcgccgacccgcgtcctaccactatccccgacgcaccctccctctttatccccaaacgcgcgactcccaaatcgaaaaaaaaacgactcgaaaatatcctaaaccgcgaaaatatcgaacgacgatcgaaaaacccgaacaaaaacgacgcgcactcgacgacgccccgcgataccgacaactacccgaacgattaaaaacgcaaaacgaaaccgaaccgcccctcgccgcccgaactcttcgcgaactactctttatctccccgacctcgatccctacgtctccgacgacgtacgaactcgtctaaaacttcccgcatctccccgctaaaactcctacctcccgaaaattaaaaaaaaattcgttcgaaaactaa

SEQ ID NO: 795 - DNA, 568 bp, Artificial Sequence
  chemically treated genomic DNA (Homo sapiens) CpG-island No: 795
aaaaaaaaaaaaaaaatttagggggttaggcgtgttggtttatgtttgtaattttaaacggttaggcgggtttagggaagcggagatttttggacgtcgggagggtcgagagaatttcgagttcgggagagcgcggttagagcgggagaaggagggggcgtcgtcgagggttttcgtcgagttcggagggcgtcgtcggttcgcgttttgttattgttttcggcgtattttttttttttgtttttaggcgcgcggtttttaaatcgggagggaaacggttcgggggtgttttgggtcgcggaggtgtcgggcgacggtcggggagttcggatagaagcggcgcgtattcggcggcgtttcgcggtgtcgataattattcgggcggttaggggcgtagggcggagtcgggtcgtttttcgtcgttcgggtttttcgcgggttgttttttgttttttcgatttcgatttttgcgttttcggcggcgtgcgggttcgtttgaggtttttcgtattttttcgttggaatttttgtttttcgggggttagaggagggttcgttcgagggttgg

SEQ ID NO: 796 - DNA, 568 bp, Artificial Sequence
  chemically treated genomic DNA (Homo sapiens) CpG-island No: 796
ccaaccctcgaacgaaccctcctctaacccccgaaaaacaaaaattccaacgaaaaaatacgaaaaacctcaaacgaacccgcacgccgccgaaaacgcaaaaatcgaaatcgaaaaaacaaaaaacaacccgcgaaaaacccgaacgacgaaaaacgacccgactccgccctacgcccctaaccgcccgaataattatcgacaccgcgaaacgccgccgaatacgcgccgcttctatccgaactccccgaccgtcgcccgacacctccgcgacccaaaacacccccgaaccgtttccctcccgatttaaaaaccgcgcgcctaaaaacaaaaaaaaaaaatacgccgaaaacaataacaaaacgcgaaccgacgacgccctccgaactcgacgaaaaccctcgacgacgccccctccttctcccgctctaaccgcgctctcccgaactcgaaattctctcgaccctcccgacgtccaaaaatctccgcttccctaaacccgcctaaccgtttaaaattacaaacataaaccaacacgcctaaccccctaaatttttttttttttttt

SEQ ID NO: 797 - DNA, 509 bp, Artificial Sequence
  chemically treated genomic DNA (Homo sapiens) CpG-island No: 797
ttcggtagcgtttcgttttgggtttggttttgggcggtcggttgttgattgcgattgcgcgtttcgaggtttgtagagacggttcggggtatttgttatcgtatcgtttaagatcggaagcggaaatggaatcgagatagtttcgcgcgtttagttggtcgtcgttatttttacgttttaggtcgggtcgatttacggagtcgtcggaagcggaagtcgttgaggggtggtgaagcggttgggaaagtgtcggtttattttcgcgttttttgcgtttttgtcgcggtttgtttgggtaggtaaagcgcgattgcgagagttcggtaattttgtcgatttagtcggaatcggttttcggttcgaggggcgtggtgttttggtgtttcgatttttttcgtaggttttttgggattcgcggtttcgggagttttttgtttagggttttttttttgtagtgaggcgtcgttcgttttttttgtgttttcgtagatttttattatgggtaatat

SEQ ID NO: 798 - DNA, 509 bp, Artificial Sequence
  chemically treated genomic DNA (Homo sapiens) CpG-island No: 798
atattacccataataaaaatctacgaaaacacaaaaaaaacgaacgacgcctcactacaaaaaaaaaaccctaaacaaaaaactcccgaaaccgcgaatcccaaaaaacctacgaaaaaaatcgaaacaccaaaacaccacgcccctcgaaccgaaaaccgattccgactaaatcgacaaaattaccgaactctcgcaatcgcgctttacctacccaaacaaaccgcgacaaaaacgcaaaaaacgcgaaaataaaccgacactttcccaaccgcttcaccacccctcaacgacttccgcttccgacgactccgtaaatcgacccgacctaaaacgtaaaaataacgacgaccaactaaacgcgcgaaactatctcgattccatttccgcttccgatcttaaacgatacgataacaaataccccgaaccgtctctacaaacctcgaaacgcgcaatcgcaatcaacaaccgaccgcccaaaaccaaacccaaaacgaaacgctaccgaa

SEQ ID NO: 799 - DNA, 509 bp, Artificial Sequence
  chemically treated genomic DNA (Homo sapiens) CpG-island No: 799
gtattgtttatgatgggggtttgcggggatatagggaaggcggacggcgttttattgtaggaaagggattttgagtaagggattttcggaatcgcgggttttaaggagtttgcggaaggagtcggagtattaggatattacgtttttcgggtcgggagtcggtttcggttgagtcggtagggttgtcgagttttcgtaatcgcgttttatttgtttaggtaagtcgcggtaagaacgtaaggggcgcgaagataaatcgatatttttttaatcgttttattattttttagcgattttcgttttcggcgatttcgtaagtcggttcggtttagggcgtggaggtggcggcggttagttaaacgcgcgaggttatttcgattttattttcgttttcggttttgagcggtgcggtaataggtgtttcgggtcgtttttgtaggtttcggagcgcgtagtcgtagttagtagtcggtcgtttagggttaggtttaggacgaggcgttgtcgag

SEQ ID NO: 800 - DNA, 509 bp, Artificial Sequence
  chemically treated genomic DNA (Homo sapiens) CpG-island No: 800
ctcgacaacgcctcgtcctaaacctaaccctaaacgaccgactactaactacgactacgcgctccgaaacctacaaaaacgacccgaaacacctattaccgcaccgctcaaaaccgaaaacgaaaataaaatcgaaataacctcgcgcgtttaactaaccgccgccacctccacgccctaaaccgaaccgacttacgaaatcgccgaaaacgaaaatcgctaaaaaataataaaacgattaaaaaaatatcgatttatcttcgcgccccttacgttcttaccgcgacttacctaaacaaataaaacgcgattacgaaaactcgacaaccctaccgactcaaccgaaaccgactcccgacccgaaaaacgtaatatcctaatactccgactccttccgcaaactccttaaaacccgcgattccgaaaatcccttactcaaaatccctttcctacaataaaacgccgtccgccttccctatatccccgcaaacccccatcataaacaatac

SEQ ID NO: 801 - DNA, 569 bp, Artificial Sequence
  chemically treated genomic DNA (Homo sapiens) CpG-island No: 801
gatgggggaggggagaggacggggggagggggatttataaagttgcggggttgtagttcggattgcggtttcgcggcgcgggcgaggcgtaatttcggtttggttttcgcggcgcggcgtagcgaggttttttcgggtcgttcgttcggttttcgtagtaacgtagtttgcgttttttcgtcgaggttcgaagtttcggggacgttcggcgtcgtcgtttttgttgtcgtcgtcgcgggttgcgggttttgcggtagcgttcgcggtttttttcgttcggagggaggtttttgtttcgtttattttatgtgtgtaaagtgtacgagtaagtggggcgcggcgaaggaggttcgcgagttttaagtttttcgtagcgtcgcggggagaggttcgagtcgttgtattagcgttattttttatatcgattcgttgtcgtcgtcgtcgtcgtcgtcgtcgtcgtcgtcgatatcgtcgtcgtcgtaggttttagatcggaagtgaatgttttattcggtaatttttttcgggggcgttacggttattggtttttaagatggaggttttagtaa

SEQ ID NO: 802 - DNA, 569 bp, Artificial Sequence
  chemically treated genomic DNA (Homo sapiens) CpG-island No: 802
ttactaaaacctccatcttaaaaaccaataaccgtaacgcccccgaaaaaaattaccgaataaaacattcacttccgatctaaaacctacgacgacgacgatatcgacgacgacgacgacgacgacgacgacgacgacaacgaatcgatataaaaaataacgctaatacaacgactcgaacctctccccgcgacgctacgaaaaacttaaaactcgcgaacctccttcgccgcgccccacttactcgtacactttacacacataaaataaacgaaacaaaaacctccctccgaacgaaaaaaaccgcgaacgctaccgcaaaacccgcaacccgcgacgacgacaacaaaaacgacgacgccgaacgtccccgaaacttcgaacctcgacgaaaaaacgcaaactacgttactacgaaaaccgaacgaacgacccgaaaaaacctcgctacgccgcgccgcgaaaaccaaaccgaaattacgcctcgcccgcgccgcgaaaccgcaatccgaactacaaccccgcaactttataaatccccctccccccgtcctctcccctcccccatc

SEQ ID NO: 803 - DNA, 569 bp, Artificial Sequence
  chemically treated genomic DNA (Homo sapiens) CpG-island No: 803
ttgttagggtttttattttgggggttagtggtcgtggcgttttcggaaggggttgtcgagtggggtatttattttcggtttggggtttgcggcggcggcggtgtcggcggcggcggcggcggcggcggcggcggcggtagcgggtcggtgtagaaaatggcgttggtgtagcggttcgggttttttttcgcggcgttgcggagggtttgaggttcgcgagtttttttcgtcgcgttttatttgttcgtgtattttatatatatgaggtgagcggaataagggttttttttcgggcgggaggagtcgcgggcgttgtcgtagggttcgtaattcgcggcggcggtagtagaggcggcggcgtcgggcgttttcgagatttcgggtttcggcgggagggcgtaggttgcgttgttgcggaggtcgagcgggcggttcgggggagtttcgttgcgtcgcgtcgcgggggttaggtcggggttgcgtttcgttcgcgtcgcgggatcgtagttcgggttgtagtttcgtagttttgtgagttttttttttttcgttttttttttttttttatt

SEQ ID NO: 804 - DNA, 569 bp, Artificial Sequence
  chemically treated genomic DNA (Homo sapiens) CpG-island No: 804
aataaaaaaaaaaaaaaaacgaaaaaaaaaaaactcacaaaactacgaaactacaacccgaactacgatcccgcgacgcgaacgaaacgcaaccccgacctaacccccgcgacgcgacgcaacgaaactcccccgaaccgcccgctcgacctccgcaacaacgcaacctacgccctcccgccgaaacccgaaatctcgaaaacgcccgacgccgccgcctctactaccgccgccgcgaattacgaaccctacgacaacgcccgcgactcctcccgcccgaaaaaaaacccttattccgctcacctcatatatataaaatacacgaacaaataaaacgcgacgaaaaaaactcgcgaacctcaaaccctccgcaacgccgcgaaaaaaaacccgaaccgctacaccaacgccattttctacaccgacccgctaccgccgccgccgccgccgccgccgccgccgccgacaccgccgccgccgcaaaccccaaaccgaaaataaataccccactcgacaaccccttccgaaaacgccacgaccactaacccccaaaataaaaaccctaacaa

SEQ ID NO: 805 - DNA, 520 bp, Artificial Sequence
  chemically treated genomic DNA (Homo sapiens) CpG-island No: 805
aagcggcgcgtttcgcggttttttcgggcgtcgcgaagttgggaggcgcgtaaagtgcggtttaggggggatcgtcgggggttttcgttagtagttttttgttcgaggtcgtagtttttgtttttttcgtttttcgttcggtcgtttggtcgttcggtcgtttcgtcgatcgagggtttattagcgtttttttatggtcgcggtagttaatcgatgattgaatcgaataaagagtagcggcgagattaatttttaatatttatcgatgggtagcgggcggtcgagtttcggcgagtttcggtagtcgtcgttcgtcgttttagggcgttcgtttgttcgttcggggatttttttaatgcgtttagggcgcgttcgggggttttttacggtcgcgcggtcggcgttgttcgtattaatttggagtcgtcgtagattaaatcgtttttaatattgaaatatcgattttatattggcggttattttgggggttatcgagacgcgtatatataagagtttggtt

SEQ ID NO: 806 - DNA, 520 bp, Artificial Sequence
  chemically treated genomic DNA (Homo sapiens) CpG-island No: 806
aaccaaactcttatatatacgcgtctcgataacccccaaaataaccgccaatataaaatcgatatttcaatattaaaaacgatttaatctacgacgactccaaattaatacgaacaacgccgaccgcgcgaccgtaaaaaacccccgaacgcgccctaaacgcattaaaaaaatccccgaacgaacaaacgaacgccctaaaacgacgaacgacgactaccgaaactcgccgaaactcgaccgcccgctacccatcgataaatattaaaaattaatctcgccgctactctttattcgattcaatcatcgattaactaccgcgaccataaaaaaacgctaataaaccctcgatcgacgaaacgaccgaacgaccaaacgaccgaacgaaaaacgaaaaaaacaaaaactacgacctcgaacaaaaaactactaacgaaaacccccgacgatcccccctaaaccgcactttacgcgcctcccaacttcgcgacgcccgaaaaaaccgcgaaacgcgccgctt

SEQ ID NO: 807 - DNA, 520 bp, Artificial Sequence
  chemically treated genomic DNA (Homo sapiens) CpG-island No: 807
agttaaatttttgtgtgtgcgcgtttcgatagtttttaagatggtcgttaatgtgggatcgatgttttaatattggaagcgatttgatttacggcgattttaggttagtgcgggtagcgtcggtcgcgcggtcgtgaggagttttcgggcgcgttttgggcgtattggggaggttttcgggcgggtaggcggacgttttggggcggcgggcggcggttgtcggggttcgtcggggttcggtcgttcgttgtttatcgataggtattaggaattgatttcgtcgttgttttttgttcggtttagttatcgattagttgtcgcgattatggagaagcgttagtgagttttcggtcggcggagcggtcgagcggttaggcggtcgggcgaggagcggggaaggtaggggttacggtttcgggtagggggttgttggcgggaattttcggcggttttttttgagtcgtattttgcgcgttttttaatttcgcggcgttcggggaggtcgcggagcgcgtcgttt

SEQ ID NO: 808 - DNA, 520 bp, Artificial Sequence
  chemically treated genomic DNA (Homo sapiens) CpG-island No: 808
aaacgacgcgctccgcgacctccccgaacgccgcgaaattaaaaaacgcgcaaaatacgactcaaaaaaaaccgccgaaaattcccgccaacaaccccctacccgaaaccgtaacccctaccttccccgctcctcgcccgaccgcctaaccgctcgaccgctccgccgaccgaaaactcactaacgcttctccataatcgcgacaactaatcgataactaaaccgaacaaaaaacaacgacgaaatcaattcctaatacctatcgataaacaacgaacgaccgaaccccgacgaaccccgacaaccgccgcccgccgccccaaaacgtccgcctacccgcccgaaaacctccccaatacgcccaaaacgcgcccgaaaactcctcacgaccgcgcgaccgacgctacccgcactaacctaaaatcgccgtaaatcaaatcgcttccaatattaaaacatcgatcccacattaacgaccatcttaaaaactatcgaaacgcgcacacacaaaaatttaact

SEQ ID NO: 809 - DNA, 636 bp, Artificial Sequence
  chemically treated genomic DNA (Homo sapiens) CpG-island No: 809
tcgcgataatatttgtagagggttcgtgcggagttttttagtgagcggatcgaaaatcgttattttggaaggatattggtatgttttagggtgaaaatttatattacgatattcggggggtgggtttttttcgagttttcgttcgcgggtgtttttatttagatttgaggggtgtcgggaagattttcgtttatcgagttagggcgggattaagattttcggcgttggaaacgcgtagggcggggtttagatttggatttagttagtcgggcggtgtggggtgcgtatgcgtaatgttcgtttcggttttaggatcgcgcgggcgatagtagggtcgcggtgtagtgttcgattcgagagttgcggtttgagttatcggtttcgtttttcggagtcggacgttgcgggaggttcgggagcggtagtggaatcgatttttagaatttcggacgtgtgcggcggtaagcgttcggttcgtatttttttcgtatttcgtaatttcgattttggcggtttttagattcggcgaaatcgtgaagtttcggttttaggagttttttagatttatggttttagattcgaatttttagatttgttcgatttttttttatgtcgtttcggggatttttttttatt

SEQ ID NO: 810 - DNA, 636 bp, Artificial Sequence
  chemically treated genomic DNA (Homo sapiens) CpG-island No: 810
aataaaaaaaaatccccgaaacgacataaaaaaaaatcgaacaaatctaaaaattcgaatctaaaaccataaatctaaaaaactcctaaaaccgaaacttcacgatttcgccgaatctaaaaaccgccaaaatcgaaattacgaaatacgaaaaaaatacgaaccgaacgcttaccgccgcacacgtccgaaattctaaaaatcgattccactaccgctcccgaacctcccgcaacgtccgactccgaaaaacgaaaccgataactcaaaccgcaactctcgaatcgaacactacaccgcgaccctactatcgcccgcgcgatcctaaaaccgaaacgaacattacgcatacgcaccccacaccgcccgactaactaaatccaaatctaaaccccgccctacgcgtttccaacgccgaaaatcttaatcccgccctaactcgataaacgaaaatcttcccgacacccctcaaatctaaataaaaacacccgcgaacgaaaactcgaaaaaaacccaccccccgaatatcgtaatataaattttcaccctaaaacataccaatatccttccaaaataacgattttcgatccgctcactaaaaaactccgcacgaaccctctacaaatattatcgcga

SEQ ID NO: 811 - DNA, 636 bp, Artificial Sequence
  chemically treated genomic DNA (Homo sapiens) CpG-island No: 811
ggtggagaagggttttcgggacggtataaaaggagatcgaataggtttgagggttcgaatttgagattatggatttggggggtttttgaggtcgagattttacggtttcgtcgggtttgggggtcgttaaagtcggagttgcggggtgcggagggggtacgggtcgggcgtttatcgtcgtatacgttcggagttttgggagtcggttttattgtcgttttcgggtttttcgtagcgttcggtttcggagggcggggtcggtgatttaggtcgtaattttcgggtcggatattgtatcgcggttttgttgtcgttcgcgcggttttagagtcgaagcggatattgcgtatgcgtattttatatcgttcggttagttggatttaggtttgggtttcgttttacgcgtttttagcgtcggaggttttaatttcgttttgattcggtaggcgggggttttttcgatattttttaggtttgggtggaggtattcgcggacgagaattcggaggggatttatttttcgagtgtcgtagtgtgaatttttattttagggtatgttaatatttttttagggtggcggttttcggttcgtttattaagggatttcgtacgggttttttgtaggtgttgtcgcga

SEQ ID NO: 812 - DNA, 636 bp, Artificial Sequence
  chemically treated genomic DNA (Homo sapiens) CpG-island No: 812
tcgcgacaacacctacaaaaaacccgtacgaaatcccttaataaacgaaccgaaaaccgccaccctaaaaaaatattaacataccctaaaataaaaattcacactacgacactcgaaaaataaatcccctccgaattctcgtccgcgaatacctccacccaaacctaaaaaatatcgaaaaaacccccgcctaccgaatcaaaacgaaattaaaacctccgacgctaaaaacgcgtaaaacgaaacccaaacctaaatccaactaaccgaacgatataaaatacgcatacgcaatatccgcttcgactctaaaaccgcgcgaacgacaacaaaaccgcgatacaatatccgacccgaaaattacgacctaaatcaccgaccccgccctccgaaaccgaacgctacgaaaaacccgaaaacgacaataaaaccgactcccaaaactccgaacgtatacgacgataaacgcccgacccgtaccccctccgcaccccgcaactccgactttaacgacccccaaacccgacgaaaccgtaaaatctcgacctcaaaaaccccccaaatccataatctcaaattcgaaccctcaaacctattcgatctccttttataccgtcccgaaaacccttctccacc

SEQ ID NO: 813 - DNA, 819 bp, Artificial Sequence
  chemically treated genomic DNA (Homo sapiens) CpG-island No: 813
  misc_feature (108)..(108): n is either a, c, g or t
  misc_feature (175)..(175): n is either a, c, g or t
  misc_feature (207)..(207): n is either a, c, g or t
  misc_feature (279)..(279): n is either a, c, g or t
  misc_feature (360)..(360): n is either a, c, g or t
  misc_feature (423)..(423): n is either a, c, g or t
gggacggtcgcgtttatttgaatcgaattgtacgtataagcgcgtttttgattttaggtgtatatcgtggaggtttgaaacgagagttatgatcgcgacgcgttgaantaaattaagtcgttagtttttcgtttcgtttcggtttcggttttggcgaggtgcgtatgcgtagggntcgggagttaggatttcgcggtaggcgggcgncgttcgcgtcgtacggaagtttcgcgatgtttgcgtttgaattttttggcgggtgtcggttatggcggtttncgttttcgggatttgggagtcggttttttcgtatatatggggttgcggacggtaggagatagcggcggtcgggtcgggaangtcgcgtagtggttttcgtcgtaggatcggaggcgtttttttaatagtagcggtagtagcgancgttagtatcggcgatttttcgtagttcgacgattttgacgatttcgacgatttcgattttttcggtagttcggtgaggcggcggcggaggcgtttcggcggtcgagtgtttaaggatcggtttagtttgatcgtgattttaaagcgttggaagttgcgagttcgtttaagtttaatcgtgattttaagacgtttggggttgcgagttcggttttcgtagaagtgtagtatattttgcggttcgtttcgattttcgtttttttttagtcgcgatttcggtcgttttagttcggattttagcgtgtgcggttagtttagggacggcgacgagttgggtattagtgtttttttgtttagttttttggtttcgttttgtttcgggtttttaacgttaag

SEQ ID NO: 814 - DNA, 819 bp, Artificial Sequence
  chemically treated genomic DNA (Homo sapiens) CpG-island No: 814
  misc_feature (397)..(397): n is either a, c, g or t
  misc_feature (460)..(460): n is either a, c, g or t
  misc_feature (541)..(541): n is either a, c, g or t
  misc_feature (613)..(613): n is either a, c, g or t
  misc_feature (645)..(645): n is either a, c, g or t
  misc_feature (712)..(712): n is either a, c, g or t
cttaacgttaaaaacccgaaacaaaacgaaaccaaaaaactaaacaaaaaaacactaatacccaactcgtcgccgtccctaaactaaccgcacacgctaaaatccgaactaaaacgaccgaaatcgcgactaaaaaaaaacgaaaatcgaaacgaaccgcaaaatatactacacttctacgaaaaccgaactcgcaaccccaaacgtcttaaaatcacgattaaacttaaacgaactcgcaacttccaacgctttaaaatcacgatcaaactaaaccgatccttaaacactcgaccgccgaaacgcctccgccgccgcctcaccgaactaccgaaaaaatcgaaatcgtcgaaatcgtcaaaatcgtcgaactacgaaaaatcgccgatactaacgntcgctactaccgctactattaaaaaaacgcctccgatcctacgacgaaaaccactacgcgacnttcccgacccgaccgccgctatctcctaccgtccgcaaccccatatatacgaaaaaaccgactcccaaatcccgaaaacgnaaaccgccataaccgacacccgccaaaaaattcaaacgcaaacatcgcgaaacttccgtacgacgcgaacgncgcccgcctaccgcgaaatcctaactcccganccctacgcatacgcacctcgccaaaaccgaaaccgaaacgaaacgaaaaactaacgacttaatttanttcaacgcgtcgcgatcataactctcgtttcaaacctccacgatatacacctaaaatcaaaaacgcgcttatacgtacaattcgattcaaataaacgcgaccgtccc

SEQ ID NO: 815 - DNA, 819 bp, Artificial Sequence
  chemically treated genomic DNA (Homo sapiens) CpG-island No: 815
  misc_feature (397)..(397): n is either a, c, g or t
  misc_feature (460)..(460): n is either a, c, g or t
  misc_feature (541)..(541): n is either a, c, g or t
  misc_feature (613)..(613): n is either a, c, g or t
  misc_feature (645)..(645): n is either a, c, g or t
  misc_feature (712)..(712): n is either a, c, g or t
tttggcgttggggattcggggtagggcgaggttagagagttgaatagggaggtattgatgtttagttcgtcgtcgtttttgggttggtcgtatacgttgaggttcgggttgaggcggtcggagtcgcggttggggaagggcggaagtcggagcgggtcgtagggtgtgttgtatttttgcgggggtcgagttcgtagttttaggcgttttggggttacggttaggtttgggcgagttcgtagtttttagcgttttggggttacggttaggttgggtcggtttttgggtattcggtcgtcgggacgttttcgtcgtcgttttatcgggttgtcggggaagtcggggtcgtcgggatcgttaggatcgtcggattgcgaggggtcgtcgatgttggcgntcgttgttgtcgttgttgttgaagaaacgttttcggttttgcggcgggaattattgcgcggtnttttcggttcggtcgtcgttgttttttgtcgttcgtagttttatatgtgcggaaaagtcggtttttaggtttcgggagcgnaagtcgttatggtcggtattcgttaagaggtttaaacgtaaatatcgcgagattttcgtgcgacgcggacgncgttcgtttgtcgcggggttttagttttcggnttttgcgtatgcgtatttcgttagggtcggggtcgggacgggacggaaaattggcggtttggtttgntttagcgcgtcgcggttatggttttcgttttaggtttttacggtgtgtatttggagttaggagcgcgtttgtgcgtatagttcggtttaggtaagcgcggtcgtttt

SEQ ID NO: 816 - DNA, 819 bp, Artificial Sequence
  chemically treated genomic DNA (Homo sapiens) CpG-island No: 816
  misc_feature (108)..(108): n is either a, c, g or t
  misc_feature (175)..(175): n is either a, c, g or t
  misc_feature (207)..(207): n is either a, c, g or t
  misc_feature (279)..(279): n is either a, c, g or t
  misc_feature (360)..(360): n is either a, c, g or t
  misc_feature (423)..(423): n is either a, c, g or t
aaaacgaccgcgcttacctaaaccgaactatacgcacaaacgcgctcctaactccaaatacacaccgtaaaaacctaaaacgaaaaccataaccgcgacgcgctaaancaaaccaaaccgccaattttccgtcccgtcccgaccccgaccctaacgaaatacgcatacgcaaaanccgaaaactaaaaccccgcgacaaacgaacgncgtccgcgtcgcacgaaaatctcgcgatatttacgtttaaacctcttaacgaataccgaccataacgacttncgctcccgaaacctaaaaaccgacttttccgcacatataaaactacgaacgacaaaaaacaacgacgaccgaaccgaaaanaccgcgcaataattcccgccgcaaaaccgaaaacgtttcttcaacaacaacgacaacaacgancgccaacatcgacgacccctcgcaatccgacgatcctaacgatcccgacgaccccgacttccccgacaacccgataaaacgacgacgaaaacgtcccgacgaccgaatacccaaaaaccgacccaacctaaccgtaaccccaaaacgctaaaaactacgaactcgcccaaacctaaccgtaaccccaaaacgcctaaaactacgaactcgacccccgcaaaaatacaacacaccctacgacccgctccgacttccgcccttccccaaccgcgactccgaccgcctcaacccgaacctcaacgtatacgaccaacccaaaaacgacgacgaactaaacatcaatacctccctattcaactctctaacctcgccctaccccgaatccccaacgccaaa

SEQ ID NO: 817 - DNA, 516 bp, Artificial Sequence
  chemically treated genomic DNA (Homo sapiens) CpG-island No: 817
  misc_feature (149)..(149): n is either a, c, g or t
  misc_feature (155)..(155): n is either a, c, g or t
  misc_feature (166)..(166): n is either a, c, g or t
tattcgttttgtttttttttcgtttttttaaaagttcgcggagaatttatacgattaggtacgttaggatggaggtttgtagtagtcggtatagtaggtttatttttttgtttttggcgatgatatatttttcggttttgtagtcgaantagcgnataggtagagntttttgtagttcgtttgttttatggcgcgtttttagtcgggtttgcggatcgttcggtttacgtgcgtttatggggagtattcggtttttcggtttttgcgcgttcggcgttcgtttcggttcgtttgcgttcgtttagttgtagttcggggtgttcggtagggttgcggggcgcgggggcgggtcggggcggttttttattgacgcggttgagaaagtttcggttgggagttgggcggcggcgagtatcggaattttagatcgcgattttgtcgttattttttttttttttttttttttttttttttttgatatagtgatatttttgtaatttattttttagttatcgg

SEQ ID NO: 818 - DNA, 516 bp, Artificial Sequence
  chemically treated genomic DNA (Homo sapiens) CpG-island No: 818
  misc_feature (351)..(351): n is either a, c, g or t
  misc_feature (362)..(362): n is either a, c, g or t
  misc_feature (368)..(368): n is either a, c, g or t
ccgataactaaaaaataaattacaaaaatatcactatatcaaaaaaaaaaaaaaaaaaaaaaaaaaaaaaaataacgacaaaatcgcgatctaaaattccgatactcgccgccgcccaactcccaaccgaaactttctcaaccgcgtcaataaaaaaccgccccgacccgcccccgcgccccgcaaccctaccgaacaccccgaactacaactaaacgaacgcaaacgaaccgaaacgaacgccgaacgcgcaaaaaccgaaaaaccgaatactccccataaacgcacgtaaaccgaacgatccgcaaacccgactaaaaacgcgccataaaacaaacgaactacaaaaanctctacctatncgctanttcgactacaaaaccgaaaaatatatcatcgccaaaaacaaaaaaataaacctactataccgactactacaaacctccatcctaacgtacctaatcgtataaattctccgcgaacttttaaaaaaacgaaaaaaaaacaaaacgaata

SEQ ID NO: 819 - DNA, 516 bp, Artificial Sequence
  chemically treated genomic DNA (Homo sapiens) CpG-island No: 819
  misc_feature (351)..(351): n is either a, c, g or t
  misc_feature (362)..(362): n is either a, c, g or t
  misc_feature (368)..(368): n is either a, c, g or t
tcggtggttggggagtaggttgtaggggtgttattgtgttaggggaggaggaggaggaggaggaagaagaggtagcggtaaggtcgcggtttgaggtttcggtgttcgtcgtcgtttagtttttagtcgaggtttttttaatcgcgttaataaaaggtcgtttcgattcgttttcgcgtttcgtagttttgtcggatatttcgggttgtagttgagcgggcgtagacgggtcgaggcgggcgtcgggcgcgtagggatcgagggatcgagtgttttttatgagcgtacgtgggtcgggcggttcgtaagttcggttgagagcgcgttatggggtaggcgggttgtaagggnttttgtttgtncgttgnttcgattataagatcgagaagtatgttatcgttaagaataagaaggtgggtttgttgtatcggttgttgtaggtttttattttggcgtatttggtcgtgtaagtttttcgcggatttttgggaaggcgggggaggggtagggcgggtg

SEQ ID NO: 820 - DNA, 516 bp, Artificial Sequence
  chemically treated genomic DNA (Homo sapiens) CpG-island No: 820
  misc_feature (149)..(149): n is either a, c, g or t
  misc_feature (155)..(155): n is either a, c, g or t
  misc_feature (166)..(166): n is either a, c, g or t
cacccgccctacccctcccccgccttcccaaaaatccgcgaaaaacttacacgaccaaatacgccaaaataaaaacctacaacaaccgatacaacaaacccaccttcttattcttaacgataacatacttctcgatcttataatcgaancaacgnacaaacaaaancccttacaacccgcctaccccataacgcgctctcaaccgaacttacgaaccgcccgacccacgtacgctcataaaaaacactcgatccctcgatccctacgcgcccgacgcccgcctcgacccgtctacgcccgctcaactacaacccgaaatatccgacaaaactacgaaacgcgaaaacgaatcgaaacgaccttttattaacgcgattaaaaaaacctcgactaaaaactaaacgacgacgaacaccgaaacctcaaaccgcgaccttaccgctacctcttcttcctcctcctcctcctcctcccctaacacaataacacccctacaacctactccccaaccaccga

SEQ ID NO: 821 - DNA, 525 bp, Artificial Sequence
  chemically treated genomic DNA (Homo sapiens) CpG-island No: 821
cgggtcggaaaataaagcgcgagttcggtcggtgggtttatttggttgtagaagatttcgggttgttggttgggggtaggtacggtttgggtggcggcggttgataagaggcggcggtttaggcggggttcgaagcgggcggtagcgcgtaatatcgtagcgggttagcggatagcgagcggatcgagagtagagttagggttttagggttattgagtcgatttcgtttttcgtttcgcgcggtagttaatggaaaggcgggggcgggtcgggggcggggttgtttttattatttttcgggatggggcgcgtagttgatgtaagcgaagcgggtggcgttaggtattttcggttcgtggttgttttttggttcgcgcgacgttttcgcgttcgttatcgtttttcgtttgtgcggaaagattcggtttcgcgaacgtagttcgttttggttgagtttttaatgtgtgtttttgattttaatgtgaataggttcgagttagggcgattttgattttttcggttgat

SEQ ID NO: 822 - DNA, 525 bp, Artificial Sequence
  chemically treated genomic DNA (Homo sapiens) CpG-island No: 822
atcaaccgaaaaaatcaaaatcgccctaactcgaacctattcacattaaaatcaaaaacacacattaaaaactcaaccaaaacgaactacgttcgcgaaaccgaatctttccgcacaaacgaaaaacgataacgaacgcgaaaacgtcgcgcgaaccaaaaaacaaccacgaaccgaaaatacctaacgccacccgcttcgcttacatcaactacgcgccccatcccgaaaaataataaaaacaaccccgcccccgacccgcccccgcctttccattaactaccgcgcgaaacgaaaaacgaaatcgactcaataaccctaaaaccctaactctactctcgatccgctcgctatccgctaacccgctacgatattacgcgctaccgcccgcttcgaaccccgcctaaaccgccgcctcttatcaaccgccgccacccaaaccgtacctacccccaaccaacaacccgaaatcttctacaaccaaataaacccaccgaccgaactcgcgctttattttccgacccg

SEQ ID NO: 823 - DNA, 525 bp, Artificial Sequence
  chemically treated genomic DNA (Homo sapiens) CpG-island No: 823
attagtcgggaaggttagggtcgttttggttcgggtttgtttatattggggttaaaggtatatattgggggtttaattaaggcgagttgcgttcgcggggtcgggttttttcgtataggcggagggcggtggcgggcgcggaggcgtcgcgcgagttagggggtagttacgggtcgggggtatttagcgttattcgtttcgtttgtattagttgcgcgttttatttcgaggaatggtagaggtagtttcgttttcggttcgttttcgtttttttattggttgtcgcgcggggcggggagcggggtcggtttagtggttttgagattttagttttgttttcggttcgttcgttgttcgttagttcgttgcgatgttgcgcgttgtcgttcgtttcgggtttcgtttgggtcgtcgttttttgttagtcgtcgttatttaggtcgtgtttgtttttaattagtagttcgaggttttttgtaattaggtgagtttatcggtcgggttcgcgttttgtttttcggttcg

SEQ ID NO: 824 - DNA, 525 bp, Artificial Sequence
  chemically treated genomic DNA (Homo sapiens) CpG-island No: 824
cgaaccgaaaaacaaaacgcgaacccgaccgataaactcacctaattacaaaaaacctcgaactactaattaaaaacaaacacgacctaaataacgacgactaacaaaaaacgacgacccaaacgaaacccgaaacgaacgacaacgcgcaacatcgcaacgaactaacgaacaacgaacgaaccgaaaacaaaactaaaatctcaaaaccactaaaccgaccccgctccccgccccgcgcgacaaccaataaaaaaacgaaaacgaaccgaaaacgaaactacctctaccattcctcgaaataaaacgcgcaactaatacaaacgaaacgaataacgctaaatacccccgacccgtaactaccccctaactcgcgcgacgcctccgcgcccgccaccgccctccgcctatacgaaaaaacccgaccccgcgaacgcaactcgccttaattaaacccccaatatatacctttaaccccaatataaacaaacccgaaccaaaacgaccctaaccttcccgactaat

SEQ ID NO: 825 - DNA, 710 bp, Artificial Sequence
  chemically treated genomic DNA (Homo sapiens) CpG-island No: 825
gagttagggatttcgcgtcgttagtcgaggtggattaggacgaggtttttggagtaagtagaggttaattcgcgattgtgcgaaaatttgtagtttagtttaagtgtggtattttagcgtaagtaatttttacgacgttttttcgtttcgatttttttaaaattgcgttcggaagagtagtgggtgatttttgttacgtcgtttaatcgttgtgcgcggttttgcgcgtatgcgtaaatcgtaggttagcgacggcggtcgggaggcggaagtggaggttgttgtggtttcgagggttgttcgaggagttgttgttgttgaggcggcggtaattgtattgaggtggtggcggcgttgtcggtttcgggtcgttcggtttttcggttcgttttttagtttcgtttgagttcgtcggggttcgcgtcggttagcgtttgttttatgagtgtgttattggttgttattcgattggagttcgcggaatattcgtttgttttcgtcggtttcggttttagcgtcgcgggtgagtttcgcggtttcgtcgtattttttgtagtcgggtttgggttcggagggtttttttttttaaagtattggttcgggaaaagttcgcggcgagggttgttgtttaggaagatacggagaggtaatcgggattttttttttttttattcgtttttgagaggttttttcgtttgttattttaggga

SEQ ID NO: 826 - DNA, 710 bp, Artificial Sequence
  chemically treated genomic DNA (Homo sapiens) CpG-island No: 826
tccctaaaataacaaacgaaaaaacctctcaaaaacgaataaaaaaaaaaaaaatcccgattacctctccgtatcttcctaaacaacaaccctcgccgcgaacttttcccgaaccaatactttaaaaaaaaaaaccctccgaacccaaacccgactacaaaaaatacgacgaaaccgcgaaactcacccgcgacgctaaaaccgaaaccgacgaaaacaaacgaatattccgcgaactccaatcgaataacaaccaataacacactcataaaacaaacgctaaccgacgcgaaccccgacgaactcaaacgaaactaaaaaacgaaccgaaaaaccgaacgacccgaaaccgacaacgccgccaccacctcaatacaattaccgccgcctcaacaacaacaactcctcgaacaaccctcgaaaccacaacaacctccacttccgcctcccgaccgccgtcgctaacctacgatttacgcatacgcgcaaaaccgcgcacaacgattaaacgacgtaacaaaaatcacccactactcttccgaacgcaattttaaaaaaatcgaaacgaaaaaacgtcgtaaaaattacttacgctaaaataccacacttaaactaaactacaaattttcgcacaatcgcgaattaacctctacttactccaaaaacctcgtcctaatccacctcgactaacgacgcgaaatccctaactc

SEQ ID NO: 827 - DNA, 710 bp, Artificial Sequence
  chemically treated genomic DNA (Homo sapiens) CpG-island No: 827
tttttgagataataaacgggaaggttttttaaaggcggatgggaaagagagggatttcgattattttttcgtgtttttttgggtaatagttttcgtcgcgggtttttttcgggttagtgttttgggaagggaagtttttcgggtttagattcggttatagggaatgcggcgaggtcgcgggatttattcgcggcgttgaagtcgaagtcggcggggataggcgagtgtttcgcgagttttaatcggataataattagtgatatatttatagggtaggcgttggtcggcgcgggtttcggcgggtttaggcgaggttggaaggcgagtcgagaggtcgagcggttcggggtcggtagcgtcgttattattttaatgtagttgtcgtcgttttagtagtagtagtttttcgaatagttttcggagttataataatttttattttcgtttttcggtcgtcgtcgttgatttgcggtttacgtatgcgcgtaggatcgcgtatagcgattgggcggcgtggtaggggttatttattgttttttcggacgtaattttgaggaggtcggagcggaaggacgtcgtggagattgtttgcgttggggtgttatatttaggttgagttgtaggttttcgtatagtcgcgagttaatttttgtttgttttagaggtttcgttttaatttatttcggttgacggcgcgggatttttggttt

SEQ ID NO: 828 - DNA, 710 bp, Artificial Sequence
  chemically treated genomic DNA (Homo sapiens) CpG-island No: 828
aaaccaaaaatcccgcgccgtcaaccgaaataaattaaaacgaaacctctaaaacaaacaaaaattaactcgcgactatacgaaaacctacaactcaacctaaatataacaccccaacgcaaacaatctccacgacgtccttccgctccgacctcctcaaaattacgtccgaaaaaacaataaataacccctaccacgccgcccaatcgctatacgcgatcctacgcgcatacgtaaaccgcaaatcaacgacgacgaccgaaaaacgaaaataaaaattattataactccgaaaactattcgaaaaactactactactaaaacgacgacaactacattaaaataataacgacgctaccgaccccgaaccgctcgacctctcgactcgccttccaacctcgcctaaacccgccgaaacccgcgccgaccaacgcctaccctataaatatatcactaattattatccgattaaaactcgcgaaacactcgcctatccccgccgacttcgacttcaacgccgcgaataaatcccgcgacctcgccgcattccctataaccgaatctaaacccgaaaaacttcccttcccaaaacactaacccgaaaaaaacccgcgacgaaaactattacccaaaaaaacacgaaaaaataatcgaaatccctctctttcccatccgcctttaaaaaaccttcccgtttattatctcaaaaa

SEQ ID NO: 829 - DNA, 816 bp, Artificial Sequence
  chemically treated genomic DNA (Homo sapiens) CpG-island No: 829
gtcggtttcggggatcgtagagataggcgttaggtacgggttttaggtagttttttgtttttttttggtttttttgacgtcgtagtggcgttcgtattttcgtcgttcgagttcggtttttgtcggggtagtcggagttttttcgcgcgcgtattcggttcgttatcgttagcgttcggttttcgcgtcgtttcgggtttagtcggtcgagttgtcggtttttatacgttcggggacggcggttcgcgtgtaggtagcgacgtaggcgaaggcgggcgtacgtttattcgtagttttttgtttcgggggtcgttgtcgcggtttaagttgggtttcggggtagtcggagcgtttcgtgcgtcggtttcgcgcgggttcgttagtttttgaagttgtcggggtttagtagcgtgcggggcggggatagtcgcgtcgttcgtttcggtttgcgtgtgttcggcggagttgataggagttttggtcgtcgcggttttcgttcggtttttttcgggttcgttcgttgggttgtagtgcgtagtcgtattagttcgggtcgggtttggttagttgcggaattttaggagggacgcgcgattgaattttttcggaattttatttgagtaagcgtatgatcgggtagtggtcgaaacgttcgttttcgtttcggtagacgcgtagcggggtgcgtttttcgcggttttattcggtttcggtttaggtagttttaggtttttgtcgttgcgtttttcgggtaaaggggtgttgttttttgtcggtatagcgtatttttcgagtttttttttttttcgtgtttgt

SEQ ID NO: 830 - DNA, 816 bp, Artificial Sequence
  chemically treated genomic DNA (Homo sapiens) CpG-island No: 830
acaaacacgaaaaaaaaaaaaactcgaaaaatacgctataccgacaaaaaacaacacccctttacccgaaaaacgcaacgacaaaaacctaaaactacctaaaccgaaaccgaataaaaccgcgaaaaacgcaccccgctacgcgtctaccgaaacgaaaacgaacgtttcgaccactacccgatcatacgcttactcaaataaaattccgaaaaaattcaatcgcgcgtccctcctaaaattccgcaactaaccaaacccgacccgaactaatacgactacgcactacaacccaacgaacgaacccgaaaaaaaccgaacgaaaaccgcgacgaccaaaactcctatcaactccgccgaacacacgcaaaccgaaacgaacgacgcgactatccccgccccgcacgctactaaaccccgacaacttcaaaaactaacgaacccgcgcgaaaccgacgcacgaaacgctccgactaccccgaaacccaacttaaaccgcgacaacgacccccgaaacaaaaaactacgaataaacgtacgcccgccttcgcctacgtcgctacctacacgcgaaccgccgtccccgaacgtataaaaaccgacaactcgaccgactaaacccgaaacgacgcgaaaaccgaacgctaacgataacgaaccgaatacgcgcgcgaaaaaactccgactaccccgacaaaaaccgaactcgaacgacgaaaatacgaacgccactacgacgtcaaaaaaaccaaaaaaaaacaaaaaactacctaaaacccgtacctaacgcctatctctacgatccccgaaaccgac

SEQ ID NO: 831 - DNA, 816 bp, Artificial Sequence
  chemically treated genomic DNA (Homo sapiens) CpG-island No: 831
gtaggtacggaaaggaaagggattcgaggaatgcgttgtatcgataggaggtagtatttttttgttcgaggggcgtaacgatagagatttaaggttatttgggtcggagtcgggtgaggtcgcggagaacgtatttcgttacgcgtttgtcgagacggaggcgggcgtttcgattattgttcgattatgcgtttatttaagtaggatttcgaaaaaatttagtcgcgcgttttttttaaggtttcgtagttggttaggttcggttcgggttggtgcggttgcgtattgtagtttagcggacgggttcgggaggagtcgggcggggatcgcggcggttagagtttttgttagtttcgtcgggtatacgtaggtcggggcgggcggcgcggttgttttcgtttcgtacgttgttgggtttcggtagttttagaggttggcggattcgcgcggggtcggcgtacggagcgtttcggttgtttcggggtttagtttggatcgcggtagcggttttcggagtaaggggttacgggtgagcgtgcgttcgttttcgtttgcgtcgttgtttgtacgcgggtcgtcgttttcgggcgtgtgagagtcggtagttcggtcgattgggttcggagcggcgcggaggtcgggcgttgacggtaacgggtcgggtgcgcgcgcgggagggtttcggttgtttcgatagaggtcgggttcgggcggcgggagtgcgagcgttattgcggcgttagaggggttaggaagggataggaggttgtttgaggttcgtatttggcgtttgtttttgcggttttcggggtcgat

SEQ ID NO: 832 - DNA, 816 bp, Artificial Sequence
  chemically treated genomic DNA (Homo sapiens) CpG-island No: 832
atcgaccccgaaaaccgcaaaaacaaacgccaaatacgaacctcaaacaacctcctatcccttcctaacccctctaacgccgcaataacgctcgcactcccgccgcccgaacccgacctctatcgaaacaaccgaaaccctcccgcgcgcgcacccgacccgttaccgtcaacgcccgacctccgcgccgctccgaacccaatcgaccgaactaccgactctcacacgcccgaaaacgacgacccgcgtacaaacaacgacgcaaacgaaaacgaacgcacgctcacccgtaaccccttactccgaaaaccgctaccgcgatccaaactaaaccccgaaacaaccgaaacgctccgtacgccgaccccgcgcgaatccgccaacctctaaaactaccgaaacccaacaacgtacgaaacgaaaacaaccgcgccgcccgccccgacctacgtatacccgacgaaactaacaaaaactctaaccgccgcgatccccgcccgactcctcccgaacccgtccgctaaactacaatacgcaaccgcaccaacccgaaccgaacctaaccaactacgaaaccttaaaaaaaacgcgcgactaaattttttcgaaatcctacttaaataaacgcataatcgaacaataatcgaaacgcccgcctccgtctcgacaaacgcgtaacgaaatacgttctccgcgacctcacccgactccgacccaaataaccttaaatctctatcgttacgcccctcgaacaaaaaaatactacctcctatcgatacaacgcattcctcgaatccctttcctttccgtacctac

SEQ ID NO: 833 - DNA, 556 bp, Artificial Sequence
  chemically treated genomic DNA (Homo sapiens) CpG-island No: 833
tacgcgaattatattgtttagaaggcgtcgcgtcgtgagtcgcgatgtttggttaatgaaaagaggtttattcgagagtgcgacgcgtaatgggcgggattttcggcgttttttttcggcggttgttttcgttgtttttaagagaatttagtttgtcggaagttggttgttcgttgcggcgattagtttcggaaagcgcggtggggacgcgttgtgttttcgtagtttagaggcgggtttgaggttcggtggcggcgtttagggtggttcgggtttttttttcggtcgttgttttatcgttataggtttcgatggcggcggttacgttgagggatttcgtttaggtgagcgtcgcgttttttcggtttttttcgaattttaaagttttgtgagggtcgtttgtttaggttttcgggtgtagaattgtggggcgttcgtgggcggcgtttcgtttttgatacgtagtgtgatggggtggtaatggagggtaaggggttcggttcgtaaagatgtgaggcgtatttagcgagtttcgaatttgaggttttttggtgtt

SEQ ID NO: 834 - DNA, 556 bp, Artificial Sequence
  chemically treated genomic DNA (Homo sapiens) CpG-island No: 834
aacaccaaaaaacctcaaattcgaaactcgctaaatacgcctcacatctttacgaaccgaaccccttaccctccattaccaccccatcacactacgtatcaaaaacgaaacgccgcccacgaacgccccacaattctacacccgaaaacctaaacaaacgaccctcacaaaactttaaaattcgaaaaaaaccgaaaaaacgcgacgctcacctaaacgaaatccctcaacgtaaccgccgccatcgaaacctataacgataaaacaacgaccgaaaaaaaaacccgaaccaccctaaacgccgccaccgaacctcaaacccgcctctaaactacgaaaacacaacgcgtccccaccgcgctttccgaaactaatcgccgcaacgaacaaccaacttccgacaaactaaattctcttaaaaacaacgaaaacaaccgccgaaaaaaaacgccgaaaatcccgcccattacgcgtcgcactctcgaataaacctcttttcattaaccaaacatcgcgactcacgacgcgacgccttctaaacaatataattcgcgta

SEQ ID NO: 835 - DNA, 556 bp, Artificial Sequence
  chemically treated genomic DNA (Homo sapiens) CpG-island No: 835
gatattaggaggttttaggttcgggattcgttgaatgcgttttatatttttgcgagtcgggttttttgttttttattgttattttattatattgcgtgttagaaacgggacgtcgtttacgaacgttttatagttttgtattcggggatttgagtaggcggtttttatagggttttaggattcgggggaggtcgggaggacgcggcgtttatttgagcggggttttttagcgtggtcgtcgttatcggagtttgtggcggtgagataacgatcgaggaaagggttcgggttattttgggcgtcgttatcgagttttagattcgtttttgagttgcgagaatatagcgcgtttttatcgcgtttttcggagttggtcgtcgtagcgaataattagttttcggtaagttgagtttttttgagggtagcgaaagtaatcgtcgaggggagacgtcggaagtttcgtttattgcgcgtcgtattttcgggtagatttttttttattggttaagtatcgcggtttacggcgcggcgttttttgggtagtgtagttcgcgtg

SEQ ID NO: 836 - DNA, 556 bp, Artificial Sequence
  chemically treated genomic DNA (Homo sapiens) CpG-island No: 836
cacgcgaactacactacccaaaaaacgccgcgccgtaaaccgcgatacttaaccaataaaaaaaaatctacccgaaaatacgacgcgcaataaacgaaacttccgacgtctcccctcgacgattactttcgctaccctcaaaaaaactcaacttaccgaaaactaattattcgctacgacgaccaactccgaaaaacgcgataaaaacgcgctatattctcgcaactcaaaaacgaatctaaaactcgataacgacgcccaaaataacccgaaccctttcctcgatcgttatctcaccgccacaaactccgataacgacgaccacgctaaaaaaccccgctcaaataaacgccgcgtcctcccgacctcccccgaatcctaaaaccctataaaaaccgcctactcaaatccccgaatacaaaactataaaacgttcgtaaacgacgtcccgtttctaacacgcaatataataaaataacaataaaaaacaaaaaacccgactcgcaaaaatataaaacgcattcaacgaatcccgaacctaaaacctcctaatatc

SEQ ID NO: 837 - DNA, 556 bp, Artificial Sequence
  chemically treated genomic DNA (Homo sapiens) CpG-island No: 837
gtcggttttttcgtttgttacgtttttttatatttcgttatacgtagtgttaaaaaaagggttttatttacgaacgttttagtgttttcgattttgggtagcggggattcgagtaggcgttttttattgatggttttagaacgtgggtgggggaaggtgtgtgaggacgggaagacgtcgtatttatttgagttggcgtttttagagtggtcgttgttattagattttgcgggtagagttgggtcgggagcgacgggcgatattggtagggattcggggatagcggtttttattttaggtttgacgtgggttttttagggcggcgtcgttaaggtttagacgttttcgtgtaggagggacgacgattttttttacgttttcgtggttttaattcggcgttttgttatttttgattcggtgaatatattttagagaagttaaaatggtcgttacgaagaggtttttttaaaagtttcgttttttttttttgtgatttttaaggaaagtcggttttttgagtttttattggtttagtagcgtggcgtttaacgtagag

SEQ ID NO: 838 - DNA, 556 bp, Artificial Sequence
  chemically treated genomic DNA (Homo sapiens) CpG-island No: 838
ctctacgttaaacgccacgctactaaaccaataaaaactcaaaaaaccgactttccttaaaaatcacaaaaaaaaaaaacgaaacttttaaaaaaacctcttcgtaacgaccattttaacttctctaaaatatattcaccgaatcaaaaataacaaaacgccgaattaaaaccacgaaaacgtaaaaaaaatcgtcgtccctcctacacgaaaacgtctaaaccttaacgacgccgccctaaaaaacccacgtcaaacctaaaataaaaaccgctatccccgaatccctaccaatatcgcccgtcgctcccgacccaactctacccgcaaaatctaataacaacgaccactctaaaaacgccaactcaaataaatacgacgtcttcccgtcctcacacaccttcccccacccacgttctaaaaccatcaataaaaaacgcctactcgaatccccgctacccaaaatcgaaaacactaaaacgttcgtaaataaaaccctttttttaacactacgtataacgaaatataaaaaaacgtaacaaacgaaaaaaccgac

SEQ ID NO: 839 - DNA, 556 bp, Artificial Sequence
  chemically treated genomic DNA (Homo sapiens) CpG-island No: 839
ttttgcgttgaacgttacgttattaagttagtaagagtttagaaaatcgattttttttgagagttataaaaagaaaggacgggatttttgggggggttttttcgtggcggttattttagtttttttgaggtgtgtttatcggattagagatagtagagcgtcgagttggggttacgaaggcgtgaggggagtcgtcgttttttttgtacgaaagcgtttaagttttggcgacgtcgttttgggggatttacgttaggtttgggatagggatcgttgttttcgggtttttattaatgtcgttcgtcgttttcggtttagttttattcgtagagtttgatggtagcggttattttgaggacgttaatttaggtgagtgcggcgttttttcgtttttatatatttttttttatttacgttttaaagttattagtgaggggcgtttgttcgagttttcgttgtttagggtcggggatattgaggcgttcgtgggtggggttttttttttgatattgcgtgtgacgaggtgtgggagagcgtgataggcggaggaatcggt

SEQ ID NO: 840 - DNA, 556 bp, Artificial Sequence
  chemically treated genomic DNA (Homo sapiens) CpG-island No: 840
accgattcctccgcctatcacgctctcccacacctcgtcacacgcaatatcaaaaaaaaaaccccacccacgaacgcctcaatatccccgaccctaaacaacgaaaactcgaacaaacgcccctcactaataactttaaaacgtaaataaaaaaaaatatataaaaacgaaaaaacgccgcactcacctaaattaacgtcctcaaaataaccgctaccatcaaactctacgaataaaactaaaccgaaaacgacgaacgacattaataaaaacccgaaaacaacgatccctatcccaaacctaacgtaaatcccccaaaacgacgtcgccaaaacttaaacgctttcgtacaaaaaaaacgacgactcccctcacgccttcgtaaccccaactcgacgctctactatctctaatccgataaacacacctcaaaaaaactaaaataaccgccacgaaaaaacccccccaaaaatcccgtcctttctttttataactctcaaaaaaaatcgattttctaaactcttactaacttaataacgtaacgttcaacgcaaaa

SEQ ID NO: 841 - DNA, 990 bp, Artificial Sequence
  chemically treated genomic DNA (Homo sapiens) CpG-island No: 841
tgacgcgggcgtcgggggggtaggtcgcgaggtcggggtttttatggcgtaggagtacgggggttttcgaggattacgcgggtttgggaatcgtttgttaggttaggtcggacgacgtacgtgtttcgagttgggtcgagggggcggggttgagggtcgcggtcgggttacgggtcggggaggagtcgcggacggtgggcggggttagtgggtcggggtttaaaaggcggcgcgggcggggtttttgacgtagttgcgggcggcgggcggcgagcggcgcgtataattttcgttcggttgcggttttcgggtgttttaggttcggtcggtaagtagagtatggcgggtgcgggttcgaagcggcgcgcgttagcggtttcggtggtcgaggagaaggaagaggcgcgggagaagatgatggtcgttaagcgcgcggacggcgcggcgtcggtaggcgagggcgagggcgtgattttgtaggggaatattacgttatttaagggcgtggtcgttatcgtggtcgttattatgagttcgggtattttcgtgacgtttacgggcgtgtttaaggaggtaggttcgtcggggttggcgttggtggtgtgggtcgcgtgcggcgttttttttatcgtgggcgcgttttgttacgcggagttgggtattattatttttaaatcgggcggcgattacgtttatatgttggacgtttacggttcgttgttcgttttttttaagttttggatcgagttgtttattattcggtttttatcgtagtatatcgtggttttggttttcgttatttatttgtttaagtcgtttttttttatttgttcggtgttcgaggaggtagttaagttcgtagtttgttatttcgtgcgtgagtacggggcgcgggtcgggggttgggaggtcgtagtttttgggtttttgtatttttgtattattacgtttttggtttttatatttttatatttttgcgtttttggatcg

SEQ ID NO: 842 - DNA, 990 bp, Artificial Sequence
  chemically treated genomic DNA (Homo sapiens) CpG-island No: 842
cgatccaaaaacgcaaaaatataaaaatataaaaaccaaaaacgtaataatacaaaaatacaaaaacccaaaaactacgacctcccaacccccgacccgcgccccgtactcacgcacgaaataacaaactacgaacttaactacctcctcgaacaccgaacaaataaaaaaaaacgacttaaacaaataaataacgaaaaccaaaaccacgatatactacgataaaaaccgaataataaacaactcgatccaaaacttaaaaaaaacgaacaacgaaccgtaaacgtccaacatataaacgtaatcgccgcccgatttaaaaataataatacccaactccgcgtaacaaaacgcgcccacgataaaaaaaacgccgcacgcgacccacaccaccaacgccaaccccgacgaacctacctccttaaacacgcccgtaaacgtcacgaaaatacccgaactcataataacgaccacgataacgaccacgcccttaaataacgtaatattcccctacaaaatcacgccctcgccctcgcctaccgacgccgcgccgtccgcgcgcttaacgaccatcatcttctcccgcgcctcttccttctcctcgaccaccgaaaccgctaacgcgcgccgcttcgaacccgcacccgccatactctacttaccgaccgaacctaaaacacccgaaaaccgcaaccgaacgaaaattatacgcgccgctcgccgcccgccgcccgcaactacgtcaaaaaccccgcccgcgccgccttttaaaccccgacccactaaccccgcccaccgtccgcgactcctccccgacccgtaacccgaccgcgaccctcaaccccgccccctcgacccaactcgaaacacgtacgtcgtccgacctaacctaacaaacgattcccaaacccgcgtaatcctcgaaaacccccgtactcctacgccataaaaaccccgacctcgcgacctacccccccgacgcccgcgtca

SEQ ID NO: 843 - DNA, 990 bp, Artificial Sequence
  chemically treated genomic DNA (Homo sapiens) CpG-island No: 843
cggtttaggaacgtaaaaatgtagagatgtgggagttaggggcgtagtgatgtaaggatgtagggatttagggattacgattttttaattttcggttcgcgtttcgtatttacgtacggagtggtaggttacgagtttggttgttttttcgggtatcgggtaggtggggaagagcggtttgagtaggtaggtggcgaagattagggttacgatgtattgcgatgaaggtcggatgatgagtagttcgatttagagtttgaggaaggcgggtagcgagtcgtagacgtttagtatgtaggcgtagtcgtcgttcgatttggagatggtggtgtttagtttcgcgtagtagagcgcgtttacgatggagaagacgtcgtacgcggtttatattattagcgttagtttcggcgagtttgtttttttgagtacgttcgtgggcgttacgaagatgttcgagtttatgatggcgattacgatgacggttacgtttttgagtagcgtgatgtttttttgtagggttacgttttcgttttcgtttgtcggcgtcgcgtcgttcgcgcgtttggcggttattattttttttcgcgtttttttttttttttcggttatcggggtcgttagcgcgcgtcgtttcgggttcgtattcgttatgttttgtttatcggtcgggtttgggatattcgggagtcgtagtcgagcgaggattgtgcgcgtcgttcgtcgttcgtcgttcgtagttgcgttaggaatttcgttcgcgtcgttttttaggtttcggtttattggtttcgtttatcgttcgcggttttttttcgattcgtggttcggtcgcggtttttagtttcgttttttcgatttagttcggagtacgtgcgtcgttcggtttagtttggtaggcgatttttaggttcgcgtggttttcgaaggttttcgtatttttgcgttatggagatttcggtttcgcgatttattttttcggcgttcgcgtta

SEQ ID NO: 844 - DNA, 990 bp, Artificial Sequence
  chemically treated genomic DNA (Homo sapiens) CpG-island No: 844
taacgcgaacgccgaaaaaataaatcgcgaaaccgaaatctccataacgcaaaaatacgaaaaccttcgaaaaccacgcgaacctaaaaatcgcctaccaaactaaaccgaacgacgcacgtactccgaactaaatcgaaaaaacgaaactaaaaaccgcgaccgaaccacgaatcgaaaaaaaaccgcgaacgataaacgaaaccaataaaccgaaacctaaaaaacgacgcgaacgaaattcctaacgcaactacgaacgacgaacgacgaacgacgcgcacaatcctcgctcgactacgactcccgaatatcccaaacccgaccgataaacaaaacataacgaatacgaacccgaaacgacgcgcgctaacgaccccgataaccgaaaaaaaaaaaaaaacgcgaaaaaaaataataaccgccaaacgcgcgaacgacgcgacgccgacaaacgaaaacgaaaacgtaaccctacaaaaaaacatcacgctactcaaaaacgtaaccgtcatcgtaatcgccatcataaactcgaacatcttcgtaacgcccacgaacgtactcaaaaaaacaaactcgccgaaactaacgctaataatataaaccgcgtacgacgtcttctccatcgtaaacgcgctctactacgcgaaactaaacaccaccatctccaaatcgaacgacgactacgcctacatactaaacgtctacgactcgctacccgccttcctcaaactctaaatcgaactactcatcatccgaccttcatcgcaatacatcgtaaccctaatcttcgccacctacctactcaaaccgctcttccccacctacccgatacccgaaaaaacaaccaaactcgtaacctaccactccgtacgtaaatacgaaacgcgaaccgaaaattaaaaaatcgtaatccctaaatccctacatccttacatcactacgcccctaactcccacatctctacatttttacgttcctaaaccg

SEQ ID NO: 845 - DNA, 854 bp, Artificial Sequence
  chemically treated genomic DNA (Homo sapiens) CpG-island No: 845
cgttttaggattcgttatcgttacgtttagattttttcgtcgtttaagagtttggggtcgtggggggcggggcggtttgttatcggtttcgtttcgtcgataggattcgttttttttcgtaggtacggcggggtcgatttcgtttttcgtttttagtatgtcgtgcgatagcggcggcgcggcgagcggagtcgggaggcggggaagtagtggtcgtgtgagcgtgaggagttgtcgttatcgtttgtttttcgtcgttttttttttcgggggtttcggcgacgtgggtcgcgtagggttttggaagagacgtcgttttttttttattcgttttttttttatcgcgtcgttttcgttttttcgttttgtgttgcgggtttaggcggaattcgaaacggtcgtttttttttttcgttcgtcgtcgtttttttttttttttttttttcggttttttttttagtttcgggtcggagcggggtgttggcggcggtcggttcgggtggcgattcgcgtttttttgggcggcggcgtttggttatatcgtgtcggggaaggtaatgagtcgtagagtttcggggtttcggttgagcggcggcggcggcggcggcggcggcggcggtattaacggtattaattattcgcggagttggaatgattggtaatttaggtgggtgatcggttcgggatttcgtttcgatttttcgggtttcgtttcgggcgggcggaggtttagggtcgcggggttgggaggcgcggtttaggttttttattttcgggagtcgggcgcggttttttgggtttttttcgtttcggttgggggaggaaggtcgcggggaggcgaggtttaagtgttt

SEQ ID NO: 846 - DNA, 854 bp, Artificial Sequence
  chemically treated genomic DNA (Homo sapiens) CpG-island No: 846
aaacacttaaacctcgcctccccgcgaccttcctcccccaaccgaaacgaaaaaaacccaaaaaaccgcgcccgactcccgaaaataaaaaacctaaaccgcgcctcccaaccccgcgaccctaaacctccgcccgcccgaaacgaaacccgaaaaatcgaaacgaaatcccgaaccgatcacccacctaaattaccaatcattccaactccgcgaataattaataccgttaataccgccgccgccgccgccgccgccgccgccgctcaaccgaaaccccgaaactctacgactcattaccttccccgacacgatataaccaaacgccgccgcccaaaaaaacgcgaatcgccacccgaaccgaccgccgccaacaccccgctccgacccgaaactaaaaaaaaaaccgaaaaaaaaaaaaaaaaaaaaacgacgacgaacgaaaaaaaaaaacgaccgtttcgaattccgcctaaacccgcaacacaaaacgaaaaaacgaaaacgacgcgataaaaaaaaaacgaataaaaaaaaaacgacgtctcttccaaaaccctacgcgacccacgtcgccgaaacccccgaaaaaaaaaacgacgaaaaacaaacgataacgacaactcctcacgctcacacgaccactacttccccgcctcccgactccgctcgccgcgccgccgctatcgcacgacatactaaaaacgaaaaacgaaatcgaccccgccgtacctacgaaaaaaaacgaatcctatcgacgaaacgaaaccgataacaaaccgccccgccccccacgaccccaaactcttaaacgacgaaaaaatctaaacgtaacgataacgaatcctaaaacg

SEQ ID NO: 847 - DNA, 854 bp, Artificial Sequence
  chemically treated genomic DNA (Homo sapiens) CpG-island No: 847
aggtatttaggtttcgttttttcgcggttttttttttttagtcggggcggaggagatttaggaagtcgcgttcggttttcgggggtggagggtttaggtcgcgttttttagtttcgcggttttaggttttcgttcgttcgaggcggagttcgggaggtcggggcggggtttcgggtcggttatttatttgggttgttagttattttagtttcgcgaatagttggtgtcgttggtgtcgtcgtcgtcgtcgtcgtcgtcgtcgtcgtttagtcgagatttcggggttttgcggtttattatttttttcgatacgatatggttaagcgtcgtcgtttagagaagcgcgagtcgttattcgaatcggtcgtcgttaatatttcgtttcggttcggggttgagaaggaagtcgagaaggaggaggaggaggaggcggcggcgggcgggggaagaggacgatcgtttcgggtttcgtttgagttcgtagtataggacgaggaggcgggagcggcgcggtgagagagaggcggatgaaggggaggcgacgttttttttagggttttgcgcggtttacgtcgtcggggttttcgaggaggaggacgacgaggaataggcggtggcggtagttttttacgtttatacggttattgttttttcgtttttcggtttcgttcgtcgcgtcgtcgttgtcgtacggtatgttgggagcgagaggcggggtcggtttcgtcgtgtttgcggagagaggcgggttttgtcggcggggcggggtcgatagtaggtcgtttcgttttttacggttttaggtttttggacggcgaagaggtttgggcgtagcggtgacgaattttaagacg

SEQ ID NO: 848 - DNA, 854 bp, Artificial Sequence
  chemically treated genomic DNA (Homo sapiens) CpG-island No: 848
cgtcttaaaattcgtcaccgctacgcccaaacctcttcgccgtccaaaaacctaaaaccgtaaaaaacgaaacgacctactatcgaccccgccccgccgacaaaacccgcctctctccgcaaacacgacgaaaccgaccccgcctctcgctcccaacataccgtacgacaacgacgacgcgacgaacgaaaccgaaaaacgaaaaaacaataaccgtataaacgtaaaaaactaccgccaccgcctattcctcgtcgtcctcctcctcgaaaaccccgacgacgtaaaccgcgcaaaaccctaaaaaaaacgtcgcctccccttcatccgcctctctctcaccgcgccgctcccgcctcctcgtcctatactacgaactcaaacgaaacccgaaacgatcgtcctcttcccccgcccgccgccgcctcctcctcctcctccttctcgacttccttctcaaccccgaaccgaaacgaaatattaacgacgaccgattcgaataacgactcgcgcttctctaaacgacgacgcttaaccatatcgtatcgaaaaaaataataaaccgcaaaaccccgaaatctcgactaaacgacgacgacgacgacgacgacgacgacgacaccaacgacaccaactattcgcgaaactaaaataactaacaacccaaataaataaccgacccgaaaccccgccccgacctcccgaactccgcctcgaacgaacgaaaacctaaaaccgcgaaactaaaaaacgcgacctaaaccctccacccccgaaaaccgaacgcgacttcctaaatctcctccgccccgactaaaaaaaaaaaaccgcgaaaaaacgaaacctaaatacct

SEQ ID NO: 849 - DNA, 1190 bp, Artificial Sequence
  chemically treated genomic DNA (Homo sapiens) CpG-island No: 849
gagcggaaagtagcgcgcgttttttcgatcggtagcgggggtgggcgttttttcggggcgcgggagcgtttttaaagtcgcggggcgttcgtagcgggtaggagttttgttttgtatttttttacggcggggcgtttcgtacgtttttttatgttggttttcggtttcggaacggcgcgcgttttttgtttcggaacgtcgtttttagttaggcggagcgttgggagttgggtttaggcggcgggaggagggcgaacgggttcggggttcgggtttcgatggtcgcgtcgtttcgggggagtcggagtcgagttggtcgtcgttcgcgcgtatttattaagttcgttgagttttttttcgtacgagtattagatgtcggtgtggaaatttttgaagaggaagcggtcgtcgtcggttttttagttgtagagcgcgtcgttaggggggtcgtttttcgaggcggtggcggcggcggcggcggcggcgggggcggcggtgtcgttggtcgtggcgttggcgttcgagttggggtagttggcgcgttcgttttggtcgtagttcggtttggggattcgttgcgtgttttggtattagtgcgtggtgaggaaagcggtggtggcgaatagtagcgttagtaggtttagggttacggttaggagcgttcggtcgcggcggttagtttttatgtcgttcgcgtcgtcgggacgggattgtatcgtcggggagtttcgcgcgcgaagttggtagttggcgtttcgcgttagcggtcgttgttcgtcgcgtttcggggttcgggtgtttgagatcggcggcggcggacgcggcgcgggtttatgttttttttaatttcggggtgggggcgcggcgcggggggcgtgcggggcgggttggcggggcgggcggcggtggaggagcggttacggcgcgttcggagttcggagcgcgagtgtatttcggttaggagtcgttggcgtttggtagcggttacggcgtagggacgcgcgttttttcgtggggagatatttgtaggcggtcggcgatattgtttcggagttcgttcgtacggggagagggggtcgttacgtcgggcgcgggcgggggtttgggagtggagggacgttttcgaaagaaattcgagttagggtgagggtttgagacgtaaggagaattttaggtaaggcgtttttgag

SEQ ID NO: 850 - DNA, 1190 bp, Artificial Sequence
  chemically treated genomic DNA (Homo sapiens) CpG-island No: 850
ctcaaaaacgccttacctaaaattctccttacgtctcaaaccctcaccctaactcgaatttctttcgaaaacgtccctccactcccaaacccccgcccgcgcccgacgtaacgaccccctctccccgtacgaacgaactccgaaacaatatcgccgaccgcctacaaatatctccccacgaaaaaacgcgcgtccctacgccgtaaccgctaccaaacgccaacgactcctaaccgaaatacactcgcgctccgaactccgaacgcgccgtaaccgctcctccaccgccgcccgccccgccaacccgccccgcacgccccccgcgccgcgcccccaccccgaaattaaaaaaaacataaacccgcgccgcgtccgccgccgccgatctcaaacacccgaaccccgaaacgcgacgaacaacgaccgctaacgcgaaacgccaactaccaacttcgcgcgcgaaactccccgacgatacaatcccgtcccgacgacgcgaacgacataaaaactaaccgccgcgaccgaacgctcctaaccgtaaccctaaacctactaacgctactattcgccaccaccgctttcctcaccacgcactaataccaaaacacgcaacgaatccccaaaccgaactacgaccaaaacgaacgcgccaactaccccaactcgaacgccaacgccacgaccaacgacaccgccgcccccgccgccgccgccgccgccgccaccgcctcgaaaaacgacccccctaacgacgcgctctacaactaaaaaaccgacgacgaccgcttcctcttcaaaaatttccacaccgacatctaatactcgtacgaaaaaaaactcaacgaacttaataaatacgcgcgaacgacgaccaactcgactccgactcccccgaaacgacgcgaccatcgaaacccgaaccccgaacccgttcgccctcctcccgccgcctaaacccaactcccaacgctccgcctaactaaaaacgacgttccgaaacaaaaaacgcgcgccgttccgaaaccgaaaaccaacataaaaaaacgtacgaaacgccccgccgtaaaaaaatacaaaacaaaactcctacccgctacgaacgccccgcgactttaaaaacgctcccgcgccccgaaaaaacgcccacccccgctaccgatcgaaaaaacgcgcgctactttccgctc

SEQ ID NO: 851 - DNA, 1190 bp, Artificial Sequence
  chemically treated genomic DNA (Homo sapiens) CpG-island No: 851
tttaggagcgttttgtttgggattttttttgcgttttagatttttattttggttcggatttttttcgggggcgtttttttatttttaggttttcgttcgcgttcggcgtggcggtttttttttttcgtgcgggcgggtttcggaatagtgtcgtcggtcgtttgtaggtgtttttttacggaggggcgcgcgtttttgcgtcgtggtcgttgttaggcgttagcggtttttagtcgaggtgtattcgcgtttcgggtttcgggcgcgtcgtagtcgtttttttatcgtcgttcgtttcgttagttcgtttcgtacgtttttcgcgtcgcgtttttatttcggggttggggggggtatgggttcgcgtcgcgttcgtcgtcgtcgattttaggtattcgagtttcggggcgcggcgggtagcggtcgttgacgcggggcgttagttgttaatttcgcgcgcggagtttttcggcggtgtagtttcgtttcggcggcgcgggcggtatgaagattagtcgtcgcggtcgagcgtttttggtcgtggttttgaatttgttggcgttgttgttcgttattatcgttttttttattacgtattggtgttagggtacgtagcgggtttttaagtcgggttgcggttagggcgggcgcgttaattgttttaattcgggcgttaacgttacggttaacggtatcgtcgttttcgtcgtcgtcgtcgtcgtcgttatcgtttcggggaacggtttttttggcggcgcgttttatagttgggagatcggcgacgatcgttttttttttaggaatttttatatcggtatttggtattcgtgcgaggaggagtttagcgggtttggtgagtgcgcgcgggcggcggttagttcggtttcggttttttcggggcggcgcggttatcgaggttcgagtttcggattcgttcgtttttttttcgtcgtttgggtttagtttttagcgtttcgtttggttaggggcgacgtttcggggtagggggcgcgcgtcgtttcggggtcggggattagtatggggggacgtgcgggacgtttcgtcgtggagaggtgtaaggtagagtttttattcgttgcggacgtttcgcggttttggggacgttttcgcgtttcgggaaggcgtttattttcgttgtcggtcggaggggcgcgcgttgtttttcgttt

SEQ ID NO: 852 - DNA, 1190 bp, Artificial Sequence
  chemically treated genomic DNA (Homo sapiens) CpG-island No: 852
aaacgaaaaacaacgcgcgcccctccgaccgacaacgaaaataaacgccttcccgaaacgcgaaaacgtccccaaaaccgcgaaacgtccgcaacgaataaaaactctaccttacacctctccacgacgaaacgtcccgcacgtccccccatactaatccccgaccccgaaacgacgcgcgccccctaccccgaaacgtcgcccctaaccaaacgaaacgctaaaaactaaacccaaacgacgaaaaaaaaacgaacgaatccgaaactcgaacctcgataaccgcgccgccccgaaaaaaccgaaaccgaactaaccgccgcccgcgcgcactcaccaaacccgctaaactcctcctcgcacgaataccaaataccgatataaaaattcctaaaaaaaaaacgatcgtcgccgatctcccaactataaaacgcgccgccaaaaaaaccgttccccgaaacgataacgacgacgacgacgacgacgaaaacgacgataccgttaaccgtaacgttaacgcccgaattaaaacaattaacgcgcccgccctaaccgcaacccgacttaaaaacccgctacgtaccctaacaccaatacgtaataaaaaaaacgataataacgaacaacaacgccaacaaattcaaaaccacgaccaaaaacgctcgaccgcgacgactaatcttcataccgcccgcgccgccgaaacgaaactacaccgccgaaaaactccgcgcgcgaaattaacaactaacgccccgcgtcaacgaccgctacccgccgcgccccgaaactcgaatacctaaaatcgacgacgacgaacgcgacgcgaacccataccccccccaaccccgaaataaaaacgcgacgcgaaaaacgtacgaaacgaactaacgaaacgaacgacgataaaaaaacgactacgacgcgcccgaaacccgaaacgcgaatacacctcgactaaaaaccgctaacgcctaacaacgaccacgacgcaaaaacgcgcgcccctccgtaaaaaaacacctacaaacgaccgacgacactattccgaaacccgcccgcacgaaaaaaaaaaaccgccacgccgaacgcgaacgaaaacctaaaaataaaaaaacgcccccgaaaaaaatccgaaccaaaataaaaatctaaaacgcaaaaaaaatcccaaacaaaacgctcctaaa

SEQ ID NO: 853 - DNA, 511 bp, Artificial Sequence
  chemically treated genomic DNA (Homo sapiens) CpG-island No: 853
cggtagaaagggatgcgaaggtgtaaggatgagggcgcgtattagtacgcgggagaaaaagagggggcggcgggtaaaatgaagttgtttttttgtttttttgtttttttgtttttggtatagatcgtaatttttcgtcgcgtatcgcgtagcgtcgggttcgaaggtagggaagcggttgttggagtttttgtgattttaggattttgttttattttgttcgtcgcgttttggcgtttcgtcgtttgttcgtcgggtgttgcgtttcgagggttaaagagggagtcgcgcggcgtagtcggggtttttttttgttgcgaggtattagtattcgtattttcgtattttttgttcgtttcgattattttattttgttttggcgtaggcggagagtacggattttaattcgaatgtcgttgtagttatttttaaaagttttcgttttaggttttttaggaataggagttgagttattgcggtcgtagcggtagagttttcgtttgattttatt

SEQ ID NO: 854 - DNA, 511 bp, Artificial Sequence
  chemically treated genomic DNA (Homo sapiens) CpG-island No: 854
aataaaatcaaacgaaaactctaccgctacgaccgcaataactcaactcctattcctaaaaaacctaaaacgaaaacttttaaaaataactacaacgacattcgaattaaaatccgtactctccgcctacgccaaaacaaaataaaataatcgaaacgaacaaaaaatacgaaaatacgaatactaatacctcgcaacaaaaaaaaaccccgactacgccgcgcgactccctctttaaccctcgaaacgcaacacccgacgaacaaacgacgaaacgccaaaacgcgacgaacaaaataaaacaaaatcctaaaatcacaaaaactccaacaaccgcttccctaccttcgaacccgacgctacgcgatacgcgacgaaaaattacgatctataccaaaaacaaaaaaacaaaaaaacaaaaaaacaacttcattttacccgccgccccctctttttctcccgcgtactaatacgcgccctcatccttacaccttcgcatccctttctaccg

SEQ ID NO: 855 - DNA, 511 bp, Artificial Sequence
  chemically treated genomic DNA (Homo sapiens) CpG-island No: 855
ggtgaggttaggcggaggttttgtcgttgcggtcgtagtagtttagtttttatttttgggaagtttggaacggggatttttgaaaataattgtagcggtattcgggttagggttcgtgtttttcgtttgcgttaggatagggtgaagtggtcggggcgagtagagggtgcgaaggtgcgggtgttggtgtttcgtagtaggagggagtttcggttgcgtcgcgcgattttttttttggttttcggagcgtagtattcggcggataagcggcgggacgttaggacgcggcgagtaaggtgaggtagggttttgaagttataggggttttagtagtcgtttttttgttttcggattcggcgttgcgcggtgcgcggcgaggagttgcgatttgtattaggggtagaggagtagaggagtagggaaatagttttattttgttcgtcgttttttttttttttttcgcgtgttggtgcgcgtttttatttttatattttcgtatttttttttgtcg

SEQ ID NO: 856 - DNA, 511 bp, Artificial Sequence
  chemically treated genomic DNA (Homo sapiens) CpG-island No: 856
cgacaaaaaaaaatacgaaaatataaaaataaaaacgcgcaccaacacgcgaaaaaaaaaaaaaaaacgacgaacaaaataaaactatttccctactcctctactcctctacccctaatacaaatcgcaactcctcgccgcgcaccgcgcaacgccgaatccgaaaacaaaaaaacgactactaaaacccctataacttcaaaaccctacctcaccttactcgccgcgtcctaacgtcccgccgcttatccgccgaatactacgctccgaaaaccaaaaaaaaaatcgcgcgacgcaaccgaaactccctcctactacgaaacaccaacacccgcaccttcgcaccctctactcgccccgaccacttcaccctatcctaacgcaaacgaaaaacacgaaccctaacccgaataccgctacaattattttcaaaaatccccgttccaaacttcccaaaaataaaaactaaactactacgaccgcaacgacaaaacctccgcctaacctcacc

SEQ ID NO: 857 - DNA, 508 bp, Artificial Sequence
  chemically treated genomic DNA (Homo sapiens) CpG-island No: 857
ttcggtcgagtggaaagaagtcggattatattcggcgaggaggaaggtttatttttcggaggggaggtttttcgattagagcgagtggagaggatagtatgacgtgggggtaggatcgagaggggttacggtagtcgaagggtatacggagggatacgcgcggaatagatagagagcggtgcggggggtatattaaagagtgtttttatgttaaggaaaggcgaggacggaaattaagagtggagtttagaggtggtttaacgggtcgaaacgtaggagaaggcggtaagacgaggttcgggtgaggagtagtttttcgaaaggtgtttgtgtatgaattcgggattaaagggagttataatgagggttcggggtttaaacgttacgaatatatcgtaaattaaggacggttgagcggtgagttaatgtgtaacgcgagagaggcgtgttttgtatgtggataagttttaggtttattacggatatgtaaataatgatattgtaagat

SEQ ID NO: 858 - DNA, 508 bp, Artificial Sequence
  chemically treated genomic DNA (Homo sapiens) CpG-island No: 858
atcttacaatatcattatttacatatccgtaataaacctaaaacttatccacatacaaaacacgcctctctcgcgttacacattaactcaccgctcaaccgtccttaatttacgatatattcgtaacgtttaaaccccgaaccctcattataactccctttaatcccgaattcatacacaaacacctttcgaaaaactactcctcacccgaacctcgtcttaccgccttctcctacgtttcgacccgttaaaccacctctaaactccactcttaatttccgtcctcgcctttccttaacataaaaacactctttaatataccccccgcaccgctctctatctattccgcgcgtatccctccgtatacccttcgactaccgtaacccctctcgatcctacccccacgtcatactatcctctccactcgctctaatcgaaaaacctcccctccgaaaaataaaccttcctcctcgccgaatataatccgacttctttccactcgaccgaa

SEQ ID NO: 859 - DNA, 508 bp, Artificial Sequence
  chemically treated genomic DNA (Homo sapiens) CpG-island No: 859
attttatagtgttattgtttgtatgttcgtgatgggtttaggatttatttatatatagagtacgtttttttcgcgttgtatattgatttatcgtttagtcgtttttgatttacggtgtgttcgtaacgtttgagtttcgggtttttattgtggttttttttggtttcgaatttatgtataaatatttttcggggggttattttttattcgaatttcgttttgtcgtttttttttgcgtttcggttcgttgggttatttttgggttttatttttggttttcgttttcgtttttttttaatataggagtattttttggtgtgtttttcgtatcgttttttgtttatttcgcgcgtgttttttcgtgtatttttcggttgtcgtggtttttttcggttttgtttttacgttatattgttttttttattcgttttgatcgggagatttttttttcgggaggtaagttttttttttcgtcgggtgtagttcggtttttttttattcggtcggg

SEQ ID NO: 860 - DNA, 508 bp, Artificial Sequence
  chemically treated genomic DNA (Homo sapiens) CpG-island No: 860
cccgaccgaataaaaaaaaaccgaactacacccgacgaaaaaaaaaacttacctcccgaaaaaaaaatctcccgatcaaaacgaataaaaaaaacaatataacgtaaaaacaaaaccgaaaaaaaccacgacaaccgaaaaatacacgaaaaaacacgcgcgaaataaacaaaaaacgatacgaaaaacacaccaaaaaatactcctatattaaaaaaaaacgaaaacgaaaaccaaaaataaaacccaaaaataacccaacgaaccgaaacgcaaaaaaaaacgacaaaacgaaattcgaataaaaaataaccccccgaaaaatatttatacataaattcgaaaccaaaaaaaaccacaataaaaacccgaaactcaaacgttacgaacacaccgtaaatcaaaaacgactaaacgataaatcaatatacaacgcgaaaaaaacgtactctatatataaataaatcctaaacccatcacgaacatacaaacaataacactataaaat

SEQ ID NO: 861 - DNA, 883 bp, Artificial Sequence
  chemically treated genomic DNA (Homo sapiens) CpG-island No: 861
tatcgtggcgtttttagcgtcgtggtggtcgatgaggcggttgttttttgggtgtcgttgtgtttagcggttgatgtcgtagacgcggcgttcgatgattagttatttgtcgtcgggttggtcgtgcgcgcggatttgtttttagtagaaggtgggtagcggtgttttcggttgcgcgggtttttttcgcggtttcggtttttcgacgtcgtttatgttgtacgtacgagttttggggattttaggcggtggtcgaggttcgagtaagatttcgagggaagcgaagagcgttttcgggcgtcgttttcgtcgtcgttcgttgtttcggtttcgttttgtcgtcgcggtcgtcgtacgagcgagcgtgcgtttttcggttcgcggcgtagggaatttttcgttttataatcgcgcggacggcgttcgtttcgtttcgtttgttttttcgttttcggttaggtttcggtttttaaggttggttgatttttcgcgttcgttttaatttaggcgcggggtttcggtttttattggtcgttagggagggcggcgtcgaggcggttcgtttttttcgggaggatagcggtcgttatttagttttgtttcggggtatcgtttcgtttttttttttcgggttgtcggtttttaggtttttgatttcgttcggagcgcggggtttggggatataatacgtatttgttgggcgtttcgtagcgtttcgttacgttttcgggaatcggaggcggagtttcggtttgtgagtagcggggtttggggggtttttagtcgcgcgttttgtaacgttaaatttagtgcgtttagaggggggacgttgtttcggggtgtttgtgaatagtttttaaattatgggttttaatttttgcgg

SEQ ID NO: 862 - DNA, 883 bp, Artificial Sequence
  chemically treated genomic DNA (Homo sapiens) CpG-island No: 862
ccgcaaaaattaaaacccataatttaaaaactattcacaaacaccccgaaacaacgtcccccctctaaacgcactaaatttaacgttacaaaacgcgcgactaaaaaccccccaaaccccgctactcacaaaccgaaactccgcctccgattcccgaaaacgtaacgaaacgctacgaaacgcccaacaaatacgtattatatccccaaaccccgcgctccgaacgaaatcaaaaacctaaaaaccgacaacccgaaaaaaaaaaacgaaacgataccccgaaacaaaactaaataacgaccgctatcctcccgaaaaaaacgaaccgcctcgacgccgccctccctaacgaccaataaaaaccgaaaccccgcgcctaaattaaaacgaacgcgaaaaatcaaccaaccttaaaaaccgaaacctaaccgaaaacgaaaaaacaaacgaaacgaaacgaacgccgtccgcgcgattataaaacgaaaaattccctacgccgcgaaccgaaaaacgcacgctcgctcgtacgacgaccgcgacgacaaaacgaaaccgaaacaacgaacgacgacgaaaacgacgcccgaaaacgctcttcgcttccctcgaaatcttactcgaacctcgaccaccgcctaaaatccccaaaactcgtacgtacaacataaacgacgtcgaaaaaccgaaaccgcgaaaaaaacccgcgcaaccgaaaacaccgctacccaccttctactaaaaacaaatccgcgcgcacgaccaacccgacgacaaataactaatcatcgaacgccgcgtctacgacatcaaccgctaaacacaacgacacccaaaaaacaaccgcctcatcgaccaccacgacgctaaaaacgccacgata

SEQ ID NO: 863 - DNA, 883 bp, Artificial Sequence
  chemically treated genomic DNA (Homo sapiens) CpG-island No: 863
tcgtagagattggggtttatggtttgaaggttgtttataggtatttcgagatagcgttttttttttgggcgtattggatttgacgttgtaggacgcgcggttggaagttttttaggtttcgttgtttatagatcgggatttcgttttcggttttcgagggcgtggcgaggcgttgcgggacgtttaataggtgcgtgttgtgtttttaggtttcgcgtttcgggcggagttaagagtttggaagtcggtagttcgggaaaagggggcgggacggtgtttcggggtagggttgggtggcggtcgttgttttttcgggaggggcgggtcgtttcgacgtcgttttttttggcggttaatggagatcgaggtttcgcgtttggattggagcggacgcggggggttagttagttttgggggtcggggtttggtcgggggcgggggggtaggcgaggcgaggcgggcgtcgttcgcgcggttataaggcggggagttttttgcgtcgcgagtcgggaggcgtacgttcgttcgtacggcggtcgcggcggtagggcggggtcggagtagcgggcggcggcggaggcggcgttcgggagcgtttttcgtttttttcggggttttgttcggatttcggttatcgtttgggatttttaggattcgtgcgtgtagtatgggcggcgtcggggagtcgggatcgcgggagggattcgcgtagtcgggggtatcgttgtttattttttgttgggagtagattcgcgcgtacgattagttcggcgataagtggttggttatcgagcgtcgcgtttacgatattagtcgttgggtatagcggtatttagggggtagtcgttttatcggttattacggcgttgaggacgttacggta

SEQ ID NO: 864 - DNA, 883 bp, Artificial Sequence
  chemically treated genomic DNA (Homo sapiens) CpG-island No: 864
taccgtaacgtcctcaacgccgtaataaccgataaaacgactaccccctaaataccgctatacccaacgactaatatcgtaaacgcgacgctcgataaccaaccacttatcgccgaactaatcgtacgcgcgaatctactcccaacaaaaaataaacaacgatacccccgactacgcgaatccctcccgcgatcccgactccccgacgccgcccatactacacgcacgaatcctaaaaatcccaaacgataaccgaaatccgaacaaaaccccgaaaaaaacgaaaaacgctcccgaacgccgcctccgccgccgcccgctactccgaccccgccctaccgccgcgaccgccgtacgaacgaacgtacgcctcccgactcgcgacgcaaaaaactccccgccttataaccgcgcgaacgacgcccgcctcgcctcgcctacccccccgcccccgaccaaaccccgacccccaaaactaactaaccccccgcgtccgctccaatccaaacgcgaaacctcgatctccattaaccgccaaaaaaaacgacgtcgaaacgacccgcccctcccgaaaaaacaacgaccgccacccaaccctaccccgaaacaccgtcccgcccccttttcccgaactaccgacttccaaactcttaactccgcccgaaacgcgaaacctaaaaacacaacacgcacctattaaacgtcccgcaacgcctcgccacgccctcgaaaaccgaaaacgaaatcccgatctataaacaacgaaacctaaaaaacttccaaccgcgcgtcctacaacgtcaaatccaatacgcccaaaaaaaaaacgctatctcgaaatacctataaacaaccttcaaaccataaaccccaatctctacga

SEQ ID NO: 865 - DNA, 594 bp, Artificial Sequence
  chemically treated genomic DNA (Homo sapiens) CpG-island No: 865
gtatagtattttcgggtggcggcgtagattcggcggggattttcgaaattttttcgtttcgggaggcgatcgcggtttagatttagcgcgggatcgcgagcgcgcgcggatttattcgttttatatttcggcgtttcggggcgtttaggcgttcgtttttagcgtcgtcgcgtttttttagcgtcgcgttttcgttcgtcgtcgatttcgttaggggtcgagtcgttttatcgtttgttagttttgttcgcggttagttagtaggttttagacgtttgggttcgcggtttttagtttagtttcgattttgttttgggcgggttacgtggcggaggggggagcggttcgaggatacgtgttcggtttcgttttttcgtcggttcggcgttgggattcggcgcgcgtttttaaggtttggttttattcggttcgtcgcgtcgggatagggagattacggcgttcggagggaattcggtttttaatatttcgcgggtcgcgtcgcgtttagattttttagttgattttttttttttagtcgtttttcgtattatttattttgggttatttttgtttaagaatttataatggttttcg

SEQ ID NO: 866 - DNA, 594 bp, Artificial Sequence
  chemically treated genomic DNA (Homo sapiens) CpG-island No: 866
cgaaaaccattataaattcttaaacaaaaataacccaaaataaataatacgaaaaacgactaaaaaaaaaaaatcaactaaaaaatctaaacgcgacgcgacccgcgaaatattaaaaaccgaattccctccgaacgccgtaatctccctatcccgacgcgacgaaccgaataaaaccaaaccttaaaaacgcgcgccgaatcccaacgccgaaccgacgaaaaaacgaaaccgaacacgtatcctcgaaccgctcccccctccgccacgtaacccgcccaaaacaaaatcgaaactaaactaaaaaccgcgaacccaaacgtctaaaacctactaactaaccgcgaacaaaactaacaaacgataaaacgactcgacccctaacgaaatcgacgacgaacgaaaacgcgacgctaaaaaaacgcgacgacgctaaaaacgaacgcctaaacgccccgaaacgccgaaatataaaacgaataaatccgcgcgcgctcgcgatcccgcgctaaatctaaaccgcgatcgcctcccgaaacgaaaaaatttcgaaaatccccgccgaatctacgccgccacccgaaaatactatac

SEQ ID NO: 867 - DNA, 594 bp, Artificial Sequence
  chemically treated genomic DNA (Homo sapiens) CpG-island No: 867
cgggagttattgtaggtttttgagtaggggtggtttaaagtgggtggtgcggagggcgattggagaggaggagttagttggggagtttgagcgcggcgcggttcgcgggatgttgggggtcgggtttttttcgagcgtcgtggtttttttgtttcggcgcggcgggtcgggtggggttaggttttgggagcgcgcgtcggattttagcgtcgggtcggcggaggggcggggtcgggtacgtgttttcgggtcgttttttttttcgttacgtgattcgtttagggtagggtcggggttgggttgggggtcgcgagtttaggcgtttgagatttattgattggtcgcgggtagggttgataggcggtggggcggttcggtttttggcggagtcggcggcgggcggggacgcggcgttgggaggacgcggcggcgttgggaacggacgtttgggcgtttcgaggcgtcgggatgtggagcgggtaggttcgcgcgcgttcgcggtttcgcgttgggtttgggtcgcggtcgtttttcgggacgggaggatttcgggggttttcgtcgggtttgcgtcgttattcggaggtgttgtgt

SEQ ID NO: 868 - DNA, 594 bp, Artificial Sequence
  chemically treated genomic DNA (Homo sapiens) CpG-island No: 868
acacaacacctccgaataacgacgcaaacccgacgaaaacccccgaaatcctcccgtcccgaaaaacgaccgcgacccaaacccaacgcgaaaccgcgaacgcgcgcgaacctacccgctccacatcccgacgcctcgaaacgcccaaacgtccgttcccaacgccgccgcgtcctcccaacgccgcgtccccgcccgccgccgactccgccaaaaaccgaaccgccccaccgcctatcaaccctacccgcgaccaatcaataaatctcaaacgcctaaactcgcgacccccaacccaaccccgaccctaccctaaacgaatcacgtaacgaaaaaaaaaacgacccgaaaacacgtacccgaccccgcccctccgccgacccgacgctaaaatccgacgcgcgctcccaaaacctaaccccacccgacccgccgcgccgaaacaaaaaaaccacgacgctcgaaaaaaacccgacccccaacatcccgcgaaccgcgccgcgctcaaactccccaactaactcctcctctccaatcgccctccgcaccacccactttaaaccacccctactcaaaaacctacaataactcccg

SEQ ID NO: 869 - DNA, 720 bp, Artificial Sequence
  chemically treated genomic DNA (Homo sapiens) CpG-island No: 869
ttttagaagggcgtagggaggcgggagagttcgcgggtggttatattttcggttcgttttagcgcgcgtttcgggaatcgcgttcggttttcgttatcgtttaggttcgttcgcgtttattatggataggtaaacgtaggaggcgtagagttttaggttgatttggcggttgatggcggtttttgagttttggtggtagttttggcgtatttgcgaggtggacgcggtcgttatggcggcgattaaggagaggcggcggcggcggcggtggttgcgcggcgttggagcggcggcgggggttttggggtagttcgagggtgcggtgaagaggtgacggagggttggttatgggcggtcggtcggggtggggaacgagcgtcgggtttcgtttaagtattgttgaagtaggaaatttcgacgattttcggcgaagaacgtttggttttgcgggtcgtttgtggttttttatagtcgcgtcggcgttaggttcgtttcggttaattagcgtcgttcgtttcgagttcgtttttttcggtgggcgcgggatttcgtttttgttgtgggggaggggcggtcgttggaggttttcgcgcgttttggcggagttcgggagcggggatcggtagtcgattgtttttgggatagcggtggcgtttttgtgttcgtttagtggagttggagggaagttgcgaggaggcgtaggaagtttattttagaatt

SEQ ID NO: 870 - DNA, 720 bp, Artificial Sequence
  chemically treated genomic DNA (Homo sapiens) CpG-island No: 870
aattctaaaataaacttcctacgcctcctcgcaacttccctccaactccactaaacgaacacaaaaacgccaccgctatcccaaaaacaatcgactaccgatccccgctcccgaactccgccaaaacgcgcgaaaacctccaacgaccgcccctcccccacaacaaaaacgaaatcccgcgcccaccgaaaaaaacgaactcgaaacgaacgacgctaattaaccgaaacgaacctaacgccgacgcgactataaaaaaccacaaacgacccgcaaaaccaaacgttcttcgccgaaaatcgtcgaaatttcctacttcaacaatacttaaacgaaacccgacgctcgttccccaccccgaccgaccgcccataaccaaccctccgtcacctcttcaccgcaccctcgaactaccccaaaacccccgccgccgctccaacgccgcgcaaccaccgccgccgccgccgcctctccttaatcgccgccataacgaccgcgtccacctcgcaaatacgccaaaactaccaccaaaactcaaaaaccgccatcaaccgccaaatcaacctaaaactctacgcctcctacgtttacctatccataataaacgcgaacgaacctaaacgataacgaaaaccgaacgcgattcccgaaacgcgcgctaaaacgaaccgaaaatataaccacccgcgaactctcccgcctccctacgcccttctaaaa

SEQ ID NO: 871 - DNA, 720 bp, Artificial Sequence
  chemically treated genomic DNA (Homo sapiens) CpG-island No: 871
ggttttgaggtggattttttgcgttttttcgtagtttttttttaattttattaaacgggtatagagacgttatcgttgttttagaggtagtcggttatcggttttcgttttcgagtttcgttagagcgcgcgagggtttttagcggtcgttttttttttatagtaggggcggggtttcgcgtttatcggaaggagcgggttcggggcgggcggcgttgattggtcggggcgggtttgacgtcgacgcggttataagagattataagcgattcgtagggttagacgtttttcgtcgagagtcgtcggggttttttgttttaatagtgtttggacggaattcggcgttcgttttttatttcggtcggtcgtttatagttagtttttcgttatttttttatcgtattttcggattgttttaaggttttcgtcgtcgttttagcgtcgcgtagttatcgtcgtcgtcgtcgtttttttttagtcgtcgttatgacgatcgcgtttatttcgtaggtgcgttagaattattattaggatttagaggtcgttattaatcgttagattaatttggagttttacgttttttacgtttatttgtttatggtgagcgcgggcgggtttaagcggtggcgggggtcgggcgcggttttcggggcgcgcgttggggcgggtcgggggtgtggttattcgcgggttttttcgtttttttgcgtttttttggaa

SEQ ID NO: 872 - DNA, 720 bp, Artificial Sequence
  chemically treated genomic DNA (Homo sapiens) CpG-island No: 872
ttccaaaaaaacgcaaaaaaacgaaaaaacccgcgaataaccacacccccgacccgccccaacgcgcgccccgaaaaccgcgcccgacccccgccaccgcttaaacccgcccgcgctcaccataaacaaataaacgtaaaaaacgtaaaactccaaattaatctaacgattaataacgacctctaaatcctaataataattctaacgcacctacgaaataaacgcgatcgtcataacgacgactaaaaaaaaacgacgacgacgacgataactacgcgacgctaaaacgacgacgaaaaccttaaaacaatccgaaaatacgataaaaaaataacgaaaaactaactataaacgaccgaccgaaataaaaaacgaacgccgaattccgtccaaacactattaaaacaaaaaaccccgacgactctcgacgaaaaacgtctaaccctacgaatcgcttataatctcttataaccgcgtcgacgtcaaacccgccccgaccaatcaacgccgcccgccccgaacccgctccttccgataaacgcgaaaccccgcccctactataaaaaaaaaacgaccgctaaaaaccctcgcgcgctctaacgaaactcgaaaacgaaaaccgataaccgactacctctaaaacaacgataacgtctctatacccgtttaataaaattaaaaaaaaactacgaaaaaacgcaaaaaatccacctcaaaacc

SEQ ID NO: 873 - DNA, 543 bp, Artificial Sequence
  chemically treated genomic DNA (Homo sapiens) CpG-island No: 873
gtacgcgtatttacgcgagttcgggtttatgacgttattagcgtagcgttatcgtcgcggaaggtttaggggtttgttttgtatgcggcgtgttttagggaggtttaggcggacgtttgtaagtcgggtgcgcggttcgggggcggttcggaaattttagcggaaggtagtaaggggcgcgtggggtcgtggagttacgaagttgggcggtaggaggggcggtttggagttttcgcggggtatagcgcgtgcgtgagggcggtcggcggggttgttcggcgcgggtgtttcggcgatgtgtggcgttgaggcggcggcgggagtagcggcgtcgagttttgtttcggtttcggtttcggtttcgcggcggtgtaggcggcggaggcggaggcgtaggtttttttttaggatttggcgagtttaggtttaagcggcggtttcgcgaggtttttgtacggcgtttcgggtcgaggtttttttcgtttcgttttattttaggagtttgtttttttagttggggatgaggttaggaggcggtcgcgt

SEQ ID NO: 874 - DNA, 543 bp, Artificial Sequence
  chemically treated genomic DNA (Homo sapiens) CpG-island No: 874
acgcgaccgcctcctaacctcatccccaactaaaaaaacaaactcctaaaataaaacgaaacgaaaaaaacctcgacccgaaacgccgtacaaaaacctcgcgaaaccgccgcttaaacctaaactcgccaaatcctaaaaaaaaacctacgcctccgcctccgccgcctacaccgccgcgaaaccgaaaccgaaaccgaaacaaaactcgacgccgctactcccgccgccgcctcaacgccacacatcgccgaaacacccgcgccgaacaaccccgccgaccgccctcacgcacgcgctataccccgcgaaaactccaaaccgcccctcctaccgcccaacttcgtaactccacgaccccacgcgccccttactaccttccgctaaaatttccgaaccgcccccgaaccgcgcacccgacttacaaacgtccgcctaaacctccctaaaacacgccgcatacaaaacaaacccctaaaccttccgcgacgataacgctacgctaataacgtcataaacccgaactcgcgtaaatacgcgtac

SEQ ID NO: 875 - DNA, 543 bp, Artificial Sequence
  chemically treated genomic DNA (Homo sapiens) CpG-island No: 875
acgcggtcgttttttagttttatttttagttggggaggtaggtttttggggtagggcgaggcggggagggtttcgattcggggcgtcgtgtaagggtttcgcggggtcgtcgtttagatttgggttcgttaggttttaaagaagagtttgcgttttcgttttcgtcgtttgtatcgtcgcgaagtcgaagtcgaagtcgaagtagagttcggcgtcgttgttttcgtcgtcgttttagcgttatatatcgtcgggatattcgcgtcgggtagtttcgtcggtcgtttttacgtacgcgttgtgtttcgcgggagttttaggtcgttttttttgtcgtttagtttcgtgattttacggttttacgcgttttttgttgtttttcgttggggttttcgagtcgttttcgaatcgcgtattcgatttgtaggcgttcgtttgggtttttttaagatacgtcgtatataggataggtttttgggtttttcgcggcgatggcgttgcgttaatgacgttataggttcggattcgcgtgagtgcgcgtgt

SEQ ID NO: 876 - DNA, 543 bp, Artificial Sequence
  chemically treated genomic DNA (Homo sapiens) CpG-island No: 876
acacgcgcactcacgcgaatccgaacctataacgtcattaacgcaacgccatcgccgcgaaaaacccaaaaacctatcctatatacgacgtatcttaaaaaaacccaaacgaacgcctacaaatcgaatacgcgattcgaaaacgactcgaaaaccccaacgaaaaacaacaaaaaacgcgtaaaaccgtaaaatcacgaaactaaacgacaaaaaaaacgacctaaaactcccgcgaaacacaacgcgtacgtaaaaacgaccgacgaaactacccgacgcgaatatcccgacgatatataacgctaaaacgacgacgaaaacaacgacgccgaactctacttcgacttcgacttcgacttcgcgacgatacaaacgacgaaaacgaaaacgcaaactcttctttaaaacctaacgaacccaaatctaaacgacgaccccgcgaaacccttacacgacgccccgaatcgaaaccctccccgcctcgccctaccccaaaaacctacctccccaactaaaaataaaactaaaaaacgaccgcgt

SEQ ID NO: 877 - DNA, 567 bp, Artificial Sequence
  chemically treated genomic DNA (Homo sapiens) CpG-island No: 877
tcggtgtagaagtatcgttcgattttcggcgcgggtgttcgttatagttttagtgtttcgttcggtgtagtttttttttcgtcggtttcgttattcgtagttattttacgtttgtcgtttcggcgttttattcggggtagtcgattagtaggtagttttcggtttttagtattgtatcgtttgcggtgcgaacgtgacgttcgcgatatagggggggattttcggcgcgtcgcgttacgttacgtgtttcgtatcggaagcgcgtttttagtcgtttcggtaatagtcgtttttttcgcgttttttattttttttttgtttttttaaggaaaattaggtttttgcgcggttaacgtttaggattcgtaagttgcgcgtttacgaggtgatttcggggacggttgggttttttttggggagtgagggaggagtttagacgtttcgggttttggttttttttgatgcgtagagagtcgaggttttggacgttacgttgtttttataattattttaatttcgcgataaaaggtggggtcggaggtttatgagatttttaaattattgtag

SEQ ID NO: 878 - DNA, 567 bp, Artificial Sequence
  chemically treated genomic DNA (Homo sapiens) CpG-island No: 878
ctacaataatttaaaaatctcataaacctccgaccccaccttttatcgcgaaattaaaataattataaaaacaacgtaacgtccaaaacctcgactctctacgcatcaaaaaaaaccaaaacccgaaacgtctaaactcctccctcactccccaaaaaaaacccaaccgtccccgaaatcacctcgtaaacgcgcaacttacgaatcctaaacgttaaccgcgcaaaaacctaattttccttaaaaaaacaaaaaaaaaataaaaaacgcgaaaaaaacgactattaccgaaacgactaaaaacgcgcttccgatacgaaacacgtaacgtaacgcgacgcgccgaaaatccccccctatatcgcgaacgtcacgttcgcaccgcaaacgatacaatactaaaaaccgaaaactacctactaatcgactaccccgaataaaacgccgaaacgacaaacgtaaaataactacgaataacgaaaccgacgaaaaaaaaactacaccgaacgaaacactaaaactataacgaacacccgcgccgaaaatcgaacgatacttctacaccga

SEQ ID NO: 879 - DNA, 567 bp, Artificial Sequence
  chemically treated genomic DNA (Homo sapiens) CpG-island No: 879
ttgtaatgatttaggaattttatgggttttcggttttattttttgtcgcgggattaagataattatgagagtaacgtgacgtttaagatttcggttttttgcgtattagaagaagttagggttcggggcgtttaagttttttttttattttttaaaggaaatttagtcgttttcgaagttatttcgtgggcgcgtagtttgcggattttgggcgttggtcgcgtaggggtttagttttttttggagagatagagggggagtgggggacgcgagggaggcggttgttgtcggggcgattggaagcgcgttttcggtgcggaatacgtggcgtggcgcggcgcgtcggaagtttttttttgtgtcgcggacgttacgttcgtatcgtaggcggtgtagtgttggaggtcggaagttgtttgttaatcggttatttcgagtggagcgtcggggcggtaggcgtgggatggttgcgggtggcggggtcggcggagagggagttgtatcgggcggggtattgggattgtggcgggtattcgcgtcgggggtcggacggtgtttttgtatcgg

SEQ ID NO: 880 - DNA, 567 bp, Artificial Sequence
  chemically treated genomic DNA (Homo sapiens) CpG-island No: 880
ccgatacaaaaacaccgtccgacccccgacgcgaatacccgccacaatcccaataccccgcccgatacaactccctctccgccgaccccgccacccgcaaccatcccacgcctaccgccccgacgctccactcgaaataaccgattaacaaacaacttccgacctccaacactacaccgcctacgatacgaacgtaacgtccgcgacacaaaaaaaaacttccgacgcgccgcgccacgccacgtattccgcaccgaaaacgcgcttccaatcgccccgacaacaaccgcctccctcgcgtcccccactccccctctatctctccaaaaaaaactaaacccctacgcgaccaacgcccaaaatccgcaaactacgcgcccacgaaataacttcgaaaacgactaaatttcctttaaaaaataaaaaaaaaacttaaacgccccgaaccctaacttcttctaatacgcaaaaaaccgaaatcttaaacgtcacgttactctcataattatcttaatcccgcgacaaaaaataaaaccgaaaacccataaaattcctaaatcattacaa

SEQ ID NO: 881 - DNA, 989 bp, Artificial Sequence
  chemically treated genomic DNA (Homo sapiens) CpG-island No: 881
gcggatcgtcgttttcgcgattttagaagtttatttttttttttatttatttttttcgttggttttttcggttttcgcgattttcggcgttcgttcgggggggttttagaggaagtcgcgagttttgtttgtagatttcgcgcgttcgttgtttttaatcgggttttagtttcgggcgtataaagttttcggcgttgacgttagggttttttttcgcgcggtcggtttttagtgtaggcggagtcgcgtcgcgtttttatttcggtcgggagttaggagttagcggttagtttcgcgtagcgtagcgtagttcgtagaagttcggttagcgtacgtgttcgcgagatttgtaaatttgtgttatcggttttgttcgttttcggggagttcgaacgtttcgtagtttttatttttttcgttagtttttagttatgggtaagcgagcgcgttggttgcgcgttacggttacggtttcgcgttttcgtttcgggagggcgcgttttttcgagggtttcgtttttttttcgtttaggtggcgttttttcggttatttttgcgacgaagtcgggacgttggaggtgggaggggcgcggcgtaggtgttcggaacgtttaggtgcgtttttttgttgtattttgtggggggggtggttttcgtttcggttgcggttaggttgtattttcgtacgtgcggttcgcgggagtttaagagttgggtattcgggaggggttgtagagagaatagacggcgcgtttcgggttagtgttttattttaaggggttagtagagagtcgttttttgtttgtttttcgggacgttttttttgtcgttcgagtttttagtttagttttgtttcgtttcgtttcgtcgtgtttttgttttttttaagttcgcgcgaaataaatattcggttttttaagtttggggtttttcgggagtttatttcgaaattatgatttttgaaattaggaaagtgataggagagattt

SEQ ID NO: 882 - DNA, 989 bp, Artificial Sequence
  chemically treated genomic DNA (Homo sapiens) CpG-island No: 882
aaatctctcctatcactttcctaatttcaaaaatcataatttcgaaataaactcccgaaaaaccccaaacttaaaaaaccgaatatttatttcgcgcgaacttaaaaaaaacaaaaacacgacgaaacgaaacgaaacaaaactaaactaaaaactcgaacgacaaaaaaaacgtcccgaaaaacaaacaaaaaacgactctctactaaccccttaaaataaaacactaacccgaaacgcgccgtctattctctctacaacccctcccgaatacccaactcttaaactcccgcgaaccgcacgtacgaaaatacaacctaaccgcaaccgaaacgaaaaccaccccccccacaaaatacaacaaaaaaacgcacctaaacgttccgaacacctacgccgcgcccctcccacctccaacgtcccgacttcgtcgcaaaaataaccgaaaaaacgccacctaaacgaaaaaaaaacgaaaccctcgaaaaaacgcgccctcccgaaacgaaaacgcgaaaccgtaaccgtaacgcgcaaccaacgcgctcgcttacccataactaaaaactaacgaaaaaaataaaaactacgaaacgttcgaactccccgaaaacgaacaaaaccgataacacaaatttacaaatctcgcgaacacgtacgctaaccgaacttctacgaactacgctacgctacgcgaaactaaccgctaactcctaactcccgaccgaaataaaaacgcgacgcgactccgcctacactaaaaaccgaccgcgcgaaaaaaaaccctaacgtcaacgccgaaaactttatacgcccgaaactaaaacccgattaaaaacaacgaacgcgcgaaatctacaaacaaaactcgcgacttcctctaaaacccccccgaacgaacgccgaaaatcgcgaaaaccgaaaaaaccaacgaaaaaaataaataaaaaaaaaaataaacttctaaaatcgcgaaaacgacgatccgc

SEQ ID NO: 883 - DNA, 989 bp, Artificial Sequence
  chemically treated genomic DNA (Homo sapiens) CpG-island No: 883
gagttttttttgttatttttttggttttaagggttatggtttcgaaatgagttttcggaagattttaggtttggggaatcgggtgtttgtttcgcgcgggtttaaggagaatagaagtacggcggggcggggcggggtaggattggattgggagttcgggcgatagggagagcgtttcgggaaataggtaagaagcgattttttattggttttttaaaataaagtattagttcgggacgcgtcgtttgttttttttgtaatttttttcgggtatttagtttttaggttttcgcgagtcgtacgtgcgggggtgtagtttggtcgtagtcggagcggggattattttttttataggatataatagggaagcgtatttgggcgtttcggatatttgcgtcgcgttttttttatttttagcgtttcggtttcgtcgtagaggtggtcgaggaggcgttatttgagcgggggaggggcgggattttcggaagggcgcgttttttcggggcgggggcgcgagatcgtggtcgtggcgcgtagttagcgcgttcgtttatttatggttggagattggcgggaggggtgagggttgcggggcgttcgggtttttcggggacgggtagagtcggtggtataagtttgtaggtttcgcgggtacgtgcgttgatcgggtttttgcgggttgcgttgcgttgcgcggggttggtcgttggtttttagttttcggtcggggtgggagcgcggcgcggtttcgtttgtattgggggtcggtcgcgcggagaggggttttgacgttagcgtcgggggttttgtgcgttcggagttagggttcgattgggggtagcgggcgcgcggagtttgtaggtaaagttcgcggttttttttgggattttttcgggcgagcgtcgagggtcgcgggaatcggaaaagttagcgagggggatgggtagagaggggagtgggtttttaggatcgcggaggcggcgattcgt

SEQ ID NO: 884 - DNA, 989 bp, Artificial Sequence
  chemically treated genomic DNA (Homo sapiens) CpG-island No: 884
acgaatcgccgcctccgcgatcctaaaaacccactcccctctctacccatccccctcgctaacttttccgattcccgcgaccctcgacgctcgcccgaaaaaatcccaaaaaaaaccgcgaactttacctacaaactccgcgcgcccgctacccccaatcgaaccctaactccgaacgcacaaaacccccgacgctaacgtcaaaacccctctccgcgcgaccgacccccaatacaaacgaaaccgcgccgcgctcccaccccgaccgaaaactaaaaaccaacgaccaaccccgcgcaacgcaacgcaacccgcaaaaacccgatcaacgcacgtacccgcgaaacctacaaacttataccaccgactctacccgtccccgaaaaacccgaacgccccgcaaccctcacccctcccgccaatctccaaccataaataaacgaacgcgctaactacgcgccacgaccacgatctcgcgcccccgccccgaaaaaacgcgcccttccgaaaatcccgcccctcccccgctcaaataacgcctcctcgaccacctctacgacgaaaccgaaacgctaaaaataaaaaaaacgcgacgcaaatatccgaaacgcccaaatacgcttccctattatatcctataaaaaaaataatccccgctccgactacgaccaaactacacccccgcacgtacgactcgcgaaaacctaaaaactaaatacccgaaaaaaattacaaaaaaaacaaacgacgcgtcccgaactaatactttattttaaaaaaccaataaaaaatcgcttcttacctatttcccgaaacgctctccctatcgcccgaactcccaatccaatcctaccccgccccgccccgccgtacttctattctccttaaacccgcgcgaaacaaacacccgattccccaaacctaaaatcttccgaaaactcatttcgaaaccataacccttaaaaccaaaaaaataacaaaaaaaactc

SEQ ID NO: 885 - DNA, 967 bp, Artificial Sequence
  chemically treated genomic DNA (Homo sapiens) CpG-island No: 885
gtcgttattttttttcgagcgggggtcgtttcgagttcgggaggaatgaatgaacgattgaattaatgagtttttgtggacgcggttcgtcgtttttcggtttttgcgggcgaggaaatgggggcgtcgggttcgggaggtcgtagtcggttatttaggttaattcggcggggacgcggtcgtcgtcgtagttagagggtcgagtttgcgacgttattacggagttcggggcgggtttttaaggtcgagttcgagttttttatttcgggagttatttatcgacgacgttagggttcgggttttatttcgagattatcgcgcgcggagttattttcgtcgtcgttttaggttttttattcgtcgtcgtcgtcgcgcgaggcggggatatgtaaatgaattaacggttttcgtagcgtcgcgtcgcgtaggcgtaagtcgtcgtcgagttttggtgcgtaggcgcgggtcgtcgcggttcggtttttttgcgtaagcgcgttgttcgttttttttgggcggacgttttggaggtaaaatatttttttgttgggggcggcgattatcgtgagcgtttcggaaggggcggtaaagacgttttcgtcgcgtacgaggtggtttcgttggttttattttggttcgcggtcgtttttggttatcgtgagcgttcgcgagtttttgggaggttaagtttaggggcgttatagcgtttgcgcgcgtacggcggtcggaaggggttagaggcggttttttgggtgataatcgcgcgttttatttttttttacgtggtcgcgaagatcgggtgagacgttgcggttgtcgaggtttgtttcgcgcggagtggggagtgggggtgtcgtagggtcgggttggcgcgattttcgggtacgtggtttggggggaaaaaaaaaatgaaagaattttatagaagtcgtttggggataaaattttcggtttttttggtattcgt

SEQ ID NO: 886 - DNA, 967 bp, Artificial Sequence
  chemically treated genomic DNA (Homo sapiens) CpG-island No: 886
acgaataccaaaaaaaccgaaaattttatccccaaacgacttctataaaattctttcattttttttttccccccaaaccacgtacccgaaaatcgcgccaacccgaccctacgacacccccactccccactccgcgcgaaacaaacctcgacaaccgcaacgtctcacccgatcttcgcgaccacgtaaaaaaaaataaaacgcgcgattatcacccaaaaaaccgcctctaaccccttccgaccgccgtacgcgcgcaaacgctataacgcccctaaacttaacctcccaaaaactcgcgaacgctcacgataaccaaaaacgaccgcgaaccaaaataaaaccaacgaaaccacctcgtacgcgacgaaaacgtctttaccgccccttccgaaacgctcacgataatcgccgcccccaacaaaaaaatattttacctccaaaacgtccgcccaaaaaaaacgaacaacgcgcttacgcaaaaaaaccgaaccgcgacgacccgcgcctacgcaccaaaactcgacgacgacttacgcctacgcgacgcgacgctacgaaaaccgttaattcatttacatatccccgcctcgcgcgacgacgacgacgaataaaaaacctaaaacgacgacgaaaataactccgcgcgcgataatctcgaaataaaacccgaaccctaacgtcgtcgataaataactcccgaaataaaaaactcgaactcgaccttaaaaacccgccccgaactccgtaataacgtcgcaaactcgaccctctaactacgacgacgaccgcgtccccgccgaattaacctaaataaccgactacgacctcccgaacccgacgcccccatttcctcgcccgcaaaaaccgaaaaacgacgaaccgcgtccacaaaaactcattaattcaatcgttcattcattcctcccgaactcgaaacgacccccgctcgaaaaaaaataacgac

SEQ ID NO: 887 - DNA, 967 bp, Artificial Sequence
  chemically treated genomic DNA (Homo sapiens) CpG-island No: 887
gcgaatgttagggaagtcgaggattttgtttttaggcggtttttgtaaaatttttttattttttttttttttttaaattacgtattcgagggtcgcgttagttcgattttgcggtatttttattttttatttcgcgcgggataggtttcggtagtcgtagcgttttattcggttttcgcggttacgtggggaaaggtggggcgcgcggttgttatttagggagtcgtttttagtttttttcggtcgtcgtacgcgcgtaggcgttgtggcgtttttaggtttggttttttagagattcgcggacgtttacgataattaaggacgatcgcgaattaaggtaaagttaacgaggttatttcgtgcgcgacggaggcgtttttgtcgtttttttcgggacgtttacggtggtcgtcgtttttagtagggaaatgttttgtttttagagcgttcgtttagaagaagcggatagcgcgtttgcgtaagagagtcgggtcgcggcggttcgcgtttgcgtattaggattcggcggcggtttgcgtttgcgcggcgcggcgttgcggagatcgttggtttatttgtatgttttcgtttcgcgcggcggcggcggcgggtgaggagtttgaggcggcggcgggggtggtttcgcgcgcggtggtttcggggtgaggttcgggttttggcgtcgtcggtgggtggttttcggggtgggaagttcgggttcggttttgggggttcgtttcgggtttcgtgatggcgtcgtaggttcggttttttggttgcggcggcggtcgcgttttcgtcgggttggtttgggtggtcggttgcggtttttcgggttcggcgtttttattttttcgttcgtagaggtcgggagacggcgggtcgcgtttataaaggtttattggtttagtcgtttatttatttttttcgaattcggagcggttttcgttcgggaggagataacggt

SEQ ID NO: 888 - DNA, 967 bp, Artificial Sequence
  chemically treated genomic DNA (Homo sapiens) CpG-island No: 888
accgttatctcctcccgaacgaaaaccgctccgaattcgaaaaaaataaataaacgactaaaccaataaacctttataaacgcgacccgccgtctcccgacctctacgaacgaaaaaataaaaacgccgaacccgaaaaaccgcaaccgaccacccaaaccaacccgacgaaaacgcgaccgccgccgcaaccaaaaaaccgaacctacgacgccatcacgaaacccgaaacgaacccccaaaaccgaacccgaacttcccaccccgaaaaccacccaccgacgacgccaaaacccgaacctcaccccgaaaccaccgcgcgcgaaaccacccccgccgccgcctcaaactcctcacccgccgccgccgccgcgcgaaacgaaaacatacaaataaaccaacgatctccgcaacgccgcgccgcgcaaacgcaaaccgccgccgaatcctaatacgcaaacgcgaaccgccgcgacccgactctcttacgcaaacgcgctatccgcttcttctaaacgaacgctctaaaaacaaaacatttccctactaaaaacgacgaccaccgtaaacgtcccgaaaaaaacgacaaaaacgcctccgtcgcgcacgaaataacctcgttaactttaccttaattcgcgatcgtccttaattatcgtaaacgtccgcgaatctctaaaaaaccaaacctaaaaacgccacaacgcctacgcgcgtacgacgaccgaaaaaaactaaaaacgactccctaaataacaaccgcgcgccccacctttccccacgtaaccgcgaaaaccgaataaaacgctacgactaccgaaacctatcccgcgcgaaataaaaaataaaaataccgcaaaatcgaactaacgcgaccctcgaatacgtaatttaaaaaaaaaaaaaaaataaaaaaattttacaaaaaccgcctaaaaacaaaatcctcgacttccctaacattcgc

SEQ ID NO: 889 - DNA, 504 bp, Artificial Sequence
  chemically treated genomic DNA (Homo sapiens) CpG-island No: 889
tcgtatcggggttgagcgttcgttttttgtcggtcgcggttttacgttttcgttttagattttttgttagagagcgagggtcggggagcgagagttagggttcgaggtgatcgtcgtagttggggtcgaggttcgtgtggtaggggattgggataggagtcggagtcgtagggcgagggtttagatcggggttggaagttataggttttttatttcgtttggtcgagcggtcgggatttcgggttcgtagcggatggaagcgggcgttgtttgttcggcggcggtcggggttttttggggttttttcgcgggcgttcggtagggcggtagtagttgtcgcggagaggacgatcgtcgtcggtgtaattaggttttcgcgtttttgttcggtttttggggcgtttaagcgggtcgtttttatcgcggtaattttacgttcgtttttttagtttaattttatagttttgttttgtttttaagtaaggagtcggtttttttgtttat

SEQ ID NO: 890 - DNA, 504 bp, Artificial Sequence
  chemically treated genomic DNA (Homo sapiens) CpG-island No: 890
ataaacaaaaaaaccgactccttacttaaaaacaaaacaaaactataaaattaaactaaaaaaacgaacgtaaaattaccgcgataaaaacgacccgcttaaacgccccaaaaaccgaacaaaaacgcgaaaacctaattacaccgacgacgatcgtcctctccgcgacaactactaccgccctaccgaacgcccgcgaaaaaaccccaaaaaaccccgaccgccgccgaacaaacaacgcccgcttccatccgctacgaacccgaaatcccgaccgctcgaccaaacgaaataaaaaacctataacttccaaccccgatctaaaccctcgccctacgactccgactcctatcccaatcccctaccacacgaacctcgaccccaactacgacgatcacctcgaaccctaactctcgctccccgaccctcgctctctaacaaaaaatctaaaacgaaaacgtaaaaccgcgaccgacaaaaaacgaacgctcaaccccgatacga

SEQ ID NO: 891 - DNA, 504 bp, Artificial Sequence
  chemically treated genomic DNA (Homo sapiens) CpG-island No: 891
gtggatagggaggtcgattttttgtttgggggtaggataaggttgtgaggttgggttggaggggcgggcgtggagttgtcgcggtgaggacggttcgtttgggcgttttagaggtcgggtaggggcgcggggatttggttgtatcggcggcggtcgtttttttcgcggtagttgttgtcgttttgtcgagcgttcgcgggaaaattttagaaggtttcggtcgtcgtcgggtaggtagcgttcgtttttattcgttgcgggttcggagtttcggtcgttcggttaagcgaggtgagaggtttgtggtttttagtttcgatttgggttttcgttttgcgatttcgatttttgttttagttttttattatacggatttcggttttaattacgacggttatttcggattttggttttcgtttttcgattttcgttttttgataaagggtttggggcgagggcgtggagtcgcggtcggtaggaggcgagcgtttagtttcggtgcgg

SEQ ID NO: 892 - DNA, 504 bp, Artificial Sequence
  chemically treated genomic DNA (Homo sapiens) CpG-island No: 892
ccgcaccgaaactaaacgctcgcctcctaccgaccgcgactccacgccctcgccccaaaccctttatcaaaaaacgaaaatcgaaaaacgaaaaccaaaatccgaaataaccgtcgtaattaaaaccgaaatccgtataataaaaaactaaaacaaaaatcgaaatcgcaaaacgaaaacccaaatcgaaactaaaaaccacaaacctctcacctcgcttaaccgaacgaccgaaactccgaacccgcaacgaataaaaacgaacgctacctacccgacgacgaccgaaaccttctaaaattttcccgcgaacgctcgacaaaacgacaacaactaccgcgaaaaaaacgaccgccgccgatacaaccaaatccccgcgcccctacccgacctctaaaacgcccaaacgaaccgtcctcaccgcgacaactccacgcccgcccctccaacccaacctcacaaccttatcctacccccaaacaaaaaatcgacctccctatccac

SEQ ID NO: 893 - DNA, 674 bp, Artificial Sequence
  chemically treated genomic DNA (Homo sapiens) CpG-island No: 893
ggcggagagcgttgcgcggggagataaagggaagggatagggatcgtagggatagggataggagcggttgtcgggttttgggttttcgatcgttattagatatgttttcgagtagtcgaggtaaagggaacggatgggaaaggaaaatagaggagcggtttagaagggcggttcgttgcggtggtggggcgcggattcgggaattcggggcgggtagggtacgggcgtattttttttttttttttttttcgttcgaggtcggtagcgtttttcgtttcgcgttatgtatatttattgtggtgatgagagttcgcgtttcgtgttcgttacggttattgtgcgtttaataaaaataaatattgtcgaggagtcgtcgcgatgcggggcggacgcgcggttcggaaaggggagggggttttaggaagagttatattcgcgagtcgggtttgggttaggggcgaggggagagcgttaagattgtttcgtcgtcgagggcgtcgatggaggtataggggttttcgtggggcgtttcgagagatatcgtgtttggtcggcgggacgtgggttggttttttattcgacggagagaagcggtatttttattttcgggtatcgggtttgggtttcgagcgggggtttttggaatataaggtagtgggggtagacgggtttgg

SEQ ID NO: 894 - DNA, 674 bp, Artificial Sequence
  chemically treated genomic DNA (Homo sapiens) CpG-island No: 894
ccaaacccgtctacccccactaccttatattccaaaaacccccgctcgaaacccaaacccgatacccgaaaataaaaataccgcttctctccgtcgaataaaaaaccaacccacgtcccgccgaccaaacacgatatctctcgaaacgccccacgaaaacccctatacctccatcgacgccctcgacgacgaaacaatcttaacgctctcccctcgcccctaacccaaacccgactcgcgaatataactcttcctaaaaccccctcccctttccgaaccgcgcgtccgccccgcatcgcgacgactcctcgacaatatttatttttattaaacgcacaataaccgtaacgaacacgaaacgcgaactctcatcaccacaataaatatacataacgcgaaacgaaaaacgctaccgacctcgaacgaaaaaaaaaaaaaaaaaaaatacgcccgtaccctacccgccccgaattcccgaatccgcgccccaccaccgcaacgaaccgcccttctaaaccgctcctctattttcctttcccatccgttccctttacctcgactactcgaaaacatatctaataacgatcgaaaacccaaaacccgacaaccgctcctatccctatccctacgatccctatcccttccctttatctccccgcgcaacgctctccgcc

SEQ ID NO: 895 - DNA, 674 bp, Artificial Sequence
  chemically treated genomic DNA (Homo sapiens) CpG-island No: 895
ttaggttcgtttgtttttattgttttgtgttttaggagttttcgttcggagtttagattcggtgttcgaagatgagagtgtcgttttttttcgtcgggtgagaagttagtttacgtttcgtcggttaggtacggtgtttttcggggcgttttacgggaatttttgtgtttttatcggcgttttcggcggcggggtagttttggcgtttttttttcgtttttggtttaggttcggttcgcgggtgtagttttttttagggttttttttttttttcgggtcgcgcgttcgtttcgtatcgcggcggtttttcggtagtgtttgtttttattggacgtatagtgatcgtgacgggtacggggcgcgagtttttattattataatgggtgtgtatggcgcggggcggggggcgttgtcggtttcgagcgagggaggggagaggagggggtgcgttcgtgttttgttcgtttcgagttttcgagttcgcgttttattatcgtagcgagtcgtttttttgggtcgtttttttgttttttttttttattcgttttttttgtttcggttgttcggagatatgtttggtggcgatcggggatttagagttcggtagtcgtttttgtttttgtttttgcgatttttgttttttttttttgttttttcgcgtagcgtttttcgtt

SEQ ID NO: 896 - DNA, 674 bp, Artificial Sequence
  chemically treated genomic DNA (Homo sapiens) CpG-island No: 896
aacgaaaaacgctacgcgaaaaaacaaaaaaaaaaaacaaaaatcgcaaaaacaaaaacaaaaacgactaccgaactctaaatccccgatcgccaccaaacatatctccgaacaaccgaaacaaaaaaaacgaataaaaaaaaaaaacaaaaaaacgacccaaaaaaacgactcgctacgataataaaacgcgaactcgaaaactcgaaacgaacaaaacacgaacgcaccccctcctctcccctccctcgctcgaaaccgacaacgccccccgccccgcgccatacacacccattataataataaaaactcgcgccccgtacccgtcacgatcactatacgtccaataaaaacaaacactaccgaaaaaccgccgcgatacgaaacgaacgcgcgacccgaaaaaaaaaaaaaaccctaaaaaaaactacacccgcgaaccgaacctaaaccaaaaacgaaaaaaaaacgccaaaactaccccgccgccgaaaacgccgataaaaacacaaaaattcccgtaaaacgccccgaaaaacaccgtacctaaccgacgaaacgtaaactaacttctcacccgacgaaaaaaaacgacactctcatcttcgaacaccgaatctaaactccgaacgaaaactcctaaaacacaaaacaataaaaacaaacgaacctaa

SEQ ID NO: 897 - DNA, 627 bp, Artificial Sequence
  chemically treated genomic DNA (Homo sapiens) CpG-island No: 897
cggcgtggcgggtaggtgaattcgatttcggggaaacgattcgttcgcgacgttttcgttttcggttcggttttatttcgatgttgtttatagtgcgggcgtagtttattatttttagtttttgttggattagggttcgggttacggtcgcgtcgatgtttttcgaggttttcgttattagcgttagtcggtcgcgttatcgttttatgtcgggtttggttatgggtttacgtcgttcgttcgtttcgttggattagttcgatacgggggtcgaggagttgacgttcggtcgtttttttgtcgtcgtcgtcgatttgtttgggttcgattcgcgtttagatttattagagtttcggtttgttttcggtcgggattttatttttaggttttcggcgattcgtcgtatttagtcggaggtcgtcgcggttcggtcgtttcgtttttttcgtttttttgtttcgtttcggcgtagggaaatcgggttgcgcgggagcgttttggtagttggcggcgtcgtttttttagtgagcgttgttttttggggttagggaaatcgaggtttagcggggaggtttttttagttttaagggcgtatattgaagcgtttcgtttagtttttttttttta

SEQ ID NO: 898 - DNA, 627 bp, Artificial Sequence
  chemically treated genomic DNA (Homo sapiens) CpG-island No: 898
taaaaaaaaaaaactaaacgaaacgcttcaatatacgcccttaaaactaaaaaaacctccccgctaaacctcgatttccctaaccccaaaaaacaacgctcactaaaaaaacgacgccgccaactaccaaaacgctcccgcgcaacccgatttccctacgccgaaacgaaacaaaaaaacgaaaaaaacgaaacgaccgaaccgcgacgacctccgactaaatacgacgaatcgccgaaaacctaaaaataaaatcccgaccgaaaacaaaccgaaactctaataaatctaaacgcgaatcgaacccaaacaaatcgacgacgacgacaaaaaaacgaccgaacgtcaactcctcgacccccgtatcgaactaatccaacgaaacgaacgaacgacgtaaacccataaccaaacccgacataaaacgataacgcgaccgactaacgctaataacgaaaacctcgaaaaacatcgacgcgaccgtaacccgaaccctaatccaacaaaaactaaaaataataaactacgcccgcactataaacaacatcgaaataaaaccgaaccgaaaacgaaaacgtcgcgaacgaatcgtttccccgaaatcgaattcacctacccgccacgccg

SEQ ID NO: 899 - DNA, 627 bp, Artificial Sequence
  chemically treated genomic DNA (Homo sapiens) CpG-island No: 899
tagagaagggagattaagcgggacgttttagtatgcgtttttggggttgaaggaattttttcgttaaatttcggtttttttgattttaaagggtagcgtttattggggaagcggcgtcgttagttgttaggacgttttcgcgtagttcggtttttttacgtcggggcggggtagaggggcggaaggggcggggcggtcgggtcgcggcggttttcgattggatacggcggatcgtcgggggtttgagggtggagtttcggtcggaggtaggtcgggattttggtgggtttaggcgcggatcggatttaagtaggtcggcggcggcggtaggagagcggtcgggcgttagtttttcgattttcgtgtcgggttagtttagcgaggcggacgggcggcgtgggtttatggttaggttcggtatggagcggtggcgcgatcggttggcgttggtgacgggggtttcggggggtatcggcgcggtcgtggttcgggttttggtttagtagggattgaaggtggtgggttgcgttcgtattgtgggtaatatcgaggtgaggtcgggtcgagggcggggacgtcgcgggcgggtcgttttttcggagtcgggtttatttgttcgttacgtcg

SEQ ID NO: 900 - DNA, 627 bp, Artificial Sequence
  chemically treated genomic DNA (Homo sapiens) CpG-island No: 900
cgacgtaacgaacaaataaacccgactccgaaaaaacgacccgcccgcgacgtccccgccctcgacccgacctcacctcgatattacccacaatacgaacgcaacccaccaccttcaatccctactaaaccaaaacccgaaccacgaccgcgccgataccccccgaaacccccgtcaccaacgccaaccgatcgcgccaccgctccataccgaacctaaccataaacccacgccgcccgtccgcctcgctaaactaacccgacacgaaaatcgaaaaactaacgcccgaccgctctcctaccgccgccgccgacctacttaaatccgatccgcgcctaaacccaccaaaatcccgacctacctccgaccgaaactccaccctcaaacccccgacgatccgccgtatccaatcgaaaaccgccgcgacccgaccgccccgccccttccgcccctctaccccgccccgacgtaaaaaaaccgaactacgcgaaaacgtcctaacaactaacgacgccgcttccccaataaacgctaccctttaaaatcaaaaaaaccgaaatttaacgaaaaaattccttcaaccccaaaaacgcatactaaaacgtcccgcttaatctcccttctcta

SEQ ID NO: 901 - DNA, 892 bp, Artificial Sequence
  chemically treated genomic DNA (Homo sapiens) CpG-island No: 901
agcgtagagtttgggagcgtagagcgcgggggttgcggggtgggttgaaggtgggtagtatcggggggcggcgggcggagcggggtcgggagggggcggtgtcggagggttagcggtgtggcgcgtcgtttgtagggggcgtttgcggcggtttcggtcggagataatcgcgttgagcgggcgtcgtagcgggagcgggagtcggagttgcgaggcgcggcgtagagttggggttgcgcggggtcgggcgagcgggattaggcgggagttatggatcgttagggttcggtttagtttcgcgatgtcgtcggcgagtggttttagcgttttcgcgcggttgttgtcgttgttggggttgttgttcggtagcgtttttcgggttttcggtaagtcgtcgtcggagttttttagttcgtagggtgagttttagtcgggaggggtcgcgatcgcgggtttgcgttttttgattaggttttcgttcgttagtttttttttcgcggcgttcgtgaattgagtggtattttgttttttggattcgggtggggggagttaagcgatttggggttggcgtttttgggggaaagtggaggcggggagagggaggtcgttcggggcgggggttttggggagatataatgggtagtgcgagggtttttaggatttgcgtcgtcgttttttttttatttgttttttttttttttggttcgcgaggcgttgttgtttgagttattgtttatcgaagatattcgtttaggggcgggttggggcgggcgtttgtttcgtagttttttgcgggttgttcgttttcgattttggcggggtgggggcgtcggtattcgttgttattttaggtcgggatcggaggttgggagtttggagttgggtttgaagg

SEQ ID NO: 902 - DNA, 892 bp, Artificial Sequence
  chemically treated genomic DNA (Homo sapiens) CpG-island No: 902
ccttcaaacccaactccaaactcccaacctccgatcccgacctaaaataacaacgaataccgacgcccccaccccgccaaaatcgaaaacgaacaacccgcaaaaaactacgaaacaaacgcccgccccaacccgcccctaaacgaatatcttcgataaacaataactcaaacaacaacgcctcgcgaaccaaaaaaaaaaaaaacaaataaaaaaaaaacgacgacgcaaatcctaaaaaccctcgcactacccattatatctccccaaaacccccgccccgaacgacctccctctccccgcctccactttcccccaaaaacgccaaccccaaatcgcttaactccccccacccgaatccaaaaaacaaaataccactcaattcacgaacgccgcgaaaaaaaaactaacgaacgaaaacctaatcaaaaaacgcaaacccgcgatcgcgacccctcccgactaaaactcaccctacgaactaaaaaactccgacgacgacttaccgaaaacccgaaaaacgctaccgaacaacaaccccaacaacgacaacaaccgcgcgaaaacgctaaaaccactcgccgacgacatcgcgaaactaaaccgaaccctaacgatccataactcccgcctaatcccgctcgcccgaccccgcgcaaccccaactctacgccgcgcctcgcaactccgactcccgctcccgctacgacgcccgctcaacgcgattatctccgaccgaaaccgccgcaaacgccccctacaaacgacgcgccacaccgctaaccctccgacaccgccccctcccgaccccgctccgcccgccgccccccgatactacccaccttcaacccaccccgcaacccccgcgctctacgctcccaaactctacgct

SEQ ID NO: 903 - DNA, 892 bp, Artificial Sequence
  chemically treated genomic DNA (Homo sapiens) CpG-island No: 903
tttttaaatttagttttaggtttttagttttcggtttcggtttagggtggtagcggatgtcggcgtttttatttcgttagggtcgggagcgagtaattcgtagggggttgcggagtaggcgttcgttttagttcgtttttgggcgggtgttttcggtagataatggtttaggtagtagcgtttcgcggattaggagggagaaaaataaatagggagagggcggcggcgtagattttggggattttcgtattatttattgtgtttttttaagattttcgtttcggacggttttttttttttcgtttttatttttttttagaagcgttaattttagatcgtttagttttttttattcgaatttagggaatagaatattatttaatttacgaacgtcgcgaagagggggttgacgggcgggagtttgattagggggcgtaggttcgcgatcgcggtttttttcggttgagatttattttgcgggttggggggtttcggcggcgatttgtcgggagttcgggaggcgttgtcgagtagtagttttagtagcggtaatagtcgcgcgaggacgttggggttattcgtcggcggtatcgcggggttaggtcgggttttagcggtttatggttttcgtttggtttcgttcgttcggtttcgcgtagttttagttttgcgtcgcgtttcgtagtttcggttttcgttttcgttgcggcgttcgtttagcgcgattgttttcgatcggagtcgtcgtaagcgttttttgtaggcggcgcgttatatcgttggtttttcggtatcgttttttttcggtttcgtttcgttcgtcgtttttcggtattgtttatttttagtttatttcgtagttttcgcgttttgcgtttttagattttgcgtt

SEQ ID NO: 904 - DNA, 892 bp, Artificial Sequence
  chemically treated genomic DNA (Homo sapiens) CpG-island No: 904
aacgcaaaatctaaaaacgcaaaacgcgaaaactacgaaataaactaaaaataaacaataccgaaaaacgacgaacgaaacgaaaccgaaaaaaaacgataccgaaaaaccaacgatataacgcgccgcctacaaaaaacgcttacgacgactccgatcgaaaacaatcgcgctaaacgaacgccgcaacgaaaacgaaaaccgaaactacgaaacgcgacgcaaaactaaaactacgcgaaaccgaacgaacgaaaccaaacgaaaaccataaaccgctaaaacccgacctaaccccgcgataccgccgacgaataaccccaacgtcctcgcgcgactattaccgctactaaaactactactcgacaacgcctcccgaactcccgacaaatcgccgccgaaaccccccaacccgcaaaataaatctcaaccgaaaaaaaccgcgatcgcgaacctacgccccctaatcaaactcccgcccgtcaaccccctcttcgcgacgttcgtaaattaaataatattctattccctaaattcgaataaaaaaaactaaacgatctaaaattaacgcttctaaaaaaaaataaaaacgaaaaaaaaaaaaccgtccgaaacgaaaatcttaaaaaaacacaataaataatacgaaaatccccaaaatctacgccgccgccctctccctatttatttttctccctcctaatccgcgaaacgctactacctaaaccattatctaccgaaaacacccgcccaaaaacgaactaaaacgaacgcctactccgcaaccccctacgaattactcgctcccgaccctaacgaaataaaaacgccgacatccgctaccaccctaaaccgaaaccgaaaactaaaaacctaaaactaaatttaaaaa

SEQ ID NO: 905 - DNA, 690 bp, Artificial Sequence
  chemically treated genomic DNA (Homo sapiens) CpG-island No: 905
gggatgatttttttcgtattaagtcgcgttttgttagtcgttcggtcgtcgagttttcgggtgttcgcgggggcgagagcgtcgggtttaagggcgttcgttcggtcgagggtttcggcgggttggagttcggtttagaggagtatcggcgggggttttcgggggttgcggtttttttgtacgagtcgttttcgtcgtcgtcgtttttcgattattatttgggttataagggggcggtcgagggtaagattttcgattttttgttgtcgtagtcggtggattagttggcgcggtcgtcgtcgttgggttaggcggggtagtttattttttgcggttttatcgattattttaaggataacgtttatcgtaacgttatgtttattttggtgattttcgcgtattacgtgcgtttcggcggcgaggcgggcgtcgtcggcgtgggcgacgagtcggtttcgtcggagggtacggtattcggttcggcgcgcgtttttttttagttcgatttttagcgttcgtagatgtcgggttattcgggttcggggggcgagggcggcgggggcggcggcgagggttggggggtcgggcgcgcggcgttcgttagtggtttagttattatttttgtgttatttaacgagtttattatggcgtagtttaacggggagttgtaggttttgatcgagaagaagt

SEQ ID NO: 906 - DNA, 690 bp, Artificial Sequence
  chemically treated genomic DNA (Homo sapiens) CpG-island No: 906
acttcttctcgatcaaaacctacaactccccgttaaactacgccataataaactcgttaaataacacaaaaataataactaaaccactaacgaacgccgcgcgcccgaccccccaaccctcgccgccgcccccgccgccctcgccccccgaacccgaataacccgacatctacgaacgctaaaaatcgaactaaaaaaaaacgcgcgccgaaccgaataccgtaccctccgacgaaaccgactcgtcgcccacgccgacgacgcccgcctcgccgccgaaacgcacgtaatacgcgaaaatcaccaaaataaacataacgttacgataaacgttatccttaaaataatcgataaaaccgcaaaaaataaactaccccgcctaacccaacgacgacgaccgcgccaactaatccaccgactacgacaacaaaaaatcgaaaatcttaccctcgaccgcccccttataacccaaataataatcgaaaaacgacgacgacgaaaacgactcgtacaaaaaaaccgcaacccccgaaaacccccgccgatactcctctaaaccgaactccaacccgccgaaaccctcgaccgaacgaacgcccttaaacccgacgctctcgcccccgcgaacacccgaaaactcgacgaccgaacgactaacaaaacgcgacttaatacgaaaaaaatcatccc

SEQ ID NO: 907 - DNA, 690 bp, Artificial Sequence
  chemically treated genomic DNA (Homo sapiens) CpG-island No: 907
gttttttttcggttagggtttgtagtttttcgttgagttgcgttatggtggattcgttgaatagtatagggatggtgattgagttattgacgggcgtcgcgcgttcggttttttagttttcgtcgtcgttttcgtcgttttcgtttttcgggttcgagtggttcggtatttgcgggcgttgggggtcgggttggggaaaagcgcgcgtcgggtcgggtgtcgtgtttttcggcggggtcggttcgtcgtttacgtcggcggcgttcgtttcgtcgtcgaggcgtacgtagtgcgcggggattattagggtgggtatgacgttgcggtagacgttgtttttgaggtggtcgatggagtcgtagaagatgagttgtttcgtttggtttagcgacggcggtcgcgttagttggtttatcgattgcgatagtaggaagtcgggggttttgttttcggtcgtttttttgtggtttaggtagtggtcgaagggcggcggcggcgagggcggttcgtgtaggaaggtcgtagttttcgagggttttcgtcggtgtttttttaggtcgggttttagttcgtcggggttttcggtcgagcgagcgtttttgagttcggcgttttcgttttcgcgggtattcgaaggttcggcggtcgggcggttggtagagcgcggtttggtgcggaagaagttatttt

SEQ ID NO: 908 - DNA, 690 bp, Artificial Sequence
  chemically treated genomic DNA (Homo sapiens) CpG-island No: 908
aaaataacttcttccgcaccaaaccgcgctctaccaaccgcccgaccgccgaaccttcgaatacccgcgaaaacgaaaacgccgaactcaaaaacgctcgctcgaccgaaaaccccgacgaactaaaacccgacctaaaaaaacaccgacgaaaaccctcgaaaactacgaccttcctacacgaaccgccctcgccgccgccgcccttcgaccactacctaaaccacaaaaaaacgaccgaaaacaaaacccccgacttcctactatcgcaatcgataaaccaactaacgcgaccgccgtcgctaaaccaaacgaaacaactcatcttctacgactccatcgaccacctcaaaaacaacgtctaccgcaacgtcatacccaccctaataatccccgcgcactacgtacgcctcgacgacgaaacgaacgccgccgacgtaaacgacgaaccgaccccgccgaaaaacacgacacccgacccgacgcgcgcttttccccaacccgacccccaacgcccgcaaataccgaaccactcgaacccgaaaaacgaaaacgacgaaaacgacgacgaaaactaaaaaaccgaacgcgcgacgcccgtcaataactcaatcaccatccctatactattcaacgaatccaccataacgcaactcaacgaaaaactacaaaccctaaccgaaaaaaaac

SEQ ID NO: 909 - DNA, 699 bp, Artificial Sequence
  chemically treated genomic DNA (Homo sapiens) CpG-island No: 909
gtcgtattcgcgcgtttggttcgtgtttttcgacgggcgttttaattcgtaagtgcgttatttttatatcgatttgtaggcgggcggcggggtacgtagtatcgacgttagtttggattcgggcgtagatgtttacgaggcgcggttcgcgcgtcgtcggttcgcgagggaggagcgggagcgcgtttcgtttgtcgcgtcgtcgtcgtcgttcgcgttttcgcgtttggcgtttagcgaggatacggagtttagtagtagcgagagtcgtacgggtttttgtttttcggaggataattcgttgacgtcgttgttggacgaggtggcggcgttcgagggtcgggcggttacggtatttcgggggcggggtcgtagtcgcggggatagttttcgtagtagcgttagcgagttgcggcgcgattcgtttattagttcggaggacgagttgggggcggaggtgggcgacgaggcgggagataagaagagttcgtggtagcggcgggaggagcggtcgttgatggtgtttaacgttaagtagcgttcgcgtagggtttggtatcgtttttttcgcgcgggttcgtatttagggtgcgcgtttcgggggttcgcgggggttttcgcgcgtagtttttagttttaggtcggagaggggtttaggggttttggagttgtttcgtggttggtgttgggtcgtgtttt

SEQ ID NO: 910 - DNA, 699 bp, Artificial Sequence
  chemically treated genomic DNA (Homo sapiens) CpG-island No: 910
aaaacacgacccaacaccaaccacgaaacaactccaaaacccctaaacccctctccgacctaaaactaaaaactacgcgcgaaaacccccgcgaacccccgaaacgcgcaccctaaatacgaacccgcgcgaaaaaaacgataccaaaccctacgcgaacgctacttaacgttaaacaccatcaacgaccgctcctcccgccgctaccacgaactcttcttatctcccgcctcgtcgcccacctccgcccccaactcgtcctccgaactaataaacgaatcgcgccgcaactcgctaacgctactacgaaaactatccccgcgactacgaccccgcccccgaaataccgtaaccgcccgaccctcgaacgccgccacctcgtccaacaacgacgtcaacgaattatcctccgaaaaacaaaaacccgtacgactctcgctactactaaactccgtatcctcgctaaacgccaaacgcgaaaacgcgaacgacgacgacgacgcgacaaacgaaacgcgctcccgctcctccctcgcgaaccgacgacgcgcgaaccgcgcctcgtaaacatctacgcccgaatccaaactaacgtcgatactacgtaccccgccgcccgcctacaaatcgatataaaaataacgcacttacgaattaaaacgcccgtcgaaaaacacgaaccaaacgcgcgaatacgac

SEQ ID NO: 911 - DNA, 699 bp, Artificial Sequence
  chemically treated genomic DNA (Homo sapiens) CpG-island No: 911
aagatacgatttagtattaattacggaatagttttaaggtttttgggttttttttcggtttggggttgggagttacgcgcgagggttttcgcgggttttcggggcgcgtattttgggtgcgggttcgcgcgggaggggcggtgttaggttttgcgcgggcgttatttgacgttgaatattattagcggtcgtttttttcgtcgttgttacgggttttttttgtttttcgtttcgtcgtttattttcgtttttagttcgtttttcgggttggtgagcgagtcgcgtcgtagttcgttggcgttgttgcgggagttgttttcgcggttgcggtttcgttttcggggtatcgtggtcgttcggttttcgggcgtcgttatttcgtttagtagcggcgttagcgagttgtttttcggagagtagaggttcgtgcggttttcgttgttgttgggtttcgtgttttcgttgagcgttaggcgcgggggcgcgggcggcggcggcggcgcggtaggcggggcgcgttttcgtttttttttcgcgggtcggcggcgcgcgggtcgcgtttcgtggatatttacgttcgagtttaggttggcgtcggtgttgcgtgtttcgtcgttcgtttgtaggtcgatgtaagagtggcgtatttgcgagttggagcgttcgtcgagggatacgaattaggcgcgcgggtgcggt

SEQ ID NO: 912 - DNA, 699 bp, Artificial Sequence
  chemically treated genomic DNA (Homo sapiens) CpG-island No: 912
accgcacccgcgcgcctaattcgtatccctcgacgaacgctccaactcgcaaatacgccactcttacatcgacctacaaacgaacgacgaaacacgcaacaccgacgccaacctaaactcgaacgtaaatatccacgaaacgcgacccgcgcgccgccgacccgcgaaaaaaaaacgaaaacgcgccccgcctaccgcgccgccgccgccgcccgcgcccccgcgcctaacgctcaacgaaaacacgaaacccaacaacaacgaaaaccgcacgaacctctactctccgaaaaacaactcgctaacgccgctactaaacgaaataacgacgcccgaaaaccgaacgaccacgataccccgaaaacgaaaccgcaaccgcgaaaacaactcccgcaacaacgccaacgaactacgacgcgactcgctcaccaacccgaaaaacgaactaaaaacgaaaataaacgacgaaacgaaaaacaaaaaaaacccgtaacaacgacgaaaaaaacgaccgctaataatattcaacgtcaaataacgcccgcgcaaaacctaacaccgcccctcccgcgcgaacccgcacccaaaatacgcgccccgaaaacccgcgaaaaccctcgcgcgtaactcccaaccccaaaccgaaaaaaaacccaaaaaccttaaaactattccgtaattaatactaaatcgtatctt

SEQ ID NO: 913 - DNA, 500 bp, Artificial Sequence
  chemically treated genomic DNA (Homo sapiens) CpG-island No: 913
ttcgcgtagagttatttcgggttttaggcgaggttgtgatttgtttaaggttacgcgaaggtgggatttggttttttatggttttttcgtttttttcggtttgtttacgttttagttcgttcggttcgggttgtagtttagttaatttagtggcgtatattcgcgcggggttttgtggtttataaagcgttttgtagttgtaggtttgttttgtaatttgaaaaatgggggcgatgttaaggtcggcgagagaagtcgtcgcgaagtttttaagtttcggcgggtagttcggtaagtaatttcgtcgttattgtgtggtttttcggcgatttcgaagaatttatttttattgtcgtcgttacgtatttgaggatatcgaggaagagggttagtgcgttattttcgtcgtttagaaggcgttggggtttttagtgtcgcgcgcggtcggggcggggttggtgaaaatgcgttgttaaggtcggcgcggcggtttacgtttg

SEQ ID NO: 914 - DNA, 500 bp, Artificial Sequence
  chemically treated genomic DNA (Homo sapiens) CpG-island No: 914
caaacgtaaaccgccgcgccgaccttaacaacgcattttcaccaaccccgccccgaccgcgcgcgacactaaaaaccccaacgccttctaaacgacgaaaataacgcactaaccctcttcctcgatatcctcaaatacgtaacgacgacaataaaaataaattcttcgaaatcgccgaaaaaccacacaataacgacgaaattacttaccgaactacccgccgaaacttaaaaacttcgcgacgacttctctcgccgaccttaacatcgcccccatttttcaaattacaaaacaaacctacaactacaaaacgctttataaaccacaaaaccccgcgcgaatatacgccactaaattaactaaactacaacccgaaccgaacgaactaaaacgtaaacaaaccgaaaaaaacgaaaaaaccataaaaaaccaaatcccaccttcgcgtaaccttaaacaaatcacaacctcgcctaaaacccgaaataactctacgcgaa

SEQ ID NO: 915 - DNA, 500 bp, Artificial Sequence
  chemically treated genomic DNA (Homo sapiens) CpG-island No: 915
taggcgtgagtcgtcgcgtcggttttaatagcgtatttttattagtttcgtttcggtcgcgcgcggtattggaaattttagcgttttttggacggcgagggtgacgtattggttttttttttcggtgtttttaggtgcgtggcggcggtagtgagaatgagtttttcgagatcgtcgggagattatataataacgacgaagttatttgtcgggttattcgtcgagatttgaaaatttcgcggcgatttttttcgtcggttttagtatcgtttttattttttaggttataggataggtttgtaattgtaaaacgttttgtaaattatagggtttcgcgcgggtgtgcgttattgggttagttgagttgtagttcgggtcgggcgggttgggacgtgagtaagtcgggggagacgggagagttatggggagttagattttattttcgcgtgattttgggtaaattataatttcgtttaaggttcggaatgattttgcgcgga

SEQ ID NO: 916 - DNA, 500 bp, Artificial Sequence
  chemically treated genomic DNA (Homo sapiens) CpG-island No: 916
tccgcgcaaaatcattccgaaccttaaacgaaattataatttacccaaaatcacgcgaaaataaaatctaactccccataactctcccgtctcccccgacttactcacgtcccaacccgcccgacccgaactacaactcaactaacccaataacgcacacccgcgcgaaaccctataatttacaaaacgttttacaattacaaacctatcctataacctaaaaaataaaaacgatactaaaaccgacgaaaaaaatcgccgcgaaattttcaaatctcgacgaataacccgacaaataacttcgtcgttattatataatctcccgacgatctcgaaaaactcattctcactaccgccgccacgcacctaaaaacaccgaaaaaaaaaaccaatacgtcaccctcgccgtccaaaaaacgctaaaatttccaataccgcgcgcgaccgaaacgaaactaataaaaatacgctattaaaaccgacgcgacgactcacgccta

SEQ ID NO: 917 - DNA, 728 bp, Artificial Sequence
  chemically treated genomic DNA (Homo sapiens) CpG-island No: 917
tggataggtatggaattcgttcgcgcggtttcgttaagggggcgggatcgtcgtaggttcgggcggagacgcgagtgggcggagtcggggatatttcgggtttgcggttggtcggttcgcggcgggcggggtttcgtggcgcggtgtaggggcggggtttttttggttgttttcggcgtcggtttaggtgcgttgcgagcgcgcgcggatcgcgtataggcggcggagtcggtatgggttcgtttgattttgggcgtcgcgtcgtacgagtattagtttagagttaggtaggcggtattgggtcggggttgggggcggagacggaagcgggggttttcgggcggtcgtgcgagttagggtaggtgttggggtcgtcgagttggcgtggttttttttatttggcggtttttcgtcgttcggggtcgggagtgtcgtcgagggtcggggagacgttttggttttacgtttttatttttcgttttttcggttgcgtttcgggtttgtattttggggcgggaatttagagattgtttttttttttcgggtttcgggtttggttcgttcggtcgggcggggagggtcgggtattttagttcgtagttttgaggaggcgacgggttttttttggttatcggatttgtttatacgttattttcgatgttcggtcgtttttttacgtttagtaatttgggtttttaggtgtttgttcggggttttggtgttggagt

SEQ ID NO: 918 - DNA, 728 bp, Artificial Sequence
  chemically treated genomic DNA (Homo sapiens) CpG-island No: 918
actccaacaccaaaaccccgaacaaacacctaaaaacccaaattactaaacgtaaaaaaacgaccgaacatcgaaaataacgtataaacaaatccgataaccaaaaaaaacccgtcgcctcctcaaaactacgaactaaaatacccgaccctccccgcccgaccgaacgaaccaaacccgaaacccgaaaaaaaaaaacaatctctaaattcccgccccaaaatacaaacccgaaacgcaaccgaaaaaacgaaaaataaaaacgtaaaaccaaaacgtctccccgaccctcgacgacactcccgaccccgaacgacgaaaaaccgccaaataaaaaaaaccacgccaactcgacgaccccaacacctaccctaactcgcacgaccgcccgaaaacccccgcttccgtctccgcccccaaccccgacccaataccgcctacctaactctaaactaatactcgtacgacgcgacgcccaaaatcaaacgaacccataccgactccgccgcctatacgcgatccgcgcgcgctcgcaacgcacctaaaccgacgccgaaaacaaccaaaaaaaccccgcccctacaccgcgccacgaaaccccgcccgccgcgaaccgaccaaccgcaaacccgaaatatccccgactccgcccactcgcgtctccgcccgaacctacgacgatcccgcccccttaacgaaaccgcgcgaacgaattccatacctatcca

SEQ ID NO: 919 - DNA, 728 bp, Artificial Sequence
  chemically treated genomic DNA (Homo sapiens) CpG-island No: 919
attttagtattaaggtttcgggtaggtatttgagagtttaagttattgggcgtggagggacggtcgggtatcgagggtgacgtgtaaatagattcggtgattaagaagggttcgtcgtttttttaggattgcgggttgggatgttcggtttttttcgttcggtcggacgggttagattcggggttcggagagaaagagtagtttttgggttttcgttttaaaatgtaggttcggggcgtagtcgggagagcgggaagtaggaacgtaggattaggacgttttttcgattttcggcgatattttcggtttcgaacggcggagagtcgttaggtgagggggattacgttagttcgacggttttagtatttgttttggttcgtacggtcgttcggagattttcgttttcgttttcgtttttagtttcggtttagtgtcgtttatttggttttaggttggtgttcgtgcggcgcggcgtttagggttaggcgggtttatatcggtttcgtcgtttgtgcgcggttcgcgcgcgttcgtagcgtatttaggtcgacgtcgaaagtagttaagggggtttcgtttttatatcgcgttacgaggtttcgttcgtcgcgggtcgattagtcgtaagttcggagtgttttcggtttcgtttattcgcgttttcgttcggatttgcgacggtttcgtttttttgacggggtcgcgcgggcgagttttatgtttgttta

SEQ ID NO: 920 - DNA, 728 bp, Artificial Sequence
  chemically treated genomic DNA (Homo sapiens) CpG-island No: 920
taaacaaacataaaactcgcccgcgcgaccccgtcaaaaaaacgaaaccgtcgcaaatccgaacgaaaacgcgaataaacgaaaccgaaaacactccgaacttacgactaatcgacccgcgacgaacgaaacctcgtaacgcgatataaaaacgaaacccccttaactactttcgacgtcgacctaaatacgctacgaacgcgcgcgaaccgcgcacaaacgacgaaaccgatataaacccgcctaaccctaaacgccgcgccgcacgaacaccaacctaaaaccaaataaacgacactaaaccgaaactaaaaacgaaaacgaaaacgaaaatctccgaacgaccgtacgaaccaaaacaaatactaaaaccgtcgaactaacgtaatccccctcacctaacgactctccgccgttcgaaaccgaaaatatcgccgaaaatcgaaaaaacgtcctaatcctacgttcctacttcccgctctcccgactacgccccgaacctacattttaaaacgaaaacccaaaaactactctttctctccgaaccccgaatctaacccgtccgaccgaacgaaaaaaaccgaacatcccaacccgcaatcctaaaaaaacgacgaacccttcttaatcaccgaatctatttacacgtcaccctcgatacccgaccgtccctccacgcccaataacttaaactctcaaatacctacccgaaaccttaatactaaaat

SEQ ID NO: 921 - DNA, 784 bp, Artificial Sequence
  chemically treated genomic DNA (Homo sapiens) CpG-island No: 921
tagagtcgatggaagtgaagatggggtttattcggtgatgtggtcggggcggcgggggttaggggttagggtaggtcgtgcgtttatagttgtttttgtagttttaggattacgttttttagttttcgtttttcgcgttggttttgcgtcgtcgttttttttagttgtagttgaagtcgtcggtttttcgtttttaggttttttagttgcgattcgcgtagacgtattagtttttttaggtagttttgcggggcgtcggtttagttcgggcggttgggaggacgtttcggtcgcggtttttattttcgtttcgtttcgggatgttcggatttttcgttcggttcgttcgtttttcgggttcgtcggcgtcgcgtattttttgcgcgtagacgatgcggaatttttgttttattttgtgttatttgttgtattagttgtttttatcggtgacgagcgggaggtacgggtgttcgggcgagttgttttcgttcgtgttgttttcggcgttgtgtcgttttttttcgttcgttaggtagtcgtagtttgggagagggagtagtgggtacggtcggtttcgttttttttttcgcgcgtttgcgttggtcgttgagggcggtgggattaggacgtttttaggatgtttcgaggtttcgtttttcgtttcgtcgtagttatggagtcgtttatttttgcgtgaattttaggtagggcgtgtaatcgatgattacgggggttttttcgtttaggatttttttttttagatagaagttgaggtagaggagtt

SEQ ID NO: 922 - DNA, 784 bp, Artificial Sequence
  chemically treated genomic DNA (Homo sapiens) CpG-island No: 922
aactcctctacctcaacttctatctaaaaaaaaaaatcctaaacgaaaaaacccccgtaatcatcgattacacgccctacctaaaattcacgcaaaaataaacgactccataactacgacgaaacgaaaaacgaaacctcgaaacatcctaaaaacgtcctaatcccaccgccctcaacgaccaacgcaaacgcgcgaaaaaaaaaacgaaaccgaccgtacccactactccctctcccaaactacgactacctaacgaacgaaaaaaaacgacacaacgccgaaaacaacacgaacgaaaacaactcgcccgaacacccgtacctcccgctcgtcaccgataaaaacaactaatacaacaaataacacaaaataaaacaaaaattccgcatcgtctacgcgcaaaaaatacgcgacgccgacgaacccgaaaaacgaacgaaccgaacgaaaaatccgaacatcccgaaacgaaacgaaaataaaaaccgcgaccgaaacgtcctcccaaccgcccgaactaaaccgacgccccgcaaaactacctaaaaaaactaatacgtctacgcgaatcgcaactaaaaaacctaaaaacgaaaaaccgacgacttcaactacaactaaaaaaaacgacgacgcaaaaccaacgcgaaaaacgaaaactaaaaaacgtaatcctaaaactacaaaaacaactataaacgcacgacctaccctaacccctaacccccgccgccccgaccacatcaccgaataaaccccatcttcacttccatcgactcta

SEQ ID NO: 923 - DNA, 784 bp, Artificial Sequence
  chemically treated genomic DNA (Homo sapiens) CpG-island No: 923
ggtttttttgttttagtttttgtttaaagggggaagttttggacgggaagattttcgtggttatcgattatacgttttatttaaagtttacgtagaggtgagcggttttatgattgcggcggggcgggggacggggtttcgggatattttggggacgttttggttttatcgtttttagcggttagcgtagacgcgcggggggaggggcgggatcggtcgtgtttattgtttttttttttaagttacgattatttgacggacgaggaggagcggtatagcgtcgagagtagtacgagcgaggataattcgttcgagtattcgtatttttcgttcgttatcgatgaggatagttggtatagtaagtggtataagatggagtagaagtttcgtatcgtttacgcgtagaaggtgcgcgacgtcggcgggttcggggggcgggcgggtcgggcgggggattcgggtatttcggggcggggcggggatgggggtcgcggtcgggacgtttttttagtcgttcgggttgagtcggcgtttcgtagggttatttggaggagttggtgcgtttgcgcgagtcgtagttgaaggatttggaggcggagaatcggcggttttagttgtagttggaggaggcggcggcgtagaattagcgcgagaaacgggagttggaaggcgtgattttggagttgtaggagtagttgtgagcgtacggtttgttttaatttttgattttcgtcgtttcgattatattatcgggtgaattttatttttatttttatcgatttta

SEQ ID NO: 924 - DNA, 784 bp, Artificial Sequence
  chemically treated genomic DNA (Homo sapiens) CpG-island No: 924
taaaatcgataaaaataaaaataaaattcacccgataatataatcgaaacgacgaaaatcaaaaattaaaacaaaccgtacgctcacaactactcctacaactccaaaatcacgccttccaactcccgtttctcgcgctaattctacgccgccgcctcctccaactacaactaaaaccgccgattctccgcctccaaatccttcaactacgactcgcgcaaacgcaccaactcctccaaataaccctacgaaacgccgactcaacccgaacgactaaaaaaacgtcccgaccgcgacccccatccccgccccgccccgaaatacccgaatcccccgcccgacccgcccgccccccgaacccgccgacgtcgcgcaccttctacgcgtaaacgatacgaaacttctactccatcttataccacttactataccaactatcctcatcgataacgaacgaaaaatacgaatactcgaacgaattatcctcgctcgtactactctcgacgctataccgctcctcctcgtccgtcaaataatcgtaacttaaaaaaaaaaacaataaacacgaccgatcccgcccctccccccgcgcgtctacgctaaccgctaaaaacgataaaaccaaaacgtccccaaaatatcccgaaaccccgtcccccgccccgccgcaatcataaaaccgctcacctctacgtaaactttaaataaaacgtataatcgataaccacgaaaatcttcccgtccaaaacttccccctttaaacaaaaactaaaacaaaaaaacc

SEQ ID NO: 925 - DNA, 515 bp, Artificial Sequence
  chemically treated genomic DNA (Homo sapiens) CpG-island No: 925
ttaattcgcgggtttttcgtttttattttattacggaataggtttaaatttataggtcgtgcgtttttattcgggtattagtcgggttttaatttgcgggttacgcgtttttatttaggcgttgattagattttaattcgcgggtcgcgcgcgtttttatttaggtagtcgagaaggtcgtaggtagcggtagcgcgtaggatgcggatcgaggtcggcggggacgtcgcgggggattcggggttcgcgggtcggcggtcgggtagtagttgtagaaggtttagcgttaagcggagttcgtcgttgtttaggtagagcgcgtggaaggttcgcggttggaagtttagtacgagttgcgtggttgcgtttcgcgtggggtagtagaaggtttttaggcgcggggaggttatgggttgtgttcgcggacgcggttcgggtgtgttaggatttcgtcggtttgtttgggttatgtgttgggcgggttgggggcggtattatgtgttttgggttttttt

SEQ ID NO: 926 - DNA, 515 bp, Artificial Sequence
  chemically treated genomic DNA (Homo sapiens) CpG-island No: 926
aaaaaaacccaaaacacataataccgcccccaacccgcccaacacataacccaaacaaaccgacgaaatcctaacacacccgaaccgcgtccgcgaacacaacccataacctccccgcgcctaaaaaccttctactaccccacgcgaaacgcaaccacgcaactcgtactaaacttccaaccgcgaaccttccacgcgctctacctaaacaacgacgaactccgcttaacgctaaaccttctacaactactacccgaccgccgacccgcgaaccccgaatcccccgcgacgtccccgccgacctcgatccgcatcctacgcgctaccgctacctacgaccttctcgactacctaaataaaaacgcgcgcgacccgcgaattaaaatctaatcaacgcctaaataaaaacgcgtaacccgcaaattaaaacccgactaatacccgaataaaaacgcacgacctataaatttaaacctattccgtaataaaataaaaacgaaaaacccgcgaattaa

SEQ ID NO: 927 - DNA, 515 bp, Artificial Sequence
  chemically treated genomic DNA (Homo sapiens) CpG-island No: 927
ggagaggtttagggtatatgatgtcgtttttagttcgtttagtatatgatttaggtaggtcggcggggttttggtatattcgagtcgcgttcgcgaatatagtttatggttttttcgcgtttagggattttttgttgttttacgcgggacgtagttacgtagttcgtgttgagtttttagtcgcgggttttttacgcgttttgtttgggtagcggcgggtttcgtttggcgttgggttttttgtagttgttgttcggtcgtcggttcgcgggtttcgggtttttcgcgacgttttcgtcggtttcggttcgtattttgcgcgttgtcgttgtttgcgattttttcggttgtttgggtaagggcgcgcgcggttcgcgggttggaatttgattagcgtttgggtgagggcgcgtggttcgtaggttgagattcgattggtgttcggataagggcgtacggtttgtggatttggatttgtttcgtgatggagtgaggacgagaggttcgcgggttgg

SEQ ID NO: 928 - DNA, 515 bp, Artificial Sequence
  chemically treated genomic DNA (Homo sapiens) CpG-island No: 928
ccaacccgcgaacctctcgtcctcactccatcacgaaacaaatccaaatccacaaaccgtacgcccttatccgaacaccaatcgaatctcaacctacgaaccacgcgccctcacccaaacgctaatcaaattccaacccgcgaaccgcgcgcgcccttacccaaacaaccgaaaaaatcgcaaacaacgacaacgcgcaaaatacgaaccgaaaccgacgaaaacgtcgcgaaaaacccgaaacccgcgaaccgacgaccgaacaacaactacaaaaaacccaacgccaaacgaaacccgccgctacccaaacaaaacgcgtaaaaaacccgcgactaaaaactcaacacgaactacgtaactacgtcccgcgtaaaacaacaaaaaatccctaaacgcgaaaaaaccataaactatattcgcgaacgcgactcgaatataccaaaaccccgccgacctacctaaatcatatactaaacgaactaaaaacgacatcatataccctaaacctctcc

SEQ ID NO: 929 - DNA, 1434 bp, Artificial Sequence
  chemically treated genomic DNA (Homo sapiens) CpG-island No: 929
ttttgcgcggtggttgtgggaggtttttgcgggaaggtgggaaggttttcgtggaaacggggtacggtttttttgcgttcgttttttaagtttttttagaggtcggattcgcgttcggtttaggttgttggggggcgtttttttcggttttttaagtttagagtgtgagtgcgcgtagggtcgcgcgggacgggcggtttttttgtttcggggtagcggttatagcgcgggtattagggtttttcgcggcgttttcgtttttatttgcgcggtagttcgcggtgcgcgagaataaagtgtgggcgtcggcgggtcgcgcgtttcgagacggaggaggtcggagattttcgttacgttatttcgcgtttattttatttgtcgttttatttgttcggttttggtttttaatcggcgggcgggggcgtttagagtttcgaagtattgtagagttttggcgcgggaggaaaggttcgatttggcgtcggggttttcgttttcgttttcgttcgcgttggtttcgttagtttcggggcgcgcgtttttcgatttcgatttcgaattcgttgaacggcgcgcgcgtttgagcgtttttttcggttcgtttttttttatcgggcgagagaatcggggcgcgtttttttttagtttttttcggtacgagcggtcgcgtgggtttttgagcgcgtatttgatttcgttttttatttttcgggtcgcgggttggatttttggacgcgtttttcgtgatcggtttcgcggtacgagttttcgaacgcgttcgtttcgtttttcgtcggtttcgtttttttttcgttagtttcggtttcggtttcggtttcggtttcgtttttttttcgttagtttttcgggtttttttcgtcgtcgggtcggtattttttttttaagttacggcgtaagttttgcggcgttcggagttttttttgcgattttacggtcgggattgttcggagtgtatgggcgcgggttagggacgttgagcggtcgcgttatggagggcgtcgagtttcgcgcgcggttcgagcgtttggtcgaggtcgagacgcgggcggcggacggcgggcgtttggtggaggtgtagttgagcggcggcgtttcgtggggttttattttgaagggcggtcgcgagtacggcgagtcgttggttattattaaggtaaggcggtcgcggggcgcgggcgttgatagtcgggagttggtcgttttgcggggcgcgtcgaggtaggggcgcgggaggggcggtaggttcgcgttttcgggtttggcgcgcgcgtttgttggggttatttgtcgggtttgggcgtcgggatcggcgtgggcgtgtgattttggcggtttttcgcgtttcgtagagtttaaatggtttttgttcggagttttttttttttttttttttttttttcgggtaggggtttg

SEQ ID NO: 930 - DNA, 1434 bp, Artificial Sequence
  chemically treated genomic DNA (Homo sapiens) CpG-island No: 930
caaacccctacccgaaaaaaaaaaaaaaaaaaaaaaaaaactccgaacaaaaaccatttaaactctacgaaacgcgaaaaaccgccaaaatcacacgcccacgccgatcccgacgcccaaacccgacaaataaccccaacaaacgcgcgcgccaaacccgaaaacgcgaacctaccgcccctcccgcgcccctacctcgacgcgccccgcaaaacgaccaactcccgactatcaacgcccgcgccccgcgaccgccttaccttaataataaccaacgactcgccgtactcgcgaccgcccttcaaaataaaaccccacgaaacgccgccgctcaactacacctccaccaaacgcccgccgtccgccgcccgcgtctcgacctcgaccaaacgctcgaaccgcgcgcgaaactcgacgccctccataacgcgaccgctcaacgtccctaacccgcgcccatacactccgaacaatcccgaccgtaaaatcgcaaaaaaaactccgaacgccgcaaaacttacgccgtaacttaaaaaaaaaataccgacccgacgacgaaaaaaacccgaaaaactaacgaaaaaaaaacgaaaccgaaaccgaaaccgaaaccgaaactaacgaaaaaaaaacgaaaccgacgaaaaacgaaacgaacgcgttcgaaaactcgtaccgcgaaaccgatcacgaaaaacgcgtccaaaaatccaacccgcgacccgaaaaataaaaaacgaaatcaaatacgcgctcaaaaacccacgcgaccgctcgtaccgaaaaaaactaaaaaaaaacgcgccccgattctctcgcccgataaaaaaaaacgaaccgaaaaaaacgctcaaacgcgcgcgccgttcaacgaattcgaaatcgaaatcgaaaaacgcgcgccccgaaactaacgaaaccaacgcgaacgaaaacgaaaacgaaaaccccgacgccaaatcgaacctttcctcccgcgccaaaactctacaatacttcgaaactctaaacgcccccgcccgccgattaaaaaccaaaaccgaacaaataaaacgacaaataaaataaacgcgaaataacgtaacgaaaatctccgacctcctccgtctcgaaacgcgcgacccgccgacgcccacactttattctcgcgcaccgcgaactaccgcgcaaataaaaacgaaaacgccgcgaaaaaccctaatacccgcgctataaccgctaccccgaaacaaaaaaaccgcccgtcccgcgcgaccctacgcgcactcacactctaaacttaaaaaaccgaaaaaaacgccccccaacaacctaaaccgaacgcgaatccgacctctaaaaaaacttaaaaaacgaacgcaaaaaaaccgtaccccgtttccacgaaaaccttcccaccttcccgcaaaaacctcccacaaccaccgcgcaaaa

SEQ ID NO: 931 - DNA, 1434 bp, Artificial Sequence
  chemically treated genomic DNA (Homo sapiens) CpG-island No: 931
taggtttttgttcggaggagggagggggaggggaaagggatttcgggtaggagttatttaaattttgcgaggcgcggggaatcgttaggattatacgtttacgtcggtttcggcgtttaggttcggtaggtgattttagtagacgcgcgcgttagattcgggggcgcgagtttatcgtttttttcgcgtttttatttcgacgcgtttcgtagggcggttagttttcggttgttagcgttcgcgtttcgcggtcgttttattttggtgatgattagcggttcgtcgtgttcgcggtcgttttttagggtgaagttttacggggcgtcgtcgtttagttgtatttttattaggcgttcgtcgttcgtcgttcgcgtttcggtttcggttaggcgttcgggtcgcgcgcggggttcggcgttttttatggcgcgatcgtttagcgtttttggttcgcgtttatgtatttcgggtagtttcggtcgtgggatcgtaagggaggtttcgagcgtcgtagaatttgcgtcgtaatttggaaagaaagtgtcggttcggcggcggagggagttcggagggttggcggggagggggcggggtcggggtcggggtcggggtcggggttggcggggagggggcggggtcgacggggggcggggcgggcgcgttcgggagttcgtatcgcggggtcggttacggggagcgcgtttagaggtttagttcgcggttcgaagggtgagggacggggttaggtgcgcgtttaggggtttacgcggtcgttcgtatcggggagagttggagaggggcgcgtttcggttttttcgttcggtggaggggagcgggtcgggaggggcgtttaggcgcgcgcgtcgtttagcgggttcggggtcggggtcgaggagcgcgcgtttcggggttggcggagttagcgcgggcgaggacgggggcggaggtttcggcgttaggtcgggttttttttttcgcgttagagttttgtagtgtttcgaagttttgggcgttttcgttcgtcggttggaggttaggatcgggtaggtgaggcggtaggtgagatgggcgcggggtggcgtggcgggagttttcggtttttttcgtttcggggcgcgcggttcgtcggcgtttatattttgttttcgcgtatcgcgggttgtcgcgtaggtgagagcggaagcgtcgcgggaggttttggtgttcgcgttgtggtcgttgtttcggggtagagggatcgttcgtttcgcgcggttttgcgcgtatttatattttggatttagagagtcgggaagggcgttttttagtagtttgagtcgggcgcgggttcggtttttggaggggtttggaaggcgggcgtagaaggatcgtgtttcgtttttacgagggtttttttattttttcgtagaggttttttatagttatcgcgtagaa

SEQ ID NO: 932 - DNA, 1434 bp, Artificial Sequence
  chemically treated genomic DNA (Homo sapiens) CpG-island No: 932
ttctacgcgataactataaaaaacctctacgaaaaaataaaaaaaccctcgtaaaaacgaaacacgatccttctacgcccgccttccaaacccctccaaaaaccgaacccgcgcccgactcaaactactaaaaaacgcccttcccgactctctaaatccaaaatataaatacgcgcaaaaccgcgcgaaacgaacgatccctctaccccgaaacaacgaccacaacgcgaacaccaaaacctcccgcgacgcttccgctctcacctacgcgacaacccgcgatacgcgaaaacaaaatataaacgccgacgaaccgcgcgccccgaaacgaaaaaaaccgaaaactcccgccacgccaccccgcgcccatctcacctaccgcctcacctacccgatcctaacctccaaccgacgaacgaaaacgcccaaaacttcgaaacactacaaaactctaacgcgaaaaaaaaaacccgacctaacgccgaaacctccgcccccgtcctcgcccgcgctaactccgccaaccccgaaacgcgcgctcctcgaccccgaccccgaacccgctaaacgacgcgcgcgcctaaacgcccctcccgacccgctcccctccaccgaacgaaaaaaccgaaacgcgcccctctccaactctccccgatacgaacgaccgcgtaaacccctaaacgcgcacctaaccccgtccctcacccttcgaaccgcgaactaaacctctaaacgcgctccccgtaaccgaccccgcgatacgaactcccgaacgcgcccgccccgccccccgtcgaccccgccccctccccgccaaccccgaccccgaccccgaccccgaccccgccccctccccgccaaccctccgaactccctccgccgccgaaccgacactttctttccaaattacgacgcaaattctacgacgctcgaaacctcccttacgatcccacgaccgaaactacccgaaatacataaacgcgaaccaaaaacgctaaacgatcgcgccataaaaaacgccgaaccccgcgcgcgacccgaacgcctaaccgaaaccgaaacgcgaacgacgaacgacgaacgcctaataaaaatacaactaaacgacgacgccccgtaaaacttcaccctaaaaaacgaccgcgaacacgacgaaccgctaatcatcaccaaaataaaacgaccgcgaaacgcgaacgctaacaaccgaaaactaaccgccctacgaaacgcgtcgaaataaaaacgcgaaaaaaacgataaactcgcgcccccgaatctaacgcgcgcgtctactaaaatcacctaccgaacctaaacgccgaaaccgacgtaaacgtataatcctaacgattccccgcgcctcgcaaaatttaaataactcctacccgaaatccctttcccctccccctccctcctccgaacaaaaaccta

SEQ ID NO: 933 - DNA, 1038 bp, Artificial Sequence
  chemically treated genomic DNA (Homo sapiens) CpG-island No: 933
gtttcgcggtaggcgagttttattttgggggtattggggcgtagagtaggcgggcgggtttggcggcggcgcggggtattagtgaaggggaagtaggcggtttttgcgcgcgttcggagttagcgtgtggttagtaggagtgcgcggtttggaggttcggggcgagcgcggtatcggtagcgcgtgcgagggcgcgttcgcggatcgttgcgagtgggttggacggggtacgtcggattgcgttggtttggtcgtcgattttattgtttcggggcgaggggttaggtcgtagtttagttcggggttgagaggcgatttattttagtcgttttttggtcgtttcgtatcgggttttagggtttcgtttcgttatttatcggttaagcgtcgatttttttaattaagcgagtgttgcgtttcgttcgttcgcgatttttcgtcgtcggtcgtcgatcgttgagttttcggttcgtggtcgtttcgtttcggtttcgggtttcgttttttcgttttttcggtcgttttcggggttacgtttttttcggaggttgtaattttgtttcgtttcgcgttttttttttttggtcgtatcgcgattcgtggtttcgtttatttttttacgttaattaatgagacggtcgtttcggtaagttcgttttttcgttttttagtaacgattggttaacgaggtttggtttttagaaatgggtattattttcggacgatgtttgtagaagggagatcgttgggcgggcggattgatagaaggcggaggcgattagggtgttggtggaattatatatgcgttttcggtttttggtagttttattagttgcgttttcgaggttacgggaaggaagggcgagtgtgcgtatgcgtgggtattttttgttattgatttcggttattttggagatagcgaggcgttttttttcgtgggtcgcgcgcgtttcgttttttttttgttgttaagcggtggcggttgaggcgggaggtggtgggggtagagacgtttttattgagtttttatcgtgtgtt

SEQ ID NO: 934 - DNA, 1038 bp, Artificial Sequence
  chemically treated genomic DNA (Homo sapiens) CpG-island No: 934
aacacacgataaaaactcaataaaaacgtctctacccccaccacctcccgcctcaaccgccaccgcttaacaacaaaaaaaaaacgaaacgcgcgcgacccacgaaaaaaaacgcctcgctatctccaaaataaccgaaatcaataacaaaaaatacccacgcatacgcacactcgcccttccttcccgtaacctcgaaaacgcaactaataaaactaccaaaaaccgaaaacgcatatataattccaccaacaccctaatcgcctccgccttctatcaatccgcccgcccaacgatctcccttctacaaacatcgtccgaaaataatacccatttctaaaaaccaaacctcgttaaccaatcgttactaaaaaacgaaaaaacgaacttaccgaaacgaccgtctcattaattaacgtaaaaaaataaacgaaaccacgaatcgcgatacgaccaaaaaaaaaaaacgcgaaacgaaacaaaattacaacctccgaaaaaaacgtaaccccgaaaacgaccgaaaaaacgaaaaaacgaaacccgaaaccgaaacgaaacgaccacgaaccgaaaactcaacgatcgacgaccgacgacgaaaaatcgcgaacgaacgaaacgcaacactcgcttaattaaaaaaatcgacgcttaaccgataaataacgaaacgaaaccctaaaacccgatacgaaacgaccaaaaaacgactaaaataaatcgcctctcaaccccgaactaaactacgacctaacccctcgccccgaaacaataaaatcgacgaccaaaccaacgcaatccgacgtaccccgtccaacccactcgcaacgatccgcgaacgcgccctcgcacgcgctaccgataccgcgctcgccccgaacctccaaaccgcgcactcctactaaccacacgctaactccgaacgcgcgcaaaaaccgcctacttccccttcactaataccccgcgccgccgccaaacccgcccgcctactctacgccccaatacccccaaaataaaactcgcctaccgcgaaac

SEQ ID NO: 935 - DNA, 1038 bp, Artificial Sequence
  chemically treated genomic DNA (Homo sapiens) CpG-island No: 935
ggtatacggtaagagtttaataaaaacgtttttatttttattatttttcgttttagtcgttatcgtttggtagtagagaggaagcggaacgcgcgcgatttacgagggagagcgtttcgttgtttttaaggtaatcgaagttagtggtagggagtgtttacgtatgcgtatattcgtttttttttttcgtaatttcgagaacgtagttggtaagattgttagaagtcgagggcgtatgtgtggttttattaatattttagtcgttttcgttttttgttagttcgttcgtttagcgattttttttttataaatatcgttcggaaatagtgtttatttttggaaattaggtttcgttaattaatcgttgttagggagcgggaagacgggtttgtcgggacgatcgttttattggttggcgtaggggagtgggcggggttacgggtcgcggtgcggttaaagaaaggaggcgcgaagcgaggtaaagttatagttttcgggggaggcgtggtttcgggggcggtcgagaaggcgagggggcggagttcgggatcggggcggggcgattacgggtcgggagtttagcggtcggcggtcggcggcgggagatcgcgggcgagcggagcgtaatattcgtttggttggggagatcggcgtttggtcggtaggtgacggggcgggattttggggttcggtgcgaggcgattagggagcggttgggatggatcgttttttagtttcgggttgggttgcggtttggtttttcgtttcggagtagtggggtcggcggttaggttagcgtagttcgacgtatttcgtttaatttattcgtagcggttcgcgggcgcgttttcgtacgcgttgtcggtgtcgcgttcgtttcgggtttttaggtcgcgtatttttgttggttatacgttggtttcgagcgcgcgtaggggtcgtttgttttttttttattagtgtttcgcgtcgtcgttaggttcgttcgtttgttttgcgttttagtgtttttaggatggagttcgtttgtcgcggggt

SEQ ID NO: 936 - DNA, 1038 bp, Artificial Sequence
  chemically treated genomic DNA (Homo sapiens) CpG-island No: 936
accccgcgacaaacgaactccatcctaaaaacactaaaacgcaaaacaaacgaacgaacctaacgacgacgcgaaacactaataaaaaaaaaacaaacgacccctacgcgcgctcgaaaccaacgtataaccaacaaaaatacgcgacctaaaaacccgaaacgaacgcgacaccgacaacgcgtacgaaaacgcgcccgcgaaccgctacgaataaattaaacgaaatacgtcgaactacgctaacctaaccgccgaccccactactccgaaacgaaaaaccaaaccgcaacccaacccgaaactaaaaaacgatccatcccaaccgctccctaatcgcctcgcaccgaaccccaaaatcccgccccgtcacctaccgaccaaacgccgatctccccaaccaaacgaatattacgctccgctcgcccgcgatctcccgccgccgaccgccgaccgctaaactcccgacccgtaatcgccccgccccgatcccgaactccgccccctcgccttctcgaccgcccccgaaaccacgcctcccccgaaaactataactttacctcgcttcgcgcctcctttctttaaccgcaccgcgacccgtaaccccgcccactcccctacgccaaccaataaaacgatcgtcccgacaaacccgtcttcccgctccctaacaacgattaattaacgaaacctaatttccaaaaataaacactatttccgaacgatatttataaaaaaaaaatcgctaaacgaacgaactaacaaaaaacgaaaacgactaaaatattaataaaaccacacatacgccctcgacttctaacaatcttaccaactacgttctcgaaattacgaaaaaaaaaaacgaatatacgcatacgtaaacactccctaccactaacttcgattaccttaaaaacaacgaaacgctctccctcgtaaatcgcgcgcgttccgcttcctctctactaccaaacgataacgactaaaacgaaaaataataaaaataaaaacgtttttattaaactcttaccgtatacc

SEQ ID NO: 937 - DNA, 850 bp, Artificial Sequence
  chemically treated genomic DNA (Homo sapiens) CpG-island No: 937
gacgttgagcggagcgggtttttttgcgtttcggtttcgtgcgggcgcggtttttagcgcgttattcgttttcgcgttttagcgttcggggaggtatttgttttgcgtttttttttcgcggcgggacgtgtaagttttggatgatttcgtagacgttttttgagtcgttgcgcgttagaggtcgcgggtatatttaggagttcgttacgttgtaggttttgaagttgtcgttgttttttaggaggtcggcgggaggcgagacggcggcgtaggttaggtcgtttagggattgcgcgggtcgtacgggcgtcgcgggtcgtaggtataggtaggttggtaggtcgggcgttaggttgttgcgttgggtcgcggcgtcgcgttgcgtagggtcgtatagggagttggttcggttttcggatttttcgggggcgtcgtcggggttcgcggtcgtcgtcgcgtttataaatcggtagtcgtaggcgagcggtttaggggtcgcggggttcgggtggggatttggcggcgcggcggcggtagggttgtttagcgcgggtagttcgcgtacgtattgcgtaggtaggtagaaggggcggtcgtcgggtttacgtcgtacgtgttattagtgttcggtgttgcgtcgtagtagtcggtagcgtttattcggtcggatggttacgcggcgttcgtttttgtcggtgtattcgaaggggtgttttattagtacgtatacgttttttattacgttcgtcgttatcgtagtcgcggcgtttttttgcgggtaataagaaggagggtcgcggaggttaagattatcgagtttggaatagtttcgtattcggggatagatttg

SEQ ID NO: 938 - DNA, 850 bp, Artificial Sequence
  chemically treated genomic DNA (Homo sapiens) CpG-island No: 938
caaatctatccccgaatacgaaactattccaaactcgataatcttaacctccgcgaccctccttcttattacccgcaaaaaaacgccgcgactacgataacgacgaacgtaataaaaaacgtatacgtactaataaaacaccccttcgaatacaccgacaaaaacgaacgccgcgtaaccatccgaccgaataaacgctaccgactactacgacgcaacaccgaacactaataacacgtacgacgtaaacccgacgaccgccccttctacctacctacgcaatacgtacgcgaactacccgcgctaaacaaccctaccgccgccgcgccgccaaatccccacccgaaccccgcgacccctaaaccgctcgcctacgactaccgatttataaacgcgacgacgaccgcgaaccccgacgacgcccccgaaaaatccgaaaaccgaaccaactccctatacgaccctacgcaacgcgacgccgcgacccaacgcaacaacctaacgcccgacctaccaacctacctatacctacgacccgcgacgcccgtacgacccgcgcaatccctaaacgacctaacctacgccgccgtctcgcctcccgccgacctcctaaaaaacaacgacaacttcaaaacctacaacgtaacgaactcctaaatatacccgcgacctctaacgcgcaacgactcaaaaaacgtctacgaaatcatccaaaacttacacgtcccgccgcgaaaaaaaaacgcaaaacaaatacctccccgaacgctaaaacgcgaaaacgaataacgcgctaaaaaccgcgcccgcacgaaaccgaaacgcaaaaaaacccgctccgctcaacgtc

SEQ ID NO: 939 - DNA, 850 bp, Artificial Sequence
  chemically treated genomic DNA (Homo sapiens) CpG-island No: 939
taagtttgttttcgagtgcggggttattttaggttcggtggttttgattttcgcggtttttttttttgttgttcgtaggaaaacgtcgcggttgcgatggcggcggacgtggtgggggacgtgtacgtgttggtggagtattttttcgagtatatcggtaaggacgggcgtcgcgtggttattcggtcgaatgagcgttatcggttgttgcggcgtagtatcgagtattggtggtacgtgcggcgtgagttcggcggtcgttttttttatttgtttgcgtagtacgtgcgcgagttgttcgcgttgggtaattttgtcgtcgtcgcgtcgttaggtttttattcgagtttcgcggtttttgagtcgttcgtttacgattatcggtttgtgagcgcggcggcgatcgcgggtttcgacggcgttttcgaggagttcggaggtcgagttagttttttgtgcggttttgcgtaacgcggcgtcgcgatttagcgtagtagtttggcgttcggtttgttagtttgtttgtatttgcggttcgcggcgttcgtgcggttcgcgtagtttttgaacgatttggtttgcgtcgtcgtttcgtttttcgtcggttttttaggaagtagcggtagttttaaggtttgtagcgtggcgggtttttgggtgtgttcgcggtttttggcgcgtagcgatttagagaacgtttacgaggttatttaggatttgtacgtttcgtcgcgggaggagagcgtagagtaggtattttttcgggcgttggggcgcggaggcgggtggcgcgttagggatcgcgttcgtacggagtcggggcgtaaggagattcgtttcgtttagcgtt

SEQ ID NO: 940 - DNA, 850 bp, Artificial Sequence
  chemically treated genomic DNA (Homo sapiens) CpG-island No: 940
aacgctaaacgaaacgaatctccttacgccccgactccgtacgaacgcgatccctaacgcgccacccgcctccgcgccccaacgcccgaaaaaatacctactctacgctctcctcccgcgacgaaacgtacaaatcctaaataacctcgtaaacgttctctaaatcgctacgcgccaaaaaccgcgaacacacccaaaaacccgccacgctacaaaccttaaaactaccgctacttcctaaaaaaccgacgaaaaacgaaacgacgacgcaaaccaaatcgttcaaaaactacgcgaaccgcacgaacgccgcgaaccgcaaatacaaacaaactaacaaaccgaacgccaaactactacgctaaatcgcgacgccgcgttacgcaaaaccgcacaaaaaactaactcgacctccgaactcctcgaaaacgccgtcgaaacccgcgatcgccgccgcgctcacaaaccgataatcgtaaacgaacgactcaaaaaccgcgaaactcgaataaaaacctaacgacgcgacgacgacaaaattacccaacgcgaacaactcgcgcacgtactacgcaaacaaataaaaaaaacgaccgccgaactcacgccgcacgtaccaccaatactcgatactacgccgcaacaaccgataacgctcattcgaccgaataaccacgcgacgcccgtccttaccgatatactcgaaaaaatactccaccaacacgtacacgtcccccaccacgtccgccgccatcgcaaccgcgacgttttcctacgaacaacaaaaaaaaaaaccgcgaaaatcaaaaccaccgaacctaaaataaccccgcactcgaaaacaaactta

SEQ ID NO: 941 - DNA, 1352 bp, Artificial Sequence
  chemically treated genomic DNA (Homo sapiens) CpG-island No: 941
tatatattcgttttcggattagttcgggtttcgcgtttttttttttttttcgttttttgttttcggtgatttcggagcggttcggtcgttttcgcgttaagttgttcgcgcgttttttattgtcgtcgttttttatcgttttcgtttcgttttcgttgagttttttggcgtttatcggggtttcgggaagtcgagggtcgagttgggttggaagggggacggtttcggtcgggttttcgtcgtttcgggagtagttttataaaagtttgagtcgtaggtgcgagcggagttggcgttgtcgtcggcgggtttcgggggtttagtttatttttcgatattttttgaattttttatttgtttttttttattcgttgggtcgggtgcgttcgcggatcgttttgcgttttcggggttttcgggcggggcgcgaaagagggcgcgagggcgttcggggttagtagggcgtagggtcgggttggggtgttcgggttcggggcgtcggggggttcggggtgttttgtcggatcggcgggcgttttcgggttcgtttattttgcgtagtttgttaattgagtttttcgatgaatattttgttgcgggaggaggagagatataaagggttcgcgtgagcgtcgggcgttagggcgtagggggcgcgggttcgggtttcggggaggttcggtcggattcggatcggttatgttggcggggtcggggcgggcgcgggttaagtaggtcgggtcgggtcgtattaggggtcgtgcggcgagttcggggaggcgaggtcgggttggggcgcgttagtttttatcgggagtcgcgggcggcgcgggtagcggagcggcggcggcggcggcggcggcggcgttcggcgcggggtagatgaggagcgcggcgaagggggtcggacggataggttatgttgttttttttttcgatttcgttcgggcgggcgggcggggacggtcgaggggagggttcgtcgggggtcgatttgtcggttttttttttcgtcgttttgcgcgtataaagtttcgcgttcgttcgcgagttcgggcgttcgcggaggcggcggcgtcgggatttttttttcgcggggtttttgggttttcggggtcgagcgagattttcgaatttcggtgcgggtcgggattagggcgcggtcgtattttttatttatttcggcgcgggggttcggtcgcgggaacgttttttcggaatgaagcgtttttcggtgtttttaaggtagttcggtttcggatcgggaattttttcggtttttttttttaggtttttgttgtttagaattgaagagaattttaattttttcgggtcgggcgggagatagtttt

SEQ ID NO: 942 - DNA, 1352 bp, Artificial Sequence
  chemically treated genomic DNA (Homo sapiens) CpG-island No: 942
aaaactatctcccgcccgacccgaaaaaattaaaattctcttcaattctaaacaacaaaaacctaaaaaaaaaaaccgaaaaaattcccgatccgaaaccgaactaccttaaaaacaccgaaaaacgcttcattccgaaaaaacgttcccgcgaccgaacccccgcgccgaaataaataaaaaatacgaccgcgccctaatcccgacccgcaccgaaattcgaaaatctcgctcgaccccgaaaacccaaaaaccccgcgaaaaaaaaatcccgacgccgccgcctccgcgaacgcccgaactcgcgaacgaacgcgaaactttatacgcgcaaaacgacgaaaaaaaaaaccgacaaatcgacccccgacgaaccctcccctcgaccgtccccgcccgcccgcccgaacgaaatcgaaaaaaaaaacaacataacctatccgtccgacccccttcgccgcgctcctcatctaccccgcgccgaacgccgccgccgccgccgccgccgccgctccgctacccgcgccgcccgcgactcccgataaaaactaacgcgccccaacccgacctcgcctccccgaactcgccgcacgacccctaatacgacccgacccgacctacttaacccgcgcccgccccgaccccgccaacataaccgatccgaatccgaccgaacctccccgaaacccgaacccgcgccccctacgccctaacgcccgacgctcacgcgaaccctttatatctctcctcctcccgcaacaaaatattcatcgaaaaactcaattaacaaactacgcaaaataaacgaacccgaaaacgcccgccgatccgacaaaacaccccgaaccccccgacgccccgaacccgaacaccccaacccgaccctacgccctactaaccccgaacgccctcgcgccctctttcgcgccccgcccgaaaaccccgaaaacgcaaaacgatccgcgaacgcacccgacccaacgaataaaaaaaaacaaataaaaaattcaaaaaatatcgaaaaataaactaaacccccgaaacccgccgacgacaacgccaactccgctcgcacctacgactcaaacttttataaaactactcccgaaacgacgaaaacccgaccgaaaccgtcccccttccaacccaactcgaccctcgacttcccgaaaccccgataaacgccaaaaaactcaacgaaaacgaaacgaaaacgataaaaaacgacgacaataaaaaacgcgcgaacaacttaacgcgaaaacgaccgaaccgctccgaaatcaccgaaaacaaaaaacgaaaaaaaaaaaaaaacgcgaaacccgaactaatccgaaaacgaatatata

SEQ ID NO: 943 - DNA, 1352 bp, Artificial Sequence
  chemically treated genomic DNA (Homo sapiens) CpG-island No: 943
agggttatttttcgttcgattcgaggagattggggttttttttaattttggatagtagggatttgagagggaagatcgggggggttttcgattcggaatcgagttattttgaaggtatcgggaagcgttttatttcgggagggcgttttcgcggtcgggttttcgcgtcggggtgggtggggggtgcggtcgcgttttggtttcggttcgtatcgggattcgggggtttcgttcggtttcggagatttaggagtttcgcgggaagggggtttcggcgtcgtcgttttcgcgggcgttcgggttcgcgggcgagcgcggggttttatgcgcgtagggcggcggggggaggagtcggtaggtcggttttcggcgggtttttttttcggtcgttttcgttcgttcgttcgagcggggtcgggggagggggtagtatggtttgttcgttcggtttttttcgtcgcgttttttatttgtttcgcgtcgagcgtcgtcgtcgtcgtcgtcgtcgtcgtttcgttgttcgcgtcgttcgcggttttcgatggagattgacgcgttttagttcggtttcgttttttcggattcgtcgtacgatttttggtacggttcggttcggtttgtttggttcgcgttcgtttcggtttcgttaatatggtcgattcgggttcggtcgggttttttcggagttcgggttcgcgttttttgcgttttggcgttcggcgtttacgcgggttttttgtgtttttttttttttcgtagtaagatgtttatcgggggatttagttggtagattacgtagggtgagcgagttcgggagcgttcgtcggttcggtagggtatttcggatttttcggcgtttcggattcggatattttagttcggttttgcgttttgttgatttcgggcgttttcgcgttttttttcgcgtttcgttcggagatttcgagagcgtagggcgattcgcgagcgtattcggtttagcgggtggaggggagtagatgaggggtttagggggtatcggggggtgggttgggttttcgggattcgtcggcggtagcgttaatttcgttcgtatttgcggtttaaatttttgtgaggttgttttcggagcggcgggaattcggtcggagtcgttttttttttagtttagttcggttttcggtttttcggggtttcggtgggcgttaggaggtttagcgggaacggggcgagggcggtggggggcggcggtagtggagaacgcgcgggtagtttggcgcgggggcggtcgggtcgtttcggggttatcgggggtaaaggacgggggggggggaagggcgcggggttcgggttggttcgaaggcgggtgtgtg

SEQ ID NO: 944 - DNA, 1352 bp, Artificial Sequence
  chemically treated genomic DNA (Homo sapiens) CpG-island No: 944
cacacacccgccttcgaaccaacccgaaccccgcgcccttcccccccccccgtcctttacccccgataaccccgaaacgacccgaccgcccccgcgccaaactacccgcgcgttctccactaccgccgccccccaccgccctcgccccgttcccgctaaacctcctaacgcccaccgaaaccccgaaaaaccgaaaaccgaactaaactaaaaaaaaaacgactccgaccgaattcccgccgctccgaaaacaacctcacaaaaatttaaaccgcaaatacgaacgaaattaacgctaccgccgacgaatcccgaaaacccaacccaccccccgataccccctaaacccctcatctactcccctccacccgctaaaccgaatacgctcgcgaatcgccctacgctctcgaaatctccgaacgaaacgcgaaaaaaaacgcgaaaacgcccgaaatcaacaaaacgcaaaaccgaactaaaatatccgaatccgaaacgccgaaaaatccgaaataccctaccgaaccgacgaacgctcccgaactcgctcaccctacgtaatctaccaactaaatcccccgataaacatcttactacgaaaaaaaaaaaaacacaaaaaacccgcgtaaacgccgaacgccaaaacgcaaaaaacgcgaacccgaactccgaaaaaacccgaccgaacccgaatcgaccatattaacgaaaccgaaacgaacgcgaaccaaacaaaccgaaccgaaccgtaccaaaaatcgtacgacgaatccgaaaaaacgaaaccgaactaaaacgcgtcaatctccatcgaaaaccgcgaacgacgcgaacaacgaaacgacgacgacgacgacgacgacgacgctcgacgcgaaacaaataaaaaacgcgacgaaaaaaaccgaacgaacaaaccatactaccccctcccccgaccccgctcgaacgaacgaacgaaaacgaccgaaaaaaaaacccgccgaaaaccgacctaccgactcctccccccgccgccctacgcgcataaaaccccgcgctcgcccgcgaacccgaacgcccgcgaaaacgacgacgccgaaacccccttcccgcgaaactcctaaatctccgaaaccgaacgaaacccccgaatcccgatacgaaccgaaaccaaaacgcgaccgcaccccccacccaccccgacgcgaaaacccgaccgcgaaaacgccctcccgaaataaaacgcttcccgataccttcaaaataactcgattccgaatcgaaaacccccccgatcttccctctcaaatccctactatccaaaattaaaaaaaaccccaatctcctcgaatcgaacgaaaaataaccct

SEQ ID NO: 945 - DNA, 777 bp, Artificial Sequence
  chemically treated genomic DNA (Homo sapiens) CpG-island No: 945
ttcgtagcgcggcgaacgtttcgtttagcgattgggtgcgttggcgttttcgtacgttggttatgattcgttgcgtttgtagtttttcgtaagattgcggattttcgtcgtcgttgttgttgtcgtcgtcgtcgttcgcgtcgtcgtcgtcgttatagttcgtagattttttgtcgcgtttgttttgggtcgggttgttcggttcgtcgtcgttttcgacgtttttattcgcggtttcgtcgggtttcgcgtcgtcgttcgcgttgcgtttgttgttgcgtcgtttgcgtttttcgcgtttgtcgttcggcggttgttgtcggtttggttttttttcgttgttgtttaggttgtcgtcggtcggcgagattggcgagttggatacgttttgtattatttttcgagcggcgacgcgtggtttcgcgggttcggggtagaggagaagagcggggcgttttagttcgttagtttttttcgcgcgcggcgtcggttcgggcgatgcggttcgcggaggagagagtaggaggacggacgggagggattttcgcggggagggcgcgcgggggaggcggggagggaggcgggagggggaggggacggtgtggatggtttcgaggtttaaaaagaaagcgtttaacggttggacgtatatttcgttaggttttttggaaacggtgtcggtgttgtagagttcgcgaggtgtttgggagttgggcgagagttgtagatttggaggtttttatattttcgtgtaggcggaaagtttgggggtagtag

SEQ ID NO: 946 - DNA, 777 bp, Artificial Sequence
  chemically treated genomic DNA (Homo sapiens) CpG-island No: 946
ctactacccccaaactttccgcctacacgaaaatataaaaacctccaaatctacaactctcgcccaactcccaaacacctcgcgaactctacaacaccgacaccgtttccaaaaaacctaacgaaatatacgtccaaccgttaaacgctttctttttaaacctcgaaaccatccacaccgtcccctccccctcccgcctccctccccgcctcccccgcgcgccctccccgcgaaaatccctcccgtccgtcctcctactctctcctccgcgaaccgcatcgcccgaaccgacgccgcgcgcgaaaaaaactaacgaactaaaacgccccgctcttctcctctaccccgaacccgcgaaaccacgcgtcgccgctcgaaaaataatacaaaacgtatccaactcgccaatctcgccgaccgacgacaacctaaacaacaacgaaaaaaaaccaaaccgacaacaaccgccgaacgacaaacgcgaaaaacgcaaacgacgcaacaacaaacgcaacgcgaacgacgacgcgaaacccgacgaaaccgcgaataaaaacgtcgaaaacgacgacgaaccgaacaacccgacccaaaacaaacgcgacaaaaaatctacgaactataacgacgacgacgacgcgaacgacgacgacgacaacaacaacgacgacgaaaatccgcaatcttacgaaaaactacaaacgcaacgaatcataaccaacgtacgaaaacgccaacgcacccaatcgctaaacgaaacgttcgccgcgctacgaa

SEQ ID NO: 947 - DNA, 777 bp, Artificial Sequence
  chemically treated genomic DNA (Homo sapiens) CpG-island No: 947
ttgttgtttttaaatttttcgtttgtacggaggtataagagtttttaagtttgtagttttcgtttaatttttagatatttcgcgggttttgtagtatcggtatcgtttttaggaggtttggcggggtgtgcgtttagtcgttgggcgttttttttttggatttcggggttatttatatcgttttttttttttttcgttttttttttcgtttttttcgcgcgtttttttcgcggaggtttttttcgttcgtttttttgttttttttttcgcgggtcgtatcgttcgggtcggcgtcgcgcgcgggggaagttggcgggttgaggcgtttcgttttttttttttgtttcgggttcgcgaggttacgcgtcgtcgttcgagagatgatgtaggacgtgtttagttcgttagtttcgtcggtcgacgatagtttgagtaatagcgaggaagagttagatcggtagtagtcgtcgagcggtaagcgcgggggacgtaagcggcgtagtagtaggcgtagcgcgggcggcggcgcggggttcggcggagtcgcgggtgggggcgtcggaggcggcgacgagtcgggtagttcggtttagggtaagcgcggtaagaagtttgcgggttgtggcggcggcggcggcgcgggcggcggcggcggtagtagtagcggcggcgggagttcgtagttttacgaggagttgtagacgtagcgggttatggttaacgtgcgggagcgttagcgtatttagtcgttgaacgaggcgttcgtcgcgttgcgga

SEQ ID NO: 948 - DNA, 777 bp, Artificial Sequence
  chemically treated genomic DNA (Homo sapiens) CpG-island No: 948
tccgcaacgcgacgaacgcctcgttcaacgactaaatacgctaacgctcccgcacgttaaccataacccgctacgtctacaactcctcgtaaaactacgaactcccgccgccgctactactaccgccgccgccgcccgcgccgccgccgccgccacaacccgcaaacttcttaccgcgcttaccctaaaccgaactacccgactcgtcgccgcctccgacgcccccacccgcgactccgccgaaccccgcgccgccgcccgcgctacgcctactactacgccgcttacgtcccccgcgcttaccgctcgacgactactaccgatctaactcttcctcgctattactcaaactatcgtcgaccgacgaaactaacgaactaaacacgtcctacatcatctctcgaacgacgacgcgtaacctcgcgaacccgaaacaaaaaaaaaaaacgaaacgcctcaacccgccaacttcccccgcgcgcgacgccgacccgaacgatacgacccgcgaaaaaaaaaacaaaaaaacgaacgaaaaaaacctccgcgaaaaaaacgcgcgaaaaaaacgaaaaaaaaaacgaaaaaaaaaaaaaacgatataaataaccccgaaatccaaaaaaaaaacgcccaacgactaaacgcacaccccgccaaacctcctaaaaacgataccgatactacaaaacccgcgaaatatctaaaaattaaacgaaaactacaaacttaaaaactcttatacctccgtacaaacgaaaaatttaaaaacaacaa

SEQ ID NO: 949 - DNA, 504 bp, Artificial Sequence
  chemically treated genomic DNA (Homo sapiens) CpG-island No: 949
ggcggattcggatggagtagtttttgagtgacggttttttcgggtttgggcgttaagggcgaaggtcgaaagtcggcgttagaaagaggaacgttagtttttatcgaagattttaaggtcgcggtaaggagataattgttcgggggaggttatgcgttcgggtttagcggttttttagttcgcggacgcgtttaaatttcgtcgggtcggaagtcggcgtcgggaagcgcgtgtgttttttacgttcgttttcgcgtagtcgcggtcgttgtcgtcgcgttttcgtttgtttttttgcgtcgcgcgttttttagtgtcggttttagagggcgtttttgggttagcgtgtagggttggcggcggcggcgttcgggttatttttgggagcggagtgggggcggagcgagacggaagtagtttaggagatttgaggcgtaggttgcggtttttaaggtgatcgcgttttatgtgggattcgttttaatgtttttgaatttgggtttg

SEQ ID NO: 950 - DNA, 504 bp, Artificial Sequence
  chemically treated genomic DNA (Homo sapiens) CpG-island No: 950
caaacccaaattcaaaaacattaaaacgaatcccacataaaacgcgatcaccttaaaaaccgcaacctacgcctcaaatctcctaaactacttccgtctcgctccgcccccactccgctcccaaaaataacccgaacgccgccgccgccaaccctacacgctaacccaaaaacgccctctaaaaccgacactaaaaaacgcgcgacgcaaaaaaacaaacgaaaacgcgacgacaacgaccgcgactacgcgaaaacgaacgtaaaaaacacacgcgcttcccgacgccgacttccgacccgacgaaatttaaacgcgtccgcgaactaaaaaaccgctaaacccgaacgcataacctcccccgaacaattatctccttaccgcgaccttaaaatcttcgataaaaactaacgttcctctttctaacgccgactttcgaccttcgcccttaacgcccaaacccgaaaaaaccgtcactcaaaaactactccatccgaatccgcc

SEQ ID NO: 951 - DNA, 504 bp, Artificial Sequence
  chemically treated genomic DNA (Homo sapiens) CpG-island No: 951
taaatttaggtttagaggtattagggcgagttttatatagggcgcggttattttggggatcgtagtttacgttttaagttttttgagttgttttcgtttcgtttcgtttttatttcgtttttagaggtgattcgagcgtcgtcgtcgttagttttatacgttagtttaggagcgttttttagagtcggtattggagagcgcgcggcgtagggaggtaggcggagacgcggcggtagcggtcgcggttgcgcgggggcggacgtaaaaggtatacgcgtttttcggcgtcggttttcggttcggcgaggtttgagcgcgttcgcgggttgggaggtcgttggattcgggcgtatggtttttttcgggtagttatttttttgtcgcgattttgaggttttcggtaagaattggcgtttttttttttaacgtcggttttcggttttcgtttttgacgtttaggttcggggaggtcgttatttagaaattgttttattcgagttcgtt

SEQ ID NO: 952 - DNA, 504 bp, Artificial Sequence
  chemically treated genomic DNA (Homo sapiens) CpG-island No: 952
aacgaactcgaataaaacaatttctaaataacgacctccccgaacctaaacgtcaaaaacgaaaaccgaaaaccgacgttaaaaaaaaaaacgccaattcttaccgaaaacctcaaaatcgcgacaaaaaaataactacccgaaaaaaaccatacgcccgaatccaacgacctcccaacccgcgaacgcgctcaaacctcgccgaaccgaaaaccgacgccgaaaaacgcgtataccttttacgtccgcccccgcgcaaccgcgaccgctaccgccgcgtctccgcctacctccctacgccgcgcgctctccaataccgactctaaaaaacgctcctaaactaacgtataaaactaacgacgacgacgctcgaatcacctctaaaaacgaaataaaaacgaaacgaaacgaaaacaactcaaaaaacttaaaacgtaaactacgatccccaaaataaccgcgccctatataaaactcgccctaatacctctaaacctaaattta

SEQ ID NO: 953 - DNA, 522 bp, Artificial Sequence
  chemically treated genomic DNA (Homo sapiens) CpG-island No: 953
gcgcggtttttcgggttaatcgtcgggcggcgcgcgtcgagaagttttgggtaaagtatttagaattggtcgcgtgttggtggcgttcgttagtcggttcgggagaggggatttgagcgtttcgcggtcggtgcgtagcgcggtttcggtttcgtagtttgtttgtaagtggttattttcgttttcgatttttgcggtcggtgcgggagttgttagttgtacgttgcgggggtatcggagaagtcggggttgttttttttcggttttgtgcgttaatttcggagttcggtttcggggaattagggagcgttttcggttgtatagcgtttaggtgagtggcggggcgttcgtttaaatggggtttgggtgtcggggggtttggcggcggcgcgggttcggaagggttgttgtttgcggggcgtcgcggttttttgtcggatcggggtttgttcgagtcgttcggggaggtttcggttttggggtagatttaagtttgggagtttgggtgtcggttgtagtttt

SEQ ID NO: 954 - DNA, 522 bp, Artificial Sequence
  chemically treated genomic DNA (Homo sapiens) CpG-island No: 954
aaaactacaaccgacacccaaactcccaaacttaaatctaccccaaaaccgaaacctccccgaacgactcgaacaaaccccgatccgacaaaaaaccgcgacgccccgcaaacaacaacccttccgaacccgcgccgccgccaaaccccccgacacccaaaccccatttaaacgaacgccccgccactcacctaaacgctatacaaccgaaaacgctccctaattccccgaaaccgaactccgaaattaacgcacaaaaccgaaaaaaaacaaccccgacttctccgatacccccgcaacgtacaactaacaactcccgcaccgaccgcaaaaatcgaaaacgaaaataaccacttacaaacaaactacgaaaccgaaaccgcgctacgcaccgaccgcgaaacgctcaaatcccctctcccgaaccgactaacgaacgccaccaacacgcgaccaattctaaatactttacccaaaacttctcgacgcgcgccgcccgacgattaacccgaaaaaccgcgc

SEQ ID NO: 955 - DNA, 522 bp, Artificial Sequence
  chemically treated genomic DNA (Homo sapiens) CpG-island No: 955
ggagttgtagtcggtatttaagtttttaggtttgggtttgttttagggtcggagttttttcgggcgattcggatagatttcggttcggtagagaatcgcggcgtttcgtaaatagtagttttttcgagttcgcgtcgtcgttaggtttttcgatatttaggttttatttaggcgggcgtttcgttatttatttgagcgttgtgtagtcggagacgttttttagtttttcggggtcgggtttcggggttagcgtatagaatcgggagaaggtaatttcggttttttcggtattttcgtaacgtgtagttgatagttttcgtatcggtcgtaggagtcgggggcggggatggttatttgtagatagattgcggggtcggagtcgcgttgcgtatcggtcgcgaagcgtttaagttttttttttcgggtcggttggcgggcgttattagtacgcggttagttttgagtattttgtttagaatttttcggcgcgcgtcgttcggcgattagttcgaggagtcgcgt

SEQ ID NO: 956 - DNA, 522 bp, Artificial Sequence
  chemically treated genomic DNA (Homo sapiens) CpG-island No: 956
acgcgactcctcgaactaatcgccgaacgacgcgcgccgaaaaattctaaacaaaatactcaaaactaaccgcgtactaataacgcccgccaaccgacccgaaaaaaaaaacttaaacgcttcgcgaccgatacgcaacgcgactccgaccccgcaatctatctacaaataaccatccccgcccccgactcctacgaccgatacgaaaactatcaactacacgttacgaaaataccgaaaaaaccgaaattaccttctcccgattctatacgctaaccccgaaacccgaccccgaaaaactaaaaaacgtctccgactacacaacgctcaaataaataacgaaacgcccgcctaaataaaacctaaatatcgaaaaacctaacgacgacgcgaactcgaaaaaactactatttacgaaacgccgcgattctctaccgaaccgaaatctatccgaatcgcccgaaaaaactccgaccctaaaacaaacccaaacctaaaaacttaaataccgactacaactcc

SEQ ID NO: 957 - DNA, 677 bp, Artificial Sequence
  chemically treated genomic DNA (Homo sapiens) CpG-island No: 957
tcggggaggttgtttacgtagtgtttttcgaaggtttgcgcgttcgtttgttcgtgtttgttatttttgtatttttcgatttttttttttttcggttttcggcgggcggtattttttagtcggtttttaattttgaggagttttaagtagtcgcggcggtagtagtagttttggacgtagtagttaagtttttcgttggttttcgggggttttttcgggttttttttattgtaggttgaaggtatcgtttcggcgttttggtcgtcgtgtgttcgcgcgcggggcgtttcgtttttagagtcggggtcgcgggagggggcgtaggtagtcgggcggtagcgggcggtttcgttttttcgtattcgggaggttgtaggattcggggttttcgcgcgttcggggtcgggagacgggttggggcgtcggttttatttttgcgcgttttgttttttgcgggtagtagttcggagtttgcgggagggagtaggttgggcgcgtggtggggggcgcgcgatgcggagggggcggcggcgtagttaattcgagaggcggtcggcgtttttttatatcgtttcgcggtttcgtcgttttttttcgttttttttttttagtttttattcggatttttagaacggtcgcgtagagcggggagggggtaggggtttatattagaggtt

SEQ ID NO: 958 - DNA, 677 bp, Artificial Sequence
  chemically treated genomic DNA (Homo sapiens) CpG-island No: 958
aacctctaatataaacccctaccccctccccgctctacgcgaccgttctaaaaatccgaataaaaactaaaaaaaaaaaacgaaaaaaaacgacgaaaccgcgaaacgatataaaaaaacgccgaccgcctctcgaattaactacgccgccgccccctccgcatcgcgcgccccccaccacgcgcccaacctactccctcccgcaaactccgaactactacccgcaaaaaacaaaacgcgcaaaaataaaaccgacgccccaacccgtctcccgaccccgaacgcgcgaaaaccccgaatcctacaacctcccgaatacgaaaaaacgaaaccgcccgctaccgcccgactacctacgccccctcccgcgaccccgactctaaaaacgaaacgccccgcgcgcgaacacacgacgaccaaaacgccgaaacgataccttcaacctacaataaaaaaaacccgaaaaaacccccgaaaaccaacgaaaaacttaactactacgtccaaaactactactaccgccgcgactacttaaaactcctcaaaattaaaaaccgactaaaaaataccgcccgccgaaaaccgaaaaaaaaaaaaatcgaaaaatacaaaaataacaaacacgaacaaacgaacgcgcaaaccttcgaaaaacactacgtaaacaacctccccga

SEQ ID NO: 959 - DNA, 677 bp, Artificial Sequence
  chemically treated genomic DNA (Homo sapiens) CpG-island No: 959
ggtttttggtgtggatttttgtttttttttcgttttgcgcggtcgttttagaggttcgggtgggagttggaggaggaaagcgggaggaggcggcgaggtcgcggggcggtatgagggggcgtcggtcgtttttcggattggttgcgtcgtcgtttttttcgtatcgcgcgttttttattacgcgtttagtttgttttttttcgtaggtttcgagttgttgttcgtaggaggtaggacgcgtaggggtgggatcggcgttttagttcgtttttcggtttcgggcgcgcgggaatttcgggttttgtagtttttcgagtgcggagaggcggggtcgttcgttgtcgttcggttgtttgcgttttttttcgcggtttcggttttgggagcggggcgtttcgcgcgcgggtatacggcggttagagcgtcgaggcggtatttttagtttgtaatgagaggaattcgggagagttttcgggagttagcgaagagtttggttgttgcgtttagggttgttgttgtcgtcgcggttgtttgaaattttttaaagttgagagtcggttagagggtgtcgttcgtcgggagtcggagggaaaggaagtcggaaggtgtaagagtgatagatacggatagacggacgcgtagattttcggaaggtattgcgtaggtagttttttcgg

SEQ ID NO: 960 - DNA, 677 bp, Artificial Sequence
  chemically treated genomic DNA (Homo sapiens) CpG-island No: 960
ccgaaaaaactacctacgcaataccttccgaaaatctacgcgtccgtctatccgtatctatcactcttacaccttccgacttcctttccctccgactcccgacgaacgacaccctctaaccgactctcaactttaaaaaatttcaaacaaccgcgacgacaacaacaaccctaaacgcaacaaccaaactcttcgctaactcccgaaaactctcccgaattcctctcattacaaactaaaaataccgcctcgacgctctaaccgccgtatacccgcgcgcgaaacgccccgctcccaaaaccgaaaccgcgaaaaaaaacgcaaacaaccgaacgacaacgaacgaccccgcctctccgcactcgaaaaactacaaaacccgaaattcccgcgcgcccgaaaccgaaaaacgaactaaaacgccgatcccacccctacgcgtcctacctcctacgaacaacaactcgaaacctacgaaaaaaaacaaactaaacgcgtaataaaaaacgcgcgatacgaaaaaaacgacgacgcaaccaatccgaaaaacgaccgacgccccctcataccgccccgcgacctcgccgcctcctcccgctttcctcctccaactcccacccgaacctctaaaacgaccgcgcaaaacgaaaaaaaaacaaaaatccacaccaaaaacc

SEQ ID NO: 961 - DNA, 804 bp, Artificial Sequence
  chemically treated genomic DNA (Homo sapiens) CpG-island No: 961
ttggttcgcggttttgtcgataaaatttaatttttattttgtaagattaataggtcgcgtaggatttttttagtcgttttttgtttcgtatttttttgggtttgaggattttcggttcggtttttttcgcgcgcgcgaggttttagatggcgagggcgtagttttttggtttatttgattacgttggggtgttcgaaggtttttaggtgttttagtatcgttatttcgcggatggtggagagcggtatgtttttttcgtcggtttgtattcgtacgcgttttaacgttacgaaacggttttcgttttttaagtcgcgggttttgaatatttttttataggcgtttttttcgattttcgttacgtattcgtattgttggttagcgcggtataggtcgtttttttttatgtcgtttggacgtcgttcgtcgcggcgtcgttggggcgggcggggggtgcgtttaattagttggcggtcgtcgttcgtttatttcggggtttttcggagatcggtttagttttatttgtttttcgtcggtttaggcgttcgggcgttggggttttcgtcgttgtagaagttggatggagagattttttcgcggggttggcgtaattttggtgtcgtcgtcgcgaaatttcgtttgtagagtcgtcgtcgtcgtcgtcgtcggaggagcgagtcgattttttttttttttttttcgaagcgaagtttttaatatagatacgattatatagtttttgtttaagcgcgttttagtttagaattattgtatttaaaggaggagacgggaggataagaagaa

SEQ ID NO: 962 - DNA, 804 bp, Artificial Sequence
  chemically treated genomic DNA (Homo sapiens) CpG-island No: 962
ttcttcttatcctcccgtctcctcctttaaatacaataattctaaactaaaacgcgcttaaacaaaaactatataatcgtatctatattaaaaacttcgcttcgaaaaaaaaaaaaaaaaaatcgactcgctcctccgacgacgacgacgacgacgactctacaaacgaaatttcgcgacgacgacaccaaaattacgccaaccccgcgaaaaaatctctccatccaacttctacaacgacgaaaaccccaacgcccgaacgcctaaaccgacgaaaaacaaataaaactaaaccgatctccgaaaaaccccgaaataaacgaacgacgaccgccaactaattaaacgcaccccccgcccgccccaacgacgccgcgacgaacgacgtccaaacgacataaaaaaaaacgacctataccgcgctaaccaacaatacgaatacgtaacgaaaatcgaaaaaaacgcctataaaaaaatattcaaaacccgcgacttaaaaaacgaaaaccgtttcgtaacgttaaaacgcgtacgaatacaaaccgacgaaaaaaacataccgctctccaccatccgcgaaataacgatactaaaacacctaaaaaccttcgaacaccccaacgtaatcaaataaaccaaaaaactacgccctcgccatctaaaacctcgcgcgcgcgaaaaaaaccgaaccgaaaatcctcaaacccaaaaaaatacgaaacaaaaaacgactaaaaaaatcctacgcgacctattaatcttacaaaataaaaattaaattttatcgacaaaaccgcgaaccaa

SEQ ID NO: 963 - DNA, 804 bp, Artificial Sequence
  chemically treated genomic DNA (Homo sapiens) CpG-island No: 963
ttttttttattttttcgtttttttttttaggtgtaatgattttggattgagacgcgtttgggtagaggttatgtaatcgtgtttgtgttgaggatttcgtttcgaggagggaagaggagggatcggttcgttttttcggcggcggcggcggcggcgattttgtaggcggagtttcgcggcggcggtattagggttacgttagtttcgcggggaggtttttttatttagtttttgtagcggcgaaagttttagcgttcgagcgtttgagtcggcggggagtaagtaaagttagatcgattttcggggagtttcggagtaggcgagcggcggtcgttagttagttgagcgtatttttcgttcgttttagcggcgtcgcggcgggcggcgtttaggcggtatggagaaggacggtttgtgtcgcgttgattagtagtacgaatgcgtggcggagatcggggagggcgtttatgggaaggtgtttaaggttcgcgatttgaagaacggaggtcgtttcgtggcgttgaagcgcgtgcgggtgtagatcggcgaggagggtatgtcgttttttattattcgcgaggtggcggtgttgaggtatttggagattttcgagtattttaacgtggttaggtgagttagggagttgcgttttcgttatttggggtttcgcgcgcgcggggagggtcgagtcgggaatttttaggtttagaaaggtgcggggtagagggcgattggggaggttttgcgcgatttgttggttttatagagtgagagttaagttttgtcgatagagtcgcgagttag

SEQ ID NO: 964 - DNA, 804 bp, Artificial Sequence
  chemically treated genomic DNA (Homo sapiens) CpG-island No: 964
ctaactcgcgactctatcgacaaaacttaactctcactctataaaaccaacaaatcgcgcaaaacctccccaatcgccctctaccccgcacctttctaaacctaaaaattcccgactcgaccctccccgcgcgcgcgaaaccccaaataacgaaaacgcaactccctaactcacctaaccacgttaaaatactcgaaaatctccaaatacctcaacaccgccacctcgcgaataataaaaaacgacataccctcctcgccgatctacacccgcacgcgcttcaacgccacgaaacgacctccgttcttcaaatcgcgaaccttaaacaccttcccataaacgccctccccgatctccgccacgcattcgtactactaatcaacgcgacacaaaccgtccttctccataccgcctaaacgccgcccgccgcgacgccgctaaaacgaacgaaaaatacgctcaactaactaacgaccgccgctcgcctactccgaaactccccgaaaatcgatctaactttacttactccccgccgactcaaacgctcgaacgctaaaactttcgccgctacaaaaactaaataaaaaaacctccccgcgaaactaacgtaaccctaataccgccgccgcgaaactccgcctacaaaatcgccgccgccgccgccgccgaaaaaacgaaccgatccctcctcttccctcctcgaaacgaaatcctcaacacaaacacgattacataacctctacccaaacgcgtctcaatccaaaatcattacacctaaaaaaaaaaacgaaaaaataaaaaaaa

SEQ ID NO: 965 - DNA, 1201 bp, Artificial Sequence
  chemically treated genomic DNA (Homo sapiens) CpG-island No: 965
gtcggagcgagggcgtttagtgaggagtttaggcggaaggtggcggtgtttcgttgttcgttttagatttattcggttcggttcgtatcggatttaaaatggttagaattggtagtcgacgtttcgcgttttggtgattttgtattgatagcgcgattttcggttttttttaggaaatcgggagagttggtaaggttgggtttttacggttgtagttttcgggttcgatcgagggaattgaggttcgttaggtcggttttaaatcgttcgtttgttgtaaggtcgttcgttttagcgcggagggtcgcggttaggaaggtcgtattcggatttgtcgtaggtaatagggttcgttcgggtgttaggaggtcggcgcgttagtagtcgcgttgaggaggtttcgtattttggtttttggtcgagcgttagatttcggtttttacgcgttcgcgttcggggatttcgtcggtcgcgttttcgttacgttaggtcgcgggttttttttaggtcgtcgttttcgagttttcggttcgcgttcgttttcgcgtttttcggatttcgcgtcgttagtttgttttcggtttagcgatgtttgtttgtcgttcgattttcgcgttcgttgtcgttcggttcgttcggtttacgtttcgtagttgatttggtgtcgtcgttagtcgaggtcgtattcgtagttggagggaggcgggaggcgggaggcgggaggcgcgaggcgggaggttgggcgagaggagtcggcggggcgggggtttgggtcgttacgtgggtgcgtcgcgtaggcgtcgggcgggttagacgtaggttcgggggttttcggtttggtcgggtagtagcgcgggggcggttttggggcggggagatagggggcggttttatttcggcgttttgcggaggatagtagcgatcgttaaggtttagtgagttttcgtattagcgcggtatttggtatttggcggggtcgaattaacgaatgagcgaatttgtcgagagtcgtttcgtttgaatttattgattttttttttgtttcggttttatttttatttttcgatttatttttttttgtttttttttattattttttttttcgtttatatttttttttttttttttttatttttttttttatttttttttttttttttttatttttttttttttatttttttttttttttattttttta

SEQ ID NO: 966 - DNA, 1201 bp, Artificial Sequence
  chemically treated genomic DNA (Homo sapiens) CpG-island No: 966
taaaaaaataaaaaaaaaaaaaaataaaaaaaaaaaaataaaaaaaaaaaaaaaaaaataaaaaaaaaaataaaaaaaaaaaaaaaaaaatataaacgaaaaaaaaaataataaaaaaaaacaaaaaaaaataaatcgaaaaataaaaataaaaccgaaacaaaaaaaaaatcaataaattcaaacgaaacgactctcgacaaattcgctcattcgttaattcgaccccgccaaataccaaataccgcgctaatacgaaaactcactaaaccttaacgatcgctactatcctccgcaaaacgccgaaataaaaccgccccctatctccccgccccaaaaccgcccccgcgctactacccgaccaaaccgaaaacccccgaacctacgtctaacccgcccgacgcctacgcgacgcacccacgtaacgacccaaacccccgccccgccgactcctctcgcccaacctcccgcctcgcgcctcccgcctcccgcctcccgcctccctccaactacgaatacgacctcgactaacgacgacaccaaatcaactacgaaacgtaaaccgaacgaaccgaacgacaacgaacgcgaaaatcgaacgacaaacaaacatcgctaaaccgaaaacaaactaacgacgcgaaatccgaaaaacgcgaaaacgaacgcgaaccgaaaactcgaaaacgacgacctaaaaaaaacccgcgacctaacgtaacgaaaacgcgaccgacgaaatccccgaacgcgaacgcgtaaaaaccgaaatctaacgctcgaccaaaaaccaaaatacgaaacctcctcaacgcgactactaacgcgccgacctcctaacacccgaacgaaccctattacctacgacaaatccgaatacgaccttcctaaccgcgaccctccgcgctaaaacgaacgaccttacaacaaacgaacgatttaaaaccgacctaacgaacctcaattccctcgatcgaacccgaaaactacaaccgtaaaaacccaaccttaccaactctcccgatttcctaaaaaaaaccgaaaatcgcgctatcaatacaaaatcaccaaaacgcgaaacgtcgactaccaattctaaccattttaaatccgatacgaaccgaaccgaataaatctaaaacgaacaacgaaacaccgccaccttccgcctaaactcctcactaaacgccctcgctccgac

SEQ ID NO: 967 - DNA, 1201 bp, Artificial Sequence
  chemically treated genomic DNA (Homo sapiens) CpG-island No: 967
tgagagagtgaaggagggagggaatgagagggggggagtaagagaggagagaagagagtgaagaagggaatgaggaaaggagagggaggatatgagcggggagggagatagtgaggaagggtaggaggaagtgagtcgaggaatgagggtaggatcgaggtaaggaaagagttaatggatttagacggggcgattttcggtaaattcgtttattcgttggttcggtttcgttaagtgttaggtgtcgcgttagtgcggggatttattgagttttggcgatcgttgttgtttttcgtagagcgtcggagtggagtcgttttttgttttttcgttttagggtcgttttcgcgttgttattcggttaggtcgggaattttcgggtttacgtttggttcgttcggcgtttgcgcggcgtatttacgtgacggtttaggttttcgtttcgtcggtttttttcgtttagtttttcgtttcgcgtttttcgtttttcgtttttcgtttttttttagttgcgagtgcggtttcggttggcggcggtattaggttagttgcgaggcgtgagtcgaacgggtcgggcggtagcgaacgcgggggtcgggcggtaagtaggtatcgttgggtcggggataagttagcggcgcggagttcgaggggcgcgggggcgggcgcgggtcggaggttcgggggcggcgatttgaggagagttcgcggtttgacgtggcggggacgcggtcggcgggattttcgggcgcgggcgcgtaggggtcgggatttggcgttcggttaggggttagggtgcgaggtttttttagcgcggttgttggcgcgtcggttttttggtattcgggcgggttttgttgtttgcggtaggttcgaatgcggtttttttggtcgcgatttttcgcgttggagcgggcggttttgtaataggcgggcgatttggggtcggtttgacgagttttagttttttcgatcgggttcggggattgtagtcgtaggagtttagttttgttagttttttcggttttttgagaggagtcggagatcgcgttgttagtgtaaaattattagagcgcgaagcgtcggttgttagttttgattattttagattcggtgcgggtcgagtcgagtggatttggggcgggtagcggggtatcgttatttttcgtttgggttttttattgggcgttttcgtttcggt

SEQ ID NO: 968 - DNA, 1201 bp, Artificial Sequence
  chemically treated genomic DNA (Homo sapiens) CpG-island No: 968
accgaaacgaaaacgcccaataaaaaacccaaacgaaaaataacgataccccgctacccgccccaaatccactcgactcgacccgcaccgaatctaaaataatcaaaactaacaaccgacgcttcgcgctctaataattttacactaacaacgcgatctccgactcctctcaaaaaaccgaaaaaactaacaaaactaaactcctacgactacaatccccgaacccgatcgaaaaaactaaaactcgtcaaaccgaccccaaatcgcccgcctattacaaaaccgcccgctccaacgcgaaaaatcgcgaccaaaaaaaccgcattcgaacctaccgcaaacaacaaaacccgcccgaataccaaaaaaccgacgcgccaacaaccgcgctaaaaaaacctcgcaccctaacccctaaccgaacgccaaatcccgacccctacgcgcccgcgcccgaaaatcccgccgaccgcgtccccgccacgtcaaaccgcgaactctcctcaaatcgccgcccccgaacctccgacccgcgcccgcccccgcgcccctcgaactccgcgccgctaacttatccccgacccaacgatacctacttaccgcccgacccccgcgttcgctaccgcccgacccgttcgactcacgcctcgcaactaacctaataccgccgccaaccgaaaccgcactcgcaactaaaaaaaaacgaaaaacgaaaaacgaaaaacgcgaaacgaaaaactaaacgaaaaaaaccgacgaaacgaaaacctaaaccgtcacgtaaatacgccgcgcaaacgccgaacgaaccaaacgtaaacccgaaaattcccgacctaaccgaataacaacgcgaaaacgaccctaaaacgaaaaaacaaaaaacgactccactccgacgctctacgaaaaacaacaacgatcgccaaaactcaataaatccccgcactaacgcgacacctaacacttaacgaaaccgaaccaacgaataaacgaatttaccgaaaatcgccccgtctaaatccattaactctttccttacctcgatcctaccctcattcctcgactcacttcctcctacccttcctcactatctccctccccgctcatatcctccctctcctttcctcattcccttcttcactctcttctctcctctcttactccccccctctcattccctccctccttcactctctca

SEQ ID NO: 969 - DNA, 886 bp, Artificial Sequence
  chemically treated genomic DNA (Homo sapiens) CpG-island No: 969
  misc_feature (467)..(467): n is either a, c, g or t
tcgttatcggagatttatagggttagaagcgggagcggggtgcgtttcgattcgtaaaagtgtaaggttattgggatcgttcgagttgtaatcgtgggacggggttgatgttgcgggtttaggaaggtagcgttgggcggggtagatatcgttaggaaacggcggacgagtgcggggatttttgatgtgggggtgtcgggtttaggttaggggacgggggggtggggatggaggggcgaggaataaggagggaatcgcgggagattttataggaggcggtttgagcgtcgggacgtagatttttttttagtattcgtaattttcgggattttcgggagagtcgggttgcgggcgcgtttacgtcggggacgcgggatatttttcgttcgtaggggtttgtttttatcgacggtagcggggttttttttttttcgcgatagcgtcgcggtggattttttagtttttgncgttgtaggagcgagcgtcgatttcgcgatttaggtcgtcgtcgttatttcgattcgggtattagtttttagtttcgatttgtttttcgggagcgagtttcgtgatcgcgcgcgcgatttcgtcgggggagtcggttttgcggaacgtttaggcgcgttattttagagtatgcgtagtaagatcgcgcggttcgttttttaggtaaatcgttgtttcgggttttttttgcgcggcgtcgagtcgtaggtttggtttgttagcgtatgggggcggggacgtaatttacggaaaaggcggggttatttcgagattggacggcggcgtttaggggcggagttaggatgggggagttgaataggacgtttttggcgtaaaggggttggggtagggggcgtttaattgagattttaggacggtt

SEQ ID NO: 970 - DNA, 886 bp, Artificial Sequence
  chemically treated genomic DNA (Homo sapiens) CpG-island No: 970
  misc_feature (420)..(420): n is either a, c, g or t
aaccgtcctaaaatctcaattaaacgccccctaccccaacccctttacgccaaaaacgtcctattcaactcccccatcctaactccgcccctaaacgccgccgtccaatctcgaaataaccccgccttttccgtaaattacgtccccgcccccatacgctaacaaaccaaacctacgactcgacgccgcgcaaaaaaaacccgaaacaacgatttacctaaaaaacgaaccgcgcgatcttactacgcatactctaaaataacgcgcctaaacgttccgcaaaaccgactcccccgacgaaatcgcgcgcgcgatcacgaaactcgctcccgaaaaacaaatcgaaactaaaaactaatacccgaatcgaaataacgacgacgacctaaatcgcgaaatcgacgctcgctcctacaacgncaaaaactaaaaaatccaccgcgacgctatcgcgaaaaaaaaaaaaccccgctaccgtcgataaaaacaaacccctacgaacgaaaaatatcccgcgtccccgacgtaaacgcgcccgcaacccgactctcccgaaaatcccgaaaattacgaatactaaaaaaaaatctacgtcccgacgctcaaaccgcctcctataaaatctcccgcgattccctccttattcctcgcccctccatccccacccccccgtcccctaacctaaacccgacacccccacatcaaaaatccccgcactcgtccgccgtttcctaacgatatctaccccgcccaacgctaccttcctaaacccgcaacatcaaccccgtcccacgattacaactcgaacgatcccaataaccttacacttttacgaatcgaaacgcaccccgctcccgcttctaaccctataaatctccgataacga

SEQ ID NO: 971 - DNA, 886 bp, Artificial Sequence
  chemically treated genomic DNA (Homo sapiens) CpG-island No: 971
  misc_feature (420)..(420): n is either a, c, g or t
gatcgttttggggttttaattaagcgttttttattttagtttttttacgttaagagcgttttgtttagtttttttattttagtttcgtttttggacgtcgtcgtttaatttcgggatggtttcgtttttttcgtgagttacgttttcgtttttatgcgttgataggttaggtttgcggttcggcgtcgcgtagggaagattcggagtagcggtttatttaaggaacgggtcgcgcggttttgttgcgtatgttttgaagtagcgcgtttgagcgtttcgtaaggtcggttttttcggcggggtcgcgcgcgcggttacggggttcgttttcgaggggtaggtcggggttgggagttggtgttcgggtcggggtggcggcggcggtttgggtcgcggggtcgacgttcgtttttgtagcgntagaggttgaaggatttatcgcggcgttgtcgcgggagagggagggtttcgttgtcgtcggtgaggataggtttttgcgggcggggaatgtttcgcgttttcggcgtggacgcgttcgtagttcggttttttcgggggtttcgagggttgcgggtgttggggaggggtttgcgtttcggcgtttaggtcgttttttgtggggtttttcgcgattttttttttgtttttcgtttttttatttttattttttcgttttttggtttaagttcgatatttttatattaaggattttcgtattcgttcgtcgttttttggcggtgtttgtttcgtttagcgttgtttttttggattcgtagtattagtttcgttttacggttgtagttcgggcggttttagtgattttgtatttttgcgggtcgggacgtatttcgttttcgtttttgattttatagattttcggtgacgg

SEQ ID NO: 972 - DNA, 886 bp, Artificial Sequence
  chemically treated genomic DNA (Homo sapiens) CpG-island No: 972
  misc_feature (467)..(467): n is either a, c, g or t
ccgtcaccgaaaatctataaaatcaaaaacgaaaacgaaatacgtcccgacccgcaaaaatacaaaatcactaaaaccgcccgaactacaaccgtaaaacgaaactaatactacgaatccaaaaaaacaacgctaaacgaaacaaacaccgccaaaaaacgacgaacgaatacgaaaatccttaatataaaaatatcgaacttaaaccaaaaaacgaaaaaataaaaataaaaaaacgaaaaacaaaaaaaaaatcgcgaaaaaccccacaaaaaacgacctaaacgccgaaacgcaaacccctccccaacacccgcaaccctcgaaacccccgaaaaaaccgaactacgaacgcgtccacgccgaaaacgcgaaacattccccgcccgcaaaaacctatcctcaccgacgacaacgaaaccctccctctcccgcgacaacgccgcgataaatccttcaacctctancgctacaaaaacgaacgtcgaccccgcgacccaaaccgccgccgccaccccgacccgaacaccaactcccaaccccgacctacccctcgaaaacgaaccccgtaaccgcgcgcgcgaccccgccgaaaaaaccgaccttacgaaacgctcaaacgcgctacttcaaaacatacgcaacaaaaccgcgcgacccgttccttaaataaaccgctactccgaatcttccctacgcgacgccgaaccgcaaacctaacctatcaacgcataaaaacgaaaacgtaactcacgaaaaaaacgaaaccatcccgaaattaaacgacgacgtccaaaaacgaaactaaaataaaaaaactaaacaaaacgctcttaacgtaaaaaaactaaaataaaaaacgcttaattaaaaccccaaaacgatc

SEQ ID NO: 973 - DNA, 683 bp, Artificial Sequence
  chemically treated genomic DNA (Homo sapiens) CpG-island No: 973
acgcgggagggcggggttagggagggcgatgcggggagtcggagttcggattatgaggttgggagcgttttttttgtatttttggtcgttcgcgtcgcgtttcgcgtttattagagggtagtattacgacgcgcgcggataaggttgaggcgggaacggtcgtatttttagtttcgttcggagtcgttcggtttcgtttcgttcgcgagtatcgattttcggcgtcggcggggaaataggttcggcgttttcgattttacggttcggttttattttgtttttgacgttagcgtcgtgttttaaataatttttttttcgagtttttttcgtcgcggcgtcgcgtttagagttaggcggggatatcgaaacggtaatttcggttcggttttttcggagtcgttttcgtttcgtttggtgttaggaagttttcgttttttttaagggatggtagtcggggttcgggtcggtcgtttgggtcgcgttggcgcgcgtttgaggaatttttggggtttgttgtttcgggaggagggtcgttgcggttaatttcggatttcgttttatgttttatcgttttttttgttttcggtttcgtaaatatttttggttttgatttttttattagcgcggtttagttttattgtgttttatcggcgtttaataaaatattgaatgaggtcgggcgt

SEQ ID NO: 974 - DNA, 683 bp, Artificial Sequence
  chemically treated genomic DNA (Homo sapiens) CpG-island No: 974
acgcccgacctcattcaatattttattaaacgccgataaaacacaataaaactaaaccgcgctaataaaaaaatcaaaaccaaaaatatttacgaaaccgaaaacaaaaaaaacgataaaacataaaacgaaatccgaaattaaccgcaacgaccctcctcccgaaacaacaaaccccaaaaattcctcaaacgcgcgccaacgcgacccaaacgaccgacccgaaccccgactaccatcccttaaaaaaaacgaaaacttcctaacaccaaacgaaacgaaaacgactccgaaaaaaccgaaccgaaattaccgtttcgatatccccgcctaactctaaacgcgacgccgcgacgaaaaaaactcgaaaaaaaaattatttaaaacacgacgctaacgtcaaaaacaaaataaaaccgaaccgtaaaatcgaaaacgccgaacctatttccccgccgacgccgaaaatcgatactcgcgaacgaaacgaaaccgaacgactccgaacgaaactaaaaatacgaccgttcccgcctcaaccttatccgcgcgcgtcgtaatactaccctctaataaacgcgaaacgcgacgcgaacgaccaaaaatacaaaaaaaacgctcccaacctcataatccgaactccgactccccgcatcgccctccctaaccccgccctcccgcgt

SEQ ID NO: 975 - DNA, 683 bp, Artificial Sequence
  chemically treated genomic DNA (Homo sapiens) CpG-island No: 975
gcgttcggttttatttagtattttattgagcgtcgatggaatatagtggggttgggtcgcgttggtgggaaagttaaggttaggggtgtttgcggggtcgagggtaggggaggcgatgggatatggggcggggttcggagttggtcgtagcgatttttttttcgggatagtaggttttagaagttttttaggcgcgcgttagcgcggtttaggcggtcgattcgggtttcggttgttattttttggaaggggcgggggttttttggtattaggcggggcggaagcggtttcgggaaggtcgggtcggggttatcgtttcggtgttttcgtttggttttgggcgcggcgtcgcggcggaagaggttcggggaggaagttatttggggtacggcgttgacgttagagatagagtggggtcggatcgtggggtcgggggcgtcggatttgttttttcgtcggcgtcgggggtcggtattcgcgggcggggcggggtcgggcggtttcgggcggggttgggggtgcggtcgttttcgttttagttttgttcgcgcgcgtcgtggtgttgttttttggtgggcgcggggcgcggcgcgggcggttaggggtgtagaaggggcgtttttagttttatggttcgggtttcggtttttcgtatcgttttttttagtttcgttttttcgcgt

SEQ ID NO: 976 - DNA, 683 bp, Artificial Sequence
  chemically treated genomic DNA (Homo sapiens) CpG-island No: 976
acgcgaaaaaacgaaactaaaaaaaacgatacgaaaaaccgaaacccgaaccataaaactaaaaacgccccttctacacccctaaccgcccgcgccgcgccccgcgcccaccaaaaaacaacaccacgacgcgcgcgaacaaaactaaaacgaaaacgaccgcacccccaaccccgcccgaaaccgcccgaccccgccccgcccgcgaataccgacccccgacgccgacgaaaaaacaaatccgacgcccccgaccccacgatccgaccccactctatctctaacgtcaacgccgtaccccaaataacttcctccccgaacctcttccgccgcgacgccgcgcccaaaaccaaacgaaaacaccgaaacgataaccccgacccgaccttcccgaaaccgcttccgccccgcctaataccaaaaaacccccgccccttccaaaaaataacaaccgaaacccgaatcgaccgcctaaaccgcgctaacgcgcgcctaaaaaacttctaaaacctactatcccgaaaaaaaaatcgctacgaccaactccgaaccccgccccatatcccatcgcctcccctaccctcgaccccgcaaacacccctaaccttaactttcccaccaacgcgacccaaccccactatattccatcgacgctcaataaaatactaaataaaaccgaacgc

SEQ ID NO: 977 - DNA, 881 bp, Artificial Sequence
  chemically treated genomic DNA (Homo sapiens) CpG-island No: 977
cggaggcgttggggagggggggcgttttttttacgaacggtggttcggatcgtacgttgcgttaagttagggcgagatttttattttgcgtcgcgtttttttgtttcgtaattatttacggttttagtcgggaggcgtcgtagtttcggaatttattttcgcgtttttggaaggatggatgcggaggaggcgggagagaggcggcggtttcggaacgagttgtttttatagttttttcgtttttcgtcgtttcgttttcgtttttagtttatttagttttgcgcgttattgtttagtttgatttttttgtataggttttcggggatttttatgatcgcggagcgcgttgagtagtcggggttttttgcgtcgggagggtagtaagaggagggtaggttagcgagcggggcggggttggagggcggggttttttcgcgtcggagcgggcgcgcgttgatttaagtacgcgttcgtgttcgtggtttgggttgcgcggcgtatgcggcgcgtttcggaaatgggttcggggtagaggtttgtggggaagggcgaaacgtcgggatagaatcggaggtagaagttgggggcggagttttagcgttcgcgtcggcgcgggcgcgtacggcgtttttttttttagatttcgatgaaggggcggggtttggaatgtagtcgtggaattttaggtgtttttgcggtatcgagtttagttttgagttaacgtagatttttaagagcgagtattagtcgtcgggagaaaggtaaggggagtgcgcggttcgtcgcgcgcggtatttttttagtagaggttgattgggaggacgttgacgcggttttttgtatttgtggttatttttttatagatttggttgtcgattttt

SEQ ID NO: 978 - DNA, 881 bp, Artificial Sequence
  chemically treated genomic DNA (Homo sapiens) CpG-island No: 978
aaaaatcgacaaccaaatctataaaaaaataaccacaaatacaaaaaaccgcgtcaacgtcctcccaatcaacctctactaaaaaaataccgcgcgcgacgaaccgcgcactccccttacctttctcccgacgactaatactcgctcttaaaaatctacgttaactcaaaactaaactcgataccgcaaaaacacctaaaattccacgactacattccaaaccccgccccttcatcgaaatctaaaaaaaaaaacgccgtacgcgcccgcgccgacgcgaacgctaaaactccgcccccaacttctacctccgattctatcccgacgtttcgcccttccccacaaacctctaccccgaacccatttccgaaacgcgccgcatacgccgcgcaacccaaaccacgaacacgaacgcgtacttaaatcaacgcgcgcccgctccgacgcgaaaaaaccccgccctccaaccccgccccgctcgctaacctaccctcctcttactaccctcccgacgcaaaaaaccccgactactcaacgcgctccgcgatcataaaaatccccgaaaacctatacaaaaaaatcaaactaaacaataacgcgcaaaactaaataaactaaaaacgaaaacgaaacgacgaaaaacgaaaaaactataaaaacaactcgttccgaaaccgccgcctctctcccgcctcctccgcatccatccttccaaaaacgcgaaaataaattccgaaactacgacgcctcccgactaaaaccgtaaataattacgaaacaaaaaaacgcgacgcaaaataaaaatctcgccctaacttaacgcaacgtacgatccgaaccaccgttcgtaaaaaaaacgccccccctccccaacgcctccg

SEQ ID NO: 979 - DNA, 881 bp, Artificial Sequence
  chemically treated genomic DNA (Homo sapiens) CpG-island No: 979
ggaggtcggtagttaggtttgtggaggagtagttataggtgtaagaggtcgcgttagcgtttttttaattagtttttgttgagggagtgtcgcgcgcggcgagtcgcgtattttttttgtttttttttcggcggttggtattcgtttttagagatttgcgttagtttagagttaggttcggtgtcgtagaggtatttgaggttttacgattgtattttaggtttcgtttttttatcgggatttggaaggaggagcgtcgtgcgcgttcgcgtcggcgcgagcgttgaagtttcgtttttagtttttattttcggttttatttcggcgtttcgtttttttttatagatttttgtttcggatttattttcgaggcgcgtcgtatgcgtcgcgtaatttaggttacgagtacgggcgcgtgtttaagttagcgcgcgttcgtttcgacgcgaggaggtttcgttttttagtttcgtttcgttcgttggtttgttttttttttgttattttttcggcgtagagaatttcggttgtttagcgcgtttcgcggttatggagattttcgggagtttgtgtaagaaagttaaattgagtaataacgcgtagaattgggtaagttggggacgaaggcgagacggcgaggagcggaggggttgtgggagtagttcgtttcggagtcgtcgtttttttttcgtttttttcgtatttatttttttaggagcgcggaggtgggtttcggggttgcggcgtttttcggttggggtcgtgggtggttgcgaggtagaggggcgcggcgtagggtggggatttcgttttagtttggcgtagcgtgcggttcgagttatcgttcgtgggaagaacgttttttttttttagcgttttcg

SEQ ID NO: 980 - DNA, 881 bp, Artificial Sequence
  chemically treated genomic DNA (Homo sapiens) CpG-island No: 980
cgaaaacgctaaaaaaaaaaaacgttcttcccacgaacgataactcgaaccgcacgctacgccaaactaaaacgaaatccccaccctacgccgcgcccctctacctcgcaaccacccacgaccccaaccgaaaaacgccgcaaccccgaaacccacctccgcgctcctaaaaaaataaatacgaaaaaaacgaaaaaaaaacgacgactccgaaacgaactactcccacaacccctccgctcctcgccgtctcgccttcgtccccaacttacccaattctacgcgttattactcaatttaactttcttacacaaactcccgaaaatctccataaccgcgaaacgcgctaaacaaccgaaattctctacgccgaaaaaataacaaaaaaaaaacaaaccaacgaacgaaacgaaactaaaaaacgaaacctcctcgcgtcgaaacgaacgcgcgctaacttaaacacgcgcccgtactcgtaacctaaattacgcgacgcatacgacgcgcctcgaaaataaatccgaaacaaaaatctataaaaaaaaacgaaacgccgaaataaaaccgaaaataaaaactaaaaacgaaacttcaacgctcgcgccgacgcgaacgcgcacgacgctcctccttccaaatcccgataaaaaaacgaaacctaaaatacaatcgtaaaacctcaaatacctctacgacaccgaacctaactctaaactaacgcaaatctctaaaaacgaataccaaccgccgaaaaaaaaacaaaaaaaatacgcgactcgccgcgcgcgacactccctcaacaaaaactaattaaaaaaacgctaacgcgacctcttacacctataactactcctccacaaacctaactaccgacctcc

SEQ ID NO: 981 - DNA, 564 bp, Artificial Sequence
  chemically treated genomic DNA (Homo sapiens) CpG-island No: 981
tttgttttcggaaggggggcgcgtagtagcgggagcggtaggtcggacgtcgggcgtcgggagggggtcgggggagggacgtcgtgttcggagcgcgcgcgtatttatatatttatatatatatttacgcgagtatcgcgaagggtatttaaggatcgcgtacgcggggttgcggagatttttcgggtagtcgcgatttcggtttcgcgagtagtattggttttttgggtttatttcgttttttttttttttttttattttagtcgtttttttcgcgttgcgttgtagcgtgtttttatagtttttttgttttgaattgaatgtaggtgggaaataggtcggcgtgtcgaaagatatcgagtaggtagaaataaggtaaatttatagaggcgtaataggttcggtttttcgtggttagggcgagtcgcggtttcgcgtggcgtttcggtcgttgttttcggattttgagcggttattgttggggttttcgaaagaggtgtcggttttttgggagtcggaagagttgtttgggtgggtttcgttttgttttttattttatcgtta

SEQ ID NO: 982 - DNA, 564 bp, Artificial Sequence
  chemically treated genomic DNA (Homo sapiens) CpG-island No: 982
taacgataaaataaaaaacaaaacgaaacccacccaaacaactcttccgactcccaaaaaaccgacacctctttcgaaaaccccaacaataaccgctcaaaatccgaaaacaacgaccgaaacgccacgcgaaaccgcgactcgccctaaccacgaaaaaccgaacctattacgcctctataaatttaccttatttctacctactcgatatctttcgacacgccgacctatttcccacctacattcaattcaaaacaaaaaaactataaaaacacgctacaacgcaacgcgaaaaaaacgactaaaataaaaaaaaaaaaaaaaaacgaaataaacccaaaaaaccaatactactcgcgaaaccgaaatcgcgactacccgaaaaatctccgcaaccccgcgtacgcgatccttaaatacccttcgcgatactcgcgtaaatatatatataaatatataaatacgcgcgcgctccgaacacgacgtccctcccccgaccccctcccgacgcccgacgtccgacctaccgctcccgctactacgcgccccccttccgaaaacaaa

SEQ ID NO: 983 - DNA, 564 bp, Artificial Sequence
  chemically treated genomic DNA (Homo sapiens) CpG-island No: 983
tggcggtggggtaaaaagtaagacgaaatttatttagatagttttttcgatttttagaggatcgatatttttttcgagggttttaatagtggtcgtttagggttcgagggtaacggtcgaggcgttacgcggggtcgcggttcgttttggttacggaggatcggatttgttgcgtttttgtgagtttgttttatttttatttattcggtgtttttcggtacgtcgatttgttttttatttgtatttagtttaaggtaaaaaggttgtgagagtacgttatagcgtagcgcgaaaggggcgattaaggtggagaagagagaggaaaacgaaataaatttaaggaattaatgttattcgcgaagtcgaagtcgcggttgttcgaaggattttcgtagtttcgcgtgcgcgatttttaaatatttttcgcgatgttcgcgtgagtgtgtgtgtgagtgtgtgagtgcgcgcgcgtttcgagtacgacgtttttttttcgattttttttcggcgttcggcgttcggtttgtcgttttcgttgttgcgcgtttttttttcgaaggtaaa

SEQ ID NO: 984 - DNA, 564 bp, Artificial Sequence
  chemically treated genomic DNA (Homo sapiens) CpG-island No: 984
tttaccttcgaaaaaaaaacgcgcaacaacgaaaacgacaaaccgaacgccgaacgccgaaaaaaaatcgaaaaaaaaacgtcgtactcgaaacgcgcgcgcactcacacactcacacacacactcacgcgaacatcgcgaaaaatatttaaaaatcgcgcacgcgaaactacgaaaatccttcgaacaaccgcgacttcgacttcgcgaataacattaattccttaaatttatttcgttttcctctctcttctccaccttaatcgcccctttcgcgctacgctataacgtactctcacaacctttttaccttaaactaaatacaaataaaaaacaaatcgacgtaccgaaaaacaccgaataaataaaaataaaacaaactcacaaaaacgcaacaaatccgatcctccgtaaccaaaacgaaccgcgaccccgcgtaacgcctcgaccgttaccctcgaaccctaaacgaccactattaaaaccctcgaaaaaaatatcgatcctctaaaaatcgaaaaaactatctaaataaatttcgtcttactttttaccccaccgcca

SEQ ID NO: 985 - DNA, 556 bp, Artificial Sequence
  chemically treated genomic DNA (Homo sapiens) CpG-island No: 985
cgttttttcgttggtagttttcgtgattcggtgcgcgttttcgcgggaagtaaggtggtttggatcgcgcggttatcgttgagggttttaaaaagagagaagggagatcgcgcggggcgttttaagtgttttttattttattttttatttaggttttttcggtgcgtcgttcggcgaattttcgggagttatttattaaagaagaggcggtaattttgcgagtagggttggtcgcgttttttagtgtggtatagggttatagtacggcgcgattcggtttttgtattggtttttaatcgtaggtacgtagcggttggggtattcgtgcgtagtagtcgtagtagcgcgtttatggcgttaatgacggttttgttgtgcgcgcggagttatttgggggttcggtcgggtcgtacgtcggtgttttttatcgttcggagttatttttttcgtttcggcgttcgggttgcgattttggtttttgttagtggaatttggaatattagttagttgtgcgtattatgtttttagcgaggtcgtagtttaaagacgagtgaga

SEQ ID NO: 986 - DNA, 556 bp, Artificial Sequence
  chemically treated genomic DNA (Homo sapiens) CpG-island No: 986
tctcactcgtctttaaactacgacctcgctaaaaacataatacgcacaactaactaatattccaaattccactaacaaaaaccaaaatcgcaacccgaacgccgaaacgaaaaaaataactccgaacgataaaaaacaccgacgtacgacccgaccgaacccccaaataactccgcgcgcacaacaaaaccgtcattaacgccataaacgcgctactacgactactacgcacgaataccccaaccgctacgtacctacgattaaaaaccaatacaaaaaccgaatcgcgccgtactataaccctataccacactaaaaaacgcgaccaaccctactcgcaaaattaccgcctcttctttaataaataactcccgaaaattcgccgaacgacgcaccgaaaaaacctaaataaaaaataaaataaaaaacacttaaaacgccccgcgcgatctcccttctctctttttaaaaccctcaacgataaccgcgcgatccaaaccaccttacttcccgcgaaaacgcgcaccgaatcacgaaaactaccaacgaaaaaacg

SEQ ID NO: 987 - DNA, 556 bp, Artificial Sequence
  chemically treated genomic DNA (Homo sapiens) CpG-island No: 987
ttttattcgtttttgagttgcggtttcgttgagggtatagtgcgtataattggttggtgttttagattttattggtagggattaggatcgtagttcgagcgtcggggcgggagggatgatttcggacggtagggggtatcggcgtgcggttcggtcgagtttttaggtagtttcgcgcgtatagtaggatcgttattgacgttatgagcgcgttgttgcggttgttgcgtacgggtgttttagtcgttgcgtgtttgcggttggggattagtgtagggatcgggtcgcgtcgtgttatggttttgtattatattgaggagcgcggttagttttgttcgtagaattatcgttttttttttagtaagtagttttcggaggttcgtcgagcggcgtatcggagaaatttgggtgggggatggaatgggggatatttgggacgtttcgcgcggttttttttttttttttttggggtttttagcggtagtcgcgcggtttaggttattttatttttcgcgggagcgcgtatcgagttacgagaattgttagcgaggaggcg

SEQ ID NO: 988 - DNA, 556 bp, Artificial Sequence
  chemically treated genomic DNA (Homo sapiens) CpG-island No: 988
cgcctcctcgctaacaattctcgtaactcgatacgcgctcccgcgaaaaataaaataacctaaaccgcgcgactaccgctaaaaaccccaaaaaaaaaaaaaaaaaaccgcgcgaaacgtcccaaatatcccccattccatcccccacccaaatttctccgatacgccgctcgacgaacctccgaaaactacttactaaaaaaaaaacgataattctacgaacaaaactaaccgcgctcctcaatataatacaaaaccataacacgacgcgacccgatccctacactaatccccaaccgcaaacacgcaacgactaaaacacccgtacgcaacaaccgcaacaacgcgctcataacgtcaataacgatcctactatacgcgcgaaactacctaaaaactcgaccgaaccgcacgccgataccccctaccgtccgaaatcatccctcccgccccgacgctcgaactacgatcctaatccctaccaataaaatctaaaacaccaaccaattatacgcactataccctcaacgaaaccgcaactcaaaaacgaataaaa

SEQ ID NO: 989 - DNA, 530 bp, Artificial Sequence
  chemically treated genomic DNA (Homo sapiens) CpG-island No: 989
ttttcgtgatttacgtcggtcgttcggttattatttgtcgggatcgttcggcgcgcggagttcggtagttagtaaaacgtagttgattgttcggtcgttcggtttttgttttcgttaaagttgtttaacgtaaattttgtattagtttatttcgaatttttatagttcggtattcgtttttatttggggcggaggcggtagcggttacgggcgcgttgggcgttaggtgttaggggtcggtagtagtcgcgtgcgttacggttagaggtttttttggagtattttttcgttttaggcgcgcggttttcgtaggcgttagcggcgtatttttttttagtcgggtttttcgttagcgtttggtggtttcgagttgtgggcgttttcgtttcgtttgttcgtttagcgcgtcgcggttttagtttgggcgggtttacgggagggtgtgtttttgtttttatttgtcggttttttacgtattcgggcgtagggttgttttttttttttcgattaaaaaaaaaaaaaaaaaagag

SEQ ID NO: 990 - DNA, 530 bp, Artificial Sequence
  chemically treated genomic DNA (Homo sapiens) CpG-island No: 990
ctcttttttttttttttttttaatcgaaaaaaaaaaaacaaccctacgcccgaatacgtaaaaaaccgacaaataaaaacaaaaacacaccctcccgtaaacccgcccaaactaaaaccgcgacgcgctaaacgaacaaacgaaacgaaaacgcccacaactcgaaaccaccaaacgctaacgaaaaacccgactaaaaaaaaatacgccgctaacgcctacgaaaaccgcgcgcctaaaacgaaaaaatactccaaaaaaacctctaaccgtaacgcacgcgactactaccgacccctaacacctaacgcccaacgcgcccgtaaccgctaccgcctccgccccaaataaaaacgaataccgaactataaaaattcgaaataaactaatacaaaatttacgttaaacaactttaacgaaaacaaaaaccgaacgaccgaacaatcaactacgttttactaactaccgaactccgcgcgccgaacgatcccgacaaataataaccgaacgaccgacgtaaatcacgaaaa

SEQ ID NO: 991 - DNA, 530 bp, Artificial Sequence
  chemically treated genomic DNA (Homo sapiens) CpG-island No: 991
tttttttttttttttttttttggtcggaggaaagaaaatagttttgcgttcggatgcgtagagagtcgataagtggaaatagggatatattttttcgtgagttcgtttaagttggagtcgcggcgcgttgagcgagtaggcggggcgggagcgtttatagttcggagttattaggcgttgacgaggagttcggttgagggaggatgcgtcgttgacgtttgcgggagtcgcgcgtttggggcgggaggatgttttagaggggtttttggtcgtggcgtacgcggttgttgtcgatttttggtatttggcgtttagcgcgttcgtggtcgttgtcgttttcgttttaggtaagagcgggtgtcgggttgtgggggttcggggtaggttggtgtaaagtttgcgttggataattttggcgggagtaaaagtcgagcggtcgagtagttaattgcgttttgttggttgtcgggtttcgcgcgtcgggcggtttcgataggtggtggtcgggcggtcgacgtgggttacggagg

SEQ ID NO: 992 - DNA, 530 bp, Artificial Sequence
  chemically treated genomic DNA (Homo sapiens) CpG-island No: 992
cctccgtaacccacgtcgaccgcccgaccaccacctatcgaaaccgcccgacgcgcgaaacccgacaaccaacaaaacgcaattaactactcgaccgctcgacttttactcccgccaaaattatccaacgcaaactttacaccaacctaccccgaacccccacaacccgacacccgctcttacctaaaacgaaaacgacaacgaccacgaacgcgctaaacgccaaataccaaaaatcgacaacaaccgcgtacgccacgaccaaaaacccctctaaaacatcctcccgccccaaacgcgcgactcccgcaaacgtcaacgacgcatcctccctcaaccgaactcctcgtcaacgcctaataactccgaactataaacgctcccgccccgcctactcgctcaacgcgccgcgactccaacttaaacgaactcacgaaaaaatatatccctatttccacttatcgactctctacgcatccgaacgcaaaactattttctttcctccgaccaaaaaaaaaaaaaaaaaaaaa

SEQ ID NO: 993 - DNA, 577 bp, Artificial Sequence
  chemically treated genomic DNA (Homo sapiens) CpG-island No: 993
gcggggtcggcgtttcggggcggtcgcgtcgagggggcggacgtgatttgtatgcgagcgggattcgggcgcgcggcgttcgcgaggaggcggcggcggtcgtttaagttttcgtcgttgttattgtcgttatcgtcggtttttttttttcgttcgggtttttttttgtttcgtttcggttttttttcgtttcgtttcggtttgcgtcgtcgttttggggtttttagtttcggtttttagggaattagtttttcgtatcgggcgtttagtataaaggtcggcggtatttggggtcgtatagcggggcgcgtagtggagatttgggttgtttttacgtcgtgtagtggcgcggggggagtggtgcgttcggattagcgcggagtaggggttagggttggcgagcgcggggaagggtgtagttttcgggaatttcggggatttcggcgggtttttatttttgggagaagaagtagagtaagcgcgaaggttgggggcgaggtgggaggttgggatggtacgggtgtttggataaagacgtgatatttaagatttttttttgaaattttttgttggtttg

SEQ ID NO: 994 - DNA, 577 bp, Artificial Sequence
  chemically treated genomic DNA (Homo sapiens) CpG-island No: 994
caaaccaacaaaaaatttcaaaaaaaaatcttaaatatcacgtctttatccaaacacccgtaccatcccaacctcccacctcgcccccaaccttcgcgcttactctacttcttctcccaaaaataaaaacccgccgaaatccccgaaattcccgaaaactacacccttccccgcgctcgccaaccctaacccctactccgcgctaatccgaacgcaccactccccccgcgccactacacgacgtaaaaacaacccaaatctccactacgcgccccgctatacgaccccaaataccgccgacctttatactaaacgcccgatacgaaaaactaattccctaaaaaccgaaactaaaaaccccaaaacgacgacgcaaaccgaaacgaaacgaaaaaaaaccgaaacgaaacaaaaaaaaacccgaacgaaaaaaaaaaaccgacgataacgacaataacaacgacgaaaacttaaacgaccgccgccgcctcctcgcgaacgccgcgcgcccgaatcccgctcgcatacaaatcacgtccgccccctcgacgcgaccgccccgaaacgccgaccccgc

SEQ ID NO: 995 - DNA, 577 bp, Artificial Sequence
  chemically treated genomic DNA (Homo sapiens) CpG-island No: 995
tagattagtaaaaagttttaaagggaaattttagatgttacgtttttgtttaggtattcgtgttattttaattttttatttcgtttttaattttcgcgtttgttttgtttttttttttaggggtggagattcgtcgaggttttcggggttttcgagggttgtattttttttcgcgttcgttagttttggtttttatttcgcgttggttcgggcgtattatttttttcgcgttattgtacggcgtgagggtagtttaggtttttattgcgcgtttcgttgtacggttttaggtgtcgtcggtttttgtgttggacgttcggtgcggggggttaattttttgggagtcggggttgagggttttagggcggcggcgtaggtcggggcggagcgggaggaggtcggggcggagtaggaggaggttcgggcggaggaggagagtcggcggtagcggtagtggtagcggcgagagtttgggcggtcgtcgtcgttttttcgcgagcgtcgcgcgttcgggtttcgttcgtatgtaagttacgttcgttttttcggcgcggtcgtttcgagacgtcggtttcgt

SEQ ID NO: 996 - DNA, 577 bp, Artificial Sequence
  chemically treated genomic DNA (Homo sapiens) CpG-island No: 996
acgaaaccgacgtctcgaaacgaccgcgccgaaaaaacgaacgtaacttacatacgaacgaaacccgaacgcgcgacgctcgcgaaaaaacgacgacgaccgcccaaactctcgccgctaccactaccgctaccgccgactctcctcctccgcccgaacctcctcctactccgccccgacctcctcccgctccgccccgacctacgccgccgccctaaaaccctcaaccccgactcccaaaaaattaaccccccgcaccgaacgtccaacacaaaaaccgacgacacctaaaaccgtacaacgaaacgcgcaataaaaacctaaactaccctcacgccgtacaataacgcgaaaaaaataatacgcccgaaccaacgcgaaataaaaaccaaaactaacgaacgcgaaaaaaaatacaaccctcgaaaaccccgaaaacctcgacgaatctccacccctaaaaaaaaaaacaaaacaaacgcgaaaattaaaaacgaaataaaaaattaaaataacacgaatacctaaacaaaaacgtaacatctaaaatttccctttaaaactttttactaatcta

SEQ ID NO: 997 - DNA, 643 bp, Artificial Sequence
  chemically treated genomic DNA (Homo sapiens) CpG-island No: 997
taagcggcgttacgtatcggcgttgatatggattttttttatttaggggtatattacgggttttttgttttttaggtttagcgggtttttgtcggttaagagtagcgggtacgcgggggcgttgttttttgtcgggacgtttggggtggcgggggtcgtttcgtagcgtcgcggggtcgttgggggtacggcgcgaggttgtaggggcggcggtagttggggttgtaggacgtggttcgtatgtaggtcgtgcgttgggtttttggtttgcgtcgggggttgttcgggttggggcggtcgttcggggttggcgtcgtcgcggtagttataggggtaggcggtgttcgcggttttatgcgcggggtatagcgcggtagtagggtaggcgggttcgcgggcggttcgcggcgcgtagtaggaggtagtgggttttcggtcgtcgttcgcgtgagggagttggggttgttgtagcggtaggtgttgggtcgggggcgttgggggttgttggtagtcggggttttcgttcgggtcgtcgtttgcgtcgttcgagtcgttgtgttgcgcgtatttttcgaagggagggaatttgggttcgatgtagttggagtttattaaaaacgagtttatggttattaatttgtga

SEQ ID NO: 998 - DNA, 643 bp, Artificial Sequence
  chemically treated genomic DNA (Homo sapiens) CpG-island No: 998
tcacaaattaataaccataaactcgtttttaataaactccaactacatcgaacccaaattccctcccttcgaaaaatacgcgcaacacaacgactcgaacgacgcaaacgacgacccgaacgaaaaccccgactaccaacaacccccaacgcccccgacccaacacctaccgctacaacaaccccaactccctcacgcgaacgacgaccgaaaacccactacctcctactacgcgccgcgaaccgcccgcgaacccgcctaccctactaccgcgctataccccgcgcataaaaccgcgaacaccgcctacccctataactaccgcgacgacgccaaccccgaacgaccgccccaacccgaacaacccccgacgcaaaccaaaaacccaacgcacgacctacatacgaaccacgtcctacaaccccaactaccgccgcccctacaacctcgcgccgtacccccaacgaccccgcgacgctacgaaacgacccccgccaccccaaacgtcccgacaaaaaacaacgcccccgcgtacccgctactcttaaccgacaaaaacccgctaaacctaaaaaacaaaaaacccgtaatatacccctaaataaaaaaaatccatatcaacgccgatacgtaacgccgctta

SEQ ID NO: 999 - DNA, 643 bp, Artificial Sequence
  chemically treated genomic DNA (Homo sapiens) CpG-island No: 999
ttataaattaatgattatgagttcgtttttgataaattttaattatatcgagtttaagtttttttttttcgaggagtacgcgtagtatagcggttcgggcggcgtagacggcggttcgggcgggggtttcggttattagtagtttttagcgttttcgatttagtatttgtcgttgtagtagttttagtttttttacgcgggcggcggtcgagagtttattgttttttattacgcgtcgcggatcgttcgcgagttcgtttattttgttgtcgcgttgtatttcgcgtatggggtcgcggatatcgtttatttttatggttatcgcggcggcgttagtttcgggcggtcgttttagttcgagtagttttcggcgtaagttaagggtttagcgtacggtttgtatgcgagttacgttttgtagttttagttgtcgtcgtttttgtagtttcgcgtcgtgtttttagcggtttcgcggcgttgcgaggcggttttcgttattttaggcgtttcggtagggggtagcgttttcgcgtgttcgttgtttttggtcgataagagttcgttgggtttgaagggtaaggagttcgtggtgtatttttggatgaagaagatttatgttagcgtcggtacgtggcgtcgtttg

SEQ ID NO: 1000 - DNA, 643 bp, Artificial Sequence
  chemically treated genomic DNA (Homo sapiens) CpG-island No: 1000
caaacgacgccacgtaccgacgctaacataaatcttcttcatccaaaaatacaccacgaactccttacccttcaaacccaacgaactcttatcgaccaaaaacaacgaacacgcgaaaacgctaccccctaccgaaacgcctaaaataacgaaaaccgcctcgcaacgccgcgaaaccgctaaaaacacgacgcgaaactacaaaaacgacgacaactaaaactacaaaacgtaactcgcatacaaaccgtacgctaaacccttaacttacgccgaaaactactcgaactaaaacgaccgcccgaaactaacgccgccgcgataaccataaaaataaacgatatccgcgaccccatacgcgaaatacaacgcgacaacaaaataaacgaactcgcgaacgatccgcgacgcgtaataaaaaacaataaactctcgaccgccgcccgcgtaaaaaaactaaaactactacaacgacaaatactaaatcgaaaacgctaaaaactactaataaccgaaacccccgcccgaaccgccgtctacgccgcccgaaccgctatactacgcgtactcctcgaaaaaaaaaaacttaaactcgatataattaaaatttatcaaaaacgaactcataatcattaatttataa

SEQ ID NO: 1001 - DNA, 589 bp, Artificial Sequence
  chemically treated genomic DNA (Homo sapiens) CpG-island No: 1001
agagtcgcgttttcgcggtcgcgtggatttagaaaaaggttggttttattatgatttatgtgtagtttgcgtatttaggggtagatttggggttgggcgggcggcgtcgggttcggttcgttttgcgtattcgtttgttcgttgttggtaggggcgtttttttcggtttcggacgtcgtgttaattttttttttgttgttgatgtgggtgttgtcggcgtcggtcgaggcgtcgttggagttgtttagggagtttttttcgtcgtggtggttgtcgttgtcgggcgagggggttacggcggagtagggtagcggatcgggttgaggagagtgcgtggacgtggtcggttggttgtatttgggttcggcgggcgtcgcgttggcgttggtagcgtagttgcgggcgcgtttttcggagttaaagtggtcggagttcgagcggtcgacgttgagatttatgttattgtagtcgtagtcgtatttgtcggagtgtatgttcgtcgagtttttgaattgttcgtttacggaattatgatttttataattatgtaattggtagttcgggttatttggatagcgatcgtaaaatg

SEQ ID NO: 1002 - DNA, 589 bp, Artificial Sequence
  chemically treated genomic DNA (Homo sapiens) CpG-island No: 1002
cattttacgatcgctatccaaataacccgaactaccaattacataattataaaaatcataattccgtaaacgaacaattcaaaaactcgacgaacatacactccgacaaatacgactacgactacaataacataaatctcaacgtcgaccgctcgaactccgaccactttaactccgaaaaacgcgcccgcaactacgctaccaacgccaacgcgacgcccgccgaacccaaatacaaccaaccgaccacgtccacgcactctcctcaacccgatccgctaccctactccgccgtaaccccctcgcccgacaacgacaaccaccacgacgaaaaaaactccctaaacaactccaacgacgcctcgaccgacgccgacaacacccacatcaacaacaaaaaaaaaattaacacgacgtccgaaaccgaaaaaaacgcccctaccaacaacgaacaaacgaatacgcaaaacgaaccgaacccgacgccgcccgcccaaccccaaatctacccctaaatacgcaaactacacataaatcataataaaaccaacctttttctaaatccacgcgaccgcgaaaacgcgactct

SEQ ID NO: 1003 - DNA, 589 bp, Artificial Sequence
  chemically treated genomic DNA (Homo sapiens) CpG-island No: 1003
tattttgcggtcgttatttaaatggttcggattattagttgtataattatggagattatagtttcgtgagcgagtaatttagggattcggcgagtatgtatttcggtaggtacggttacggttataatggtatggattttagcgtcggtcgttcgggtttcggttattttggtttcggagagcgcgttcgtagttacgttgttagcgttagcgcggcgttcgtcgagtttaggtatagttagtcggttacgtttacgtattttttttagttcgattcgttgttttgtttcgtcgtggttttttcgttcggtagcgatagttattacggcgggaaaaattttttaagtaattttagcggcgtttcggtcgacgtcggtagtatttatattagtagtagagagggggttggtacggcgttcggagtcgaggaggacgtttttgttagtagcgagtaggcgagtgcgtagagcgagtcgagttcggcgtcgttcgtttaattttagatttatttttggatgcgtaagttgtatataagttatggtaaagttagtttttttttaaatttacgcgatcgcggggacgcggtttt

SEQ ID NO: 1004 - DNA, 589 bp, Artificial Sequence
  chemically treated genomic DNA (Homo sapiens) CpG-island No: 1004
aaaaccgcgtccccgcgatcgcgtaaatttaaaaaaaaactaactttaccataacttatatacaacttacgcatccaaaaataaatctaaaattaaacgaacgacgccgaactcgactcgctctacgcactcgcctactcgctactaacaaaaacgtcctcctcgactccgaacgccgtaccaaccccctctctactactaatataaatactaccgacgtcgaccgaaacgccgctaaaattacttaaaaaatttttcccgccgtaataactatcgctaccgaacgaaaaaaccacgacgaaacaaaacaacgaatcgaactaaaaaaaatacgtaaacgtaaccgactaactatacctaaactcgacgaacgccgcgctaacgctaacaacgtaactacgaacgcgctctccgaaaccaaaataaccgaaacccgaacgaccgacgctaaaatccataccattataaccgtaaccgtacctaccgaaatacatactcgccgaatccctaaattactcgctcacgaaactataatctccataattatacaactaataatccgaaccatttaaataacgaccgcaaaata

SEQ ID NO: 1005 - DNA, 592 bp, Artificial Sequence
  chemically treated genomic DNA (Homo sapiens) CpG-island No: 1005
ttcgcgaaggagagcgtatcgggcgtgggttttagttaggagcgtatgtatttgtcgttcggcgtcgtcgtcgttacgggcgtttgggggtgtacgtaggggtggtggtgatggtggtggtatatcgtagcgggtatagcgttggcgttcgtcgcgtgtattgggttttacgaggcgttaaatatcgtcgttttggattggaagttgtacgggttgaagtcggggtgttcggttagcgtcgtcgtttgtcggggaggttggtttagggttttcggcgtatagcggttaacgtttagtttattcgcggcgtcggcgtttagtaggaacgagtttacgtagtagttgtttagggttttagtggtggttattatcgtgtttagcgtttggttcgttcggttcgatttacggaaattatgaaattgtagattttatgtaataatttggtggtatcgggggggaagtatagttatttaataagttgtcggcgttcgcgtttttattggtcgtgcgcgttacgtgttcgtttagtagaataataacgcgtaaattatttcgtacgttattaatggttcgatgttttgtagttataatt

SEQ ID NO: 1006 - DNA, 592 bp, Artificial Sequence
  chemically treated genomic DNA (Homo sapiens) CpG-island No: 1006
aattataactacaaaacatcgaaccattaataacgtacgaaataatttacgcgttattattctactaaacgaacacgtaacgcgcacgaccaataaaaacgcgaacgccgacaacttattaaataactatacttcccccccgataccaccaaattattacataaaatctacaatttcataatttccgtaaatcgaaccgaacgaaccaaacgctaaacacgataataaccaccactaaaaccctaaacaactactacgtaaactcgttcctactaaacgccgacgccgcgaataaactaaacgttaaccgctatacgccgaaaaccctaaaccaacctccccgacaaacgacgacgctaaccgaacaccccgacttcaacccgtacaacttccaatccaaaacgacgatatttaacgcctcgtaaaacccaatacacgcgacgaacgccaacgctatacccgctacgatataccaccaccatcaccaccacccctacgtacacccccaaacgcccgtaacgacgacgacgccgaacgacaaatacatacgctcctaactaaaacccacgcccgatacgctctccttcgcgaa

SEQ ID NO: 1007 - DNA, 592 bp, Artificial Sequence
  chemically treated genomic DNA (Homo sapiens) CpG-island No: 1007
aattatgattgtaaaatatcggattattaatagcgtgcggagtgatttacgcgttattgttttgttggacgggtacgtgacgcgtacggttaatgggggcgcgggcgtcggtaatttattaggtgattgtatttttttttcggtgttattaagttgttatatgaaatttgtagttttataattttcgtgggtcgggtcgggcgggttaggcgttgggtacggtgatggttattattggggttttgggtaattattacgtggattcgtttttgttgggcgtcgacgtcgcggatgagttgagcgttggtcgttatgcgtcggggattttgggttagttttttcggtaggcggcgacgttggtcgagtatttcgattttagttcgtgtagtttttagtttaaggcgacggtgtttggcgtttcgtggaatttagtgtacgcggcgggcgttaacgttgtattcgttgcggtgtattattattattattattatttttacgtgtatttttaggcgttcgtggcggcggcggcgtcggacggtaggtatatgcgtttttggttggagtttacgttcggtgcgttttttttcgcggg

SEQ ID NO: 1008 - DNA, 592 bp, Artificial Sequence
  chemically treated genomic DNA (Homo sapiens) CpG-island No: 1008
cccgcgaaaaaaaacgcaccgaacgtaaactccaaccaaaaacgcatatacctaccgtccgacgccgccgccgccacgaacgcctaaaaatacacgtaaaaataataataataataataatacaccgcaacgaatacaacgttaacgcccgccgcgtacactaaattccacgaaacgccaaacaccgtcgccttaaactaaaaactacacgaactaaaatcgaaatactcgaccaacgtcgccgcctaccgaaaaaactaacccaaaatccccgacgcataacgaccaacgctcaactcatccgcgacgtcgacgcccaacaaaaacgaatccacgtaataattacccaaaaccccaataataaccatcaccgtacccaacgcctaacccgcccgacccgacccacgaaaattataaaactacaaatttcatataacaacttaataacaccgaaaaaaaaatacaatcacctaataaattaccgacgcccgcgcccccattaaccgtacgcgtcacgtacccgtccaacaaaacaataacgcgtaaatcactccgcacgctattaataatccgatattttacaatcataatt

SEQ ID NO: 1009 - DNA, 912 bp, Artificial Sequence
  chemically treated genomic DNA (Homo sapiens) CpG-island No: 1009
gtcgaggacgacgcgtgcgttttttcgtcgttttgcgagttttcgtcgttgtcgtaagttagcgtggggggcggcggcgaatcgagggttcgtttttttcgggtcgtatcggtcgagtcggaggttagcgcgggcgggagatcgaaatcgcgtttcgggggttgcgcggggaacgggttagtttcgagttgttgcgcgtcgtcgtcgtcgttgttatagtttttggcggtgtcgtaggtttgagaaaggcggaagtagttaggtattggtatttcgttggaggtgtttagggcgtagtcgtcgggcggcgggtttcgcgggaagggagttagttcggcggcggtggtcgagattttggggtatttgttcgtcgagtcgtagaggtagtaggagtttttttttttgatgttttgcgcgaaagagtacgaggtggtttgcggcgttggttggggtggttgcggcgggggcggcggttgttgttggggcggcggcggcggttcgttaggcggttttattcggtaagatcggggcgcgtttagttataggtttatgggcgagggttcgtagtcgtgcgtttcgggatttagattttcgttatcgttatcgttgttcggcgacgttgttttattgcgtttgtcgtttagcgtggggaagagttcgtagttttgtagttcgtagggtaggtcggcggcgggcggtaggtagatttcgtcgtgggcgtagtaatcgttatcgtcgtcgtttttcgcgttattattatcgtcgtttgtttcgtttttgttcgagttgatgagcgagtcgattaaaaaagagttcgcggcgggtttttcgagtatgatattgttgtgggataatttggcgaagggagtagatagttttttttggttgatattttttgtgtaaaatatgttg

SEQ ID NO: 1010 - DNA, 912 bp, Artificial Sequence
  chemically treated genomic DNA (Homo sapiens) CpG-island No: 1010
caacatattttacacaaaaaatatcaaccaaaaaaaactatctactcccttcgccaaattatcccacaacaatatcatactcgaaaaacccgccgcgaactcttttttaatcgactcgctcatcaactcgaacaaaaacgaaacaaacgacgataataataacgcgaaaaacgacgacgataacgattactacgcccacgacgaaatctacctaccgcccgccgccgacctaccctacgaactacaaaactacgaactcttccccacgctaaacgacaaacgcaataaaacaacgtcgccgaacaacgataacgataacgaaaatctaaatcccgaaacgcacgactacgaaccctcgcccataaacctataactaaacgcgccccgatcttaccgaataaaaccgcctaacgaaccgccgccgccgccccaacaacaaccgccgcccccgccgcaaccaccccaaccaacgccgcaaaccacctcgtactctttcgcgcaaaacatcaaaaaaaaaaactcctactacctctacgactcgacgaacaaataccccaaaatctcgaccaccgccgccgaactaactcccttcccgcgaaacccgccgcccgacgactacgccctaaacacctccaacgaaataccaatacctaactacttccgcctttctcaaacctacgacaccgccaaaaactataacaacgacgacgacgacgcgcaacaactcgaaactaacccgttccccgcgcaacccccgaaacgcgatttcgatctcccgcccgcgctaacctccgactcgaccgatacgacccgaaaaaaacgaaccctcgattcgccgccgccccccacgctaacttacgacaacgacgaaaactcgcaaaacgacgaaaaaacgcacgcgtcgtcctcgac

SEQ ID NO: 1011 - DNA, 912 bp, Artificial Sequence
  chemically treated genomic DNA (Homo sapiens) CpG-island No: 1011
tagtatgttttgtataagaaatgttagttagaaagggttatttgtttttttcgttaaattattttataataatgttatgttcggagagttcgtcgcgaatttttttttggtcgattcgtttattagttcgggtagaggcgaggtaggcggcggtggtggtggcgcggggggcggcggcggtggcggttattacgtttacggcggggtttatttgtcgttcgtcgtcgatttgttttacgggttgtagagttgcgggtttttttttacgttgggcggtaagcgtaatgaggtagcgtcgtcgggtagcggtggcggtggcgggggtttaggtttcggggcgtacggttacgggttttcgtttatagatttgtggttagacgcgtttcggttttgtcggatggagtcgtttgacgggtcgtcgtcgtcgttttagtagtagtcgtcgttttcgtcgtaattattttagttagcgtcgtaggttatttcgtgttttttcgcgtagaatattaaagaagagagtttttattgtttttacgattcggcggataaatgttttaaagtttcggttatcgtcgtcgaattggtttttttttcgcggggttcgtcgttcgacggttgcgttttgggtatttttagcggggtgttagtgtttggttattttcgttttttttaggtttacggtatcgttaagggttatggtagcggcggcggcggcgcgtagtaattcggggttggttcgtttttcgcgtagttttcggggcgcggtttcgatttttcgttcgcgttagttttcggttcggtcgatgcggttcggaaggagcgagttttcgattcgtcgtcgttttttacgttggtttgcggtagcggcgggggttcgtagggcgacgaggaggcgtacgcgtcgttttcggt

SEQ ID NO: 1012 - DNA, 912 bp, Artificial Sequence
  chemically treated genomic DNA (Homo sapiens) CpG-island No: 1012
accgaaaacgacgcgtacgcctcctcgtcgccctacgaacccccgccgctaccgcaaaccaacgtaaaaaacgacgacgaatcgaaaactcgctccttccgaaccgcatcgaccgaaccgaaaactaacgcgaacgaaaaatcgaaaccgcgccccgaaaactacgcgaaaaacgaaccaaccccgaattactacgcgccgccgccgccgctaccataacccttaacgataccgtaaacctaaaaaaaacgaaaataaccaaacactaacaccccgctaaaaatacccaaaacgcaaccgtcgaacgacgaaccccgcgaaaaaaaaaccaattcgacgacgataaccgaaactttaaaacatttatccgccgaatcgtaaaaacaataaaaactctcttctttaatattctacgcgaaaaaacacgaaataacctacgacgctaactaaaataattacgacgaaaacgacgactactactaaaacgacgacgacgacccgtcaaacgactccatccgacaaaaccgaaacgcgtctaaccacaaatctataaacgaaaacccgtaaccgtacgccccgaaacctaaacccccgccaccgccaccgctacccgacgacgctacctcattacgcttaccgcccaacgtaaaaaaaaacccgcaactctacaacccgtaaaacaaatcgacgacgaacgacaaataaaccccgccgtaaacgtaataaccgccaccgccgccgccccccgcgccaccaccaccgccgcctacctcgcctctacccgaactaataaacgaatcgaccaaaaaaaaattcgcgacgaactctccgaacataacattattataaaataatttaacgaaaaaaacaaataaccctttctaactaacatttcttatacaaaacatacta

SEQ ID NO: 1013 - DNA, 677 bp, Artificial Sequence
  chemically treated genomic DNA (Homo sapiens) CpG-island No: 1013
gttttgtttttagtgtggtcggaagacgattcggggttgttgttgttttcggggcgtcgtcgtcgtttttttttttttgttgtcgtcgtcgtttttcggtagtcgtcgtcgtcgtcgttgttcgaatttgaagttgtcggcgcgttcgttgtagtcgtcgtcgtcgtcgcggaggtcgtcgtggtcgtcgggggttttttttcggcgtttttgttttcggggtagtcggaggaggcgaggtttttcggggtgtcgtaggttgtttcgaaaaattggtcgaaagtttgtggtaggacgtcgtttttgtttacggtgttatagaaattggacgagattgcgggggtggggtggtggtagacgttggtcgagtttttggttagtacgtcgttaggtacgtcggtcgcgttgggcgtttgtaggtagtttttgtgtacgagttttttcgcggagtagtagtgggttagattgtcgcgggggtgttatttagtggcgggtttaatggcgtattttttgaaggttatttcgcgtacgggttggatttggggtaggttggaggagtaggagtatgttattgggcgcgaagacggggtttggggtagaaaagaagggaggttggagaaatttggattcgagacgtagtaagtataatttggtaaatatatgttagaggagtaggg

SEQ ID NO: 1014 - DNA, 677 bp, Artificial Sequence
  chemically treated genomic DNA (Homo sapiens) CpG-island No: 1014
ccctactcctctaacatatatttaccaaattatacttactacgtctcgaatccaaatttctccaacctcccttcttttctaccccaaaccccgtcttcgcgcccaataacatactcctactcctccaacctaccccaaatccaacccgtacgcgaaataaccttcaaaaaatacgccattaaacccgccactaaataacacccccgcgacaatctaacccactactactccgcgaaaaaactcgtacacaaaaactacctacaaacgcccaacgcgaccgacgtacctaacgacgtactaaccaaaaactcgaccaacgtctaccaccaccccacccccgcaatctcgtccaatttctataacaccgtaaacaaaaacgacgtcctaccacaaactttcgaccaatttttcgaaacaacctacgacaccccgaaaaacctcgcctcctccgactaccccgaaaacaaaaacgccgaaaaaaaacccccgacgaccacgacgacctccgcgacgacgacgacgactacaacgaacgcgccgacaacttcaaattcgaacaacgacgacgacgacgactaccgaaaaacgacgacgacaacaaaaaaaaaaaaacgacgacgacgccccgaaaacaacaacaaccccgaatcgtcttccgaccacactaaaaacaaaac

SEQ ID NO: 1015 - DNA, 677 bp, Artificial Sequence
  chemically treated genomic DNA (Homo sapiens) CpG-island No: 1015
ttttgtttttttaatatgtatttgttaagttgtatttattacgtttcgggtttagatttttttagtttttttttttttttgttttagatttcgttttcgcgtttaatgatatatttttatttttttaatttgttttaggtttaattcgtgcgcgaagtgatttttagagagtacgttattgagttcgttattaaatggtattttcgcggtaatttggtttattgttatttcgcggaggagttcgtgtatagagattgtttgtaggcgtttagcgcggtcggcgtgtttggcgacgtgttggttaagagttcggttaacgtttattattattttattttcgtagtttcgtttaatttttatagtatcgtgggtaggaacggcgttttgttataggttttcgattagtttttcgagatagtttacggtatttcggaaaatttcgtttttttcgattatttcggggataagagcgtcgagaaggggttttcggcggttacggcgattttcgcggcggcggcggcggttgtaacgggcgcgtcggtaattttaagttcggatagcggcggcggcggcggttgtcgggagacggcggcggtagtagaggagaaagagcggcggcggcgtttcgagagtagtagtagtttcgagtcgtttttcggttatattgaggataaggt

SEQ ID NO: 1016 - DNA, 677 bp, Artificial Sequence
  chemically treated genomic DNA (Homo sapiens) CpG-island No: 1016
accttatcctcaatataaccgaaaaacgactcgaaactactactactctcgaaacgccgccgccgctctttctcctctactaccgccgccgtctcccgacaaccgccgccgccgccgctatccgaacttaaaattaccgacgcgcccgttacaaccgccgccgccgccgcgaaaatcgccgtaaccgccgaaaaccccttctcgacgctcttatccccgaaataatcgaaaaaaacgaaattttccgaaataccgtaaactatctcgaaaaactaatcgaaaacctataacaaaacgccgttcctacccacgatactataaaaattaaacgaaactacgaaaataaaataataataaacgttaaccgaactcttaaccaacacgtcgccaaacacgccgaccgcgctaaacgcctacaaacaatctctatacacgaactcctccgcgaaataacaataaaccaaattaccgcgaaaataccatttaataacgaactcaataacgtactctctaaaaatcacttcgcgcacgaattaaacctaaaacaaattaaaaaaataaaaatatatcattaaacgcgaaaacgaaatctaaaacaaaaaaaaaaaaaaactaaaaaaatctaaacccgaaacgtaataaatacaacttaacaaatacatattaaaaaaacaaaa

SEQ ID NO: 1017 - DNA, 1014 bp, Artificial Sequence
  chemically treated genomic DNA (Homo sapiens) CpG-island No: 1017
tcggtagttgggtcggcggtatttatgtatttgttcgcgaaggcggcggcggcggcggtcgaggcgggttgcgcgtacgatttgatggcgttggggtgcgggtttatgcgggcgtacgggtagtagtcgttgtcgaagtagttatagggtagcgtcgcgggtttcgacgagttttgcgtcgttgtcgagtaggggttgtattgtttggcggtttttgcgttcgtcgggttcgtcgggtcgggatttttcgaggacgacgcggcggcggcggcggcggttgtagcggtagtcgcggtagtagcggcggtagtcgacgggggcgttttttcgggggcgttgttgtaggcggacgcggtttttggcgttaagggcgtcgggtgcgttattaggttgcggtattggttggtcgcggtcgtcgtcgtagtcgcggtcgtcgtcgttatcgagaagttgttttttgtcgtcgtagtcgtcgggtgggggaagttttcgttttcggtttcggtagtcgtcgtcgttgtagtcgttgttgtagtcgtcgtcgttttttttatgtttttgttgagttcgtcggttattaggtcgtcgtcgttgtcgtagagaaatatgacggtgggttcgatttagcgggggtggaggagtacggaggttgttatagttcgagtcgtatggagaagattttagtggcgttgttttaaaaagtttttaagaagtgaagagcgcgcggcgcggggtcggggttcgagcgaggggggcggatcgcgtttcgcggggtcgcgttaggcggtcgtttattggttcggttttttcgtttcgtttacggcgtatgtaaagcgggcggtttcgattttagttttgtacggtgtattcgtcgttttcgtcgcggttcgcgtcgtttttagcgttagtcgcgcggtcgcgtattatttattcgggggagaggcggaggaacgtgcgggtggggtagggaaggaaggcggttttattttcgttttttttttttttttttatttt

SEQ ID NO: 1018 - DNA, 1014 bp, Artificial Sequence
  chemically treated genomic DNA (Homo sapiens) CpG-island No: 1018
aaaataaaaaaaaaaaaaaaaaacgaaaataaaaccgccttccttccctaccccacccgcacgttcctccgcctctcccccgaataaataatacgcgaccgcgcgactaacgctaaaaacgacgcgaaccgcgacgaaaacgacgaatacaccgtacaaaactaaaatcgaaaccgcccgctttacatacgccgtaaacgaaacgaaaaaaccgaaccaataaacgaccgcctaacgcgaccccgcgaaacgcgatccgcccccctcgctcgaaccccgaccccgcgccgcgcgctcttcacttcttaaaaactttttaaaacaacgccactaaaatcttctccatacgactcgaactataacaacctccgtactcctccacccccgctaaatcgaacccaccgtcatatttctctacgacaacgacgacgacctaataaccgacgaactcaacaaaaacataaaaaaaacgacgacgactacaacaacgactacaacgacgacgactaccgaaaccgaaaacgaaaacttcccccacccgacgactacgacgacaaaaaacaacttctcgataacgacgacgaccgcgactacgacgacgaccgcgaccaaccaataccgcaacctaataacgcacccgacgcccttaacgccaaaaaccgcgtccgcctacaacaacgcccccgaaaaaacgcccccgtcgactaccgccgctactaccgcgactaccgctacaaccgccgccgccgccgccgcgtcgtcctcgaaaaatcccgacccgacgaacccgacgaacgcaaaaaccgccaaacaatacaacccctactcgacaacgacgcaaaactcgtcgaaacccgcgacgctaccctataactacttcgacaacgactactacccgtacgcccgcataaacccgcaccccaacgccatcaaatcgtacgcgcaacccgcctcgaccgccgccgccgccgccttcgcgaacaaatacataaataccgccgacccaactaccga

SEQ ID NO: 1019 - DNA, 1014 bp, Artificial Sequence
  chemically treated genomic DNA (Homo sapiens) CpG-island No: 1019
gggataaaggaagggaaggggggcggagatggggtcgttttttttttttgttttattcgtacgttttttcgtttttttttcgggtgaatggtgcgcggtcgcgcggttggcgttggggacggcgcgggtcgcggcggggacgacgggtgtatcgtgtagagttggagtcggagtcgttcgttttgtatacgtcgtgggcggagcgggggggtcgggttaatgggcggtcgtttggcgcgatttcgcggggcgcgattcgtttttttcgttcgggtttcggtttcgcgtcgcgcgttttttattttttgggggttttttaaaatagcgttattggggttttttttatgcggttcgggttatgatagttttcgtgtttttttattttcgttggatcgagtttatcgttatgtttttttacgataacggcggcggtttggtggtcgacgagtttaataagaatatggaaggggcggcggcggttgtagtagcggttgtagcggcggcggttgtcggggtcgggggcgggggttttttttattcggcggttgcggcggtagggggtaatttttcggtggcggcggcggtcgcggttgcggcggcggtcgcggttaattagtgtcgtaatttgatggcgtattcggcgtttttggcgttaggagtcgcgttcgtttatagtagcgttttcggggaggcgttttcgtcggttgtcgtcgttgttgtcgcggttgtcgttgtagtcgtcgtcgtcgtcgtcgcgtcgttttcgggaggtttcggttcggcgggttcggcgggcgtagaggtcgttaagtaatgtagtttttgttcggtagcggcgtagagttcgtcggggttcgcggcgttgttttatggttatttcggtagcggttattattcgtgcgttcgtatgggttcgtattttaacgttattaagtcgtgcgcgtagttcgtttcggtcgtcgtcgtcgtcgttttcgcggataagtatatggatatcgtcggtttagttgtcga

SEQ ID NO: 1020 - DNA, 1014 bp, Artificial Sequence
  chemically treated genomic DNA (Homo sapiens) CpG-island No: 1020
tcgacaactaaaccgacgatatccatatacttatccgcgaaaacgacgacgacgacgaccgaaacgaactacgcgcacgacttaataacgttaaaatacgaacccatacgaacgcacgaataataaccgctaccgaaataaccataaaacaacgccgcgaaccccgacgaactctacgccgctaccgaacaaaaactacattacttaacgacctctacgcccgccgaacccgccgaaccgaaacctcccgaaaacgacgcgacgacgacgacgacgactacaacgacaaccgcgacaacaacgacgacaaccgacgaaaacgcctccccgaaaacgctactataaacgaacgcgactcctaacgccaaaaacgccgaatacgccatcaaattacgacactaattaaccgcgaccgccgccgcaaccgcgaccgccgccgccaccgaaaaattaccccctaccgccgcaaccgccgaataaaaaaaacccccgcccccgaccccgacaaccgccgccgctacaaccgctactacaaccgccgccgccccttccatattcttattaaactcgtcgaccaccaaaccgccgccgttatcgtaaaaaaacataacgataaactcgatccaacgaaaataaaaaaacacgaaaactatcataacccgaaccgcataaaaaaaaccccaataacgctattttaaaaaacccccaaaaaataaaaaacgcgcgacgcgaaaccgaaacccgaacgaaaaaaacgaatcgcgccccgcgaaatcgcgccaaacgaccgcccattaacccgacccccccgctccgcccacgacgtatacaaaacgaacgactccgactccaactctacacgatacacccgtcgtccccgccgcgacccgcgccgtccccaacgccaaccgcgcgaccgcgcaccattcacccgaaaaaaaaacgaaaaaacgtacgaataaaacaaaaaaaaaaaacgaccccatctccgccccccttcccttcctttatccc

SEQ ID NO: 1021 - DNA, 553 bp, Artificial Sequence
  chemically treated genomic DNA (Homo sapiens) CpG-island No: 1021
ggttatgacgtggtcgtattcggcggatttcgttttttatatttatatgatgagttatgcggcggtcgcgggcggtttgttttatttttttttatcgtatttgtttttgttttattattcgtcggtgggtttgggcgtcgtattcgtcgttttcgtcgtcgtttcgttttttagcggttcgttgcgttcgttcgatacgtttcgcgtgttgtcgtagttttattcgcggttcgaattgttgtgcgtttttcgttattcgtcgttttatttcgggttcgcgtacggattgggcgtttttgtcggcggtttttgtttttgtttcgtttgttatagcggttcggttaacgggttggcgtttcgggttgtcgtcgtttcggattttatttgtgtttttatttttcgttcggattttttttttattttcgcgttttcggtgtttagtaaggtttttttcgtcgcgttggattagagggaggaggtgttttttattagataaggggtcgtcggttggttgtcggttttatgacgttcgtggggttatttttcggtttcg

SEQ ID NO: 1022 - DNA, 553 bp, Artificial Sequence
  chemically treated genomic DNA (Homo sapiens) CpG-island No: 1022
cgaaaccgaaaaataaccccacgaacgtcataaaaccgacaaccaaccgacgaccccttatctaataaaaaacacctcctccctctaatccaacgcgacgaaaaaaaccttactaaacaccgaaaacgcgaaaataaaaaaaaaatccgaacgaaaaataaaaacacaaataaaatccgaaacgacgacaacccgaaacgccaacccgttaaccgaaccgctataacaaacgaaacaaaaacaaaaaccgccgacaaaaacgcccaatccgtacgcgaacccgaaataaaacgacgaataacgaaaaacgcacaacaattcgaaccgcgaataaaactacgacaacacgcgaaacgtatcgaacgaacgcaacgaaccgctaaaaaacgaaacgacgacgaaaacgacgaatacgacgcccaaacccaccgacgaataataaaacaaaaacaaatacgataaaaaaaaataaaacaaaccgcccgcgaccgccgcataactcatcatataaatataaaaaacgaaatccgccgaatacgaccacgtcataacc

SEQ ID NO: 1023 - DNA, 553 bp, Artificial Sequence
  chemically treated genomic DNA (Homo sapiens) CpG-island No: 1023
cggggtcggggggtgattttacgggcgttatggagtcggtagttagtcggcggttttttatttagtgaggggtattttttttttttggtttagcgcgacggaggaggttttgttgagtatcgagggcgcgaaggtgaggaaggagttcgagcgggaggtggaggtataggtgaagttcgaggcggcggtagttcggggcgttagttcgttggtcgggtcgttgtgataggcgaggtaggagtaggggtcgtcggtagaggcgtttagttcgtgcgcgggttcggggtagagcggcgggtggcggaaggcgtatagtagttcgggtcgcgggtagggttgcgatagtacgcggaacgtgtcgagcgggcgtagcgagtcgttgaagggcgaggcggcggcggaggcggcggatgcggcgtttaggtttatcggcgagtagtagggtaggggtaggtgcgatgggaaggggtagggtaggtcgttcgcggtcgtcgtatggtttattatgtaagtgtagaaggcggggttcgtcgggtgcggttacgttatggtt

SEQ ID NO: 1024 - DNA, 553 bp, Artificial Sequence
  chemically treated genomic DNA (Homo sapiens) CpG-island No: 1024
aaccataacgtaaccgcacccgacgaaccccgccttctacacttacataataaaccatacgacgaccgcgaacgacctaccctaccccttcccatcgcacctacccctaccctactactcgccgataaacctaaacgccgcatccgccgcctccgccgccgcctcgcccttcaacgactcgctacgcccgctcgacacgttccgcgtactatcgcaaccctacccgcgacccgaactactatacgccttccgccacccgccgctctaccccgaacccgcgcacgaactaaacgcctctaccgacgacccctactcctacctcgcctatcacaacgacccgaccaacgaactaacgccccgaactaccgccgcctcgaacttcacctatacctccacctcccgctcgaactccttcctcaccttcgcgccctcgatactcaacaaaacctcctccgtcgcgctaaaccaaaaaaaaaaaatacccctcactaaataaaaaaccgccgactaactaccgactccataacgcccgtaaaatcaccccccgaccccg

SEQ ID NO: 1025 - DNA, 779 bp, Artificial Sequence
  chemically treated genomic DNA (Homo sapiens) CpG-island No: 1025
ggttttttcggcggttttatttgtttcgggtttgacgggtattttcggggttgtcgtagtcggaattcggggaggtaggaaatgaatggggattcgaggggtgggggcgcggtggggtcggttttcggtttttggagggcgaggggacgaggagggaatcggtttttaatttcgattcggggcgggagttcgaagttcggtcggggcgttttttttcggacggggttaatcgaacgcggcggtggtcgggtcgaggttcgcgtcgggtttttcggggttttttattttcgcgatgttatgtttttttcgtttttcggtttcgcgacggattcgttttttgtttaggtttcgttgggttcggttatatcgggttggttcgagggaggttcgttcgggatcggacgcggggtagagttagtcggtcgcgtatagatttttttttaggtttggggatttcggagattgtgtagttgtttttcggttcggttcgtttttttttcgttttcgtttttcgtcgtcgtcgttttcgtgatgttatcgttcgcgacgttcgtcgttattttttgtttttcgttagcggaggatcgagcgacggtcgggaatggtagcgcgggggtttcgcggaggcgttacgtatagtgtttaaagtatttttgtttttttttggaaatcgcggtcgttaggtgtgagttgcgcgtttcgcgtttacgttatcgattcgttcgggttcgttgttatatcgattttatttatttcgttttataaatcgtcgttttatt

SEQ ID NO: 1026 - DNA, 779 bp, Artificial Sequence
  chemically treated genomic DNA (Homo sapiens) CpG-island No: 1026
aataaaacgacgatttataaaacgaaataaataaaatcgatataacaacgaacccgaacgaatcgataacgtaaacgcgaaacgcgcaactcacacctaacgaccgcgatttccaaaaaaaaacaaaaatactttaaacactatacgtaacgcctccgcgaaacccccgcgctaccattcccgaccgtcgctcgatcctccgctaacgaaaaacaaaaaataacgacgaacgtcgcgaacgataacatcacgaaaacgacgacgacgaaaaacgaaaacgaaaaaaaaacgaaccgaaccgaaaaacaactacacaatctccgaaatccccaaacctaaaaaaaaatctatacgcgaccgactaactctaccccgcgtccgatcccgaacgaacctccctcgaaccaacccgatataaccgaacccaacgaaacctaaacaaaaaacgaatccgtcgcgaaaccgaaaaacgaaaaaaacataacatcgcgaaaataaaaaaccccgaaaaacccgacgcgaacctcgacccgaccaccgccgcgttcgattaaccccgtccgaaaaaaaacgccccgaccgaacttcgaactcccgccccgaatcgaaattaaaaaccgattccctcctcgtcccctcgccctccaaaaaccgaaaaccgaccccaccgcgcccccacccctcgaatccccattcatttcctacctccccgaattccgactacgacaaccccgaaaatacccgtcaaacccgaaacaaataaaaccgccgaaaaaacc

SEQ ID NO: 1027 - DNA, 779 bp, Artificial Sequence
  chemically treated genomic DNA (Homo sapiens) CpG-island No: 1027
agtggagcggcgatttgtggaacgaaatgaatgaaatcgatgtggtagcgggttcggacgggtcggtggcgtagacgcggagcgcgtagtttatatttggcggtcgcggtttttaggaggaagtaaggatgttttggatattgtgcgtggcgttttcgcggagttttcgcgttgttattttcggtcgtcgttcggtttttcgttgacgggaagtaggaagtggcggcgggcgtcgcgagcggtgatattacgggggcgacggcggcgaagggcgggggcggaggaggagcgagtcgggtcggggggtagttgtatagttttcgggatttttaggtttggaggggggtttgtgcgcggtcggttggttttgtttcgcgttcggtttcgagcgggtttttttcgggttagttcgatgtgatcgagtttagcggagtttgagtaaggagcgggttcgtcgcggagtcggagggcgggaggaatatgatatcgcggaggtgaggagtttcgaggggttcggcgcgggtttcggttcggttatcgtcgcgttcggttagtttcgttcggaagggggcgtttcggtcgggtttcgggttttcgtttcgggtcggggttgggggtcggtttttttttcgttttttcgttttttaggggtcgggggtcggttttatcgcgtttttatttttcgggtttttatttattttttgttttttcgagtttcggttgcggtagtttcggggatgttcgttaggttcggggtaggtagagtcgtcgagggaatt

SEQ ID NO: 1028 - DNA, 779 bp, Artificial Sequence
  chemically treated genomic DNA (Homo sapiens) CpG-island No: 1028
aattccctcgacgactctacctaccccgaacctaacgaacatccccgaaactaccgcaaccgaaactcgaaaaaacaaaaaataaataaaaacccgaaaaataaaaacgcgataaaaccgacccccgacccctaaaaaacgaaaaaacgaaaaaaaaaccgacccccaaccccgacccgaaacgaaaacccgaaacccgaccgaaacgcccccttccgaacgaaactaaccgaacgcgacgataaccgaaccgaaacccgcgccgaacccctcgaaactcctcacctccgcgatatcatattcctcccgccctccgactccgcgacgaacccgctccttactcaaactccgctaaactcgatcacatcgaactaacccgaaaaaaacccgctcgaaaccgaacgcgaaacaaaaccaaccgaccgcgcacaaacccccctccaaacctaaaaatcccgaaaactatacaactaccccccgacccgactcgctcctcctccgcccccgcccttcgccgccgtcgcccccgtaatatcaccgctcgcgacgcccgccgccacttcctacttcccgtcaacgaaaaaccgaacgacgaccgaaaataacaacgcgaaaactccgcgaaaacgccacgcacaatatccaaaacatccttacttcctcctaaaaaccgcgaccgccaaatataaactacgcgctccgcgtctacgccaccgacccgtccgaacccgctaccacatcgatttcattcatttcgttccacaaatcgccgctccact

SEQ ID NO: 1029 - DNA, 910 bp, Artificial Sequence
  chemically treated genomic DNA (Homo sapiens) CpG-island No: 1029
tattcgggtggtttcgttcgcggagcggtgggcggagcggcgggcggggtttgtattgttcgtttcgcgaggtatgtcgggagtttcgtttttaatatggcgttttattgatagttggttgtcgagcggtagaggcggattttgtttttgagggcggcggcggcggcggcggcggcggcggcggtagggtcggggtttttcgggtcggggtcgggggtatggcgattcggatcgtttagggcggagttgtacgggcgaggtagtaagtggggcgtcgttggcgggcgcggcggtcgttgttatggattggtgatcgcggcggtttttgtttcgtttttttcggtcgggcgtttgttttttagcgttaagtttttagtcggggttatgggttcgtcggcggtcgcggcggcggcggcggcggcggtcgttgattcggcgtagtggttttcggtgaaggaagagattatttttttgtacgacgggttgattcgggttatcgatttggtcgagttgtttagcgagattttcggggttttagaggtcgcggatatcgatttggaggtgagcgaggcggttttcggttttcgttatcggattgatttattcgttcggtattttcgggtcgggtttttttttcgttttagtcgcggtttcgtttttcggcggttgtcggggtaggtgtgtgtgggcgcggggcgggtaggtggggtcgcggtcgtaggtttgcggatcgttcgtttcgtttttttttttttttttttcggggtttggcgttcgtaggggattttatttgtggtttttttttgagcgtttcgatattcggtattttattaggttagcgtttggttcggtttttatgttttagaggagttatcgttattattcgggttttttttttttttttttacgg

SEQ ID NO: 1030 - DNA, 910 bp, Artificial Sequence
  chemically treated genomic DNA (Homo sapiens) CpG-island No: 1030
ccgtaaaaaaaaaaaaaaaaaacccgaataataacgataactcctctaaaacataaaaaccgaaccaaacgctaacctaataaaataccgaatatcgaaacgctcaaaaaaaaaccacaaataaaatcccctacgaacgccaaaccccgaaaaaaaaaaaaaaaaaaacgaaacgaacgatccgcaaacctacgaccgcgaccccacctacccgccccgcgcccacacacacctaccccgacaaccgccgaaaaacgaaaccgcgactaaaacgaaaaaaaaacccgacccgaaaataccgaacgaataaatcaatccgataacgaaaaccgaaaaccgcctcgctcacctccaaatcgatatccgcgacctctaaaaccccgaaaatctcgctaaacaactcgaccaaatcgataacccgaatcaacccgtcgtacaaaaaaataatctcttccttcaccgaaaaccactacgccgaatcaacgaccgccgccgccgccgccgccgcgaccgccgacgaacccataaccccgactaaaaacttaacgctaaaaaacaaacgcccgaccgaaaaaaacgaaacaaaaaccgccgcgatcaccaatccataacaacgaccgccgcgcccgccaacgacgccccacttactacctcgcccgtacaactccgccctaaacgatccgaatcgccatacccccgaccccgacccgaaaaaccccgaccctaccgccgccgccgccgccgccgccgccgccgccctcaaaaacaaaatccgcctctaccgctcgacaaccaactatcaataaaacgccatattaaaaacgaaactcccgacatacctcgcgaaacgaacaatacaaaccccgcccgccgctccgcccaccgctccgcgaacgaaaccacccgaata

SEQ ID NO: 1031 - DNA, 910 bp, Artificial Sequence
  chemically treated genomic DNA (Homo sapiens) CpG-island No: 1031
tcgtgggggaggggagggagggttcgggtggtggcggtggtttttttggggtatgaaggtcgagttaggcgttagtttaataaaatgtcgggtgtcggaacgtttaaaagaaaattataaatgaaattttttgcgggcgttaggtttcgaggagggagggagggagagcggggcgggcggttcgtagatttgcggtcgcggttttatttgttcgtttcgcgtttatatatatttgtttcggtagtcgtcgggaggcgaggtcgcggttgaggcgaggagggggttcgattcgggggtgtcgggcgagtgggttagttcgatggcgggggtcgggggtcgtttcgtttatttttaggtcggtgttcgcggtttttggggtttcgaggatttcgttgggtagttcggttaggtcggtgattcggattagttcgtcgtgtaggaagatggtttttttttttatcgagagttattgcgtcgagttagcggtcgtcgtcgtcgtcgtcgtcgcggtcgtcgacgagtttatggtttcggttgaaggtttggcgttgaggagtagacgttcggtcgggggaaacggagtaggagtcgtcgcgattattagtttatggtagcggtcgtcgcgttcgttagcggcgttttatttgttgtttcgttcgtgtaatttcgttttaggcggttcgagtcgttatattttcgatttcggttcgggagatttcggttttgtcgtcgtcgtcgtcgtcgtcgtcgtcgtcgtttttaggagtaggattcgtttttgtcgttcggtaattaattgttagtgagacgttatgttgggggcggggttttcggtatgtttcgcggagcggataatataggtttcgttcgtcgtttcgtttatcgtttcgcggacgaggttattcgggtg

SEQ ID NO: 1032 - DNA, 910 bp, Artificial Sequence
  chemically treated genomic DNA (Homo sapiens) CpG-island No: 1032
cacccgaataacctcgtccgcgaaacgataaacgaaacgacgaacgaaacctatattatccgctccgcgaaacataccgaaaaccccgcccccaacataacgtctcactaacaattaattaccgaacgacaaaaacgaatcctactcctaaaaacgacgacgacgacgacgacgacgacgacgacaaaaccgaaatctcccgaaccgaaatcgaaaatataacgactcgaaccgcctaaaacgaaattacacgaacgaaacaacaaataaaacgccgctaacgaacgcgacgaccgctaccataaactaataatcgcgacgactcctactccgtttcccccgaccgaacgtctactcctcaacgccaaaccttcaaccgaaaccataaactcgtcgacgaccgcgacgacgacgacgacgacgaccgctaactcgacgcaataactctcgataaaaaaaaaaaccatcttcctacacgacgaactaatccgaatcaccgacctaaccgaactacccaacgaaatcctcgaaaccccaaaaaccgcgaacaccgacctaaaaataaacgaaacgacccccgacccccgccatcgaactaacccactcgcccgacacccccgaatcgaaccccctcctcgcctcaaccgcgacctcgcctcccgacgactaccgaaacaaatatatataaacgcgaaacgaacaaataaaaccgcgaccgcaaatctacgaaccgcccgccccgctctccctccctccctcctcgaaacctaacgcccgcaaaaaatttcatttataattttcttttaaacgttccgacacccgacattttattaaactaacgcctaactcgaccttcataccccaaaaaaaccaccgccaccacccgaaccctccctcccctcccccacga

SEQ ID NO: 1033 - DNA, 1463 bp, Artificial Sequence
  chemically treated genomic DNA (Homo sapiens) CpG-island No: 1033
gcggtcgtttttcgcggtttttacgtttttttgagttatttatagaggggttcgttttatttttaacgacgggagggcgaagagtgtagagttggtttcgttcgcgtttcgcgtttgcgttgttagggtcgatcgaggacggcggtaagggggttcgacgtttcgcgtttagttgtgttttcggtttcggggttttagtcgcgtcgtttattcgttttaattttagacgttttagttttgggggcgtttcggggaagaggggtcgagggcgggtttatagggcgggcgtttttcgttttcggtcggtttgcggtttttcgcggcggtagcggcgttcgggtttcgggtcgcgttgggtttttagtttcgggaacgcgggggcggcgggggcggggcggggattagtttgggagcggcgttgatagtttcgttgtgtttttttcgttcggcggggttcgttgggtcgtttaattcgtttttgttcgcgcggtgttatatcgtattattcgtataatgcggtcgtcgggttcgggtcgtcgggtcggtcgttatcgcgtagtaacgggcggttttcgcggtcgggtcgcgttttcggtttcggcgtcgggtcgcgaaatttttattgaagcggcgtttttcgttttcgcgtcgcgtcgcgtcgcgtcgaatggttagagggcgtgtgaatggcgcggcggtcgcgcggtgggggggcggtgttcgggcgttttttaggtcgtttaggttttttcggcgttcgttttcgtttttgttttcgttttcgtttggggaagcgtttcgggttcgtcgcgtcgtcgtcgcgtttcgtttttttcggtcgtcgatttcgtcgtttttagattcgcggaagacgcgcgtttcgggttgttcgattcgttgcgtttcgggttttaaagcgcggggtagagattaatttttggtcgtttacgcggcggtggtgtggggattcgtcgggggcggggtgtaaacgtggggtcggagttgggcgcgaatttgggtttaaggttcgggttttgggtatcgatcggggcgcgtatgcgttcgcggcgtttttcgggatgtttttttcgtcgtcgttagtaaatttttaaattttcgggtatatatcgttttttttttcgtaatttaaatttgttttcgggttatttagggatcggggcgtgtgttagaatttacggtggtgatttaaaacgtttaacgcggagtgaatgggtagcgtttttagagtcgtttttttttggtttttggtcggagacgggaagagcgattagaggtgattcgtttttggggagcgcgtttagacgtagggttgtttgatttagcgttatttggttcgaggaggggtatcggaaagcgttgagattaatatatcgataagaacgagtttgaaatgtaaatcgtcgttatttggttttagttaagaggttaaattttttatgtta

SEQ ID NO: 1034 - DNA, 1463 bp, Artificial Sequence
  chemically treated genomic DNA (Homo sapiens) CpG-island No: 1034
taacataaaaaatttaacctcttaactaaaaccaaataacgacgatttacatttcaaactcgttcttatcgatatattaatctcaacgctttccgatacccctcctcgaaccaaataacgctaaatcaaacaaccctacgtctaaacgcgctccccaaaaacgaatcacctctaatcgctcttcccgtctccgaccaaaaaccaaaaaaaaacgactctaaaaacgctacccattcactccgcgttaaacgttttaaatcaccaccgtaaattctaacacacgccccgatccctaaataacccgaaaacaaatttaaattacgaaaaaaaaaacgatatatacccgaaaatttaaaaatttactaacgacgacgaaaaaaacatcccgaaaaacgccgcgaacgcatacgcgccccgatcgatacccaaaacccgaaccttaaacccaaattcgcgcccaactccgaccccacgtttacaccccgcccccgacgaatccccacaccaccgccgcgtaaacgaccaaaaattaatctctaccccgcgctttaaaacccgaaacgcaacgaatcgaacaacccgaaacgcgcgtcttccgcgaatctaaaaacgacgaaatcgacgaccgaaaaaaacgaaacgcgacgacgacgcgacgaacccgaaacgcttccccaaacgaaaacgaaaacaaaaacgaaaacgaacgccgaaaaaacctaaacgacctaaaaaacgcccgaacaccgcccccccaccgcgcgaccgccgcgccattcacacgccctctaaccattcgacgcgacgcgacgcgacgcgaaaacgaaaaacgccgcttcaataaaaatttcgcgacccgacgccgaaaccgaaaacgcgacccgaccgcgaaaaccgcccgttactacgcgataacgaccgacccgacgacccgaacccgacgaccgcattatacgaataatacgatataacaccgcgcgaacaaaaacgaattaaacgacccaacgaaccccgccgaacgaaaaaaacacaacgaaactatcaacgccgctcccaaactaatccccgccccgcccccgccgcccccgcgttcccgaaactaaaaacccaacgcgacccgaaacccgaacgccgctaccgccgcgaaaaaccgcaaaccgaccgaaaacgaaaaacgcccgccctataaacccgccctcgacccctcttccccgaaacgcccccaaaactaaaacgtctaaaattaaaacgaataaacgacgcgactaaaaccccgaaaccgaaaacacaactaaacgcgaaacgtcgaacccccttaccgccgtcctcgatcgaccctaacaacgcaaacgcgaaacgcgaacgaaaccaactctacactcttcgccctcccgtcgttaaaaataaaacgaacccctctataaataactcaaaaaaacgtaaaaaccgcgaaaaacgaccgc

SEQ ID NO: 1035 - DNA, 1463 bp, Artificial Sequence
  chemically treated genomic DNA (Homo sapiens) CpG-island No: 1035
tgatataaaagatttggttttttaattggggttaagtggcggcggtttgtattttaaattcgtttttgtcggtgtgttggttttagcgtttttcggtgttttttttcgggttaggtagcgttgaattaaataattttgcgtttagacgcgttttttaaaagcgagttatttttgatcgtttttttcgttttcggttaagagttaggggaaagcggttttgggagcgttatttatttatttcgcgttgaacgttttaagttattatcgtaggttttggtatacgtttcggtttttagatggttcgaggataggtttgggttgcggggggaggggcgatgtgtgttcgagagtttgggaatttgttggcggcggcgaggagagtatttcggaagacgtcgcgagcgtatacgcgtttcggtcggtgtttagagttcggattttgaatttaggttcgcgtttagtttcggttttacgtttgtatttcgttttcggcgagtttttatattatcgtcgcgtgggcggttaagggttaatttttgtttcgcgttttgagattcggggcgtagcgggtcgggtagttcggggcgcgcgtttttcgcgagtttgggggcggcggggtcggcggtcggaaggggcgaggcgcggcggcggcgcggcgggttcgaggcgtttttttaggcgggggcgggggtaggggcgggggcgggcgtcggaggggtttgggcggtttgaaaagcgttcgagtatcgtttttttatcgcgcggtcgtcgcgttatttatacgttttttggttattcggcgcggcgcggcgcggcgcgggggcggggggcgtcgttttaatggggatttcgcggttcggcgtcggggtcgggggcgcggttcggtcgcgggagtcgttcgttgttacgcggtggcggtcggttcggcggttcgggttcggcggtcgtattatgcgggtaatgcggtgtgatatcgcgcgaataaaggcggattgagcggtttagcgggtttcgtcggacggggaaggtatagcggggttgttagcgtcgtttttaggttaattttcgtttcgttttcgtcgttttcgcgttttcggggttgggaatttagcgcggttcggggttcgggcgtcgttgtcgtcgcgagaggtcgtaggtcggtcggaaacgaggggcgttcgttttgtgaattcgttttcggtttttttttttcgaggcgtttttagggttggggcgtttaggattggggcgagtgagcggcgcggttgggatttcgaggtcgggagtataattggacgcgggacgtcgggtttttttgtcgtcgttttcggtcggttttggtagcgtaggcgcggggcgcgggcgggattagttttgtatttttcgttttttcgtcgttggaagtgggacgggtttttttgtaggtggtttaggagggcgtgggggtcgcggagagcggtcgt

SEQ ID NO: 1036 - DNA, 1463 bp, Artificial Sequence
  chemically treated genomic DNA (Homo sapiens) CpG-island No: 1036
acgaccgctctccgcgacccccacgccctcctaaaccacctacaaaaaaacccgtcccacttccaacgacgaaaaaacgaaaaatacaaaactaatcccgcccgcgccccgcgcctacgctaccaaaaccgaccgaaaacgacgacaaaaaaacccgacgtcccgcgtccaattatactcccgacctcgaaatcccaaccgcgccgctcactcgccccaatcctaaacgccccaaccctaaaaacgcctcgaaaaaaaaaaaccgaaaacgaattcacaaaacgaacgcccctcgtttccgaccgacctacgacctctcgcgacgacaacgacgcccgaaccccgaaccgcgctaaattcccaaccccgaaaacgcgaaaacgacgaaaacgaaacgaaaattaacctaaaaacgacgctaacaaccccgctataccttccccgtccgacgaaacccgctaaaccgctcaatccgcctttattcgcgcgatatcacaccgcattacccgcataatacgaccgccgaacccgaaccgccgaaccgaccgccaccgcgtaacaacgaacgactcccgcgaccgaaccgcgcccccgaccccgacgccgaaccgcgaaatccccattaaaacgacgccccccgcccccgcgccgcgccgcgccgcgccgaataaccaaaaaacgtataaataacgcgacgaccgcgcgataaaaaaacgatactcgaacgcttttcaaaccgcccaaacccctccgacgcccgcccccgcccctacccccgcccccgcctaaaaaaacgcctcgaacccgccgcgccgccgccgcgcctcgccccttccgaccgccgaccccgccgcccccaaactcgcgaaaaacgcgcgccccgaactacccgacccgctacgccccgaatctcaaaacgcgaaacaaaaattaacccttaaccgcccacgcgacgataatataaaaactcgccgaaaacgaaatacaaacgtaaaaccgaaactaaacgcgaacctaaattcaaaatccgaactctaaacaccgaccgaaacgcgtatacgctcgcgacgtcttccgaaatactctcctcgccgccgccaacaaattcccaaactctcgaacacacatcgcccctccccccgcaacccaaacctatcctcgaaccatctaaaaaccgaaacgtataccaaaacctacgataataacttaaaacgttcaacgcgaaataaataaataacgctcccaaaaccgctttcccctaactcttaaccgaaaacgaaaaaaacgatcaaaaataactcgcttttaaaaaacgcgtctaaacgcaaaattatttaattcaacgctacctaacccgaaaaaaaacaccgaaaaacgctaaaaccaacacaccgacaaaaacgaatttaaaatacaaaccgccgccacttaaccccaattaaaaaaccaaatcttttatatca

SEQ ID NO: 1037 - DNA, 1204 bp, Artificial Sequence
  chemically treated genomic DNA (Homo sapiens) CpG-island No: 1037
tcgagattcggacggtattttggcgtggcgagagtaggtggagatgcgtacggaggttgtatgtttattttcgggtttcgggcgttacggttgttcgtatttgttttagtaagcgttagttaggaattgtcgcgttattgatttttttttcgtttttgggttttaattttcgggtttttcgggttagggaggcggtggggtggggtcgaggtcgtttcgagttattcgcggcggttttatatttgtatcggatttgttttttcgtttttaattttttttaatttcgaaagtattttagtagagcgttttcgtagttcgtttcgagttcggtttatacgtagacgttgattggggaagcgaggggtcgtcggtgtgtgaggtagggtaagagattaggggatttgtacggaggagcgttttaggggaggttgttgtttcgggagttagggcgcgttcggattatatcgtacggcgtagaagtttagcgcgtacgcgcgtcgtttgtcgtttcgcgcgttttttcgtttcgcgtcgcgtttttttatttcgggagagggcggttaggcgtagggagcgtgcgcgcggttcgtttcgggcgcgggcggagggaggaggaggcggcgcgcgcggcgtttagttcgtagaagtcggtggtcgcgtaggaggacggagttttaatcgtaattcgcgtcgcgtcgcgtcgcgtcggtaggggattcgtaggttcgggggtgggggttgtggggaaggtgttggggtggggcgggagggcgggatttcgcgtttcgggtttttgggcgtagggggatttagaggttcgcgcgatttcgtttttggaaattttgtgtcggcgtttttatttgttttttggcggtttttgatttttcggggcggttcgcggaggagaggttcgagatttttcgtagcgtattttcgtcggttttgagcgtgcgttttttgtcgttttttcgtcgcgtcgcgtcgttttcgcgattttgtttttgtgtttcggggttttagtagtttcggtcgcgtttttttcgtcgtttttcgatttcgttgaggtcgtttattttcgttggtatttattcgttttggagcgcgtcgtcgttttttgtattttttcgaggtttttggtgtatggatagaagtaatttgatttttagcgatgttaagtgtttaatttgagtttttttttgcggtg

SEQ ID NO: 1038 - DNA, 1204 bp, Artificial Sequence
  chemically treated genomic DNA (Homo sapiens) CpG-island No: 1038
caccgcaaaaaaaaactcaaattaaacacttaacatcgctaaaaatcaaattacttctatccatacaccaaaaacctcgaaaaaatacaaaaaacgacgacgcgctccaaaacgaataaataccaacgaaaataaacgacctcaacgaaatcgaaaaacgacgaaaaaaacgcgaccgaaactactaaaaccccgaaacacaaaaacaaaatcgcgaaaacgacgcgacgcgacgaaaaaacgacaaaaaacgcacgctcaaaaccgacgaaaatacgctacgaaaaatctcgaacctctcctccgcgaaccgccccgaaaaatcaaaaaccgccaaaaaacaaataaaaacgccgacacaaaatttccaaaaacgaaatcgcgcgaacctctaaatccccctacgcccaaaaacccgaaacgcgaaatcccgccctcccgccccaccccaacaccttccccacaacccccacccccgaacctacgaatcccctaccgacgcgacgcgacgcgacgcgaattacgattaaaactccgtcctcctacgcgaccaccgacttctacgaactaaacgccgcgcgcgccgcctcctcctccctccgcccgcgcccgaaacgaaccgcgcgcacgctccctacgcctaaccgccctctcccgaaataaaaaaacgcgacgcgaaacgaaaaaacgcgcgaaacgacaaacgacgcgcgtacgcgctaaacttctacgccgtacgatataatccgaacgcgccctaactcccgaaacaacaacctcccctaaaacgctcctccgtacaaatcccctaatctcttaccctacctcacacaccgacgacccctcgcttccccaatcaacgtctacgtataaaccgaactcgaaacgaactacgaaaacgctctactaaaatactttcgaaattaaaaaaaattaaaaacgaaaaaacaaatccgatacaaatataaaaccgccgcgaataactcgaaacgacctcgaccccaccccaccgcctccctaacccgaaaaacccgaaaattaaaacccaaaaacgaaaaaaaaatcaataacgcgacaattcctaactaacgcttactaaaacaaatacgaacaaccgtaacgcccgaaacccgaaaataaacatacaacctccgtacgcatctccacctactctcgccacgccaaaataccgtccgaatctcga

SEQ ID NO: 1039 - DNA, 1204 bp, Artificial Sequence
  chemically treated genomic DNA (Homo sapiens) CpG-island No: 1039
tatcgtagagaaagatttaagttggatatttggtatcgttgaaagttaagttgtttttatttatgtattagaaatttcggggagatgtaaaaagcggcggcgcgttttagagcgggtggatgttagcgagagtaggcggttttagcggggtcggaaggcgacggaggaggcgcggtcgaggttgttggagtttcggggtatagggatagggtcgcgggggcggcgcggcgcggcgggggagcggtagggggcgtacgtttagggtcggcgagggtgcgttgcggaaggtttcgggtttttttttcgcgggtcgtttcgaagagttaaggatcgttagggagtaggtgggggcgtcggtataaagtttttagaggcggggtcgcgcgggtttttgggtttttttgcgtttagggattcgaagcgcgaagtttcgttttttcgttttattttaatattttttttataatttttattttcgggtttgcgggttttttatcggcgcggcgcggcgcggcgcgggttgcggttagggtttcgtttttttgcgcggttatcggtttttgcgggttgggcgtcgcgcgcgtcgttttttttttttttcgttcgcgttcggggcgggtcgcgcgtacgttttttgcgtttggtcgttttttttcgaggtggggggacgcgacgcggggcggggggacgcgcggggcggtaggcggcgcgcgtgcgcgttgggtttttgcgtcgtgcggtgtggttcgggcgcgttttagttttcgaggtagtagttttttttagagcgttttttcgtgtaggttttttggttttttattttgttttatatatcggcgatttttcgtttttttagttagcgtttgcgtatgagtcgggttcgaggcgggttgcgggggcgttttgttggggtgttttcgggattggagaggattaaaggcgagaaagtaaattcgatataggtgtgaagtcgtcgcgggtggttcgggacggtttcgattttattttatcgtttttttagttcggagagttcgggggttgggatttaagagcgaagggaaaattagtagcgcggtagtttttggttgacgtttgttggaataggtacgggtagtcgtggcgttcgagattcggaggtgaatatgtaattttcgtgcgtatttttatttgttttcgttacgttaaggtgtcgttcgagtttcgg

SEQ ID NO: 1040 - DNA, 1204 bp, Artificial Sequence
  chemically treated genomic DNA (Homo sapiens) CpG-island No: 1040
ccgaaactcgaacgacaccttaacgtaacgaaaacaaataaaaatacgcacgaaaattacatattcacctccgaatctcgaacgccacgactacccgtacctattccaacaaacgtcaaccaaaaactaccgcgctactaattttcccttcgctcttaaatcccaacccccgaactctccgaactaaaaaaacgataaaataaaatcgaaaccgtcccgaaccacccgcgacgacttcacacctatatcgaatttactttctcgcctttaatcctctccaatcccgaaaacaccccaacaaaacgcccccgcaacccgcctcgaacccgactcatacgcaaacgctaactaaaaaaacgaaaaatcgccgatatataaaacaaaataaaaaaccaaaaaacctacacgaaaaaacgctctaaaaaaaactactacctcgaaaactaaaacgcgcccgaaccacaccgcacgacgcaaaaacccaacgcgcacgcgcgccgcctaccgccccgcgcgtccccccgccccgcgtcgcgtccccccacctcgaaaaaaaacgaccaaacgcaaaaaacgtacgcgcgacccgccccgaacgcgaacgaaaaaaaaaaaaaacgacgcgcgcgacgcccaacccgcaaaaaccgataaccgcgcaaaaaaacgaaaccctaaccgcaacccgcgccgcgccgcgccgcgccgataaaaaacccgcaaacccgaaaataaaaattataaaaaaaatattaaaataaaacgaaaaaacgaaacttcgcgcttcgaatccctaaacgcaaaaaaacccaaaaacccgcgcgaccccgcctctaaaaactttataccgacgcccccacctactccctaacgatccttaactcttcgaaacgacccgcgaaaaaaaaacccgaaaccttccgcaacgcaccctcgccgaccctaaacgtacgccccctaccgctcccccgccgcgccgcgccgcccccgcgaccctatccctataccccgaaactccaacaacctcgaccgcgcctcctccgtcgccttccgaccccgctaaaaccgcctactctcgctaacatccacccgctctaaaacgcgccgccgctttttacatctccccgaaatttctaatacataaataaaaacaacttaactttcaacgataccaaatatccaacttaaatctttctctacgata

SEQ ID NO: 1041 - DNA, 954 bp, Artificial Sequence
  chemically treated genomic DNA (Homo sapiens) CpG-island No: 1041
cgtaggtagagttcgaagttagcgggtcggtcgcgcgtttttttaagttgtttcggcgtttcgggaattagtgcggggcgcgtcgagtaggcggtgcggggcgagagtttggtgcgtagttttttgtttggagttggttcggtaaagtttcgtattagttgcgcgatgttaggattaggtatttttaatcgggcggagcgagaggggcgcgggggtaaggacgagaaatgcgtattcgttcgggttagagtagaataaaagttcgtttcgcggagatttatttacgtcgtatttttcgtgtttcgtaggtatttatatggttaaaggggtttcggggtttttaggttttgtaattttcgcgtttttttttcggtttataataatgtatagttttcgagtagcgttgtagtgtcggagtttagcggtttcgcgcgggttgcgggcgttgggtaggatttgcgttggaggttttcgagtttagcgttgatattgcgtcgttcgtagttttttcggcggcggttgtttatagtttttcgacgcgttttcgggtattcggcggcgtagttattgttttgatttattgaattaagcgaatacgtcggggtatttttcggcgtattttcgttcgttagcgtttagtttagttttttcgttttagggtttcgtagtacgttgggaattgtagtttttggtttttttatttcggaagtgggcgcggtaaatgtggttcggggcggggatttagttttattgattgcgttttattggtttagagcgcggcgtaggtgtggagaaaatattacgtcgacggggagttcgtttttagtagcgtttttattggtgttatttcgttttcgattcgttttgcggttttttttttttttttttgtcgggtaatggttgtttttaagatttagggggttgtcgttcgaatgtaggaagatcgtgatggga

SEQ ID NO: 1042 - DNA, 954 bp, Artificial Sequence
  chemically treated genomic DNA (Homo sapiens) CpG-island No: 1042
tcccatcacgatcttcctacattcgaacgacaaccccctaaatcttaaaaacaaccattacccgacaaaaaaaaaaaaaaaaaaccgcaaaacgaatcgaaaacgaaataacaccaataaaaacgctactaaaaacgaactccccgtcgacgtaatattttctccacacctacgccgcgctctaaaccaataaaacgcaatcaataaaactaaatccccgccccgaaccacatttaccgcgcccacttccgaaataaaaaaaccaaaaactacaattcccaacgtactacgaaaccctaaaacgaaaaaactaaactaaacgctaacgaacgaaaatacgccgaaaaataccccgacgtattcgcttaattcaataaatcaaaacaataactacgccgccgaatacccgaaaacgcgtcgaaaaactataaacaaccgccgccgaaaaaactacgaacgacgcaatatcaacgctaaactcgaaaacctccaacgcaaatcctacccaacgcccgcaacccgcgcgaaaccgctaaactccgacactacaacgctactcgaaaactatacattattataaaccgaaaaaaaaacgcgaaaattacaaaacctaaaaaccccgaaacccctttaaccatataaatacctacgaaacacgaaaaatacgacgtaaataaatctccgcgaaacgaacttttattctactctaacccgaacgaatacgcatttctcgtccttacccccgcgcccctctcgctccgcccgattaaaaatacctaatcctaacatcgcgcaactaatacgaaactttaccgaaccaactccaaacaaaaaactacgcaccaaactctcgccccgcaccgcctactcgacgcgccccgcactaattcccgaaacgccgaaacaacttaaaaaaacgcgcgaccgacccgctaacttcgaactctacctacg

SEQ ID NO: 1043 - DNA, 954 bp, Artificial Sequence
  chemically treated genomic DNA (Homo sapiens) CpG-island No: 1043
ttttattacggtttttttgtattcgggcgatagttttttgggttttggaagtagttattattcggtagaaaagaaaagggagggtcgtagggcgggtcggaggcggggtggtattagtagaaacgttattggaggcgaatttttcgtcgacgtaatgttttttttatatttacgtcgcgttttggattaataggacgtaattagtaaaattgaattttcgtttcgaattatatttgtcgcgtttattttcgggatggggaggttaagaattataatttttagcgtgttgcggggttttgggacgggagggttggattaggcgttggcgggcgggggtgcgtcggagagtgtttcggcgtgttcgtttagtttagtgaattagaataatgattgcgtcgtcgggtattcgggagcgcgtcggaggattgtgagtagtcgtcgtcgggagagttgcgggcggcgtagtgttaacgttgggttcgggagtttttagcgtagattttgtttagcgttcgtagttcgcgcgaagtcgttgggtttcggtattgtagcgttgttcggggattgtgtattgttgtgagtcggagaaggggcgcggggattataaagtttgaagatttcggagtttttttagttatgtggatatttacggagtacgagaaatacggcgtgggtgagttttcgcggggcgaatttttattttgttttggttcgagcgagtgcgtatttttcgtttttgttttcgcgtttttttcgtttcgttcggttgaaaatgtttaattttggtatcgcgtagttggtacggggttttgtcgagttagttttaggtagagggttgcgtattaggttttcgtttcgtatcgtttgttcggcgcgtttcgtattggttttcgaagcgtcgggatagtttgggggagcgcgcggtcggttcgttagtttcgggttttgtttgcg

SEQ ID NO: 1044 - DNA, 954 bp, Artificial Sequence
  chemically treated genomic DNA (Homo sapiens) CpG-island No: 1044
cgcaaacaaaacccgaaactaacgaaccgaccgcgcgctcccccaaactatcccgacgcttcgaaaaccaatacgaaacgcgccgaacaaacgatacgaaacgaaaacctaatacgcaaccctctacctaaaactaactcgacaaaaccccgtaccaactacgcgataccaaaattaaacattttcaaccgaacgaaacgaaaaaaacgcgaaaacaaaaacgaaaaatacgcactcgctcgaaccaaaacaaaataaaaattcgccccgcgaaaactcacccacgccgtatttctcgtactccgtaaatatccacataactaaaaaaactccgaaatcttcaaactttataatccccgcgccccttctccgactcacaacaatacacaatccccgaacaacgctacaataccgaaacccaacgacttcgcgcgaactacgaacgctaaacaaaatctacgctaaaaactcccgaacccaacgttaacactacgccgcccgcaactctcccgacgacgactactcacaatcctccgacgcgctcccgaatacccgacgacgcaatcattattctaattcactaaactaaacgaacacgccgaaacactctccgacgcacccccgcccgccaacgcctaatccaaccctcccgtcccaaaaccccgcaacacgctaaaaattataattcttaacctccccatcccgaaaataaacgcgacaaatataattcgaaacgaaaattcaattttactaattacgtcctattaatccaaaacgcgacgtaaatataaaaaaaacattacgtcgacgaaaaattcgcctccaataacgtttctactaataccaccccgcctccgacccgccctacgaccctcccttttcttttctaccgaataataactacttccaaaacccaaaaaactatcgcccgaatacaaaaaaaccgtaataaaa

SEQ ID NO: 1045 - DNA, 674 bp, Artificial Sequence
  chemically treated genomic DNA (Homo sapiens) CpG-island No: 1045
aggcgggcgcgtgttcggtgtttttgaggtagtcgcgggttcggtgttttagaggcggacgtatgttcggtgtttttgaggcgggcgcgtgttcggtggttttaaggcgggcgcgtgttcggtgtttttgaggtagtcgcgggttcggtgttttagaggcggacgcgtgttcggtgttttagaggcggacgtatgttcggtggttttaaggcgggcgcgtgttcggtgtttttgaggtagtcgcgggtttagtgttttagaggcggacgcgtgttcggtgtttttgaggcgggcgtatgttcggtggttttaaggcgggcgcgtgttcggtgtttttgaggtagtcgcgggttcggtgttttagaggcggacgcgtgttcggtgtttttgaggcgggcgcgtgttcggtgttttagaggtagtcgcgggttcggtgttttagaggcggacgcgtgttcggtgttttagaggcggacgtatgttcggtggttttaaggcgggtacgtgttcggtgtttttgaggtagtcgcgggtttagtgttttagaggcggacgcgtgttcggtgtttttgaggcgggcgtatgttcggtggttttaaggcgggcgcgtgttcggtgtttttgaggtagtcgcgggtttagtgttttagaggcggacgcgtgttcggtgtttt

SEQ ID NO: 1046 - DNA, 674 bp, Artificial Sequence
  chemically treated genomic DNA (Homo sapiens) CpG-island No: 1046
aaaacaccgaacacgcgtccgcctctaaaacactaaacccgcgactacctcaaaaacaccgaacacgcgcccgccttaaaaccaccgaacatacgcccgcctcaaaaacaccgaacacgcgtccgcctctaaaacactaaacccgcgactacctcaaaaacaccgaacacgtacccgccttaaaaccaccgaacatacgtccgcctctaaaacaccgaacacgcgtccgcctctaaaacaccgaacccgcgactacctctaaaacaccgaacacgcgcccgcctcaaaaacaccgaacacgcgtccgcctctaaaacaccgaacccgcgactacctcaaaaacaccgaacacgcgcccgccttaaaaccaccgaacatacgcccgcctcaaaaacaccgaacacgcgtccgcctctaaaacactaaacccgcgactacctcaaaaacaccgaacacgcgcccgccttaaaaccaccgaacatacgtccgcctctaaaacaccgaacacgcgtccgcctctaaaacaccgaacccgcgactacctcaaaaacaccgaacacgcgcccgccttaaaaccaccgaacacgcgcccgcctcaaaaacaccgaacatacgtccgcctctaaaacaccgaacccgcgactacctcaaaaacaccgaacacgcgcccgcct

SEQ ID NO: 1047 - DNA, 674 bp, Artificial Sequence
  chemically treated genomic DNA (Homo sapiens) CpG-island No: 1047
gaaatatcgggtacgcgttcgtttttgaaatattgggttcgcggttgttttagaaatatcgggtacgcgttcgttttagagttatcgggtatgcgttcgttttagaaatatcgggtacgcgttcgtttttgaaatattgggttcgcggttgttttagaaatatcgggtacgtgttcgttttagagttatcgggtatgcgttcgtttttgaaatatcgggtacgcgttcgtttttgaaatatcgggttcgcggttgtttttgaaatatcgggtacgcgttcgttttagaaatatcgggtacgcgttcgtttttgaaatatcgggttcgcggttgttttagaaatatcgggtacgcgttcgttttagagttatcgggtatgcgttcgttttagaaatatcgggtacgcgttcgtttttgaaatattgggttcgcggttgttttagaaatatcgggtacgcgttcgttttagagttatcgggtatgcgttcgtttttgaaatatcgggtacgcgttcgtttttgaaatatcgggttcgcggttgttttagaaatatcgggtacgcgttcgttttagagttatcgggtacgcgttcgttttagaaatatcgggtatgcgttcgtttttgaaatatcgggttcgcggttgttttagaaatatcgggtacgcgttcgttt

SEQ ID NO: 1048 - DNA, 674 bp, Artificial Sequence
  chemically treated genomic DNA (Homo sapiens) CpG-island No: 1048
aaacgaacgcgtacccgatatttctaaaacaaccgcgaacccgatatttcaaaaacgaacgcatacccgatatttctaaaacgaacgcgtacccgataactctaaaacgaacgcgtacccgatatttctaaaacaaccgcgaacccgatatttcaaaaacgaacgcgtacccgatatttcaaaaacgaacgcatacccgataactctaaaacgaacgcgtacccgatatttctaaaacaaccgcgaacccaatatttcaaaaacgaacgcgtacccgatatttctaaaacgaacgcatacccgataactctaaaacgaacgcgtacccgatatttctaaaacaaccgcgaacccgatatttcaaaaacgaacgcgtacccgatatttctaaaacgaacgcgtacccgatatttcaaaaacaaccgcgaacccgatatttcaaaaacgaacgcgtacccgatatttcaaaaacgaacgcatacccgataactctaaaacgaacacgtacccgatatttctaaaacaaccgcgaacccaatatttcaaaaacgaacgcgtacccgatatttctaaaacgaacgcatacccgataactctaaaacgaacgcgtacccgatatttctaaaacaaccgcgaacccaatatttcaaaaacgaacgcgtacccgatatttc

SEQ ID NO: 1049 - DNA, 606 bp, Artificial Sequence
  chemically treated genomic DNA (Homo sapiens) CpG-island No: 1049
cgcgtcgcgcgttcgggagtagtttcgcgtgttcggggagcgttagtcgttgttgtttcgcggtgcgcggggttttcgacggtggcggcgggcggcgggcgcggtcgtgttgttggtggagatgttggagcgcgtcgtttttttcggcgttatcgttaatttcgtgttgtattttaatagtattaattttaattggatcggcgagtaggcgacgcgcgtcgcgttggtatttttgggcgttttttatttgttggcgttcgtgggcggttggttggtcgacgtgtatttgggtcgttatcgcgcggtcgcgtttagtttgttgttttatttggtcgtttcgggtttgttgttcgttatcgtttttttcgacggtcgtagttttttttgcggagagatgttcgcgtcgtcgttgggatttgtttgtttttcggtcggttgttcgcgtttttcgtttagtttttattgcgcgttcgttttttacgcgggtttgttgttattcggtttggtcgttagtttcgttcggagtaattttatttttttcggtgtcgattaggtgagtggtaggaggtttgtttcggtatatttcggcgggtgtggagggaagga

SEQ ID NO: 1050 - DNA, 606 bp, Artificial Sequence
  chemically treated genomic DNA (Homo sapiens) CpG-island No: 1050
tccttccctccacacccgccgaaatataccgaaacaaacctcctaccactcacctaatcgacaccgaaaaaaataaaattactccgaacgaaactaacgaccaaaccgaataacaacaaacccgcgtaaaaaacgaacgcgcaataaaaactaaacgaaaaacgcgaacaaccgaccgaaaaacaaacaaatcccaacgacgacgcgaacatctctccgcaaaaaaaactacgaccgtcgaaaaaaacgataacgaacaacaaacccgaaacgaccaaataaaacaacaaactaaacgcgaccgcgcgataacgacccaaatacacgtcgaccaaccaaccgcccacgaacgccaacaaataaaaaacgcccaaaaataccaacgcgacgcgcgtcgcctactcgccgatccaattaaaattaatactattaaaatacaacacgaaattaacgataacgccgaaaaaaacgacgcgctccaacatctccaccaacaacacgaccgcgcccgccgcccgccgccaccgtcgaaaaccccgcgcaccgcgaaacaacaacgactaacgctccccgaacacgcgaaactactcccgaacgcgcgacgcg

SEQ ID NO: 1051 - DNA, 606 bp, Artificial Sequence
  chemically treated genomic DNA (Homo sapiens) CpG-island No: 1051
tttttttttttatattcgtcggagtatgtcggggtaggttttttgttatttatttggtcggtatcgaaggaggtgaggttgtttcggacggagttggcggttaggtcgagtagtagtaggttcgcgtagaggacgggcgcgtagtaggggttgggcgaggagcgcgggtagtcggtcgaggggtaggtaggttttagcggcgacgcgggtattttttcgtagaaggagttgcggtcgtcggggaaggcggtggcgggtagtaggttcgaggcggttaggtagagtagtaggttgagcgcgatcgcgcggtagcggtttaggtatacgtcggttagttagtcgtttacgggcgttagtaggtaggaggcgtttaggaatattagcgcggcgcgcgtcgtttgttcgtcggtttagttgaagttggtgttgttgaggtatagtacgaggttggcggtgacgtcgaagaaggcggcgcgttttagtatttttattagtagtacggtcgcgttcgtcgttcgtcgttatcgtcgagggtttcgcgtatcgcgaggtagtagcggttggcgtttttcgggtacgcggggttgttttcgggcgcgcggcgcg

SEQ ID NO: 1052 - DNA, 606 bp, Artificial Sequence
  chemically treated genomic DNA (Homo sapiens) CpG-island No: 1052
cgcgccgcgcgcccgaaaacaaccccgcgtacccgaaaaacgccaaccgctactacctcgcgatacgcgaaaccctcgacgataacgacgaacgacgaacgcgaccgtactactaataaaaatactaaaacgcgccgccttcttcgacgtcaccgccaacctcgtactatacctcaacaacaccaacttcaactaaaccgacgaacaaacgacgcgcgccgcgctaatattcctaaacgcctcctacctactaacgcccgtaaacgactaactaaccgacgtatacctaaaccgctaccgcgcgatcgcgctcaacctactactctacctaaccgcctcgaacctactacccgccaccgccttccccgacgaccgcaactccttctacgaaaaaatacccgcgtcgccgctaaaacctacctacccctcgaccgactacccgcgctcctcgcccaacccctactacgcgcccgtcctctacgcgaacctactactactcgacctaaccgccaactccgtccgaaacaacctcacctccttcgataccgaccaaataaataacaaaaaacctaccccgacatactccgacgaatataaaaaaaaaaa

SEQ ID NO: 1053 - DNA, 754 bp, Artificial Sequence
  chemically treated genomic DNA (Homo sapiens) CpG-island No: 1053
tttttcggagatagggtgttagtggtatgtgttatttcgaacggcgcgttttttgttaagcgttgaggggtagcgtcgttggtaaggaacgtggcgcgatttatgagtttggggtttttcgaagggttcgagtcgaggttgtaggaggttgggtcgtgggtcggggttcgggggttcgggtttggcgttggtttggtttttacgttcgggagtcgttttatttttgtcggatttcggaatttcgtcgtaattttttttttttcggaaacgtgcgtttttcgggttgtttggaaacgacgttttcggttgtatagtaacggggattcgggttttcggtttgtttcgtacgttgggcgcgcggatttttttttattcggattttttaggtttcgcggtttcgtttggtgtcgtttgtagcggttgttgtttttttttttcgtgcgttgttttatatttcgatttcggttcgtttttattttttttaggttattgttattttttacgtgcgatttcgttgaaacgcgttattaaattcgcgttttaattcggggcgttggtttatttttttcgtatgcgtaaggcgggatgagttcggagattagtcggttttttttataatcgaagtttgtgtcgggagcgtatgcgtttcgttttatttattgcgtttttttttttttttataagtatttttatcgagagaagaatgggatcggaagttttagtagggaacggaagtttttggttggaaagggga

SEQ ID NO: 1054 - DNA, 754 bp, Artificial Sequence
  chemically treated genomic DNA (Homo sapiens) CpG-island No: 1054
tcccctttccaaccaaaaacttccgttccctactaaaacttccgatcccattcttctctcgataaaaatacttataaaaaaaaaaaaaaacgcaataaataaaacgaaacgcatacgctcccgacacaaacttcgattataaaaaaaaccgactaatctccgaactcatcccgccttacgcatacgaaaaaaataaaccaacgccccgaattaaaacgcgaatttaataacgcgtttcaacgaaatcgcacgtaaaaaataacaataacctaaaaaaaataaaaacgaaccgaaatcgaaatataaaacaacgcacgaaaaaaaaaaacaacaaccgctacaaacgacaccaaacgaaaccgcgaaacctaaaaaatccgaataaaaaaaaatccgcgcgcccaacgtacgaaacaaaccgaaaacccgaatccccgttactatacaaccgaaaacgtcgtttccaaacaacccgaaaaacgcacgtttccgaaaaaaaaaaaattacgacgaaattccgaaatccgacaaaaataaaacgactcccgaacgtaaaaaccaaaccaacgccaaacccgaacccccgaaccccgacccacgacccaacctcctacaacctcgactcgaacccttcgaaaaaccccaaactcataaatcgcgccacgttccttaccaacgacgctacccctcaacgcttaacaaaaaacgcgccgttcgaaataacacataccactaacaccctatctccgaaaaa

SEQ ID NO: 1055 - DNA, 754 bp, Artificial Sequence
  chemically treated genomic DNA (Homo sapiens) CpG-island No: 1055
ttttttttttagttagagattttcgttttttgttggaattttcgattttatttttttttcggtgggaatgtttgtggggggaaaaagaaacgtaatagataaagcggggcgtatgcgttttcggtataggtttcgattgtgaggaaggtcggttagttttcgagtttatttcgttttgcgtatgcggagaaggtaaattagcgtttcgagttgaggcgcgggtttggtggcgcgttttagcgaagtcgtacgtgaaggatagtagtggtttgagaaaggtgagagcgggtcgaggtcggaatgtggggtagcgtacgggaaggggagatagtagtcgttgtaggcggtattaggcggagtcgcgaggtttggagagttcgagtggggaggggttcgcgcgtttagcgtgcgaaataaatcggggattcggattttcgttgttatgtaatcgggggcgtcgtttttaggtaattcgggaggcgtacgttttcggggagaagagggttgcggcgaggtttcgaggttcggtagaggtggagcggttttcgggcgtggggattaggttagcgttaagttcgagttttcgaatttcgatttacggtttagttttttgtagtttcggttcgagtttttcggggggttttaaatttatgggtcgcgttacgttttttgttagcgacgttattttttagcgtttggtaggggacgcgtcgttcgaaatagtatatgttattgatattttgttttcgggagg

SEQ ID NO: 1056 - DNA, 754 bp, Artificial Sequence
  chemically treated genomic DNA (Homo sapiens) CpG-island No: 1056
cctcccgaaaacaaaatatcaataacatatactatttcgaacgacgcgtcccctaccaaacgctaaaaaataacgtcgctaacaaaaaacgtaacgcgacccataaatttaaaaccccccgaaaaactcgaaccgaaactacaaaaaactaaaccgtaaatcgaaattcgaaaactcgaacttaacgctaacctaatccccacgcccgaaaaccgctccacctctaccgaacctcgaaacctcgccgcaaccctcttctccccgaaaacgtacgcctcccgaattacctaaaaacgacgcccccgattacataacaacgaaaatccgaatccccgatttatttcgcacgctaaacgcgcgaacccctccccactcgaactctccaaacctcgcgactccgcctaataccgcctacaacgactactatctccccttcccgtacgctaccccacattccgacctcgacccgctctcacctttctcaaaccactactatccttcacgtacgacttcgctaaaacgcgccaccaaacccgcgcctcaactcgaaacgctaatttaccttctccgcatacgcaaaacgaaataaactcgaaaactaaccgaccttcctcacaatcgaaacctataccgaaaacgcatacgccccgctttatctattacgtttctttttccccccacaaacattcccaccgaaaaaaaaataaaatcgaaaattccaacaaaaaacgaaaatctctaactaaaaaaaaaa

SEQ ID NO: 1057 - DNA, 588 bp, Artificial Sequence
  chemically treated genomic DNA (Homo sapiens) CpG-island No: 1057
tcggcgttttacggaacgagtcgagttaattcggaaataatcgagtgttcgtggcgggtttttttttgttcggttgtattttgggaaagggtaattttcgttaggtgttgaaggttgtggcgcgcggttgtttttatttttacgtgaagcgttacgttagtatcgttcggttggcggtttttagttcgtcgcggagtagtttcggtagtagcgggggatcggaagtggttcgcggaggtttagaagttagtttcggagttcggcgtgtggcgtttcggagtacggtgacggcgttatgtttttaatttgttttagtgagtgttggttgcggttaagcgcgggttttaggaggttagagagcggcgcgggagcgtgtgcggttcgttgcggcgttcgggtcggggtggaggcgggaatggggcgtttcggaggtcgagcggcggtttgttagtatcggagtttttttcgtcggagcggggtgtatttgcgtagtgtttcgtagtttatatagtgtttgaggtttattgtcgtagatattattgaggtcggtcgttttattttatagagtggaaataggtttggatagag

SEQ ID NO: 1058 - DNA, 588 bp, Artificial Sequence
  chemically treated genomic DNA (Homo sapiens) CpG-island No: 1058
ctctatccaaacctatttccactctataaaataaaacgaccgacctcaataatatctacgacaataaacctcaaacactatataaactacgaaacactacgcaaatacaccccgctccgacgaaaaaaactccgatactaacaaaccgccgctcgacctccgaaacgccccattcccgcctccaccccgacccgaacgccgcaacgaaccgcacacgctcccgcgccgctctctaacctcctaaaacccgcgcttaaccgcaaccaacactcactaaaacaaattaaaaacataacgccgtcaccgtactccgaaacgccacacgccgaactccgaaactaacttctaaacctccgcgaaccacttccgatcccccgctactaccgaaactactccgcgacgaactaaaaaccgccaaccgaacgatactaacgtaacgcttcacgtaaaaataaaaacaaccgcgcgccacaaccttcaacacctaacgaaaattaccctttcccaaaatacaaccgaacaaaaaaaaacccgccacgaacactcgattatttccgaattaactcgactcgttccgtaaaacgccga

SEQ ID NO: 1059 - DNA, 588 bp, Artificial Sequence
  chemically treated genomic DNA (Homo sapiens) CpG-island No: 1059
ttttgtttagatttgtttttattttgtagaatgaggcgatcggttttagtaatgtttgcgataataaattttaggtattatgtaaattgcggggtattgcgtaaatgtatttcgtttcgacggggggggtttcggtgttgataggtcgtcgttcggttttcggagcgttttattttcgtttttatttcggttcgggcgtcgtagcggatcgtatacgttttcgcgtcgttttttggttttttgagattcgcgtttggtcgtagttaatatttattggagtagattagggatatggcgtcgttatcgtgtttcgaggcgttatacgtcgggtttcgggattagtttttgagttttcgcgagttattttcggtttttcgttgttgtcgggattgtttcgcggcgagttgggagtcgttagtcgagcgatgttagcgtagcgttttacgtgggaatggggatagtcgcgcgttatagtttttagtatttaacggaaattgtttttttttagaatgtagtcgggtaggaaagggttcgttacgaatattcggttattttcggattgattcggttcgtttcgtaaagcgtcgg

SEQ ID NO: 1060 - DNA, 588 bp, Artificial Sequence
  chemically treated genomic DNA (Homo sapiens) CpG-island No: 1060
ccgacgctttacgaaacgaaccgaatcaatccgaaaataaccgaatattcgtaacgaaccctttcctacccgactacattctaaaaaaaaacaatttccgttaaatactaaaaactataacgcgcgactatccccattcccacgtaaaacgctacgctaacatcgctcgactaacgactcccaactcgccgcgaaacaatcccgacaacaacgaaaaaccgaaaataactcgcgaaaactcaaaaactaatcccgaaacccgacgtataacgcctcgaaacacgataacgacgccatatccctaatctactccaataaatattaactacgaccaaacgcgaatctcaaaaaaccaaaaaacgacgcgaaaacgtatacgatccgctacgacgcccgaaccgaaataaaaacgaaaataaaacgctccgaaaaccgaacgacgacctatcaacaccgaaaccccccccgtcgaaacgaaatacatttacgcaataccccgcaatttacataatacctaaaatttattatcgcaaacattactaaaaccgatcgcctcattctacaaaataaaaacaaatctaaacaaaa

SEQ ID NO: 1061 - DNA, 890 bp, Artificial Sequence
  chemically treated genomic DNA (Homo sapiens) CpG-island No: 1061
gcggtcggtgtgggcgtagaattatcgtatcgtggtcgcggcgtataaagtttgtttggtgttttgggtattagcggtgtttaatacggtgttttatttcgtgtttcgggatattatttcgcggttggacgggcgtattatgtgttattataatgtgttgtttttgaattcggggtttgatcgcgatgttacgtgtaattcgcgttaggcggttttggtcgttagtaagtttttgttggtttttttggtgtcgttggcgattatcgtttcgagttacgcggtcgtgagtttgcggttgtagtatcgcggtcgtcggcggttaggtcgtttcgtgcgtttggtggcggtcgtcgtggtcgttttcgcgttttgttgggggttttattacgtgtttagtttgttggaggcgcgggcgtacgtaaattcggggttgcggtcgttcgtgtggcgcgggttgtttttcgttattagtttggttttttttaatagcgtggttaattcggtgttttacgtgtttatttgtttcgatatgttgcgtaagttgcggcgttcgttgcgtacggtgttggagagcgtgttggtggacgatagcgagttgggtggcgcgggaagtagtcgtcgtcgtcgtattttttttatcgttcgttcggttttttttttagttttttgtagtcgttcggaggaatcgcggggtttcgcgcgttttttcggttggttgttgggtagttgcgtagcgttttcgtagacgggttttttgaatcgggcgttgagtagtatttcgagttagaattcggtttacgtagggcggtatttatacgcgaaagtattattagggtgtcgcggtttaattcgatattcggatttttgtcgtagtgattaaagttcgaggg

SEQ ID NO: 1062 - DNA, 890 bp, Artificial Sequence
  chemically treated genomic DNA (Homo sapiens) CpG-island No: 1062
ccctcgaactttaatcactacgacaaaaatccgaatatcgaattaaaccgcgacaccctaataatactttcgcgtataaataccgccctacgtaaaccgaattctaactcgaaatactactcaacgcccgattcaaaaaacccgtctacgaaaacgctacgcaactacccaacaaccaaccgaaaaaacgcgcgaaaccccgcgattcctccgaacgactacaaaaaactaaaaaaaaaaccgaacgaacgataaaaaaaatacgacgacgacgactacttcccgcgccacccaactcgctatcgtccaccaacacgctctccaacaccgtacgcaacgaacgccgcaacttacgcaacatatcgaaacaaataaacacgtaaaacaccgaattaaccacgctattaaaaaaaaccaaactaataacgaaaaacaacccgcgccacacgaacgaccgcaaccccgaatttacgtacgcccgcgcctccaacaaactaaacacgtaataaaacccccaacaaaacgcgaaaacgaccacgacgaccgccaccaaacgcacgaaacgacctaaccgccgacgaccgcgatactacaaccgcaaactcacgaccgcgtaactcgaaacgataatcgccaacgacaccaaaaaaaccaacaaaaacttactaacgaccaaaaccgcctaacgcgaattacacgtaacatcgcgatcaaaccccgaattcaaaaacaacacattataataacacataatacgcccgtccaaccgcgaaataatatcccgaaacacgaaataaaacaccgtattaaacaccgctaatacccaaaacaccaaacaaactttatacgccgcgaccacgatacgataattctacgcccacaccgaccgc

SEQ ID NO: 1063 - DNA, 890 bp, Artificial Sequence
  chemically treated genomic DNA (Homo sapiens) CpG-island No: 1063
ttttcggattttgattattgcggtaggagttcggatatcgaattgaatcgcggtattttggtgatattttcgcgtgtgagtgtcgttttacgtgggtcgggttttaattcgaggtgttgtttagcgttcggtttagggggttcgtttgcggggacgttgcgtagttgtttagtagttagtcgaggagacgcgcggggtttcgcggttttttcgggcggttgtagagagttaaaggggaggtcgagcgggcggtggaggaggtgcggcggcggcggttgtttttcgcgttatttagttcgttgtcgtttattagtacgttttttagtatcgtgcgtagcgagcgtcgtagtttgcgtagtatgtcggggtaggtgagtacgtagagtatcgggttggttacgttgttgaagaaggttaggttggtgacgaagggtagttcgcgttatacgagcggtcgtagtttcgggtttgcgtgcgttcgcgtttttagtaggttgaatacgtggtagggtttttagtagagcgcgaaggcggttacgacggtcgttattaggcgtacgaagcggtttggtcgtcggcggtcgcggtgttgtaatcgtaggtttacggtcgcgtggttcgaggcgatgatcgttagcggtattaggaaggttagtaggaatttgttgacggttagggtcgtttggcgcgagttgtacgtggtatcgcggttaggtttcgggtttaggagtagtatattgtagtagtatataatgcgttcgtttagtcgcgagatggtgtttcggaatacgaaatagggtatcgtgttgagtatcgttagtgtttaaagtattaggtagattttgtgcgtcgcggttacggtgcggtggttttgcgtttatatcggtcgt

SEQ ID NO: 1064 - DNA, 890 bp, Artificial Sequence
  chemically treated genomic DNA (Homo sapiens) CpG-island No: 1064
acgaccgatataaacgcaaaaccaccgcaccgtaaccgcgacgcacaaaatctacctaatactttaaacactaacgatactcaacacgataccctatttcgtattccgaaacaccatctcgcgactaaacgaacgcattatatactactacaatatactactcctaaacccgaaacctaaccgcgataccacgtacaactcgcgccaaacgaccctaaccgtcaacaaattcctactaaccttcctaataccgctaacgatcatcgcctcgaaccacgcgaccgtaaacctacgattacaacaccgcgaccgccgacgaccaaaccgcttcgtacgcctaataacgaccgtcgtaaccgccttcgcgctctactaaaaaccctaccacgtattcaacctactaaaaacgcgaacgcacgcaaacccgaaactacgaccgctcgtataacgcgaactacccttcgtcaccaacctaaccttcttcaacaacgtaaccaacccgatactctacgtactcacctaccccgacatactacgcaaactacgacgctcgctacgcacgatactaaaaaacgtactaataaacgacaacgaactaaataacgcgaaaaacaaccgccgccgccgcacctcctccaccgcccgctcgacctcccctttaactctctacaaccgcccgaaaaaaccgcgaaaccccgcgcgtctcctcgactaactactaaacaactacgcaacgtccccgcaaacgaaccccctaaaccgaacgctaaacaacacctcgaattaaaacccgacccacgtaaaacgacactcacacgcgaaaatatcaccaaaataccgcgattcaattcgatatccgaactcctaccgcaataatcaaaatccgaaaa

SEQ ID NO: 1065 - DNA, 1696 bp, Artificial Sequence
  chemically treated genomic DNA (Homo sapiens) CpG-island No: 1065
  misc_feature (34)..(34): n is either a, c, g or t
  misc_feature (121)..(121): n is either a, c, g or t
  misc_feature (289)..(289): n is either a, c, g or t
  misc_feature (298)..(298): n is either a, c, g or t
  misc_feature (542)..(542): n is either a, c, g or t
  misc_feature (778)..(778): n is either a, c, g or t
  misc_feature (921)..(921): n is either a, c, g or t
  misc_feature (1054)..(1054): n is either a, c, g or t
  misc_feature (1090)..(1090): n is either a, c, g or t
  misc_feature (1092)..(1092): n is either a, c, g or t
  misc_feature (1132)..(1132): n is either a, c, g or t
  misc_feature (1166)..(1166): n is either a, c, g or t
  misc_feature (1170)..(1170): n is either a, c, g or t
  misc_feature (1172)..(1172): n is either a, c, g or t
  misc_feature (1174)..(1174): n is either a, c, g or t
  misc_feature (1201)..(1201): n is either a, c, g or t
  misc_feature (1216)..(1216): n is either a, c, g or t
  misc_feature (1219)..(1219): n is either a, c, g or t
  misc_feature (1228)..(1228): n is either a, c, g or t
  misc_feature (1252)..(1252): n is either a, c, g or t
  misc_feature (1273)..(1273): n is either a, c, g or t
  misc_feature (1307)..(1307): n is either a, c, g or t
  misc_feature (1323)..(1323): n is either a, c, g or t
  misc_feature (1331)..(1331): n is either a, c, g or t
  misc_feature (1346)..(1346): n is either a, c, g or t
  misc_feature (1406)..(1406): n is either a, c, g or t
  misc_feature (1420)..(1420): n is either a, c, g or t
  misc_feature (1422)..(1422): n is either a, c, g or t
  misc_feature (1444)..(1444): n is either a, c, g or t
  misc_feature (1453)..(1453): n is either a, c, g or t
  misc_feature (1455)..(1455): n is either a, c, g or t
  misc_feature (1465)..(1465): n is either a, c, g or t
  misc_feature (1475)..(1475): n is either a, c, g or t
  misc_feature (1491)..(1491): n is either a, c, g or t
  misc_feature (1516)..(1516): n is either a, c, g or t
  misc_feature (1584)..(1584): n is either a, c, g or t
  misc_feature (1643)..(1643): n is either a, c, g or t
  misc_feature (1685)..(1685): n is either a, c, g or t
  misc_feature (1688)..(1688): n is either a, c, g or t
  misc_feature (1691)..(1691): n is either a, c, g or t
gagacgtagagtatcggtgattgcgggagcgagncgttgcgtagaggcgaggtgagcgagagtgtagatcgagtagtttgcgaggtagtgagacgttgagcgattgtgtgtgtgcgtgagncgtgagggtgaaggacgcgtggtgcgtgtgtgtggtgtgtgtgtggtgtgtgtgcggcgcgtagggagatgtgtggtgtgagagagagagtgggtgtgggatgatgtggtgcgagacgaagagcgtagcggtcgatgagtgagtagagtggtgcgagatgtagagcgnaggtagagncgtgtgcgatgaggcgagaggagcgagtggtgtgtggtgttgtgtgggtaggtggtgtgagagtgggtgtggttggggggaggagagtgagtgggtgcgtagagtgcgagagcgatgtgagagagatgagtagtggacgttgggcggcgagagttgtgtggttgagtggagcgtgtgtgcgtgtgagggtgtgtgcgtgtgagcgtgagcgcgagcgtgcgagcgagcgtggcgcgcgcgtgtnagcgtgagtgagggagcgcgtgagcgagggagcgtggtgaggtagagtgcgtgggagcgtgtgagagtgtgtgcgagcgtgtgcgagcgagcgtgtgtgtgtgtgtgtgtgtgtgtgtgagagagggcgcgagggagggtgtgcgagagagtgggggcgagcgtgagtgagggcgcgagcgagcgcgagtgcgtgtggggtgttggagcgtgggggtgagcgagagagcgtgcgtngagcggtggcgcgcggagtagtgtggagagagcggagtgtggcgtgcgtgtggtgtgtgggagagtgcgtgcgcgtgagagagtgagggcgtggggtcgtgtgaggagaggatgcgtggtagtgtagagtagtgggcgcgtangagtgagatgtgtgtgtcgtgagggtggtgtgtggtgaggagcgagtagggggattgtgtagcgcggtggtgtgtagcgtagcgggcgtgggatgttacgagagcgttggcgtgagggcgcgtggcgagggtnggaatcgtgttgtgcgcgagcggttgtggaagcggntngcggtagagaagatgggcgtgggggcggtgtgaggaatgngtagtgggagtgcgtagttgggggtggcgcgagnggtngntntaagggttgcgagcgtgtatgcgtgtntgaaagcggagggtnagngggtgcgtnaggtagaggcgaagagaaggcgantgagtgcgtaatgggtagganagatatgttgtgcgatggcgcgcgagcgaggatnggtgtggcggagagantgagtgangagcgagcgtgaggngcgagggaggcgagatggtagaattggcgggcggtttgaggatgaagtcgcggtcgatgnggcgttgtgtgtgngngagtggggggcgtgcgagaggngatgtgtgnantgagagggtngattttcganaggggacgatttgtgngtggcgtggtcggcgaaggggaagngtagtgtgtcgtgggagtaggatgcgtgtaggatggtcgttcgttgtttgagggcgagagatgtcgtngggcgaagtgcgtaggagaagaagtgcggtgttgagaaaagtgtaggaggcgtagttgngatcgtcgagagttgaagtataaagagaaaagttcgtggtanagnggnagatg

SEQ ID NO: 1066 - DNA, 1696 bp, Artificial Sequence
  chemically treated genomic DNA (Homo sapiens) CpG-island No: 1066
  misc_feature (6)..(6): n is either a, c, g or t
  misc_feature (9)..(9): n is either a, c, g or t
  misc_feature (12)..(12): n is either a, c, g or t
  misc_feature (54)..(54): n is either a, c, g or t
  misc_feature (113)..(113): n is either a, c, g or t
  misc_feature (181)..(181): n is either a, c, g or t
  misc_feature (206)..(206): n is either a, c, g or t
  misc_feature (222)..(222): n is either a, c, g or t
  misc_feature (232)..(232): n is either a, c, g or t
  misc_feature (242)..(242): n is either a, c, g or t
  misc_feature (244)..(244): n is either a, c, g or t
  misc_feature (253)..(253): n is either a, c, g or t
  misc_feature (275)..(275): n is either a, c, g or t
  misc_feature (277)..(277): n is either a, c, g or t
  misc_feature (291)..(291): n is either a, c, g or t
  misc_feature (351)..(351): n is either a, c, g or t
  misc_feature (366)..(366): n is either a, c, g or t
  misc_feature (374)..(374): n is either a, c, g or t
  misc_feature (390)..(390): n is either a, c, g or t
  misc_feature (424)..(424): n is either a, c, g or t
  misc_feature (445)..(445): n is either a, c, g or t
  misc_feature (469)..(469): n is either a, c, g or t
  misc_feature (478)..(478): n is either a, c, g or t
  misc_feature (481)..(481): n is either a, c, g or t
  misc_feature (496)..(496): n is either a, c, g or t
  misc_feature (523)..(523): n is either a, c, g or t
  misc_feature (525)..(525): n is either a, c, g or t
  misc_feature (527)..(527): n is either a, c, g or t
  misc_feature (531)..(531): n is either a, c, g or t
  misc_feature (565)..(565): n is either a, c, g or t
  misc_feature (605)..(605): n is either a, c, g or t
  misc_feature (607)..(607): n is either a, c, g or t
  misc_feature (643)..(643): n is either a, c, g or t
  misc_feature (776)..(776): n is either a, c, g or t
  misc_feature (919)..(919): n is either a, c, g or t
  misc_feature (1155)..(1155): n is either a, c, g or t
  misc_feature (1399)..(1399): n is either a, c, g or t
  misc_feature (1408)..(1408): n is either a, c, g or t
  misc_feature (1576)..(1576): n is either a, c, g or t
  misc_feature (1663)..(1663): n is either a, c, g or t
catctnccnctntaccacgaacttttctctttatacttcaactctcgacgatcncaactacgcctcctacacttttctcaacaccgcacttcttctcctacgcacttcgcccnacgacatctctcgccctcaaacaacgaacgaccatcctacacgcatcctactcccacgacacactacncttccccttcgccgaccacgccacncacaaatcgtcccctntcgaaaatcnaccctctcantncacacatcncctctcgcacgccccccactcncncacacacaacgccncatcgaccgcgacttcatcctcaaaccgcccgccaattctaccatctcgcctccctcgcncctcacgctcgctcntcactcantctctccgccacaccnatcctcgctcgcgcgccatcgcacaacatatctntcctacccattacgcactcantcgccttctcttcgcctctacctnacgcacccnctnaccctccgctttcanacacgcatacacgctcgcaacccttanancnaccnctcgcgccacccccaactacgcactcccactacncattcctcacaccgcccccacgcccatcttctctaccgcnanccgcttccacaaccgctcgcgcacaacacgattccnaccctcgccacgcgccctcacgccaacgctctcgtaacatcccacgcccgctacgctacacaccaccgcgctacacaatccccctactcgctcctcaccacacaccaccctcacgacacacacatctcactcntacgcgcccactactctacactaccacgcatcctctcctcacacgaccccacgccctcactctctcacgcgcacgcactctcccacacaccacacgcacgccacactccgctctctccacactactccgcgcgccaccgctcnacgcacgctctctcgctcacccccacgctccaacaccccacacgcactcgcgctcgctcgcgccctcactcacgctcgcccccactctctcgcacaccctccctcgcgccctctctcacacacacacacacacacacacacacgctcgctcgcacacgctcgcacacactctcacacgctcccacgcactctacctcaccacgctccctcgctcacgcgctccctcactcacgctnacacgcgcgcgccacgctcgctcgcacgctcgcgctcacgctcacacgcacacaccctcacacgcacacacgctccactcaaccacacaactctcgccgcccaacgtccactactcatctctctcacatcgctctcgcactctacgcacccactcactctcctccccccaaccacacccactctcacaccacctacccacacaacaccacacaccactcgctcctctcgcctcatcgcacacgnctctacctncgctctacatctcgcaccactctactcactcatcgaccgctacgctcttcgtctcgcaccacatcatcccacacccactctctctctcacaccacacatctccctacgcgccgcacacacaccacacacacaccacacacacgcaccacgcgtccttcaccctcacgnctcacgcacacacacaatcgctcaacgtctcactacctcgcaaactactcgatctacactctcgctcacctcgcctctacgcaacgnctcgctcccgcaatcaccgatactctacgtctc

SEQ ID NO: 1067 - DNA, 1696 bp, Artificial Sequence
  chemically treated genomic DNA (Homo sapiens) CpG-island No: 1067
  misc_feature (6)..(6): n is either a, c, g or t
  misc_feature (9)..(9): n is either a, c, g or t
  misc_feature (12)..(12): n is either a, c, g or t
  misc_feature (54)..(54): n is either a, c, g or t
  misc_feature (113)..(113): n is either a, c, g or t
  misc_feature (181)..(181): n is either a, c, g or t
  misc_feature (206)..(206): n is either a, c, g or t
  misc_feature (222)..(222): n is either a, c, g or t
  misc_feature (232)..(232): n is either a, c, g or t
  misc_feature (242)..(242): n is either a, c, g or t
  misc_feature (244)..(244): n is either a, c, g or t
  misc_feature (253)..(253): n is either a, c, g or t
  misc_feature (275)..(275): n is either a, c, g or t
  misc_feature (277)..(277): n is either a, c, g or t
  misc_feature (291)..(291): n is either a, c, g or t
  misc_feature (351)..(351): n is either a, c, g or t
  misc_feature (366)..(366): n is either a, c, g or t
  misc_feature (374)..(374): n is either a, c, g or t
  misc_feature (390)..(390): n is either a, c, g or t
  misc_feature (424)..(424): n is either a, c, g or t
  misc_feature (445)..(445): n is either a, c, g or t
  misc_feature (469)..(469): n is either a, c, g or t
  misc_feature (478)..(478): n is either a, c, g or t
  misc_feature (481)..(481): n is either a, c, g or t
  misc_feature (496)..(496): n is either a, c, g or t
  misc_feature (523)..(523): n is either a, c, g or t
  misc_feature (525)..(525): n is either a, c, g or t
  misc_feature (527)..(527): n is either a, c, g or t
  misc_feature (531)..(531): n is either a, c, g or t
  misc_feature (565)..(565): n is either a, c, g or t
  misc_feature (605)..(605): n is either a, c, g or t
  misc_feature (607)..(607): n is either a, c, g or t
  misc_feature (643)..(643): n is either a, c, g or t
  misc_feature (776)..(776): n is either a, c, g or t
  misc_feature (919)..(919): n is either a, c, g or t
  misc_feature (1155)..(1155): n is either a, c, g or t
  misc_feature (1399)..(1399): n is either a, c, g or t
  misc_feature (1408)..(1408): n is either a, c, g or t
  misc_feature (1576)..(1576): n is either a, c, g or t
  misc_feature (1663)..(1663): n is either a, c, g or t
tatttnttnttntattacggatttttttttttatattttagttttcggcggttntagttgcgttttttatattttttttagtatcgtatttttttttttgcgtatttcgtttnacgatatttttcgtttttaagtaacggacgattattttatacgtattttatttttacgatatattgtntttttttttcgtcggttacgttatntataggtcgttttttntcggaagttngtttttttantntatatattntttttcgtacgttttttatttntntatatatagcgttntatcggtcgcgattttatttttaagtcgttcgttaattttgttatttcgtttttttcgtnttttacgttcgtttnttatttanttttttcgttatattnattttcgttcgcgcgttatcgtatagtatatttnttttgtttattacgtatttantcgtttttttttcgtttttgtttngcgtatttnttngtttttcgtttttanatacgtatgtacgttcgtagtttttgnantnattnttcgcgttatttttagttgcgtatttttattgtntattttttatatcgtttttacgtttattttttttgtcgtnantcgtttttatagtcgttcgcgtatagtacgattttnattttcgttacgcgtttttacgttagcgttttcgtagtattttacgttcgttgcgttgtatattatcgcgttgtataatttttttgttcgttttttattatatattatttttacgatatatatattttatttntgcgcgtttattgttttgtattattacgtattttttttttatacgattttacgtttttatttttttacgcgtacgtatttttttatatattatacgtacgttatatttcgttttttttatattgtttcgcgcgttatcgtttnacgtacgttttttcgtttatttttacgttttagtattttatacgtattcgcgttcgttcgcgtttttatttacgttcgtttttattttttcgtatattttttttcgcgtttttttttatatatatatatatatatatatatacgttcgttcgtatacgttcgtatatatttttatacgtttttacgtattttgttttattacgttttttcgtttacgcgtttttttatttacgttngtacgcgcgcgttacgttcgttcgtacgttcgcgtttacgtttatacgtatatatttttatacgtatatacgttttatttagttatatagttttcgtcgtttagcgtttattgtttattttttttatatcgttttcgtattttgcgtatttatttatttttttttttttagttatatttatttttatattatttgtttatatagtattatatattattcgtttttttcgttttatcgtatacgnttttgtttncgttttgtatttcgtattattttgtttatttatcgatcgttgcgtttttcgtttcgtattatattattttatatttatttttttttttatattatatatttttttgcgcgtcgtatatatattatatatatattatatatacgtattacgcgttttttatttttacgntttacgtatatatataatcgtttagcgttttattgtttcgtaagttgttcgatttgtattttcgtttatttcgtttttgcgtagcgnttcgttttcgtaattatcgatgttttgcgtttt

SEQ ID NO: 1068 - DNA, 1696 bp, Artificial Sequence
  chemically treated genomic DNA (Homo sapiens) CpG-island No: 1068
  misc_feature (34)..(34): n is either a, c, g or t
  misc_feature (121)..(121): n is either a, c, g or t
  misc_feature (289)..(289): n is either a, c, g or t
  misc_feature (298)..(298): n is either a, c, g or t
  misc_feature (542)..(542): n is either a, c, g or t
  misc_feature (778)..(778): n is either a, c, g or t
  misc_feature (921)..(921): n is either a, c, g or t
  misc_feature (1054)..(1054): n is either a, c, g or t
  misc_feature (1090)..(1090): n is either a, c, g or t
  misc_feature (1092)..(1092): n is either a, c, g or t
  misc_feature (1132)..(1132): n is either a, c, g or t
  misc_feature (1166)..(1166): n is either a, c, g or t
  misc_feature (1170)..(1170): n is either a, c, g or t
  misc_feature (1172)..(1172): n is either a, c, g or t
  misc_feature (1174)..(1174): n is either a, c, g or t
  misc_feature (1201)..(1201): n is either a, c, g or t
  misc_feature (1216)..(1216): n is either a, c, g or t
  misc_feature (1219)..(1219): n is either a, c, g or t
  misc_feature (1228)..(1228): n is either a, c, g or t
  misc_feature (1252)..(1252): n is either a, c, g or t
  misc_feature (1273)..(1273): n is either a, c, g or t
  misc_feature (1307)..(1307): n is either a, c, g or t
  misc_feature (1323)..(1323): n is either a, c, g or t
  misc_feature (1331)..(1331): n is either a, c, g or t
  misc_feature (1346)..(1346): n is either a, c, g or t
  misc_feature (1406)..(1406): n is either a, c, g or t
  misc_feature (1420)..(1420): n is either a, c, g or t
  misc_feature (1422)..(1422): n is either a, c, g or t
  misc_feature (1444)..(1444): n is either a, c, g or t
  misc_feature (1453)..(1453): n is either a, c, g or t
  misc_feature (1455)..(1455): n is either a, c, g or t
  misc_feature (1465)..(1465): n is either a, c, g or t
  misc_feature (1475)..(1475): n is either a, c, g or t
  misc_feature (1491)..(1491): n is either a, c, g or t
  misc_feature (1516)..(1516): n is either a, c, g or t
  misc_feature (1584)..(1584): n is either a, c, g or t
  misc_feature (1643)..(1643): n is either a, c, g or t
  misc_feature (1685)..(1685): n is either a, c, g or t
  misc_feature (1688)..(1688): n is either a, c, g or t
  misc_feature (1691)..(1691): n is either a, c, g or t
aaaacgcaaaacatcgataattacgaaaacgaancgctacgcaaaaacgaaataaacgaaaatacaaatcgaacaacttacgaaacaataaaacgctaaacgattatatatatacgtaaancgtaaaaataaaaaacgcgtaatacgtatatataatatatatataatatatatacgacgcgcaaaaaaatatataatataaaaaaaaaaataaatataaaataatataatacgaaacgaaaaacgcaacgatcgataaataaacaaaataatacgaaatacaaaacgnaaacaaaancgtatacgataaaacgaaaaaaacgaataatatataatactatataaacaaataatataaaaataaatataactaaaaaaaaaaaaataaataaatacgcaaaatacgaaaacgatataaaaaaaataaacaataaacgctaaacgacgaaaactatataactaaataaaacgtatatacgtataaaaatatatacgtataaacgtaaacgcgaacgtacgaacgaacgtaacgcgcgcgtacnaacgtaaataaaaaaacgcgtaaacgaaaaaacgtaataaaacaaaatacgtaaaaacgtataaaaatatatacgaacgtatacgaacgaacgtatatatatatatatatatatatataaaaaaaaacgcgaaaaaaaatatacgaaaaaataaaaacgaacgtaaataaaaacgcgaacgaacgcgaatacgtataaaatactaaaacgtaaaaataaacgaaaaaacgtacgtnaaacgataacgcgcgaaacaatataaaaaaaacgaaatataacgtacgtataatatataaaaaaatacgtacgcgtaaaaaaataaaaacgtaaaatcgtataaaaaaaaaatacgtaataatacaaaacaataaacgcgcanaaataaaatatatatatcgtaaaaataatatataataaaaaacgaacaaaaaaattatacaacgcgataatatacaacgcaacgaacgtaaaatactacgaaaacgctaacgtaaaaacgcgtaacgaaaatnaaaatcgtactatacgcgaacgactataaaaacgantnacgacaaaaaaaataaacgtaaaaacgatataaaaaatanacaataaaaatacgcaactaaaaataacgcgaanaatnantncaaaaactacgaacgtacatacgtatntaaaaacgaaaaacnaanaaatacgcnaaacaaaaacgaaaaaaaaacgantaaatacgtaataaacaaaanaaatatactatacgataacgcgcgaacgaaaatnaatataacgaaaaaantaaataanaaacgaacgtaaaanacgaaaaaaacgaaataacaaaattaacgaacgacttaaaaataaaatcgcgaccgatanaacgctatatatananaaataaaaaacgtacgaaaaanaatatatanantaaaaaaacnaacttccganaaaaaacgacctatanataacgtaaccgacgaaaaaaaaanacaatatatcgtaaaaataaaatacgtataaaataatcgtccgttacttaaaaacgaaaaatatcgtnaaacgaaatacgcaaaaaaaaaaatacgatactaaaaaaaatataaaaaacgcaactanaaccgccgaaaactaaaatataaaaaaaaaaatccgtaatanaanaanaaata

SEQ ID NO: 1069 - DNA, 564 bp, Artificial Sequence
  chemically treated genomic DNA (Homo sapiens) CpG-island No: 1069
cgtatttatatttttttattagtacggtttatggaggaataatcgtattattataattatttttagtcgagatatattatatttcgttttatattcgtaggttaataatatttttcgtgattattttgtcgtataaatatatttttttttcgtgcgcgacgtttagataattttatttattcgggtataggcgatttttattattatttttttaatttttcgttacgcgtatttatattagaagagaattttcgagcgacgtcgttattttatgttttttacgttattttataagtacgattttatttattattatttcgtcgttaattacgtttttttttttatagagacgtttatttattttttcgttaacgatatattgtttttagagaattatatttttttcgacgcgcggagttatagtacgtattttatacgtagcgttagttatggataatattttttttattttatatttagatatatcggcggtttcggtatatatattttttaggtcgtttttaaattattttttttgttatggtatttttgttatataaaaga

SEQ ID NO: 1070 - DNA, 564 bp, Artificial Sequence
  chemically treated genomic DNA (Homo sapiens) CpG-island No: 1070
tcttttatataacaaaaataccataacaaaaaaaataatttaaaaacgacctaaaaaatatatataccgaaaccgccgatatatctaaatataaaataaaaaaaatattatccataactaacgctacgtataaaatacgtactataactccgcgcgtcgaaaaaaatataattctctaaaaacaatatatcgttaacgaaaaaataaataaacgtctctataaaaaaaaaaacgtaattaacgacgaaataataataaataaaatcgtacttataaaataacgtaaaaaacataaaataacgacgtcgctcgaaaattctcttctaatataaatacgcgtaacgaaaaattaaaaaaataataataaaaatcgcctatacccgaataaataaaattatctaaacgtcgcgcacgaaaaaaaaatatatttatacgacaaaataatcacgaaaaatattattaacctacgaatataaaacgaaatataatatatctcgactaaaaataattataataatacgattattcctccataaaccgtactaataaaaaaatataaatacg

SEQ ID NO: 1071 - DNA, 564 bp, Artificial Sequence
  chemically treated genomic DNA (Homo sapiens) CpG-island No: 1071
ttttttatgtggtaaaaatattatagtaagaggagtggtttgagagcgatttggggagtgtgtgtgtcgaggtcgtcgatgtgtttaagtgtgaggtgagagaggtgttgtttatgattggcgttacgtgtggggtgcgtattgtagtttcgcgcgtcgaggagagtgtgattttttagaggtagtgtgtcgttggcggggaggtagatgagcgtttttgtgaaggagagggcgtagttggcggcgagatagtggtaggtagagtcgtgtttgtgaagtggcgtgagaggtatggagtggcgacgtcgttcggagatttttttttaatgtggatgcgcgtgacgagggattgagaaaatggtggtagggatcgtttgtgttcgagtggatggagttgtttagacgtcgcgtacgggagggaggtgtgtttgtgcgatagggtggttacggagagtgttgttggtttgcgagtgtgaggcggggtgtgatgtgtttcggttgagagtggttgtaatggtacgattgtttttttatagatcgtgttgatgagagagtatgagtgcg

SEQ ID NO: 1072 - DNA, 564 bp, Artificial Sequence
  chemically treated genomic DNA (Homo sapiens) CpG-island No: 1072
cgcactcatactctctcatcaacacgatctataaaaaaacaatcgtaccattacaaccactctcaaccgaaacacatcacaccccgcctcacactcgcaaaccaacaacactctccgtaaccaccctatcgcacaaacacacctccctcccgtacgcgacgtctaaacaactccatccactcgaacacaaacgatccctaccaccattttctcaatccctcgtcacgcgcatccacattaaaaaaaaatctccgaacgacgtcgccactccatacctctcacgccacttcacaaacacgactctacctaccactatctcgccgccaactacgccctctccttcacaaaaacgctcatctacctccccgccaacgacacactacctctaaaaaatcacactctcctcgacgcgcgaaactacaatacgcaccccacacgtaacgccaatcataaacaacacctctctcacctcacacttaaacacatcgacgacctcgacacacacactccccaaatcgctctcaaaccactcctcttactataatatttttaccacataaaaaa

SEQ ID NO: 1073 - DNA, 554 bp, Artificial Sequence
  chemically treated genomic DNA (Homo sapiens) CpG-island No: 1073
gggtaggggcggttcggtcgagtttggtacgaaaagtttaggggttcggcgttttttcgcgttttttttcgttttcggttcggatttgttggggttttagttttttcggggacgttaattcgcgtttatcgtcgttcgtttttaagtttcggcgtcgaaggaggatgtttatttcgttttcgggaaaatgtttattttcgtttattttattcgttttttcgcgtttcgggcggttgtttcgggagggtcgtcgatttatttagggtatcgtaggacgcggacgtcgagatttttagttgggtcgagttagtttcgtagtcgttcggtatcgtcgtttttcgacgtcggttcgaaatcgtttagttcgttatcgttttggttataacggttttgcgtttgcgtacgagggcgggatcgtcgtacggtttagtttttataaagtttcgaagggtcggttggcgcgtatttgttttattttttttaagagtttacgtttttggtcggttcgagttttttggtggtacgcggggaattttttgtttttgattaggtta

SEQ ID NO: 1074 - DNA, 554 bp, Artificial Sequence
  chemically treated genomic DNA (Homo sapiens) CpG-island No: 1074
taacctaatcaaaaacaaaaaattccccgcgtaccaccaaaaaactcgaaccgaccaaaaacgtaaactcttaaaaaaaataaaacaaatacgcgccaaccgacccttcgaaactttataaaaactaaaccgtacgacgatcccgccctcgtacgcaaacgcaaaaccgttataaccaaaacgataacgaactaaacgatttcgaaccgacgtcgaaaaacgacgataccgaacgactacgaaactaactcgacccaactaaaaatctcgacgtccgcgtcctacgataccctaaataaatcgacgaccctcccgaaacaaccgcccgaaacgcgaaaaaacgaataaaataaacgaaaataaacattttcccgaaaacgaaataaacatcctccttcgacgccgaaacttaaaaacgaacgacgataaacgcgaattaacgtccccgaaaaaactaaaaccccaacaaatccgaaccgaaaacgaaaaaaaacgcgaaaaaacgccgaacccctaaacttttcgtaccaaactcgaccgaaccgcccctaccc

SEQ ID NO: 1075 - DNA, 554 bp, Artificial Sequence
  chemically treated genomic DNA (Homo sapiens) CpG-island No: 1075
tagtttggttaggagtaggaggtttttcgcgtgttattaggaagttcgggtcggttaagagcgtagatttttgagaggagtgagataggtgcgcgttagtcggtttttcggggttttatgggaattgggtcgtgcggcggtttcgttttcgtgcgtaggcgtagaatcgttgtgattagagcggtggcgggttgagcggtttcgagtcggcgtcggggagcggcggtatcgggcggttgcggggttggttcgatttagttggaggtttcggcgttcgcgttttgcggtgttttgggtaagtcggcggttttttcggagtagtcgttcgagacgcgggagggcgaatgaaataaacgaaaatagatattttttcgaaggcgaaatagatattttttttcggcgtcggggtttggaggcgggcggcggtgggcgcgggttaacgttttcggggaaattgagattttagtaggttcgggtcgggggcggagaggaacgcgggagggcgtcgggtttttgggtttttcgtattaagttcgatcgagtcgtttttattt

SEQ ID NO: 1076 - DNA, 554 bp, Artificial Sequence
  chemically treated genomic DNA (Homo sapiens) CpG-island No: 1076
aaataaaaacgactcgatcgaacttaatacgaaaaacccaaaaacccgacgccctcccgcgttcctctccgcccccgacccgaacctactaaaatctcaatttccccgaaaacgttaacccgcgcccaccgccgcccgcctccaaaccccgacgccgaaaaaaaatatctatttcgccttcgaaaaaatatctattttcgtttatttcattcgccctcccgcgtctcgaacgactactccgaaaaaaccgccgacttacccaaaacaccgcaaaacgcgaacgccgaaacctccaactaaatcgaaccaaccccgcaaccgcccgataccgccgctccccgacgccgactcgaaaccgctcaacccgccaccgctctaatcacaacgattctacgcctacgcacgaaaacgaaaccgccgcacgacccaattcccataaaaccccgaaaaaccgactaacgcgcacctatctcactcctctcaaaaatctacgctcttaaccgacccgaacttcctaataacacgcgaaaaacctcctactcctaaccaaacta

SEQ ID NO: 1077 - DNA, 544 bp, Artificial Sequence
  chemically treated genomic DNA (Homo sapiens) CpG-island No: 1077
cgtcgtcgttagagggcgtttgggggcggggcgcgggtggggtaaggcggggttcgattggaggtagggcggtgagtcgagaggggcggggtaagggatcgggaggcggggttaggggtcgtaaggcggaagagtttttttcgttttcgattcggcgtttcgtatttcgtttattttcggttttttttcgtatttttgttagtttcgtagcgttgggttggtttttttcgaggtttttaagagttttttattgcgtttcgttcgtcgttcggaagtttttagttttttaaggacgtattatttaatgtcgcggttacggttatcgttataagcgtttttagttttattttatttcggtttgttcgtcgtttttttttcgttttcgtttttgtttgttagttttatcgggtcgtaggtgcggacgattttaaaatttttcggttcgcgaaggtcgttagttgcggggaggggaggggaggcgcggtttcgtagcgtttttaggtttatgttttaggtatgtttagattttcgaggtatcgtttgt

SEQ ID NO: 1078 - DNA, 544 bp, Artificial Sequence
  chemically treated genomic DNA (Homo sapiens) CpG-island No: 1078
acaaacgatacctcgaaaatctaaacatacctaaaacataaacctaaaaacgctacgaaaccgcgcctcccctcccctccccgcaactaacgaccttcgcgaaccgaaaaattttaaaatcgtccgcacctacgacccgataaaactaacaaacaaaaacgaaaacgaaaaaaaaacgacgaacaaaccgaaataaaataaaactaaaaacgcttataacgataaccgtaaccgcgacattaaataatacgtccttaaaaaactaaaaacttccgaacgacgaacgaaacgcaataaaaaactcttaaaaacctcgaaaaaaaccaacccaacgctacgaaactaacaaaaatacgaaaaaaaaccgaaaataaacgaaatacgaaacgccgaatcgaaaacgaaaaaaactcttccgccttacgacccctaaccccgcctcccgatcccttaccccgcccctctcgactcaccgccctacctccaatcgaaccccgccttaccccacccgcgccccgcccccaaacgccctctaacgacgacg

SEQ ID NO: 1079 - DNA, 544 bp, Artificial Sequence
  chemically treated genomic DNA (Homo sapiens) CpG-island No: 1079
gtaagcggtgtttcgggggtttggatatatttgggatatgagtttgggggcgttgcgggatcgcgttttttttttttttttcgtagttggcggttttcgcgggtcgaggaattttgaggtcgttcgtatttacggttcggtggagttggtaggtaggggcgggggcgggagaaggacggcgggtaggtcggggtggggtggggttgggggcgtttgtgacggtggtcgtgatcgcggtattaggtgatgcgtttttgaggggttgggggttttcgggcggcgagcggggcgtagtaggaggtttttagagatttcggaggaaattagtttagcgttacgggattggtaagaatgcgaagaggaatcgagagtgaacggagtgcgaggcgtcgggtcggaggcgagaggggttttttcgttttgcgatttttggtttcgtttttcggttttttgtttcgtttttttcggtttatcgttttgtttttagtcggatttcgttttgttttattcgcgtttcgtttttaggcgttttttagcggcggcg

SEQ ID NO: 1080 - DNA, 544 bp, Artificial Sequence
  chemically treated genomic DNA (Homo sapiens) CpG-island No: 1080
cgccgccgctaaaaaacgcctaaaaacgaaacgcgaataaaacaaaacgaaatccgactaaaaacaaaacgataaaccgaaaaaaacgaaacaaaaaaccgaaaaacgaaaccaaaaatcgcaaaacgaaaaaacccctctcgcctccgacccgacgcctcgcactccgttcactctcgattcctcttcgcattcttaccaatcccgtaacgctaaactaatttcctccgaaatctctaaaaacctcctactacgccccgctcgccgcccgaaaacccccaacccctcaaaaacgcatcacctaataccgcgatcacgaccaccgtcacaaacgcccccaaccccaccccaccccgacctacccgccgtccttctcccgcccccgcccctacctaccaactccaccgaaccgtaaatacgaacgacctcaaaattcctcgacccgcgaaaaccgccaactacgaaaaaaaaaaaaaaaacgcgatcccgcaacgcccccaaactcatatcccaaatatatccaaacccccgaaacaccgcttac

SEQ ID NO: 1081 - DNA, 769 bp, Artificial Sequence
  chemically treated genomic DNA (Homo sapiens) CpG-island No: 1081
cggtaaaacgttttgtttaaagtttattatattattacgtttaagaattgatattttagtagggtaacgtattaattaagcgatttcgttttatttttttcgtttttttagtatacgtaagcgtatagaggttcgcgagtgacgttatttttttcgatattatttcgttgtcgtacgattaaaggtttgtcgtaacggtcgggaaaagtttcgagaagaagggtacgtacgtcgtatattttaatatgttcgttagtatgcgcgcgtaggtttttggcgtaggtattgggattggagttaatgaggtgcggcgacgttattgcgtagtcgttagttcggtcgtacgttagggcgcgggagcgcggagcgagtttggttgtatttatatcggtatttaagcgcggatcggcgtgtttttggatttagagagtggggacgttcggtttcggagcgggagtgttcgttgtgttagcgattaaaaagaggtgagagcgggtcgcggaggtcgtatttggttagaggtagagttgtgggaggcgcgtatttgcgagcgatcgaaatttaagcggggagtattcgagtggagttcgcgttgggtgggagggcggggagtgaagattttggattgtggttagatcgagttgggcgagtaacggtttgaggtgcggcggagttttaattagggataggtatggtttcggttagggattggaggcggtttggatatagattcgaggaggaggcggtttttttcgtagtggttgttgaa

SEQ ID NO: 1082 - DNA, 769 bp, Artificial Sequence
  chemically treated genomic DNA (Homo sapiens) CpG-island No: 1082
ttcaacaaccactacgaaaaaaaccgcctcctcctcgaatctatatccaaaccgcctccaatccctaaccgaaaccatacctatccctaattaaaactccgccgcacctcaaaccgttactcgcccaactcgatctaaccacaatccaaaatcttcactccccgccctcccacccaacgcgaactccactcgaatactccccgcttaaatttcgatcgctcgcaaatacgcgcctcccacaactctacctctaaccaaatacgacctccgcgacccgctctcacctctttttaatcgctaacacaacgaacactcccgctccgaaaccgaacgtccccactctctaaatccaaaaacacgccgatccgcgcttaaataccgatataaatacaaccaaactcgctccgcgctcccgcgccctaacgtacgaccgaactaacgactacgcaataacgtcgccgcacctcattaactccaatcccaatacctacgccaaaaacctacgcgcgcatactaacgaacatattaaaatatacgacgtacgtacccttcttctcgaaacttttcccgaccgttacgacaaacctttaatcgtacgacaacgaaataatatcgaaaaaaataacgtcactcgcgaacctctatacgcttacgtatactaaaaaaacgaaaaaaataaaacgaaatcgcttaattaatacgttaccctactaaaatatcaattcttaaacgtaataatataataaactttaaacaaaacgttttaccg

SEQ ID NO: 1083 - DNA, 769 bp, Artificial Sequence
  chemically treated genomic DNA (Homo sapiens) CpG-island No: 1083
tttagtaattattacggaagaggtcgtttttttttcggatttgtatttaagtcgtttttagtttttgatcgagattatatttgtttttagttagggtttcgtcgtattttaagtcgttattcgtttagttcggtttgattatagtttagggtttttatttttcgtttttttatttagcgcgggttttattcgaatgtttttcgtttgggtttcggtcgttcgtaagtgcgcgttttttatagttttgtttttaattaggtgcggttttcgcgattcgtttttatttttttttagtcgttggtataacgaatattttcgtttcgaagtcggacgtttttattttttaagtttaaggatacgtcggttcgcgtttaagtatcggtgtaagtgtaattaaattcgtttcgcgttttcgcgttttgacgtgcggtcgagttggcggttacgtagtaacgtcgtcgtattttattggttttagttttaatgtttgcgttaaggatttgcgcgcgtatgttggcgagtatgttagggtgtacggcgtgcgtgttttttttttcgaggtttttttcggtcgttacgataggtttttggtcgtacgataacgaggtggtgtcgggagaggtgacgttattcgcgggtttttgtgcgtttgcgtgtgttggaggagcggggagggtggggcggagtcgtttggttggtgcgttgttttgttaaagtattagtttttgggcgtggtgatgtaatgagttttgagtagggcgttttgtcg

SEQ ID NO: 1084 - DNA, 769 bp, Artificial Sequence
  chemically treated genomic DNA (Homo sapiens) CpG-island No: 1084
cgacaaaacgccctactcaaaactcattacatcaccacgcccaaaaactaatactttaacaaaacaacgcaccaaccaaacgactccgccccaccctccccgctcctccaacacacgcaaacgcacaaaaacccgcgaataacgtcacctctcccgacaccacctcgttatcgtacgaccaaaaacctatcgtaacgaccgaaaaaaacctcgaaaaaaaaaacacgcacgccgtacaccctaacatactcgccaacatacgcgcgcaaatccttaacgcaaacattaaaactaaaaccaataaaatacgacgacgttactacgtaaccgccaactcgaccgcacgtcaaaacgcgaaaacgcgaaacgaatttaattacacttacaccgatacttaaacgcgaaccgacgtatccttaaacttaaaaaataaaaacgtccgacttcgaaacgaaaatattcgttataccaacgactaaaaaaaaataaaaacgaatcgcgaaaaccgcacctaattaaaaacaaaactataaaaaacgcgcacttacgaacgaccgaaacccaaacgaaaaacattcgaataaaacccgcgctaaataaaaaaacgaaaaataaaaaccctaaactataatcaaaccgaactaaacgaataacgacttaaaatacgacgaaaccctaactaaaaacaaatataatctcgatcaaaaactaaaaacgacttaaatacaaatccgaaaaaaaaacgacctcttccgtaataattactaaa

SEQ ID NO: 1085 - DNA, 600 bp, Artificial Sequence
  chemically treated genomic DNA (Homo sapiens) CpG-island No: 1085
atttcgcgaggaaatacgcggttttattagtgtgtttatatcgattattattaattcggatcgaatcgattcggattaaggggtcggaggtaggttttgggtattagcggtttcgatattttcgtttttcgcgtcgtattcgagtggtttttagtcgagcgggtttttattttttgattcggtttgggtttttttgcgttttttttggtttttgttcggcgttaggaggtcggtttcgcgtttttcgcggtcgttcgggttcggggtcgcgtcgggcgtttggttttgtacgcgagttcggggatttgcggttttcgtgttttttttttttcgttcgttttttcgtggagttcggcgtcggcggtggttgttcgggcggggggttgcggcgtttaggagaggtttcggtttcgtttcgggtttgtttagggggagagcggagcggttcgtagtcgggtcgggtcggggtttttttagggaggagcgtggagcggtagcggcggcggcggtagtagaaatgatggaagaattgtatagtttggatttacgacggtagaaattattggaggttaggtttattggagtaggtgttagtaaggg

SEQ ID NO: 1086 - DNA, 600 bp, Artificial Sequence
  chemically treated genomic DNA (Homo sapiens) CpG-island No: 1086
cccttactaacacctactccaataaacctaacctccaataatttctaccgtcgtaaatccaaactatacaattcttccatcatttctactaccgccgccgccgctaccgctccacgctcctccctaaaaaaaccccgacccgacccgactacgaaccgctccgctctccccctaaacaaacccgaaacgaaaccgaaacctctcctaaacgccgcaaccccccgcccgaacaaccaccgccgacgccgaactccacgaaaaaacgaacgaaaaaaaaaaaacacgaaaaccgcaaatccccgaactcgcgtacaaaaccaaacgcccgacgcgaccccgaacccgaacgaccgcgaaaaacgcgaaaccgacctcctaacgccgaacaaaaaccaaaaaaaacgcaaaaaaacccaaaccgaatcaaaaaataaaaacccgctcgactaaaaaccactcgaatacgacgcgaaaaacgaaaatatcgaaaccgctaatacccaaaacctacctccgaccccttaatccgaatcgattcgatccgaattaataataatcgatataaacacactaataaaaccgcgtatttcctcgcgaaat

SEQ ID NO: 1087 - DNA, 600 bp, Artificial Sequence
  chemically treated genomic DNA (Homo sapiens) CpG-island No: 1087
tttttattaatatttattttagtaaatttggtttttaataatttttgtcgtcgtgggtttaggttatgtaatttttttattatttttattgtcgtcgtcgtcgttgtcgttttacgtttttttttggagggatttcgattcgattcggttgcggatcgtttcgttttttttttgggtaggttcggggcggagtcggggttttttttgagcgtcgtaatttttcgttcgggtagttatcgtcggcgtcgggttttacgagagggcgggcgggggagggggggtacgaaggtcgtagattttcgggttcgcgtatagagttaggcgttcgacgcggtttcgggttcgggcggtcgcggggggcgcgggatcggttttttggcgtcggataaaggttaagggaggcgtaggagggtttaggtcgggttaggaggtgggggttcgttcggttgggggttattcgggtgcggcgcggagggcgggggtgtcggaatcgttggtgtttaggatttgttttcggttttttaattcggatcggttcggttcggattagtagtgatcggtgtaaatatattagtgaaatcgcgtgttttttcgcgagat

SEQ ID NO: 1088 - DNA, 600 bp, Artificial Sequence
  chemically treated genomic DNA (Homo sapiens) CpG-island No: 1088
atctcgcgaaaaaacacgcgatttcactaatatatttacaccgatcactactaatccgaaccgaaccgatccgaattaaaaaaccgaaaacaaatcctaaacaccaacgattccgacacccccgccctccgcgccgcacccgaataacccccaaccgaacgaacccccacctcctaacccgacctaaaccctcctacgcctcccttaacctttatccgacgccaaaaaaccgatcccgcgccccccgcgaccgcccgaacccgaaaccgcgtcgaacgcctaactctatacgcgaacccgaaaatctacgaccttcgtaccccccctcccccgcccgccctctcgtaaaacccgacgccgacgataactacccgaacgaaaaattacgacgctcaaaaaaaaccccgactccgccccgaacctacccaaaaaaaaaacgaaacgatccgcaaccgaatcgaatcgaaatccctccaaaaaaaaacgtaaaacgacaacgacgacgacgacaataaaaataataaaaaaattacataacctaaacccacgacgacaaaaattattaaaaaccaaatttactaaaataaatattaataaaaa

SEQ ID NO: 1089 - DNA, 578 bp, Artificial Sequence
  chemically treated genomic DNA (Homo sapiens) CpG-island No: 1089
cggttcgttaaattttatcgtcggtgtgtagcgagtcgtagttatagttataggcgtagggttcgcgaggtcgtaggaggttcggtcgtcgttcggaatttgcgcgtacgttgagtagttcgaagggtcgggtgtatagtcggggtgtcggttgtaggagttgtcggaaaggcgaggcgggcgcggtagcgcggaggtcggcgacggaggagtttagtatacggggtacgtagcgtagtagaggtagtatcgcggaaacgattgcgaatacgtgtagatgtaaaggataatttaggtttaggcgtttcgcgatttgaggcgtcgtcggaagtttcgtttttgttcggaagcgtttttcgcgtcggcgttttgacgatttaaggttagcgggcggaatcgcgttttttgttggagatttcggtgtagttcgggaagtttcgaattcggatttcggagtttttttgttgcgttgtcgagttcgttgttcgaagttgtttaattttttttagtggtcgtttatttattttttatttgttgtttttaaagtacgtaaggtttttgggttgcgtggaatgtat

SEQ ID NO: 1090 - DNA, 578 bp, Artificial Sequence
  chemically treated genomic DNA (Homo sapiens) CpG-island No: 1090
atacattccacgcaacccaaaaaccttacgtactttaaaaacaacaaataaaaaataaataaacgaccactaaaaaaaattaaacaacttcgaacaacgaactcgacaacgcaacaaaaaaactccgaaatccgaattcgaaacttcccgaactacaccgaaatctccaacaaaaaacgcgattccgcccgctaaccttaaatcgtcaaaacgccgacgcgaaaaacgcttccgaacaaaaacgaaacttccgacgacgcctcaaatcgcgaaacgcctaaacctaaattatcctttacatctacacgtattcgcaatcgtttccgcgatactacctctactacgctacgtaccccgtatactaaactcctccgtcgccgacctccgcgctaccgcgcccgcctcgcctttccgacaactcctacaaccgacaccccgactatacacccgacccttcgaactactcaacgtacgcgcaaattccgaacgacgaccgaacctcctacgacctcgcgaaccctacgcctataactataactacgactcgctacacaccgacgataaaatttaacgaaccg

SEQ ID NO: 1091 - DNA, 578 bp, Artificial Sequence
  chemically treated genomic DNA (Homo sapiens) CpG-island No: 1091
gtgtattttacgtagtttaaaagttttgcgtgttttgagaatagtaggtggaaagtgggtaagcggttattagagggaattaaatagtttcggatagcggattcggtagcgtagtaagaaagtttcggaattcggattcgaggtttttcgggttgtatcggagtttttagtagagggcgcgatttcgttcgttggttttaggtcgttagagcgtcggcgcgggaagcgttttcgggtaggggcggggttttcggcggcgttttaggtcgcggggcgtttaggtttgggttgttttttgtatttgtacgtgttcgtagtcgttttcgcgatgttgtttttgttgcgttgcgtgtttcgtgtgttgggttttttcgtcgtcggttttcgcgttgtcgcgttcgtttcgttttttcggtagtttttgtagtcggtatttcggttgtgtattcggtttttcgggttgtttagcgtgcgcgtaggtttcgagcggcggtcgggttttttgcggtttcgcggattttgcgtttgtggttgtggttgcggttcgttgtatatcgacggtgaggtttagcgggtcg

SEQ ID NO: 1092 - DNA, 578 bp, Artificial Sequence
  chemically treated genomic DNA (Homo sapiens) CpG-island No: 1092
cgacccgctaaacctcaccgtcgatatacaacgaaccgcaaccacaaccacaaacgcaaaatccgcgaaaccgcaaaaaacccgaccgccgctcgaaacctacgcgcacgctaaacaacccgaaaaaccgaatacacaaccgaaataccgactacaaaaactaccgaaaaaacgaaacgaacgcgacaacgcgaaaaccgacgacgaaaaaacccaacacacgaaacacgcaacgcaacaaaaacaacatcgcgaaaacgactacgaacacgtacaaatacaaaaaacaacccaaacctaaacgccccgcgacctaaaacgccgccgaaaaccccgcccctacccgaaaacgcttcccgcgccgacgctctaacgacctaaaaccaacgaacgaaatcgcgccctctactaaaaactccgatacaacccgaaaaacctcgaatccgaattccgaaactttcttactacgctaccgaatccgctatccgaaactatttaattccctctaataaccgcttacccactttccacctactattctcaaaacacgcaaaacttttaaactacgtaaaatacac

SEQ ID NO: 1093 - DNA, 724 bp, Artificial Sequence
  chemically treated genomic DNA (Homo sapiens) CpG-island No: 1093
tttttcgtttttattcgcggttttttttttttttcgtcgttacgcgcgtcgtattagtttaagtcgtttatttatttttaagtatcgtatttagacgtttcgaaattttttttttttttcgttgtcggtttaggtcgggtttagcgtttggtattttcggcgatttttgggtttttcgtatcggttcggttttttatcgttgttgtttcgacgagagtacgaggagacgtcgtgttcgattttatttcgggtttttatattcgtcgttcgcgttttcgtttttaatattaggcgcggtttatttgtatgatggttttgcggattttttagagtcggtacgtttttttttcgtcgtttatggtagttttcgtcgtcgtcgtcgttcgtatttttttttcgcgcgagaattcgcgcggattgcgtttgcgtcgaattcgaattaggtttttttcgtttaatttcgtttcgcgttggtttgtcgtcggcgaatgtttgaatgtagtaacgtttcggatcggtagcgttaagggtagttcgagttttacgagagcggtagttggttgagcgagtttttcgttttcgtagttttcgtgtgtttttggtcgtatagtttttcgggagttgtagttttcgtttaatttttattttggagtaatagtttagaattttacgaggcgggggcgaagtgtgagcggggaaattgaggtttggatggggttaaggg

SEQ ID NO: 1094 - DNA, 724 bp, Artificial Sequence
  chemically treated genomic DNA (Homo sapiens) CpG-island No: 1094
cccttaaccccatccaaacctcaatttccccgctcacacttcgcccccgcctcgtaaaattctaaactattactccaaaataaaaattaaacgaaaactacaactcccgaaaaactatacgaccaaaaacacacgaaaactacgaaaacgaaaaactcgctcaaccaactaccgctctcgtaaaactcgaactacccttaacgctaccgatccgaaacgttactacattcaaacattcgccgacgacaaaccaacgcgaaacgaaattaaacgaaaaaaacctaattcgaattcgacgcaaacgcaatccgcgcgaattctcgcgcgaaaaaaaaatacgaacgacgacgacgacgaaaactaccataaacgacgaaaaaaaaacgtaccgactctaaaaaatccgcaaaaccatcatacaaataaaccgcgcctaatattaaaaacgaaaacgcgaacgacgaatataaaaacccgaaataaaatcgaacacgacgtctcctcgtactctcgtcgaaacaacaacgataaaaaaccgaaccgatacgaaaaacccaaaaatcgccgaaaataccaaacgctaaacccgacctaaaccgacaacgaaaaaaaaaaaaaatttcgaaacgtctaaatacgatacttaaaaataaataaacgacttaaactaatacgacgcgcgtaacgacgaaaaaaaaaaaaaaccgcgaataaaaacgaaaaa

SEQ ID NO: 1095 - DNA, 724 bp, Artificial Sequence
  chemically treated genomic DNA (Homo sapiens) CpG-island No: 1095
tttttgattttatttaggttttagttttttcgtttatatttcgttttcgtttcgtgggattttaaattgttgttttaaggtgggagttgaacggaaattataattttcgagaggttgtgcggttaaagatatacgagaattacggaggcgagagattcgtttagttaattgtcgttttcgtaaggttcgggttgtttttggcgttgtcgattcgagacgttgttgtatttaggtattcgtcgacgatagattagcgcggggcggggttaggcggagggggtttgattcggattcggcgtaggcgtagttcgcgcgggttttcgcgcggagaaggggtgcgagcggcggcggcggcggaggttgttatggacgacgaggaggagacgtatcggttttggaaaattcgtaagattattatgtaggtgagtcgcgtttggtgttgggggcgggggcgcgggcggcgggtgtaggggttcgaggtggggtcgagtacggcgttttttcgtattttcgtcggagtagtagcgatgaagggtcgggtcgatacgggaggtttagaggtcgtcggggatattaggcgttggattcgatttgagtcggtagcggggaagggagggggtttcgagacgtttgggtgcggtgtttaggggtgggtgggcggtttgggttggtgcggcgcgcgtggcggcgagaggaggaggaagtcgcgaatggggacgggggg

SEQ ID NO: 1096 - DNA, 724 bp, Artificial Sequence
  chemically treated genomic DNA (Homo sapiens) CpG-island No: 1096
ccccccgtccccattcgcgacttcctcctcctctcgccgccacgcgcgccgcaccaacccaaaccgcccacccacccctaaacaccgcacccaaacgtctcgaaaccccctcccttccccgctaccgactcaaatcgaatccaacgcctaatatccccgacgacctctaaacctcccgtatcgacccgacccttcatcgctactactccgacgaaaatacgaaaaaacgccgtactcgaccccacctcgaacccctacacccgccgcccgcgcccccgcccccaacaccaaacgcgactcacctacataataatcttacgaattttccaaaaccgatacgtctcctcctcgtcgtccataacaacctccgccgccgccgccgctcgcaccccttctccgcgcgaaaacccgcgcgaactacgcctacgccgaatccgaatcaaaccccctccgcctaaccccgccccgcgctaatctatcgtcgacgaatacctaaatacaacaacgtctcgaatcgacaacgccaaaaacaacccgaaccttacgaaaacgacaattaactaaacgaatctctcgcctccgtaattctcgtatatctttaaccgcacaacctctcgaaaattataatttccgttcaactcccaccttaaaacaacaatttaaaatcccacgaaacgaaaacgaaatataaacgaaaaaactaaaacctaaataaaatcaaaaa

SEQ ID NO: 1097 - DNA, 544 bp, Artificial Sequence
  chemically treated genomic DNA (Homo sapiens) CpG-island No: 1097
cgttgttgttaattagtcggataattgcgttgtttttcgacgcgtcgttagttaggttacggttttttagatataagcgagtatgcgtagtcgttaataataagttcgtacgttcggtttcgttttttttttttcgttttttttttatttcggttttttattggttgacgtcggcgcgagcgtttaatatcgacgcgtttgattaatgagcgttttggagggcgtggtcgtgggaaaggaggcgcggaaagtcgacgcgcgtttattggtcggttggacgaggggaggagtcgttggtttttagtttcgtcgcgatgagtttcggtcgtttttgtcgtttattgaagtcggcgttgttttgtggggttttggtcgcgtttggtttggtcgggattatggtgagttagcgtcgcggtcgttgtcggttcggtgatcgttggggcgggcgcgcgatttttgttttcgttcgtcggcgtggggaatttttaggttttagtgattttggtggggggcgtttgggggttttttttttttattttcggtt

SEQ ID NO: 1098 - DNA, 544 bp, Artificial Sequence
  chemically treated genomic DNA (Homo sapiens) CpG-island No: 1098
aaccgaaaataaaaaaaaaaaacccccaaacgccccccaccaaaatcactaaaacctaaaaattccccacgccgacgaacgaaaacaaaaatcgcgcgcccgccccaacgatcaccgaaccgacaacgaccgcgacgctaactcaccataatcccgaccaaaccaaacgcgaccaaaaccccacaaaacaacgccgacttcaataaacgacaaaaacgaccgaaactcatcgcgacgaaactaaaaaccaacgactcctcccctcgtccaaccgaccaataaacgcgcgtcgactttccgcgcctcctttcccacgaccacgccctccaaaacgctcattaatcaaacgcgtcgatattaaacgctcgcgccgacgtcaaccaataaaaaaccgaaataaaaaaaaaacgaaaaaaaaaaaacgaaaccgaacgtacgaacttattattaacgactacgcatactcgcttatatctaaaaaaccgtaacctaactaacgacgcgtcgaaaaacaacgcaattatccgactaattaacaacaacg

SEQ ID NO: 1099 - DNA, 544 bp, Artificial Sequence
  chemically treated genomic DNA (Homo sapiens) CpG-island No: 1099
ggtcgggggtggggagggggagtttttagacgttttttattaaggttattggagtttgagggttttttacgtcggcgagcggaggtagggatcgcgcgttcgttttaacggttatcgggtcggtaacggtcgcggcgttagtttattatggtttcggttaggttaggcgcggttagagttttatagagtagcgtcggttttagtaggcggtaaaggcggtcgaggtttatcgcggcggggttgggagttagcggttttttttttcgtttagtcgattaatggacgcgcgtcggtttttcgcgtttttttttttacggttacgttttttagagcgtttattggttagacgcgtcggtgttgagcgttcgcgtcgacgttagttaatgggaggtcggagtgggaagaaggcggggaagggggggcgggatcggacgtgcggatttgttgttggcgattgcgtatgttcgtttgtgtttaggaggtcgtggtttggttggcggcgcgtcgggaggtagcgtagttattcggttggttgatagtagcg

SEQ ID NO: 1100 - DNA, 544 bp, Artificial Sequence
  chemically treated genomic DNA (Homo sapiens) CpG-island No: 1100
cgctactatcaaccaaccgaataactacgctacctcccgacgcgccgccaaccaaaccacgacctcctaaacacaaacgaacatacgcaatcgccaacaacaaatccgcacgtccgatcccgcccccccttccccgccttcttcccactccgacctcccattaactaacgtcgacgcgaacgctcaacaccgacgcgtctaaccaataaacgctctaaaaaacgtaaccgtaaaaaaaaaaacgcgaaaaaccgacgcgcgtccattaatcgactaaacgaaaaaaaaaaccgctaactcccaaccccgccgcgataaacctcgaccgcctttaccgcctactaaaaccgacgctactctataaaactctaaccgcgcctaacctaaccgaaaccataataaactaacgccgcgaccgttaccgacccgataaccgttaaaacgaacgcgcgatccctacctccgctcgccgacgtaaaaaaccctcaaactccaataaccttaataaaaaacgtctaaaaactccccctccccacccccgacc

SEQ ID NO: 1101 - DNA, 1288 bp, Artificial Sequence
  chemically treated genomic DNA (Homo sapiens) CpG-island No: 1101
ggacgcgggtgatcgtattgcgacgcgtttcgcggttttttaggtcgttgtaggcgcgcgggttggggtcggggaaggggaaggggttgttttacgcgcgcgggtcgtggtcggggaaggggtcgtttaggtcgttgtaggcgcgcgtgtcggggtcggggtcgggggtttaggtttgtagggggcggggttcgggacggttggggcggagttggatcgttgagggttacggcggggcgttttcgggtcgagcggggttgttgcgttcgagcggttgggggcgcggagggttggaaatttcggattacgcgttttcgggcgtcgtttcgttttcgtattttggtttagcgcggtggcgttatagtcgcgtagttttgattacggttttcgggttttttgttttcgttagcggcgttcggggtgggggagttaggaggggcgggagacgggcgggtatgggtcgcgcgggcgtaggttttttcgggcgtcgtaggtagcggtgttagagtcggggtaggcggcggtcgcgagtttttcggcggcggaaggttttagcgtgtaggcgtaggagggcgcggcgtcggcggaagaagttttgttttcgtagtttgcgatcggagatttacgaatgttttaagttttaggattcggtgcgcgcggggtttttatatcggttaatgtggtatattttggggttggaattttttttcggttttcgggttttcggtaaaatcggattagaagtataagggggcgtgtgcgtttaaggaggaggagcgtttaggtttttagggtcgtagggtttcggtgttttcgttatcgattcgttttcgatttttttttgttttagggtttcgggtttagtttttcgtttacgttttttgtttagttttttttgttttgtagtgcgcgtttcgggacgattggcgttgtgcgcgttttatgtacgagtttttcgttaaggatatcgacgggtatatggttaatttggataagtatcggtgggcgttcgtttggggtggggcgcggggtcgggttttgggagggggtcgtgtttttttgcgttgacgtcgtcgattttcgtaggggtttcgtgtgtatcgttattaacgtggttttttagtgaggtaagatcgaagtaaattatatttagttcgtcgatttgtacgttcgatacgttgagtgtggtttgcggattttggttttttcgtgtaattagttcgggaagtaggtgggttgttgcgttttcggggttcgtagaggcgggtgggtgggggtcggggtgggt

SEQ ID NO: 1102 - DNA, 1288 bp, Artificial Sequence
  chemically treated genomic DNA (Homo sapiens) CpG-island No: 1102
acccaccccgacccccacccacccgcctctacgaaccccgaaaacgcaacaacccacctacttcccgaactaattacacgaaaaaaccaaaatccgcaaaccacactcaacgtatcgaacgtacaaatcgacgaactaaatataatttacttcgatcttacctcactaaaaaaccacgttaataacgatacacacgaaacccctacgaaaatcgacgacgtcaacgcaaaaaaacacgaccccctcccaaaacccgaccccgcgccccaccccaaacgaacgcccaccgatacttatccaaattaaccatatacccgtcgatatccttaacgaaaaactcgtacataaaacgcgcacaacgccaatcgtcccgaaacgcgcactacaaaacaaaaaaaactaaacaaaaaacgtaaacgaaaaactaaacccgaaaccctaaaacaaaaaaaaatcgaaaacgaatcgataacgaaaacaccgaaaccctacgaccctaaaaacctaaacgctcctcctccttaaacgcacacgcccccttatacttctaatccgattttaccgaaaacccgaaaaccgaaaaaaaattccaaccccaaaatataccacattaaccgatataaaaaccccgcgcgcaccgaatcctaaaacttaaaacattcgtaaatctccgatcgcaaactacgaaaacaaaacttcttccgccgacgccgcgccctcctacgcctacacgctaaaaccttccgccgccgaaaaactcgcgaccgccgcctaccccgactctaacaccgctacctacgacgcccgaaaaaacctacgcccgcgcgacccatacccgcccgtctcccgcccctcctaactcccccaccccgaacgccgctaacgaaaacaaaaaacccgaaaaccgtaatcaaaactacgcgactataacgccaccgcgctaaaccaaaatacgaaaacgaaacgacgcccgaaaacgcgtaatccgaaatttccaaccctccgcgcccccaaccgctcgaacgcaacaaccccgctcgacccgaaaacgccccgccgtaaccctcaacgatccaactccgccccaaccgtcccgaaccccgccccctacaaacctaaacccccgaccccgaccccgacacgcgcgcctacaacgacctaaacgaccccttccccgaccacgacccgcgcgcgtaaaacaaccccttccccttccccgaccccaacccgcgcgcctacaacgacctaaaaaaccgcgaaacgcgtcgcaatacgatcacccgcgtcc

SEQ ID NO: 1103 - DNA, 1288 bp, Artificial Sequence
  chemically treated genomic DNA (Homo sapiens) CpG-island No: 1103
gtttatttcgatttttatttattcgtttttgcgggtttcggggacgtagtagtttatttgtttttcgaattggttatacgggaaggttaggattcgtaaattatatttagcgtatcgggcgtgtaggtcgacgagttgagtgtagtttatttcggttttgttttattgggaggttacgttggtgacgatgtatacgaagtttttgcgaggatcggcggcgttagcgtagaagaatacggtttttttttagggttcgatttcgcgttttattttaggcgagcgtttatcggtatttgtttaggttaattatgtgttcgtcgatgtttttggcggaaaattcgtgtatggagcgcgtatagcgttagtcgtttcgggacgcgtattgtaaggtaaaggaagttgagtagggagcgtggacgggaggttgagttcgggattttgaggtaggaagggatcgggagcgggtcggtggcggggatatcgaggttttgcggttttgaagatttgaacgttttttttttttaaacgtatacgtttttttgtatttttggttcggttttatcggagattcggaggtcgggagagggttttaattttaaaatgtgttatattagtcggtgtgggggtttcgcgcgtatcgggttttgggatttgggatattcgtggattttcggtcgtaagttgcggggatagggtttttttcgtcggcgtcgcgtttttttgcgtttgtacgttggggtttttcgtcgtcgaggggttcgcggtcgtcgtttgtttcggttttggtatcgttgtttgcggcgttcgggggagtttgcgttcgcgcggtttatattcgttcgtttttcgttttttttggtttttttatttcgagcgtcgttagcggggataaagggttcggaggtcgtagttaggattgcgcgattgtgacgttatcgcgttaggttaaggtgcgggggcggggcggcgttcgggggcgcgtgattcgggatttttagtttttcgcgtttttaatcgttcgggcgtagtagtttcgttcggttcggagacgtttcgtcgtggtttttaacggtttagtttcgttttagtcgtttcggatttcgttttttgtaagtttggattttcgatttcggtttcggtacgcgcgtttgtaacggtttggacggtttttttttcgattacgattcgcgcgcgtggaataatttttttttttttttcgattttagttcgcgcgtttataacggtttggagggtcgcggagcgcgtcgtagtacggttattcgcgttt

SEQ ID NO: 1104 - DNA, 1288 bp, Artificial Sequence
  chemically treated genomic DNA (Homo sapiens) CpG-island No: 1104
aaacgcgaataaccgtactacgacgcgctccgcgaccctccaaaccgttataaacgcgcgaactaaaatcgaaaaaaaaaaaaaaattattccacgcgcgcgaatcgtaatcgaaaaaaaaaccgtccaaaccgttacaaacgcgcgtaccgaaaccgaaatcgaaaatccaaacttacaaaaaacgaaatccgaaacgactaaaacgaaactaaaccgttaaaaaccacgacgaaacgtctccgaaccgaacgaaactactacgcccgaacgattaaaaacgcgaaaaactaaaaatcccgaatcacgcgcccccgaacgccgccccgcccccgcaccttaacctaacgcgataacgtcacaatcgcgcaatcctaactacgacctccgaaccctttatccccgctaacgacgctcgaaataaaaaaaccaaaaaaaacgaaaaacgaacgaatataaaccgcgcgaacgcaaactcccccgaacgccgcaaacaacgataccaaaaccgaaacaaacgacgaccgcgaacccctcgacgacgaaaaaccccaacgtacaaacgcaaaaaaacgcgacgccgacgaaaaaaaccctatccccgcaacttacgaccgaaaatccacgaatatcccaaatcccaaaacccgatacgcgcgaaacccccacaccgactaatataacacattttaaaattaaaaccctctcccgacctccgaatctccgataaaaccgaaccaaaaatacaaaaaaacgtatacgtttaaaaaaaaaaaacgttcaaatcttcaaaaccgcaaaacctcgatatccccgccaccgacccgctcccgatcccttcctacctcaaaatcccgaactcaacctcccgtccacgctccctactcaacttcctttaccttacaatacgcgtcccgaaacgactaacgctatacgcgctccatacacgaattttccgccaaaaacatcgacgaacacataattaacctaaacaaataccgataaacgctcgcctaaaataaaacgcgaaatcgaaccctaaaaaaaaaccgtattcttctacgctaacgccgccgatcctcgcaaaaacttcgtatacatcgtcaccaacgtaacctcccaataaaacaaaaccgaaataaactacactcaactcgtcgacctacacgcccgatacgctaaatataatttacgaatcctaaccttcccgtataaccaattcgaaaaacaaataaactactacgtccccgaaacccgcaaaaacgaataaataaaaatcgaaataaac

SEQ ID NO: 1105 - DNA, 573 bp, Artificial Sequence
  chemically treated genomic DNA (Homo sapiens) CpG-island No: 1105
attttttttttcggcggtttcgcggttttgtttttcgtgcggtcgcgttttcggcggcgcggggggcgtggtttgggcgtagtatttataaaggcgggcggcggtagaggcgttattttgcgaacggcgagtagcggcggcggcgcggagagacgtagcggaggtttttttggtttcggattttagcggtcggatggtgaaattttttttgtagcggatttttaatagttattgtttcgttagagagaaggaaggggataaatttagcgttattatttacgttagtcgtattatgtcgtttttaagtttgtatagtcgcggcggtagtagtagtgagaggtaagtgtttcgttttcgttcgaagtttttagaagcgtcggtcgcgtaggtttgcggggggtcgttttcggggcgttagataggttttcggcgcgcgagattcgtttttttgttaaggttagaatcgcgtcggggacgaggtaggcgtagggcgggtttggaggtttttttcggttttagtagtgttttcgggggagtcgggtttggggggtaagggtgcggagttggatttgg

SEQ ID NO: 1106 - DNA, 573 bp, Artificial Sequence
  chemically treated genomic DNA (Homo sapiens) CpG-island No: 1106
ccaaatccaactccgcacccttaccccccaaacccgactcccccgaaaacactactaaaaccgaaaaaaacctccaaacccgccctacgcctacctcgtccccgacgcgattctaaccttaacaaaaaaacgaatctcgcgcgccgaaaacctatctaacgccccgaaaacgaccccccgcaaacctacgcgaccgacgcttctaaaaacttcgaacgaaaacgaaacacttacctctcactactactaccgccgcgactatacaaacttaaaaacgacataatacgactaacgtaaataataacgctaaatttatccccttccttctctctaacgaaacaataactattaaaaatccgctacaaaaaaaatttcaccatccgaccgctaaaatccgaaaccaaaaaaacctccgctacgtctctccgcgccgccgccgctactcgccgttcgcaaaataacgcctctaccgccgcccgcctttataaatactacgcccaaaccacgccccccgcgccgccgaaaacgcgaccgcacgaaaaacaaaaccgcgaaaccgccgaaaaaaaaaat

SEQ ID NO: 1107 - DNA, 573 bp, Artificial Sequence
  chemically treated genomic DNA (Homo sapiens) CpG-island No: 1107
ttaaatttaatttcgtatttttgttttttaaattcgattttttcgagagtattgttaaggtcgggggggatttttaggttcgttttgcgtttatttcgttttcggcgcgattttggttttgataaaggggcggatttcgcgcgtcggggatttatttggcgtttcgaggacggtttttcgtaggtttgcgcggtcggcgtttttggaagtttcggacgggggcggggtatttattttttattgttgttgtcgtcgcggttgtgtaggtttaggagcggtatggtgcggttggcgtggatggtggcgttgggtttatttttttttttttttttggcgaagtagtggttattgaggattcgttgtagggaggattttattattcggtcgttggggttcgaaattaggaaaattttcgttgcgttttttcgcgtcgtcgtcgttgttcgtcgttcgtaaaatggcgtttttgtcgtcgttcgtttttatagatgttgcgtttaggttacgtttttcgcgtcgtcgggaacgcgatcgtacgaggggtagagtcgcggggtcgtcgggaaaaaaagt

SEQ ID NO: 1108 - DNA, 573 bp, Artificial Sequence
  chemically treated genomic DNA (Homo sapiens) CpG-island No: 1108
actttttttcccgacgaccccgcgactctacccctcgtacgatcgcgttcccgacgacgcgaaaaacgtaacctaaacgcaacatctataaaaacgaacgacgacaaaaacgccattttacgaacgacgaacaacgacgacgacgcgaaaaaacgcaacgaaaattttcctaatttcgaaccccaacgaccgaataataaaatcctccctacaacgaatcctcaataaccactacttcgccaaaaaaaaaaaaaaaaataaacccaacgccaccatccacgccaaccgcaccataccgctcctaaacctacacaaccgcgacgacaacaacaataaaaaataaataccccgcccccgtccgaaacttccaaaaacgccgaccgcgcaaacctacgaaaaaccgtcctcgaaacgccaaataaatccccgacgcgcgaaatccgcccctttatcaaaaccaaaatcgcgccgaaaacgaaataaacgcaaaacgaacctaaaaatcccccccgaccttaacaatactctcgaaaaaatcgaatttaaaaaacaaaaatacgaaattaaatttaa

SEQ ID NO: 1109 - DNA, 1136 bp, Artificial Sequence
  chemically treated genomic DNA (Homo sapiens) CpG-island No: 1109
gttcggggcgtttgatttgcgggaggggtatgggtcggaggtcggatttgggcgtaggacggggagtcgggggaggcgtgtgttttttgcggggttcgcgggatgggattcggtttcggaggaggggagaggtttttggtcgagggttggatttgcggggcgtagattgggaattcggtttggaggaagggtgtgcggtcgggtcggatttgggaggcgtacgatggggtaatttggttgggggcggggtcggttttggggggttggttcgcggataggtagggttcgcggggttggtgaatttgtatttttcggtttcggtcgtcgagcgtgcgttgcgggagcggggagcgttttgcggtggacgagttttcgcgggtttttgttgtttcgatgtggtttttgtacgcgacggatttcgtgggtttcgtttttcgtttttgagcgagtcggtttggatggttcgggacgcgtcgggcgaggtcgcgtacgtagacggtatttagggttttttcgcgggggtcgtcggggagttgggggtggcgtatttcgatagttcggtagcgttttgggaagattttcgtcgtttttcgggaagacgcgtttcgttttcgggggcgcgggtgttagttgcggttgtgggggagttcgcggggtttcggtcgagttttttcgattgcgtttttcgaggtgggcgtcgtttagtttcggatcgggaggttgggtcgcggtgttggcggtgtcgcggtttgggggtcgtgtaaaatggaggtaattttggggtttgtttattttgcgtagtaaatggttgttggcgttgtcggttgcgcgattgtgaaaatttttttcggggcgcgaggtcgcgtttgtttggatgacgtaatcgggagggttcgggtttggagcgggggcgggggggcgggcggtcgggagtcggagcggggcgcgttttttatgaggttaggttaggttcgttcggttttcgcggggataagtaagagttttagattttggtcgtagtgtagggtggaaaggggaagtcgcgatagaattgaaaaggggaagcgttggttgttttggtggtcggggggtgaggttttgtttcggcggggttgcgtgaggggaaggggtttttt

SEQ ID NO: 1110 - DNA, 1136 bp, Artificial Sequence
  chemically treated genomic DNA (Homo sapiens) CpG-island No: 1110
aaaaaaccccttcccctcacgcaaccccgccgaaacaaaacctcaccccccgaccaccaaaacaaccaacgcttccccttttcaattctatcgcgacttcccctttccaccctacactacgaccaaaatctaaaactcttacttatccccgcgaaaaccgaacgaacctaacctaacctcataaaaaacgcgccccgctccgactcccgaccgcccgcccccccgcccccgctccaaacccgaaccctcccgattacgtcatccaaacaaacgcgacctcgcgccccgaaaaaaattttcacaatcgcgcaaccgacaacgccaacaaccatttactacgcaaaataaacaaaccccaaaattacctccattttacacgacccccaaaccgcgacaccgccaacaccgcgacccaacctcccgatccgaaactaaacgacgcccacctcgaaaaacgcaatcgaaaaaactcgaccgaaaccccgcgaactcccccacaaccgcaactaacacccgcgcccccgaaaacgaaacgcgtcttcccgaaaaacgacgaaaatcttcccaaaacgctaccgaactatcgaaatacgccacccccaactccccgacgacccccgcgaaaaaaccctaaataccgtctacgtacgcgacctcgcccgacgcgtcccgaaccatccaaaccgactcgctcaaaaacgaaaaacgaaacccacgaaatccgtcgcgtacaaaaaccacatcgaaacaacaaaaacccgcgaaaactcgtccaccgcaaaacgctccccgctcccgcaacgcacgctcgacgaccgaaaccgaaaaatacaaattcaccaaccccgcgaaccctacctatccgcgaaccaaccccccaaaaccgaccccgcccccaaccaaattaccccatcgtacgcctcccaaatccgacccgaccgcacacccttcctccaaaccgaattcccaatctacgccccgcaaatccaaccctcgaccaaaaacctctcccctcctccgaaaccgaatcccatcccgcgaaccccgcaaaaaacacacgcctcccccgactccccgtcctacgcccaaatccgacctccgacccatacccctcccgcaaatcaaacgccccgaac

SEQ ID NO: 1111 - DNA, 1136 bp, Artificial Sequence
  chemically treated genomic DNA (Homo sapiens) CpG-island No: 1111
ggggggttttttttttttacgtagtttcgtcggggtagagttttatttttcggttattaagatagttagcgttttttttttttagttttgtcgcggttttttttttttattttgtattacggttaaaatttgggatttttgtttgttttcgcgaagatcgggcgggtttagtttgattttatggaggacgcgtttcgtttcggttttcggtcgttcgttttttcgttttcgttttaggttcgggttttttcggttgcgttatttaggtagacgcggtttcgcgtttcgggggagatttttataatcgcgtagtcggtagcgttagtagttatttgttgcgtagggtaaataggttttaaagttgtttttattttgtacggtttttaaatcgcggtatcgttagtatcgcggtttaatttttcgattcggggttgagcgacgtttatttcgggggacgtagtcgggaaagttcgatcgagatttcgcgggtttttttataatcgtagttggtattcgcgttttcggaagcgggacgcgttttttcgggaagcggcgggggtttttttagggcgttgtcgggttgtcggagtgcgttatttttagtttttcggcggttttcgcggagaagttttgggtgtcgtttacgtgcgcggtttcgttcggcgcgtttcgggttatttagatcgattcgtttaggggcgaaaaacggggtttacgaggttcgtcgcgtgtaggggttatatcgaggtaatagggattcgcgggagttcgtttatcgtaaagcgtttttcgttttcgtagcgtacgttcgacggtcgggatcgaaaagtgtagatttattagtttcgcgggttttgtttgttcgcggattagttttttaaggtcgatttcgtttttaattagattgttttatcgtgcgttttttaaattcgattcgatcgtatattttttttttaaatcgaatttttagtttgcgtttcgtaaatttaattttcgattagaagttttttttttttttcgaagtcgagttttatttcgcgaatttcgtaaaagatatacgtttttttcgatttttcgttttgcgtttaaattcgattttcgatttatgtttttttcgtaaattaggcgtttcggat

SEQ ID NO: 1112 - DNA, 1136 bp, Artificial Sequence
  chemically treated genomic DNA (Homo sapiens) CpG-island No: 1112
atccgaaacgcctaatttacgaaaaaaacataaatcgaaaatcgaatttaaacgcaaaacgaaaaatcgaaaaaaacgtatatcttttacgaaattcgcgaaataaaactcgacttcgaaaaaaaaaaaaaacttctaatcgaaaattaaatttacgaaacgcaaactaaaaattcgatttaaaaaaaaaatatacgatcgaatcgaatttaaaaaacgcacgataaaacaatctaattaaaaacgaaatcgaccttaaaaaactaatccgcgaacaaacaaaacccgcgaaactaataaatctacacttttcgatcccgaccgtcgaacgtacgctacgaaaacgaaaaacgctttacgataaacgaactcccgcgaatccctattacctcgatataacccctacacgcgacgaacctcgtaaaccccgtttttcgcccctaaacgaatcgatctaaataacccgaaacgcgccgaacgaaaccgcgcacgtaaacgacacccaaaacttctccgcgaaaaccgccgaaaaactaaaaataacgcactccgacaacccgacaacgccctaaaaaaacccccgccgcttcccgaaaaaacgcgtcccgcttccgaaaacgcgaataccaactacgattataaaaaaacccgcgaaatctcgatcgaactttcccgactacgtcccccgaaataaacgtcgctcaaccccgaatcgaaaaattaaaccgcgatactaacgataccgcgatttaaaaaccgtacaaaataaaaacaactttaaaacctatttaccctacgcaacaaataactactaacgctaccgactacgcgattataaaaatctcccccgaaacgcgaaaccgcgtctacctaaataacgcaaccgaaaaaacccgaacctaaaacgaaaacgaaaaaacgaacgaccgaaaaccgaaacgaaacgcgtcctccataaaatcaaactaaacccgcccgatcttcgcgaaaacaaacaaaaatcccaaattttaaccgtaatacaaaataaaaaaaaaaaaccgcgacaaaactaaaaaaaaaaaacgctaactatcttaataaccgaaaaataaaactctaccccgacgaaactacgtaaaaaaaaaaaacccccc

SEQ ID NO: 1113 - DNA, 623 bp, Artificial Sequence
  chemically treated genomic DNA (Homo sapiens) CpG-island No: 1113
cggttcgttttgttaggcgtaggattagtagttcgcggcgtattcgtagttagggttcgagcgttcggagttagggattaagcggtgtttcgcggtcgcgtagtttaggttcgggtttttagagtagcgtttgtagcgcgtttcgcgttcgggacgtcgagggtcgtaagcgggttagttgtgttgttaggagttttaggttcgcggttaaaggcgtggtcgagggcgtagtaaggttgagtagcgttcggaggaggttgtttagttgcggcgcgtgggggttcggggatttcgggggtttagggggttgtagatagacgcggttaaagttagtgaggagtaggcgtgggggtttcgtcgtcgtatagtttcgaggtgttattagtagtaagtttttcggtcgtaattcgattagggtcgcgttttacgtttttaggaattttagggtcgcgtttagttgtagtagtagtagggttatagtttatacgaattttttcggcggttgcgtgtaggttttcgttagttattgcgttatcgtgcgttttggaatttcggttgttagcgttattgcgtttttttagggcgtttcgggtagtgtgtttttaggtattaggttatatagt

SEQ ID NO: 1114 - DNA, 623 bp, Artificial Sequence
  chemically treated genomic DNA (Homo sapiens) CpG-island No: 1114
actatataacctaatacctaaaaacacactacccgaaacgccctaaaaaaacgcaataacgctaacaaccgaaattccaaaacgcacgataacgcaataactaacgaaaacctacacgcaaccgccgaaaaaattcgtataaactataaccctactactactacaactaaacgcgaccctaaaattcctaaaaacgtaaaacgcgaccctaatcgaattacgaccgaaaaacttactactaataacacctcgaaactatacgacgacgaaacccccacgcctactcctcactaactttaaccgcgtctatctacaaccccctaaacccccgaaatccccgaacccccacgcgccgcaactaaacaacctcctccgaacgctactcaaccttactacgccctcgaccacgcctttaaccgcgaacctaaaactcctaacaacacaactaacccgcttacgaccctcgacgtcccgaacgcgaaacgcgctacaaacgctactctaaaaacccgaacctaaactacgcgaccgcgaaacaccgcttaatccctaactccgaacgctcgaaccctaactacgaatacgccgcgaactactaatcctacgcctaacaaaacgaaccg

SEQ ID NO: 1115 - DNA, 623 bp, Artificial Sequence
  chemically treated genomic DNA (Homo sapiens) CpG-island No: 1115
gttgtgtggtttggtgtttgaaggtatattgttcggggcgttttggagaggcgtagtggcgttggtagtcgaggttttagagcgtacggtggcgtagtggttggcggaggtttgtacgtagtcgtcggaggagttcgtgtgggttgtggttttgttgttgttgtagttgagcgcggttttgaagtttttggaggcgtggggcgcggttttagtcgagttgcggtcggagaatttgttgttggtggtatttcggggttgtgcgacgacggggtttttacgtttgttttttattgattttggtcgcgtttgtttgtagttttttggattttcgggattttcgggtttttacgcgtcgtagttgggtagtttttttcgagcgttgtttagttttgttgcgttttcgattacgtttttggtcgcgggtttggagtttttggtagtatagttgattcgtttgcggttttcggcgtttcggacgcggggcgcgttgtaggcgttgttttgggggttcgggtttgagttgcgcggtcgcggagtatcgtttggtttttggtttcgagcgttcgggttttggttgcgggtgcgtcgcgggttgttggttttgcgtttagtagagcgggtcg

SEQ ID NO: 1116 - DNA, 623 bp, Artificial Sequence
  chemically treated genomic DNA (Homo sapiens) CpG-island No: 1116
cgacccgctctactaaacgcaaaaccaacaacccgcgacgcacccgcaaccaaaacccgaacgctcgaaaccaaaaaccaaacgatactccgcgaccgcgcaactcaaacccgaacccccaaaacaacgcctacaacgcgccccgcgtccgaaacgccgaaaaccgcaaacgaatcaactatactaccaaaaactccaaacccgcgaccaaaaacgtaatcgaaaacgcaacaaaactaaacaacgctcgaaaaaaactacccaactacgacgcgtaaaaacccgaaaatcccgaaaatccaaaaaactacaaacaaacgcgaccaaaatcaataaaaaacaaacgtaaaaaccccgtcgtcgcacaaccccgaaataccaccaacaacaaattctccgaccgcaactcgactaaaaccgcgccccacgcctccaaaaacttcaaaaccgcgctcaactacaacaacaacaaaaccacaacccacacgaactcctccgacgactacgtacaaacctccgccaaccactacgccaccgtacgctctaaaacctcgactaccaacgccactacgcctctccaaaacgccccgaacaatataccttcaaacaccaaaccacacaac

SEQ ID NO: 1117 - DNA, 942 bp, Artificial Sequence
  chemically treated genomic DNA (Homo sapiens) CpG-island No: 1117
gtcgtgtagtcgtttttttttttttcgggaaatgtataggtggatacgcgagcggtcggttcgcgggggaggggaggggagggttcgttttggggattttttagattatttttatgttgaatttgcgcgcgtttttttggttcgtcgcggcggtcggtttatttattttgcggaaggagtattttatcgagaagttgtttttgtgttgttcgcggtcgcggttttatacgaatagtagtacgaagtagaagaggattacgtttaggaaggtgatgtagtttatggcggtggatattaggatggtggtgaggtcgagcggcgcgcgtagggtcgttagcgtttcgttgtgggtttcgttcggggttcggttggcggtcggttcggggcgtacggttagcgtggcgaagtaggtgtcgttgtcgttcgcgttgttggttacgtacgtgtaggtgtcgttgttttgcggtcgcgcgttttggatttttagcgttttttcggggagtacgcgcgttcggttcgcgttggtggtcgttatcggtcggtgttggggggttatttaggttacggtgggcgtcggttcgttttcggcgcggtagaggaagcggacgttttcgttcgcggtggtcgtgacgcgttgtagtcgtcgttttcggattttgggtttgcggtatacgaagtattcgaatagtacggagttcggtaggtttcgtagcgcgtcgtcgcgtatttcggtcggggtggcgtaggtcggtagtcgttcgtcgaagttgagggttttgcgacgttgtacgatttatagtaggcgatagtcgtaggttagcgggttttcgtttacgcgtagcgtttttagcgtgtttatcgagtggaaggtgtttttttttaacgtggagagtaggttgttggagaggttgagtaggcggatttggcgtaggtttaggaagg

SEQ ID NO: 1118 - DNA, 942 bp, Artificial Sequence
  chemically treated genomic DNA (Homo sapiens) CpG-island No: 1118
ccttcctaaacctacgccaaatccgcctactcaacctctccaacaacctactctccacgttaaaaaaaaacaccttccactcgataaacacgctaaaaacgctacgcgtaaacgaaaacccgctaacctacgactatcgcctactataaatcgtacaacgtcgcaaaaccctcaacttcgacgaacgactaccgacctacgccaccccgaccgaaatacgcgacgacgcgctacgaaacctaccgaactccgtactattcgaatacttcgtataccgcaaacccaaaatccgaaaacgacgactacaacgcgtcacgaccaccgcgaacgaaaacgtccgcttcctctaccgcgccgaaaacgaaccgacgcccaccgtaacctaaataaccccccaacaccgaccgataacgaccaccaacgcgaaccgaacgcgcgtactccccgaaaaaacgctaaaaatccaaaacgcgcgaccgcaaaacaacgacacctacacgtacgtaaccaacaacgcgaacgacaacgacacctacttcgccacgctaaccgtacgccccgaaccgaccgccaaccgaaccccgaacgaaacccacaacgaaacgctaacgaccctacgcgcgccgctcgacctcaccaccatcctaatatccaccgccataaactacatcaccttcctaaacgtaatcctcttctacttcgtactactattcgtataaaaccgcgaccgcgaacaacacaaaaacaacttctcgataaaatactccttccgcaaaataaataaaccgaccgccgcgacgaaccaaaaaaacgcgcgcaaattcaacataaaaataatctaaaaaatccccaaaacgaaccctcccctcccctcccccgcgaaccgaccgctcgcgtatccacctatacatttcccgaaaaaaaaaaaaacgactacacgac

SEQ ID NO: 1119 - DNA, 942 bp, Artificial Sequence
  chemically treated genomic DNA (Homo sapiens) CpG-island No: 1119
tttttttgggtttgcgttagattcgtttgtttaatttttttaataatttgttttttacgttggaggagagtattttttattcggtgaatacgttagagacgttgcgcgtggacgggaattcgttggtttgcgattgtcgtttgttgtggatcgtgtagcgtcgtaagatttttaatttcgacgggcggttgtcggtttgcgttatttcggtcgaggtgcgcggcgacgcgttgcgaaatttgtcggatttcgtgttgttcgagtatttcgtgtgtcgtaaatttaagattcgggagcggcggttgtagcgcgttacggttatcgcgggcgaagacgttcgttttttttgtcgcgtcgagggcgagtcggcgtttatcgtggtttgggtgattttttagtatcggtcggtgacggttattagcgcgggtcgggcgcgcgtgtttttcggggggacgttggagatttaggacgcgcggtcgtaggatagcggtatttatacgtgcgtggttagtaacgcgggcggtaacgatatttatttcgttacgttgatcgtgcgtttcgagtcggtcgttaatcggatttcgggcgaggtttataacgagacgttggcggttttgcgcgcgtcgttcgattttattattattttggtgtttatcgttatgggttgtattatttttttgggcgtggtttttttttgtttcgtgttgttgttcgtgtggagtcgcggtcgcgggtagtataaaaataatttttcggtggagtatttttttcgtaaggtggatgggtcggtcgtcgcggcgggttagggaggcgcgcgtaagtttaatatgaagatgatttgaggggtttttagggcggattttttttttttttttttcgcgggtcggtcgttcgcgtgtttatttatgtatttttcggaggggaaggggacggttgtacggt

SEQ ID NO: 1120 - DNA, 942 bp, Artificial Sequence
  chemically treated genomic DNA (Homo sapiens) CpG-island No: 1120
accgtacaaccgtccccttcccctccgaaaaatacataaataaacacgcgaacgaccgacccgcgaaaaaaaaaaaaaaaaaatccgccctaaaaacccctcaaatcatcttcatattaaacttacgcgcgcctccctaacccgccgcgacgaccgacccatccaccttacgaaaaaaatactccaccgaaaaattatttttatactacccgcgaccgcgactccacacgaacaacaacacgaaacaaaaaaaaaccacgcccaaaaaaataatacaacccataacgataaacaccaaaataataataaaatcgaacgacgcgcgcaaaaccgccaacgtctcgttataaacctcgcccgaaatccgattaacgaccgactcgaaacgcacgatcaacgtaacgaaataaatatcgttaccgcccgcgttactaaccacgcacgtataaataccgctatcctacgaccgcgcgtcctaaatctccaacgtccccccgaaaaacacgcgcgcccgacccgcgctaataaccgtcaccgaccgatactaaaaaatcacccaaaccacgataaacgccgactcgccctcgacgcgacaaaaaaaacgaacgtcttcgcccgcgataaccgtaacgcgctacaaccgccgctcccgaatcttaaatttacgacacacgaaatactcgaacaacacgaaatccgacaaatttcgcaacgcgtcgccgcgcacctcgaccgaaataacgcaaaccgacaaccgcccgtcgaaattaaaaatcttacgacgctacacgatccacaacaaacgacaatcgcaaaccaacgaattcccgtccacgcgcaacgtctctaacgtattcaccgaataaaaaatactctcctccaacgtaaaaaacaaattattaaaaaaattaaacaaacgaatctaacgcaaacccaaaaaaa

SEQ ID NO: 1121 - DNA, 1060 bp, Artificial Sequence
  chemically treated genomic DNA (Homo sapiens) CpG-island No: 1121
cggcgggtcgcggtcggatttcgggatagtgtttggggcgtttcgggtttgggtttgtttttaaggcggcggttagggttttacgaggcgagtttgtagcgaggcgtcggcgtttttaattacgcgttcggcgggggttttttggcgttattttcggggttcgagtttcgttaggtttagtttttgtttcgcgtcgcgttatcgggtaatattttttttttgttcgtcgggttttagttttttcgtttgtaaaattaggtttatcgggtttagggattttatttgggattttcgcggtttttcgggtcgggaacgtcgcggatgtggggttattcggtcgcgatttcgttgcgtcgtttcggttaggttttgtttttcgttcgggttttagtttttcgtatgtataggacggggttcgcgcgcgtatcgttcgggtttttcgcggatttagtttgggtcggcgttgtttcgagttttagttttttcgtcgtggttagttcgcgtaagaggcgggcgtaagcgatttttatttcggtttcggttttgttttaggtttgcggcgtagattttgtcgttcgtcgtttcggttcgggttttatcggtaggcgcgggacgatttttacggagtagtagtggtagaagtatcgttcgggatgcggcgacgtttcggttatggtcgtcgttatttatttcgcgtcgttcgtttttcgcgcggtattcgtcgtcggtcgtttgttgttttttcgtcggtcgacgcgttcgcgtacgtttacgtacggtacgtacggtacgcggggcggagcgggggcgcgggagcggcgaaagttgcgtattcggcgggtagcggttcgggcgacggtggtcgttgagagataaattaggttcggtcgttgggcggggttttaagcgggggcggggttttcggcgggggcggggttaaagtaggcggcggaagagacgagaagcggggcgtgcgcggggcggggtcgaggttttttttttttttcgaagttgtttaggttttcgtgttttttagtgtttttttattttatcgtcgttt

SEQ ID NO: 1122 - DNA, 1060 bp, Artificial Sequence
  chemically treated genomic DNA (Homo sapiens) CpG-island No: 1122
aaacgacgataaaataaaaaaacactaaaaaacacgaaaacctaaacaacttcgaaaaaaaaaaaaaacctcgaccccgccccgcgcacgccccgcttctcgtctcttccgccgcctactttaaccccgcccccgccgaaaaccccgcccccgcttaaaaccccgcccaacgaccgaacctaatttatctctcaacgaccaccgtcgcccgaaccgctacccgccgaatacgcaactttcgccgctcccgcgcccccgctccgccccgcgtaccgtacgtaccgtacgtaaacgtacgcgaacgcgtcgaccgacgaaaaaacaacaaacgaccgacgacgaataccgcgcgaaaaacgaacgacgcgaaataaataacgacgaccataaccgaaacgtcgccgcatcccgaacgatacttctaccactactactccgtaaaaatcgtcccgcgcctaccgataaaacccgaaccgaaacgacgaacgacaaaatctacgccgcaaacctaaaacaaaaccgaaaccgaaataaaaatcgcttacgcccgcctcttacgcgaactaaccacgacgaaaaaactaaaactcgaaacaacgccgacccaaactaaatccgcgaaaaacccgaacgatacgcgcgcgaaccccgtcctatacatacgaaaaactaaaacccgaacgaaaaacaaaacctaaccgaaacgacgcaacgaaatcgcgaccgaataaccccacatccgcgacgttcccgacccgaaaaaccgcgaaaatcccaaataaaatccctaaacccgataaacctaattttacaaacgaaaaaactaaaacccgacgaacaaaaaaaaaatattacccgataacgcgacgcgaaacaaaaactaaacctaacgaaactcgaaccccgaaaataacgccaaaaaacccccgccgaacgcgtaattaaaaacgccgacgcctcgctacaaactcgcctcgtaaaaccctaaccgccgccttaaaaacaaacccaaacccgaaacgccccaaacactatcccgaaatccgaccgcgacccgccg

SEQ ID NO: 1123 - DNA, 1060 bp, Artificial Sequence
  chemically treated genomic DNA (Homo sapiens) CpG-island No: 1123
agacggcgatgaggtagggaagtattgagggatacgaaggtttgggtagtttcgggaggggaggagggtttcggtttcgtttcgcgtacgtttcgtttttcgtttttttcgtcgtttgttttggtttcgttttcgtcggaagtttcgttttcgtttggagtttcgtttaacggtcgggtttagtttgttttttagcggttatcgtcgttcgggtcgttgttcgtcgagtacgtagttttcgtcgttttcgcgttttcgtttcgtttcgcgtgtcgtgcgtgtcgtgcgtgagcgtgcgcgggcgcgtcggtcggcgagggagtagtaaacggtcggcggcgggtgtcgcgcggggggcgggcggcgcggagtaggtggcggcggttatggtcgaggcgtcgtcgtatttcggacggtatttttgttattgttgtttcgtggagatcgtttcgcgtttgtcggtgaggttcgggtcggggcggcgggcggtagggtttgcgtcgtaggtttgaggtaaggtcggggtcggggtgggggtcgtttgcgttcgttttttgcgcgagttgattacgacgggaaaattgaggttcggggtagcgtcggtttaggttgaattcgcggggagttcgggcggtgcgcgcgcgaatttcgttttgtatatgcgggagattgaggttcgggcgggaggtagggtttggtcggagcggcgtagcgggatcgcggtcgggtgattttatattcgcggcgttttcgattcgagaggtcgcgaggattttaggtgggatttttaagttcggtgagtttggttttgtaaacggagaaattgaggttcggcgagtagagagagggtattgttcggtggcgcggcgcggggtaggggttgggtttggcggggttcggatttcgagaataacgttaggggattttcgtcgagcgcgtggttgggggcgtcggcgtttcgttgtaggttcgtttcgtggagttttggtcgtcgttttggaggtaggtttaggttcggaacgttttaggtattgtttcggggttcgatcgcggttcgtcg

SEQ ID NO: 1124 - DNA, 1060 bp, Artificial Sequence
  chemically treated genomic DNA (Homo sapiens) CpG-island No: 1124
cgacgaaccgcgatcgaaccccgaaacaatacctaaaacgttccgaacctaaacctacctccaaaacgacgaccaaaactccacgaaacgaacctacaacgaaacgccgacgcccccaaccacgcgctcgacgaaaatcccctaacgttattctcgaaatccgaaccccgccaaacccaacccctaccccgcgccgcgccaccgaacaataccctctctctactcgccgaacctcaatttctccgtttacaaaaccaaactcaccgaacttaaaaatcccacctaaaatcctcgcgacctctcgaatcgaaaacgccgcgaatataaaatcacccgaccgcgatcccgctacgccgctccgaccaaaccctacctcccgcccgaacctcaatctcccgcatatacaaaacgaaattcgcgcgcgcaccgcccgaactccccgcgaattcaacctaaaccgacgctaccccgaacctcaattttcccgtcgtaatcaactcgcgcaaaaaacgaacgcaaacgacccccaccccgaccccgaccttacctcaaacctacgacgcaaaccctaccgcccgccgccccgacccgaacctcaccgacaaacgcgaaacgatctccacgaaacaacaataacaaaaataccgtccgaaatacgacgacgcctcgaccataaccgccgccacctactccgcgccgcccgccccccgcgcgacacccgccgccgaccgtttactactccctcgccgaccgacgcgcccgcgcacgctcacgcacgacacgcacgacacgcgaaacgaaacgaaaacgcgaaaacgacgaaaactacgtactcgacgaacaacgacccgaacgacgataaccgctaaaaaacaaactaaacccgaccgttaaacgaaactccaaacgaaaacgaaacttccgacgaaaacgaaaccaaaacaaacgacgaaaaaaacgaaaaacgaaacgtacgcgaaacgaaaccgaaaccctcctcccctcccgaaactacccaaaccttcgtatccctcaatacttccctacctcatcgccgtct

SEQ ID NO: 1125 - DNA, 530 bp, Artificial Sequence
  chemically treated genomic DNA (Homo sapiens) CpG-island No: 1125
aggttttcgcgcggttttacgttcgggattttttcgcgttcggttttacgcgcgtgttttttgttcgtagattcgtgcgacggcgtggagtgcggttcgggtaaggcgtgtcgtatgttggggggtcgttcgcgttgcgagtgcgcgttcgattgttcggggttttcggcgcggttgtaggtttgcggtttagacggcgttatttatcgcgacgagtgcgagttgcgcgtcgcgcgttgtcgcggttattcggatttgagcgttatgtatcggggtcgttgtcgtagtacgtgggggcgtggtttgtggaggggcggggcgggatttatcggatttgcgcgttatgtatcgaggttgttgtcgtagtaggcgggggcggggtttggggcgggattattcggatttgagcgtgacgtatcggggttgttatcgtaatgcgtgagggttaggtttgcgggggcggggtttgttggaggggcggggtttgttggaggggcggggtcgttgtcgtagtgcgtaggggcggggtt

SEQ ID NO: 1126 - DNA, 530 bp, Artificial Sequence
  chemically treated genomic DNA (Homo sapiens) CpG-island No: 1126
aaccccgcccctacgcactacgacaacgaccccgcccctccaacaaaccccgcccctccaacaaaccccgcccccgcaaacctaaccctcacgcattacgataacaaccccgatacgtcacgctcaaatccgaataatcccgccccaaaccccgcccccgcctactacgacaacaacctcgatacataacgcgcaaatccgataaatcccgccccgcccctccacaaaccacgcccccacgtactacgacaacgaccccgatacataacgctcaaatccgaataaccgcgacaacgcgcgacgcgcaactcgcactcgtcgcgataaataacgccgtctaaaccgcaaacctacaaccgcgccgaaaaccccgaacaatcgaacgcgcactcgcaacgcgaacgaccccccaacatacgacacgccttacccgaaccgcactccacgccgtcgcacgaatctacgaacaaaaaacacgcgcgtaaaaccgaacgcgaaaaaatcccgaacgtaaaaccgcgcgaaaacct

SEQ ID NO: 1127 - DNA, 530 bp, Artificial Sequence
  chemically treated genomic DNA (Homo sapiens) CpG-island No: 1127
ggtttcgtttttacgtattgcggtagcggtttcgtttttttagtaggtttcgtttttttagtaggtttcgttttcgtaggtttggtttttacgtattgcggtagtagtttcgatacgttacgtttaggttcgggtggtttcgttttaggtttcgttttcgtttattgcggtagtagtttcgatatatgacgcgtaggttcggtaggtttcgtttcgtttttttatagattacgtttttacgtattgcggtagcggtttcggtatatgacgtttaggttcgggtggtcgcggtagcgcgcggcgcgtagttcgtattcgtcgcggtaggtggcgtcgtttgagtcgtagatttgtagtcgcgtcgggagtttcgagtagtcgggcgcgtattcgtagcgcgggcggttttttagtatgcggtacgttttgttcgggtcgtattttacgtcgtcgtacgaatttgcggatagaggatacgcgcgtggggtcgggcgcgggagggtttcgggcgtggggtcgcgcgaaggttt

SEQ ID NO: 1128 - DNA, 530 bp, Artificial Sequence
  chemically treated genomic DNA (Homo sapiens) CpG-island No: 1128
aaaccttcgcgcgaccccacgcccgaaaccctcccgcgcccgaccccacgcgcgtatcctctatccgcaaattcgtacgacgacgtaaaatacgacccgaacaaaacgtaccgcatactaaaaaaccgcccgcgctacgaatacgcgcccgactactcgaaactcccgacgcgactacaaatctacgactcaaacgacgccacctaccgcgacgaatacgaactacgcgccgcgcgctaccgcgaccacccgaacctaaacgtcatataccgaaaccgctaccgcaatacgtaaaaacgtaatctataaaaaaacgaaacgaaacctaccgaacctacgcgtcatatatcgaaactactaccgcaataaacgaaaacgaaacctaaaacgaaaccacccgaacctaaacgtaacgtatcgaaactactaccgcaatacgtaaaaaccaaacctacgaaaacgaaacctactaaaaaaacgaaacctactaaaaaaacgaaaccgctaccgcaatacgtaaaaacgaaacc

SEQ ID NO: 1129 - DNA, 1086 bp, Artificial Sequence
  chemically treated genomic DNA (Homo sapiens) CpG-island No: 1129
gtggcgcggcgtcggggttcggggtcggggggcgttgttcgagggtacgtgcgcgggcgcgcgttttgggagtggtcgcggggtggtgggaggggcgggtaggggcggggtcgcggcggcgcgcggaggtcgagttcggttgggtttggcgaggttgcggcgcggttatcggcgggagtgtagcggttattgtatttagagatttaaaattttaaattcgggatttgggggcgttgagtcgggtcgggaagtagagtttggtcgtgaggaatagtcgttcgttgttgtttgtttttttgcggatagcgtttttttcgatttcgtttaggaagtggtgggggcggcgtggttttcgtcgggaggcgttcgaacgttcgttaggagagagaaaggatttttttgtgtttggagttcgtattcgggcgcggagggagcggcggtaggttttcgttttcggtattatgggttgtacgttgagcgtcgaggataaggcggcggtggagcggagtaagatgatcgatcgtaattttcgtgaggacggcgagaaggcggcgcgcgaggttaagttgttgttgttcggtaagggcggtcgggtcggggttcgggggtcggcgggggatcgggtgcggcgttgcgcggttttcggcgtttggaaattcggagggaagggggaggaagcgttcgaggaggtttttgagcgggagttgggttcggcggtgcggaggtaaggcgggtttttttttttcggtgtttggttttttttcgtttcggcgggcgaggatttttcgcggcggggcgggcgcgttattttattcggatgttttcgtgcgatttagtaaagagtttaggcgcgagttcgaggcggcgggtcgcgtggaaattttttgttttgaagtttagtttagttttgtaaagatgaaggggtattcgcggttagaaaatgaaaatattttttttttcgcgttattaattttttttcggaaaattttttttcgtgtgcggtgtaggttgtgtttcgattgtggtttttttatgtttagagtgttacgtttggtgaaattagtgtattttttgtggggtttttga

SEQ ID NO: 1130 - DNA, 1086 bp, Artificial Sequence
  chemically treated genomic DNA (Homo sapiens) CpG-island No: 1130
tcaaaaaccccacaaaaaatacactaatttcaccaaacgtaacactctaaacataaaaaaaccacaatcgaaacacaacctacaccgcacacgaaaaaaaattttccgaaaaaaaattaataacgcgaaaaaaaaaatattttcattttctaaccgcgaataccccttcatctttacaaaactaaactaaacttcaaaacaaaaaatttccacgcgacccgccgcctcgaactcgcgcctaaactctttactaaatcgcacgaaaacatccgaataaaataacgcgcccgccccgccgcgaaaaatcctcgcccgccgaaacgaaaaaaaaccaaacaccgaaaaaaaaaaacccgccttacctccgcaccgccgaacccaactcccgctcaaaaacctcctcgaacgcttcctcccccttccctccgaatttccaaacgccgaaaaccgcgcaacgccgcacccgatcccccgccgacccccgaaccccgacccgaccgcccttaccgaacaacaacaacttaacctcgcgcgccgccttctcgccgtcctcacgaaaattacgatcgatcatcttactccgctccaccgccgccttatcctcgacgctcaacgtacaacccataataccgaaaacgaaaacctaccgccgctccctccgcgcccgaatacgaactccaaacacaaaaaaatcctttctctctcctaacgaacgttcgaacgcctcccgacgaaaaccacgccgcccccaccacttcctaaacgaaatcgaaaaaaacgctatccgcaaaaaaacaaacaacaacgaacgactattcctcacgaccaaactctacttcccgacccgactcaacgcccccaaatcccgaatttaaaattttaaatctctaaatacaataaccgctacactcccgccgataaccgcgccgcaacctcgccaaacccaaccgaactcgacctccgcgcgccgccgcgaccccgcccctacccgcccctcccaccaccccgcgaccactcccaaaacgcgcgcccgcgcacgtaccctcgaacaacgccccccgaccccgaaccccgacgccgcgccac

SEQ ID NO: 1131 - DNA, 1086 bp, Artificial Sequence
  chemically treated genomic DNA (Homo sapiens) CpG-island No: 1131
ttagaggttttataaaaggtgtattgattttattaaacgtggtattttgggtatgagaaaattatagtcgaaatataatttatatcgtatacgaagaagggtttttcgggagggggttggtggcgcgggggggggggtgtttttattttttagtcgcgaatgtttttttatttttataaggttgagttaaattttaaagtaaagggtttttacgcgattcgtcgtttcggattcgcgtttgggttttttgttgggtcgtacgaaagtattcgagtgaagtgacgcgttcgtttcgtcgcggggagttttcgttcgtcggggcggagagagattagatatcgggagagggggattcgttttgttttcgtatcgtcggatttagttttcgtttagaagttttttcgggcgttttttttttttttttttcgggtttttaaacgtcgagggtcgcgtagcgtcgtattcggtttttcgtcgattttcgggtttcgattcggtcgtttttatcgagtagtagtagtttgatttcgcgcgtcgttttttcgtcgtttttacggaggttgcggtcgattattttatttcgttttatcgtcgttttgttttcggcgtttagcgtgtagtttatggtgtcgaaagcgagagtttgtcgtcgtttttttcgcgttcgagtgcgggttttaagtataggggaatttttttttttttttagcgggcgttcgaacgtttttcgacgggggttacgtcgtttttattattttttaagcggagtcgagggagacgttgttcgtaaaggggtagatagtaacgggcggttgttttttacgattaggttttgtttttcggttcggtttagcgtttttaagtttcgggtttggggttttgaatttttgggtatagtggtcgttgtattttcgtcggtggtcgcgtcgtagtttcgttaagtttagtcgagttcggttttcgcgcgtcgtcgcggtttcgtttttgttcgttttttttattatttcgcgattatttttagagcgcgcgttcgcgtacgtgttttcggatagcgtttttcggtttcggatttcggcgtcgcgttat

SEQ ID NO: 1132 - DNA, 1086 bp, Artificial Sequence
  chemically treated genomic DNA (Homo sapiens) CpG-island No: 1132
ataacgcgacgccgaaatccgaaaccgaaaaacgctatccgaaaacacgtacgcgaacgcgcgctctaaaaataatcgcgaaataataaaaaaaacgaacaaaaacgaaaccgcgacgacgcgcgaaaaccgaactcgactaaacttaacgaaactacgacgcgaccaccgacgaaaatacaacgaccactatacccaaaaattcaaaaccccaaacccgaaacttaaaaacgctaaaccgaaccgaaaaacaaaacctaatcgtaaaaaacaaccgcccgttactatctacccctttacgaacaacgtctccctcgactccgcttaaaaaataataaaaacgacgtaacccccgtcgaaaaacgttcgaacgcccgctaaaaaaaaaaaaaaattcccctatacttaaaacccgcactcgaacgcgaaaaaaacgacgacaaactctcgctttcgacaccataaactacacgctaaacgccgaaaacaaaacgacgataaaacgaaataaaataatcgaccgcaacctccgtaaaaacgacgaaaaaacgacgcgcgaaatcaaactactactactcgataaaaacgaccgaatcgaaacccgaaaatcgacgaaaaaccgaatacgacgctacgcgaccctcgacgtttaaaaacccgaaaaaaaaaaaaaaaaaacgcccgaaaaaacttctaaacgaaaactaaatccgacgatacgaaaacaaaacgaatccccctctcccgatatctaatctctctccgccccgacgaacgaaaactccccgcgacgaaacgaacgcgtcacttcactcgaatactttcgtacgacccaacaaaaaacccaaacgcgaatccgaaacgacgaatcgcgtaaaaaccctttactttaaaatttaactcaaccttataaaaataaaaaaacattcgcgactaaaaaataaaaacacccccccccccgcgccaccaaccccctcccgaaaaacccttcttcgtatacgatataaattatatttcgactataattttctcatacccaaaataccacgtttaataaaatcaatacaccttttataaaacctctaa

SEQ ID NO: 1133 - DNA, 781 bp, Artificial Sequence
  chemically treated genomic DNA (Homo sapiens) CpG-island No: 1133
gtttattcgtaacgcgtatagtatttattagcggtcgcggaagcgttttagttaggacgtttatcgtcgtaatagcgttcgttttttgtagtagcgacgtcgttaggcgcggtcgggatcgtagagtttcgggagttcgttcggtgagtgtagcgggagagggtaggaagggtaagtcgtagaggcggagttagcgggagaggcggggttagaggtagggttagagtagcggggcgggattagagggcggaattagagggagaggcggggattggaggcggggttagaggaggagttagcgttagggggcggagcgatttttaagaggcggagttagagggagaggtataagcgggaggcgaggttagagcgcggagtaggagttggagaacgcggcggggcgaggttagagagcgttgtgggcggggttagtgggcggggcggggcgtttgattcggtttcgttttttgttcgtagaggaggagcggtagacgtagcgttttaaatcgtagtcggcggtgttttcgcggtcgagcgtcgattttattttgaatcgttgtagcgagagtattaagcggaagttggcgtttgtcgtttgaggttggagcgtagtttttagttagcgtttcggtttttgtcgtttcgtgtttgtatatacgtgttttatagagtttggcgtttggacgtcgagggtagtttcgatttttgtttagcgcggttttcgttatttttaataaatgttgtttggagtggatcgaggttttgtaggaatgtagggagg

SEQ ID NO: 1134 - DNA, 781 bp, Artificial Sequence
  chemically treated genomic DNA (Homo sapiens) CpG-island No: 1134
cctccctacattcctacaaaacctcgatccactccaaacaacatttattaaaaataacgaaaaccgcgctaaacaaaaatcgaaactaccctcgacgtccaaacgccaaactctataaaacacgtatatacaaacacgaaacgacaaaaaccgaaacgctaactaaaaactacgctccaacctcaaacgacaaacgccaacttccgcttaatactctcgctacaacgattcaaaataaaatcgacgctcgaccgcgaaaacaccgccgactacgatttaaaacgctacgtctaccgctcctcctctacgaacaaaaaacgaaaccgaatcaaacgccccgccccgcccactaaccccgcccacaacgctctctaacctcgccccgccgcgttctccaactcctactccgcgctctaacctcgcctcccgcttatacctctccctctaactccgcctcttaaaaatcgctccgccccctaacgctaactcctcctctaaccccgcctccaatccccgcctctccctctaattccgccctctaatcccgccccgctactctaaccctacctctaaccccgcctctcccgctaactccgcctctacgacttacccttcctaccctctcccgctacactcaccgaacgaactcccgaaactctacgatcccgaccgcgcctaacgacgtcgctactacaaaaaacgaacgctattacgacgataaacgtcctaactaaaacgcttccgcgaccgctaataaatactatacgcgttacgaataaac

SEQ ID NO: 1135 - DNA, 781 bp, Artificial Sequence
  chemically treated genomic DNA (Homo sapiens) CpG-island No: 1135
tttttttgtatttttgtagagtttcggtttattttaagtaatatttattgagggtggcgggagtcgcgttggataggggtcggggttgttttcggcgtttagacgttaggttttatagaatacgtatgtataggtacggggcggtaagggtcgagacgttagttggggattgcgttttagttttagacggtagacgttagttttcgtttggtgttttcgttgtagcggtttaggatgaggtcggcgttcggtcgcgggggtatcgtcggttgcggtttagagcgttgcgtttgtcgttttttttttgcgggtagagagcggggtcgagttagacgtttcgtttcgtttattggtttcgtttatagcgttttttggtttcgtttcgtcgcgttttttaatttttgtttcgcgttttggtttcgtttttcgtttgtgtttttttttttgatttcgttttttagggatcgtttcgttttttagcgttggttttttttttgatttcgtttttagttttcgtttttttttttgatttcgttttttggtttcgtttcgttattttggttttatttttggtttcgtttttttcgttgatttcgtttttacggtttgttttttttgttttttttcgttgtatttatcgagcgggttttcggggttttgcggtttcggtcgcgtttggcggcgtcgttgttgtagaaaacggacgttgttgcggcgataggcgttttggttgaggcgttttcgcgatcgttggtggatgttgtgcgcgttgcggatggat

SEQ ID NO: 1136 - DNA, 781 bp, Artificial Sequence
  chemically treated genomic DNA (Homo sapiens) CpG-island No: 1136
atccatccgcaacgcgcacaacatccaccaacgatcgcgaaaacgcctcaaccaaaacgcctatcgccgcaacaacgtccgttttctacaacaacgacgccgccaaacgcgaccgaaaccgcaaaaccccgaaaacccgctcgataaatacaacgaaaaaaaacaaaaaaaacaaaccgtaaaaacgaaatcaacgaaaaaaacgaaaccaaaaataaaaccaaaataacgaaacgaaaccaaaaaacgaaatcaaaaaaaaaaacgaaaactaaaaacgaaatcaaaaaaaaaaccaacgctaaaaaacgaaacgatccctaaaaaacgaaatcaaaaaaaaaaacacaaacgaaaaacgaaaccaaaacgcgaaacaaaaattaaaaaacgcgacgaaacgaaaccaaaaaacgctataaacgaaaccaataaacgaaacgaaacgtctaactcgaccccgctctctacccgcaaaaaaaaaacgacaaacgcaacgctctaaaccgcaaccgacgatacccccgcgaccgaacgccgacctcatcctaaaccgctacaacgaaaacaccaaacgaaaactaacgtctaccgtctaaaactaaaacgcaatccccaactaacgtctcgacccttaccgccccgtacctatacatacgtattctataaaacctaacgtctaaacgccgaaaacaaccccgacccctatccaacgcgactcccgccaccctcaataaatattacttaaaataaaccgaaactctacaaaaatacaaaaaaa

SEQ ID NO: 1137 - DNA, 684 bp, Artificial Sequence
  chemically treated genomic DNA (Homo sapiens) CpG-island No: 1137
gtcgtcgcgattttcggcgtcggagaggcgaaataagagggggttttcgggtttttaggtatggtttagtcgtttaaggcgaagcgtacgtggtagttggcgggaaatttttggggggtggagtttcggttcgaggttcggtcgtttcgtattacgttatcgagtagttttttttttttttgttataagtcgtacgcgcggaagtaaatatttttacgttattagggcgcgttttcgtttttttttttttatttttttagatcggtggacgtgttcgtttttattcggggttaggtttatgtttcggtttttcgtagtcgcgggtagggcgttaaggcggtaggaggagggtgagcggttaagagatttttaggaagagcggttttcggttgtttgtatcgtcgatagaggtgcggttcgcgggacggtacggaagttagcgggagttacggcgtgggggttttggtggggggatgaaagtacgtttttggtaggttgagaagagtagtgaggaagtcgtggcgtttttttggttttttaagttcgaggcgaattttgcgtttaatgagtattttgttttagaggggggcggttttagatttaagttaggcgaaaattttattggggggcgaaaaagtgaattttaacgttcgaaatgtattttgtttttaaataggtttatag

SEQ ID NO: 1138 - DNA, 684 bp, Artificial Sequence
  chemically treated genomic DNA (Homo sapiens) CpG-island No: 1138
ctataaacctatttaaaaacaaaatacatttcgaacgttaaaattcactttttcgccccccaataaaattttcgcctaacttaaatctaaaaccgcccccctctaaaacaaaatactcattaaacgcaaaattcgcctcgaacttaaaaaaccaaaaaaacgccacgacttcctcactactcttctcaacctaccaaaaacgtactttcatccccccaccaaaacccccacgccgtaactcccgctaacttccgtaccgtcccgcgaaccgcacctctatcgacgatacaaacaaccgaaaaccgctcttcctaaaaatctcttaaccgctcaccctcctcctaccgccttaacgccctacccgcgactacgaaaaaccgaaacataaacctaaccccgaataaaaacgaacacgtccaccgatctaaaaaaataaaaaaaaaaaaacgaaaacgcgccctaataacgtaaaaatatttacttccgcgcgtacgacttataacaaaaaaaaaaaaaactactcgataacgtaatacgaaacgaccgaacctcgaaccgaaactccaccccccaaaaatttcccgccaactaccacgtacgcttcgccttaaacgactaaaccatacctaaaaacccgaaaaccccctcttatttcgcctctccgacgccgaaaatcgcgacgac

SEQ ID NO: 1139 - DNA, 684 bp, Artificial Sequence
  chemically treated genomic DNA (Homo sapiens) CpG-island No: 1139
ttatgagtttgtttaagaatagaatgtatttcgggcgttggggtttattttttcgttttttagtaaggttttcgtttaatttgaatttgggatcgtttttttttaaggtaaagtgtttattggacgtaaagttcgtttcgggtttggaaagttaggagaacgttacggtttttttattattttttttagtttgttaaaggcgtatttttatttttttattaaaatttttacgtcgtaattttcgttggttttcgtatcgtttcgcggatcgtatttttatcggcgatgtaaatagtcgagagtcgttttttttggaggttttttgatcgtttattttttttttgtcgttttggcgttttgttcgcgattgcgggaaatcgggatatagatttggtttcgagtggaggcgagtacgtttatcgatttgaggagatgggaggggaaagacgaggacgcgttttgatgacgtagaggtgtttattttcgcgcgtgcgatttgtagtaaggggagggggagttgttcgatgacgtggtacggggcggtcggatttcgagtcgaggttttattttttagggatttttcgttaattgttacgtgcgtttcgttttgggcggttgagttatatttgagggttcgaagatttttttttgtttcgttttttcggcgtcgaaggtcgcgacgat

SEQ ID NO: 1140 - DNA, 684 bp, Artificial Sequence
  chemically treated genomic DNA (Homo sapiens) CpG-island No: 1140
atcgtcgcgaccttcgacgccgaaaaaacgaaacaaaaaaaaatcttcgaaccctcaaatataactcaaccgcccaaaacgaaacgcacgtaacaattaacgaaaaatccctaaaaaataaaacctcgactcgaaatccgaccgccccgtaccacgtcatcgaacaactccccctccccttactacaaatcgcacgcgcgaaaataaacacctctacgtcatcaaaacgcgtcctcgtctttcccctcccatctcctcaaatcgataaacgtactcgcctccactcgaaaccaaatctatatcccgatttcccgcaatcgcgaacaaaacgccaaaacgacaaaaaaaaaataaacgatcaaaaaacctccaaaaaaaacgactctcgactatttacatcgccgataaaaatacgatccgcgaaacgatacgaaaaccaacgaaaattacgacgtaaaaattttaataaaaaaataaaaatacgcctttaacaaactaaaaaaaataataaaaaaaccgtaacgttctcctaactttccaaacccgaaacgaactttacgtccaataaacactttaccttaaaaaaaaacgatcccaaattcaaattaaacgaaaaccttactaaaaaacgaaaaaataaaccccaacgcccgaaatacattctattcttaaacaaactcataa

SEQ ID NO: 1141 - DNA, 783 bp, Artificial Sequence
  chemically treated genomic DNA (Homo sapiens) CpG-island No: 1141
gttgttggcggtgcgcgattcgcgtttgtatacgtttatgtattattttttttgttatttggttttggtagacgcgggttttattattagcgtggtgtcgtcgttgttggttaatttgcgcggattagcgttttggttgtcgcgtagttattgtacggtttagttgtgcgtatcgttggttttgggttcggtcgaatgcgtttttttggcggtgatggttttggatcgcgcggtcgtagtgtgtcgttcgttgcgttatgcggggttcgttttttcgcgtttatgtcgtacgttggttagcgttttttggttaagcggttttattaattcggttgcgtaaatcgcgtttttggttgagcggtcgttgtgcgcgtttcgtttgttggattattttatttgtgagttgtcggcgttgtttaagttggtttgcggaggcgacggagatattatcgagaattagatgttcgtcgttcgcgtggttattttgttgttgtcgtttgtcgttattttggttttttacggtgtcgtggttcgagttgtttgttgtatgcggtttagcggaggtcggaggagggcggtgggtacgtgtgggttttatttgatagtcgtttgtttgttttacggttcggttatttatatttatttgtagttcgcgtagcgttataattaggtacggggtaagttcgtatcgtttttttatatcgtggttatatttgtttttaattcgtttatttatatttttaggaataagaaagtgaagggggtagcgaggaggttgttgcg

SEQ ID NO: 1142 - DNA, 783 bp, Artificial Sequence
  chemically treated genomic DNA (Homo sapiens) CpG-island No: 1142
cgcaacaacctcctcgctacccccttcactttcttattcctaaaaatataaataaacgaattaaaaacaaatataaccacgatataaaaaaacgatacgaacttaccccgtacctaattataacgctacgcgaactacaaataaatataaataaccgaaccgtaaaacaaacaaacgactatcaaataaaacccacacgtacccaccgccctcctccgacctccgctaaaccgcatacaacaaacaactcgaaccacgacaccgtaaaaaaccaaaataacgacaaacgacaacaacaaaataaccacgcgaacgacgaacatctaattctcgataatatctccgtcgcctccgcaaaccaacttaaacaacgccgacaactcacaaataaaataatccaacaaacgaaacgcgcacaacgaccgctcaaccaaaaacgcgatttacgcaaccgaattaataaaaccgcttaaccaaaaaacgctaaccaacgtacgacataaacgcgaaaaaacgaaccccgcataacgcaacgaacgacacactacgaccgcgcgatccaaaaccatcaccgccaaaaaaacgcattcgaccgaacccaaaaccaacgatacgcacaactaaaccgtacaataactacgcgacaaccaaaacgctaatccgcgcaaattaaccaacaacgacgacaccacgctaataataaaacccgcgtctaccaaaaccaaataacaaaaaaaataatacataaacgtatacaaacgcgaatcgcgcaccgccaacaac

SEQ ID NO: 1143 - DNA, 783 bp, Artificial Sequence
  chemically treated genomic DNA (Homo sapiens) CpG-island No: 1143
cgtagtagttttttcgttgttttttttatttttttatttttgagggtgtagatgagcgggttgagagtaggtgtgattacggtgtagaagagcgatacgaatttgtttcgtgtttggttgtagcgttgcgcgggttgtaggtaggtgtagatggtcgagtcgtagaataggtagacggttgttaggtgggatttatacgtgtttatcgttttttttcggttttcgttgaatcgtatgtaatagatagttcgggttacggtatcgtaggaggttaggatgacggtaaacggtagtagtaggatgattacgcgggcggcgaatatttggttttcggtagtgttttcgtcgttttcgtaggttagtttgagtaacgtcggtagtttatagatgaagtggtttagtaggcggggcgcgtatagcggtcgtttagttaggagcgcggtttgcgtaatcgagttggtgaggtcgtttagttaggaggcgttggttagcgtgcgatataggcgcggggagacgagtttcgtatagcgtagcgggcggtatattgcggtcgcgcggtttagagttattatcgttaggaggacgtattcggtcgaatttagagttagcgatgcgtatagttgggtcgtgtagtggttgcgcggtagttagagcgttggttcgcgtaggttggttagtagcggcggtattacgttagtagtgaagttcgcgtttattaaggttaggtggtagaggaagtagtatatgggcgtgtgtaggcgcgggtcgcgtatcgttagtagt

SEQ ID NO: 1144 - DNA, 783 bp, Artificial Sequence
  chemically treated genomic DNA (Homo sapiens) CpG-island No: 1144
actactaacgatacgcgacccgcgcctacacacgcccatatactacttcctctaccacctaaccttaataaacgcgaacttcactactaacgtaataccgccgctactaaccaacctacgcgaaccaacgctctaactaccgcgcaaccactacacgacccaactatacgcatcgctaactctaaattcgaccgaatacgtcctcctaacgataataactctaaaccgcgcgaccgcaatataccgcccgctacgctatacgaaactcgtctccccgcgcctatatcgcacgctaaccaacgcctcctaactaaacgacctcaccaactcgattacgcaaaccgcgctcctaactaaacgaccgctatacgcgccccgcctactaaaccacttcatctataaactaccgacgttactcaaactaacctacgaaaacgacgaaaacactaccgaaaaccaaatattcgccgcccgcgtaatcatcctactactaccgtttaccgtcatcctaacctcctacgataccgtaacccgaactatctattacatacgattcaacgaaaaccgaaaaaaaacgataaacacgtataaatcccacctaacaaccgtctacctattctacgactcgaccatctacacctacctacaacccgcgcaacgctacaaccaaacacgaaacaaattcgtatcgctcttctacaccgtaatcacacctactctcaacccgctcatctacaccctcaaaaataaaaaaataaaaaaaacaacgaaaaaactactacg

SEQ ID NO: 1145 - DNA, 949 bp, Artificial Sequence
  chemically treated genomic DNA (Homo sapiens) CpG-island No: 1145
gggcgtaggattcggggagtcgcgtcgggaggagggtcgggcgggttttagttttttttcgtttttaggtttttattttatgaggtatttttatatcgttatgtttcggttcggtcgcggggagtttcgttttattatcgtgggttacgtggacgatacgttgttcgtgaggttcgatagcgacgttacgagttcgaggaaggagtcgcgggcgttatggatagagtaggaggggtcggagtattgggatcgggagatatagatttttaagattaatatatagatttatcgagagaatttgcgtatcgcgtttcgttattataattagagcgaggtcggtgagtgatttcggttcggggcgtaggttacgattttttattttttacgtacggttcgggtcgtttcgagttttcgggttcgagattcgttttcgaggtcgcgggattcgtttagattttcgatcggcgagagttttaggcgcgtttattcggttttatttttagttgaggttaaaattttcgcgggttggtcggggcggggcggggttcgggggacggggttgatcgcggggtcggggttagggttttatattatttagaggatgtacggttgcgacgtggggtcggacgggcgtttttttcgcgggtatgattaggacgtttacgacggtaaggattatatcgttttgaacgaggatttgagtttttggatcgcggcggatatcgcggtttagattatttagcgtaagtgggaggcggttcgtgtggcggagtagttgagagtttatttggagggtttgtgcgtggagtcgtttcgtagatatttggagaacgggaaggagacgttgtagcgcgcgggtattaggggtagtggggagttttttttattttttataggtcgtcggggatggttttttacgagaagaggaggaaaatgggattagcgttag

SEQ ID NO: 1146 - DNA, 949 bp, Artificial Sequence
  chemically treated genomic DNA (Homo sapiens) CpG-island No: 1146
ctaacgctaatcccattttcctcctcttctcgtaaaaaaccatccccgacgacctataaaaaataaaaaaaactccccactacccctaatacccgcgcgctacaacgtctccttcccgttctccaaatatctacgaaacgactccacgcacaaaccctccaaataaactctcaactactccgccacacgaaccgcctcccacttacgctaaataatctaaaccgcgatatccgccgcgatccaaaaactcaaatcctcgttcaaaacgatataatccttaccgtcgtaaacgtcctaatcatacccgcgaaaaaaacgcccgtccgaccccacgtcgcaaccgtacatcctctaaataatataaaaccctaaccccgaccccgcgatcaaccccgtcccccgaaccccgccccgccccgaccaacccgcgaaaattttaacctcaactaaaaataaaaccgaataaacgcgcctaaaactctcgccgatcgaaaatctaaacgaatcccgcgacctcgaaaacgaatctcgaacccgaaaactcgaaacgacccgaaccgtacgtaaaaaataaaaaatcgtaacctacgccccgaaccgaaatcactcaccgacctcgctctaattataataacgaaacgcgatacgcaaattctctcgataaatctatatattaatcttaaaaatctatatctcccgatcccaatactccgacccctcctactctatccataacgcccgcgactccttcctcgaactcgtaacgtcgctatcgaacctcacgaacaacgtatcgtccacgtaacccacgataataaaacgaaactccccgcgaccgaaccgaaacataacgatataaaaatacctcataaaataaaaacctaaaaacgaaaaaaaactaaaacccgcccgaccctcctcccgacgcgactccccgaatcctacgccc

SEQ ID NO: 1147 - DNA, 949 bp, Artificial Sequence
  chemically treated genomic DNA (Homo sapiens) CpG-island No: 1147
ttagcgttgattttatttttttttttttttcgtgggaggttattttcggcgatttataggagatggggaaggttttttattgtttttggtattcgcgcgttgtagcgtttttttttcgttttttaggtatttgcggagcgattttacgtataggttttttaggtaggtttttagttgtttcgttatacgggtcgttttttatttgcgttgggtgatttgagtcgcggtgttcgtcgcggtttaggagtttaggttttcgtttagggcgatgtaatttttgtcgtcgtaggcgttttggttatattcgcggaggaggcgttcgttcggttttacgtcgtagtcgtatattttttggatgatgtgagattttggtttcggtttcgcggttagtttcgtttttcgagtttcgtttcgtttcgattaattcgcggggattttggttttaattgaaaatgaaatcgggtaaacgcgtttggggttttcgtcggtcgagggtttgggcgggtttcgcggtttcgggggcggatttcggattcggagattcggggcgattcgggtcgtacgtgggggatggggagtcgtgatttgcgtttcgggtcggggttatttatcggtttcgttttggttgtagtagcggagcgcggtgcgtaggttttttcggtaagtttgtgtgttggttttggagatttgtgtttttcggttttaatatttcggttttttttgttttatttatggcgttcgcggtttttttttcggattcgtggcgtcgttgtcgaattttacgaatagcgtgtcgtttacgtagtttacggtgatgaagcggggtttttcgcggtcgggtcgggatatggcggtgtagaaatattttatggagtgggagtttgggggcgaggaggggttgagattcgttcgatttttttttcggcgcggtttttcgggttttgcgttt

SEQ ID NO: 1148 - DNA, 949 bp, Artificial Sequence
  chemically treated genomic DNA (Homo sapiens) CpG-island No: 1148
aaacgcaaaacccgaaaaaccgcgccgaaaaaaaaatcgaacgaatctcaacccctcctcgcccccaaactcccactccataaaatatttctacaccgccatatcccgacccgaccgcgaaaaaccccgcttcatcaccgtaaactacgtaaacgacacgctattcgtaaaattcgacaacgacgccacgaatccgaaaaaaaaaccgcgaacgccataaataaaacaaaaaaaaccgaaatattaaaaccgaaaaacacaaatctccaaaaccaacacacaaacttaccgaaaaaacctacgcaccgcgctccgctactacaaccaaaacgaaaccgataaataaccccgacccgaaacgcaaatcacgactccccatcccccacgtacgacccgaatcgccccgaatctccgaatccgaaatccgcccccgaaaccgcgaaacccgcccaaaccctcgaccgacgaaaaccccaaacgcgtttacccgatttcattttcaattaaaaccaaaatccccgcgaattaatcgaaacgaaacgaaactcgaaaaacgaaactaaccgcgaaaccgaaaccaaaatctcacatcatccaaaaaatatacgactacgacgtaaaaccgaacgaacgcctcctccgcgaatataaccaaaacgcctacgacgacaaaaattacatcgccctaaacgaaaacctaaactcctaaaccgcgacgaacaccgcgactcaaatcacccaacgcaaataaaaaacgacccgtataacgaaacaactaaaaacctacctaaaaaacctatacgtaaaatcgctccgcaaatacctaaaaaacgaaaaaaaaacgctacaacgcgcgaataccaaaaacaataaaaaaccttccccatctcctataaatcgccgaaaataacctcccacgaaaaaaaaaaaaaaataaaatcaacgctaa

SEQ ID NO: 1149 - DNA, 570 bp, Artificial Sequence
  chemically treated genomic DNA (Homo sapiens) CpG-island No: 1149
aggtgtgacgtgtagatgggatgttcgtcgttatgacgttgtcgagattcgcggtgattgcgttagagttttattcggggaggtgagtagtagcgggacgggggaacggcggggtagttaagtaacgtcggacgcgttgacgtcgtcggggcggtaaaacgttcgttcgggttcgaggcgggcggaggtagttgtggttacgtgcggggggtcggtgacgtagtcgcggggcgttgggacgcggtttgcggagtcggtcggcgagcgtaggttttaggttcgggcgcggcggcgggatagtatttattttttcggtttcgggttcgggagtgcggggcgcggagtcgtcggagcgttgttttttttttttttttttttttcgttttcgtttcgcggcgcgatatataatattcgtcggaagcggaagtcgcgtcgaggttcgtgttagtggaagttggggtgtcggcgggcggtcgcggtcgggtttagcggtgtttgcggaagaaggaggaggagggttggcgatgagaagtagtagggggaattaagggtaagaagggatttagaggg

SEQ ID NO: 1150 - DNA, 570 bp, Artificial Sequence
  chemically treated genomic DNA (Homo sapiens) CpG-island No: 1150
ccctctaaatcccttcttacccttaattccccctactacttctcatcgccaaccctcctcctccttcttccgcaaacaccgctaaacccgaccgcgaccgcccgccgacaccccaacttccactaacacgaacctcgacgcgacttccgcttccgacgaatattatatatcgcgccgcgaaacgaaaacgaaaaaaaaaaaaaaaaaaaaaacaacgctccgacgactccgcgccccgcactcccgaacccgaaaccgaaaaaataaatactatcccgccgccgcgcccgaacctaaaacctacgctcgccgaccgactccgcaaaccgcgtcccaacgccccgcgactacgtcaccgaccccccgcacgtaaccacaactacctccgcccgcctcgaacccgaacgaacgttttaccgccccgacgacgtcaacgcgtccgacgttacttaactaccccgccgttcccccgtcccgctactactcacctccccgaataaaactctaacgcaatcaccgcgaatctcgacaacgtcataacgacgaacatcccatctacacgtcacacct

SEQ ID NO: 1151 - DNA, 570 bp, Artificial Sequence
  chemically treated genomic DNA (Homo sapiens) CpG-island No: 1151
ttttttgggtttttttttgtttttgattttttttgttgttttttatcgttagttttttttttttttttttcgtaggtatcgttagattcggtcgcggtcgttcgtcgatattttagtttttattgatacgagtttcggcgcggttttcgttttcggcgagtattgtgtgtcgcgtcgcggggcgggggcgaggggaggaggaaggagggaggtagcgtttcggcggtttcgcgtttcgtattttcggattcgaagtcgggaaggtaggtgttgtttcgtcgtcgcgttcgagtttggggtttgcgttcgtcggtcggtttcgtaagtcgcgttttagcgtttcgcgattgcgttatcggtttttcgtacgtaattatagttgttttcgttcgtttcgggttcgggcggacgttttgtcgtttcggcgacgttagcgcgttcggcgttgtttggttatttcgtcgttttttcgtttcgttgttgtttattttttcgggtgaaattttgacgtagttatcgcgggtttcggtagcgttatagcggcgggtattttatttgtacgttatattt

SEQ ID NO: 1152 - DNA, 570 bp, Artificial Sequence
  chemically treated genomic DNA (Homo sapiens) CpG-island No: 1152
aaatataacgtacaaataaaatacccgccgctataacgctaccgaaacccgcgataactacgtcaaaatttcacccgaaaaaataaacaacaacgaaacgaaaaaacgacgaaataaccaaacaacgccgaacgcgctaacgtcgccgaaacgacaaaacgtccgcccgaacccgaaacgaacgaaaacaactataattacgtacgaaaaaccgataacgcaatcgcgaaacgctaaaacgcgacttacgaaaccgaccgacgaacgcaaaccccaaactcgaacgcgacgacgaaacaacacctaccttcccgacttcgaatccgaaaatacgaaacgcgaaaccgccgaaacgctacctccctccttcctcctcccctcgcccccgccccgcgacgcgacacacaatactcgccgaaaacgaaaaccgcgccgaaactcgtatcaataaaaactaaaatatcgacgaacgaccgcgaccgaatctaacgatacctacgaaaaaaaaaaaaaaaaaactaacgataaaaaacaacaaaaaaaatcaaaaacaaaaaaaaacccaaaaaa

SEQ ID NO: 1153 - DNA, 839 bp, Artificial Sequence
  chemically treated genomic DNA (Homo sapiens) CpG-island No: 1153
ttcgcgcgttgtagcgtttttttttcgttttttaggtatttgcggagttattttacgaattcgttttttaggtaggtttttagttgtttcgttatacgggtcgttttttatttgcgtttggtgatttgagttgttatgttcgtcgcggtttaggagcgtaggttttcgtttagagcgatgtaatttttgtcgtcgtaggcgtgttgtttatattcgcggaggaagcgttcgtcgggttttacgtcgtagttatatattatttgtatggtgtgggaatttggtttcgttttcgcggttagttcggtttttcgagtttcgttttgtttcgattaattcgcggggattttggtttaaattgaaaatgaaatcgggtaaaggcgtttgggttttttttaggttaagggtttcggggtttcgcggtttcggggaggatttcggatttagagattcgaggcgattcggtttttcgtgggggatggggaggggtcgtgatttgcgtttcgggtcggggttatttatcgttttcgttttggttgtagtagcggagcgcgattcgtaggttttttcgtttagttcgtgtttgggttttgtagatttgtgtgtttcggttttaatatttcggtttttttcgttttatttacggcgttcgcggtttttttttcggattcgcgtcgtcgttgtcgaatcgtacgaattgcgtatagtttacgtagtcgacggagatgaagcggggtttttcgcggtcgggtcgggatatggtggtgtagaaatattttatggagtgggagtttgggagcgaggaggagttgagattcgttcgatttttttttttgcgcggt

SEQ ID NO: 1154 - DNA, 839 bp, Artificial Sequence
  chemically treated genomic DNA (Homo sapiens) CpG-island No: 1154
accgcgcaaaaaaaaaaatcgaacgaatctcaactcctcctcgctcccaaactcccactccataaaatatttctacaccaccatatcccgacccgaccgcgaaaaaccccgcttcatctccgtcgactacgtaaactatacgcaattcgtacgattcgacaacgacgacgcgaatccgaaaaaaaaaccgcgaacgccgtaaataaaacgaaaaaaaccgaaatattaaaaccgaaacacacaaatctacaaaacccaaacacgaactaaacgaaaaaacctacgaatcgcgctccgctactacaaccaaaacgaaaacgataaataaccccgacccgaaacgcaaatcacgacccctccccatcccccacgaaaaaccgaatcgcctcgaatctctaaatccgaaatcctccccgaaaccgcgaaaccccgaaacccttaacctaaaaaaaacccaaacgcctttacccgatttcattttcaatttaaaccaaaatccccgcgaattaatcgaaacaaaacgaaactcgaaaaaccgaactaaccgcgaaaacgaaaccaaattcccacaccatacaaataatatataactacgacgtaaaacccgacgaacgcttcctccgcgaatataaacaacacgcctacgacgacaaaaattacatcgctctaaacgaaaacctacgctcctaaaccgcgacgaacataacaactcaaatcaccaaacgcaaataaaaaacgacccgtataacgaaacaactaaaaacctacctaaaaaacgaattcgtaaaataactccgcaaatacctaaaaaacgaaaaaaaaacgctacaacgcgcgaa

SEQ ID NO: 1155 - DNA, 839 bp, Artificial Sequence
  chemically treated genomic DNA (Homo sapiens) CpG-island No: 1155
gtcgcgtagggaggagggtcgggcgggttttagttttttttcgtttttaggtttttattttatgaggtatttttatattattatgtttcggttcggtcgcggggagtttcgttttattttcgtcggttacgtggattatacgtagttcgtgcggttcgatagcgacgacgcgagttcgagagaggagtcgcgggcgtcgtggatggagcgggaggggtcggagtattgggatcggaatatatagatttgtaaggtttaagtacggattgaacgagagaatttgcggatcgcgtttcgttattataattagagcgagggcggtgagtgatttcggttcgggacgtaggttacgatttttttttattttttacggagggtcgggtcgtttcgagtttttgggttcgagatttttttcgaaatcgcgggatttcgagatttttgatttgggagaggtttaggcgtttttattcggttttatttttagtttaggttaaaattttcgcgggttggtcggggtagggcggggttcgggggatcgggttgatcgcgggggcggggttaggtttttatattatgtaggtgatgtatggttgcgacgtggggttcgacgggcgtttttttcgcgggtatgaatagtacgtttacgacggtaaggattatatcgttttgaacgaggatttgcgtttttggatcgcggcggatatggtagtttagattattaagcgtaagtgggaggcggttcgtgtggcggagtagttgagagtttatttggagggcgagttcgtggagtggtttcgtagatatttggagaacgggaaggagacgttgtagcgcgcggg

SEQ ID NO: 1156 - DNA, 839 bp, Artificial Sequence
  chemically treated genomic DNA (Homo sapiens) CpG-island No: 1156
cccgcgcgctacaacgtctccttcccgttctccaaatatctacgaaaccactccacgaactcgccctccaaataaactctcaactactccgccacacgaaccgcctcccacttacgcttaataatctaaactaccatatccgccgcgatccaaaaacgcaaatcctcgttcaaaacgatataatccttaccgtcgtaaacgtactattcatacccgcgaaaaaaacgcccgtcgaaccccacgtcgcaaccatacatcacctacataatataaaaacctaaccccgcccccgcgatcaacccgatcccccgaaccccgccctaccccgaccaacccgcgaaaattttaacctaaactaaaaataaaaccgaataaaaacgcctaaacctctcccaaatcaaaaatctcgaaatcccgcgatttcgaaaaaaatctcgaacccaaaaactcgaaacgacccgaccctccgtaaaaaataaaaaaaaatcgtaacctacgtcccgaaccgaaatcactcaccgccctcgctctaattataataacgaaacgcgatccgcaaattctctcgttcaatccgtacttaaaccttacaaatctatatattccgatcccaatactccgacccctcccgctccatccacgacgcccgcgactcctctctcgaactcgcgtcgtcgctatcgaaccgcacgaactacgtataatccacgtaaccgacgaaaataaaacgaaactccccgcgaccgaaccgaaacataataatataaaaatacctcataaaataaaaacctaaaaacgaaaaaaaactaaaacccgcccgaccctcctccctacgcgac

SEQ ID NO: 1157 - DNA, 948 bp, Artificial Sequence
  chemically treated genomic DNA (Homo sapiens) CpG-island No: 1157
cgtgcgttgtagcgtttttttttcgttttttaggtatttgcggagttattttacgtacgtgttttttaggtaggtttttaattgtttcgttatacgggtcgttttttatttgcgttgggtgatttgagtcgttatgttcgtcgcggtttaagagcgtaggttttcgtttaaggcgatgtaatttttgtcgtcgtaggcgttttgtcggtattcgcggaggaagcgttcgttcgattttacgtcgtagttatatattatttggatggtgtgagaatttggtttcgattttacggttagtttagtttttcgagtttcgttcggtttcgattaattcggggggatttttggtttaaattgaaaatgaaatcgggtaaaggcgtttgggtttttttcggggtaagggtttcggggtttcgcggtttcggggtggatttcggattcggagattgtgggcgattcggttcgttcgtgggggatgagaggtcgtgatttgcgtttcgggtcggggttatttatcggtttcgttttggttgtagtagtcgcgtagggtttttaggttcgttcggttagtttgtgattgggtttttatatttcgtgtttgtaggttttaatatttcggttttttttgttttatttacggtgttcgcggttttattttttggttcgcggcgtcgttgttaaatcgtacgaattgcgtgtcgtttacgtagtttacggcgatgaagcggggtttttcgcggtcgggtcgggatacggatgtggtgaaatattttatggagtgggagtttgggggcgaggagtggttgagatttattcgatttttttttcggcgcggttattcgggttttgcgttttcgtcgggcgggttttttgttttttttcgtagaggcggtttttttacgatttcgtatttattcgtttaggtttgggttagggttagggttttta

SEQ ID NO: 1158 - DNA, 948 bp, Artificial Sequence
  chemically treated genomic DNA (Homo sapiens) CpG-island No: 1158
taaaaaccctaaccctaacccaaacctaaacgaataaatacgaaatcgtaaaaaaaccgcctctacgaaaaaaaacaaaaaacccgcccgacgaaaacgcaaaacccgaataaccgcgccgaaaaaaaaatcgaataaatctcaaccactcctcgcccccaaactcccactccataaaatatttcaccacatccgtatcccgacccgaccgcgaaaaaccccgcttcatcgccgtaaactacgtaaacgacacgcaattcgtacgatttaacaacgacgccgcgaaccaaaaaataaaaccgcgaacaccgtaaataaaacaaaaaaaaccgaaatattaaaacctacaaacacgaaatataaaaacccaatcacaaactaaccgaacgaacctaaaaaccctacgcgactactacaaccaaaacgaaaccgataaataaccccgacccgaaacgcaaatcacgacctctcatcccccacgaacgaaccgaatcgcccacaatctccgaatccgaaatccaccccgaaaccgcgaaaccccgaaacccttaccccgaaaaaaacccaaacgcctttacccgatttcattttcaatttaaaccaaaaatccccccgaattaatcgaaaccgaacgaaactcgaaaaactaaactaaccgtaaaatcgaaaccaaattctcacaccatccaaataatatataactacgacgtaaaatcgaacgaacgcttcctccgcgaataccgacaaaacgcctacgacgacaaaaattacatcgccttaaacgaaaacctacgctcttaaaccgcgacgaacataacgactcaaatcacccaacgcaaataaaaaacgacccgtataacgaaacaattaaaaacctacctaaaaaacacgtacgtaaaataactccgcaaatacctaaaaaacgaaaaaaaaacgctacaacgcacg

SEQ ID NO: 1159 - DNA, 948 bp, Artificial Sequence
  chemically treated genomic DNA (Homo sapiens) CpG-island No: 1159
tgggggttttggttttgatttagatttgggcgggtgagtgcggggtcgtggggaaatcgtttttgcggggagaagtaaggggttcgttcggcggggacgtaggattcgggtagtcgcgtcgggaggagggtcgggtgggttttagttatttttcgtttttaggtttttattttatgaggtattttattatattcgtgtttcggttcggtcgcggggagtttcgttttatcgtcgtgggttacgtggacgatacgtagttcgtgcggtttgatagcgacgtcgcgagttagaggatggagtcgcgggtatcgtggatagagtaggaggggtcggagtattgggatttgtagatacggaatgtgaaggtttagttatagattgatcgagcgaatttggggattttgcgcggttattataattagagcgaggtcggtgagtgatttcggttcggggcgtaggttacgattttttattttttacggacgggtcgggtcgtttatagttttcgggttcgagatttatttcgaagtcgcgggatttcgagatttttgtttcgggagaggtttaggcgtttttattcggttttatttttagtttaggttaaaaattttttcgggttggtcggggtcggacggggttcgggggattgggttgatcgtggggtcggggttaggtttttatattatttagatgatgtatggttgcgacgtggggtcggacgggcgtttttttcgcgggtatcggtaggacgtttacgacggtaaggattatatcgttttgaacgaggatttgcgtttttggatcgcggcggatatggcggtttagattatttagcgtaagtgggaggcggttcgtgtggcggagtagttgagagtttatttggagggtacgtgcgtggagtggtttcgtagatatttggagaacgggaaggagacgttgtagcgtacg

SEQ ID NO: 1160 - DNA, 948 bp, Artificial Sequence
  chemically treated genomic DNA (Homo sapiens) CpG-island No: 1160
cgtacgctacaacgtctccttcccgttctccaaatatctacgaaaccactccacgcacgtaccctccaaataaactctcaactactccgccacacgaaccgcctcccacttacgctaaataatctaaaccgccatatccgccgcgatccaaaaacgcaaatcctcgttcaaaacgatataatccttaccgtcgtaaacgtcctaccgatacccgcgaaaaaaacgcccgtccgaccccacgtcgcaaccatacatcatctaaataatataaaaacctaaccccgaccccacgatcaacccaatcccccgaaccccgtccgaccccgaccaacccgaaaaaatttttaacctaaactaaaaataaaaccgaataaaaacgcctaaacctctcccgaaacaaaaatctcgaaatcccgcgacttcgaaataaatctcgaacccgaaaactataaacgacccgacccgtccgtaaaaaataaaaaatcgtaacctacgccccgaaccgaaatcactcaccgacctcgctctaattataataaccgcgcaaaatccccaaattcgctcgatcaatctataactaaaccttcacattccgtatctacaaatcccaatactccgacccctcctactctatccacgatacccgcgactccatcctctaactcgcgacgtcgctatcaaaccgcacgaactacgtatcgtccacgtaacccacgacgataaaacgaaactccccgcgaccgaaccgaaacacgaatataataaaatacctcataaaataaaaacctaaaaacgaaaaataactaaaacccacccgaccctcctcccgacgcgactacccgaatcctacgtccccgccgaacgaaccccttacttctccccgcaaaaacgatttccccacgaccccgcactcacccgcccaaatctaaatcaaaaccaaaaccccca

SEQ ID NO: 1161 - DNA, 631 bp, Artificial Sequence
  chemically treated genomic DNA (Homo sapiens) CpG-island No: 1161
cgttcggcgagggcgtaggattcggggagtcgcgtagggaggagggtcgggcgggttttagttttttttcgtttttaggtttttattttatgaggtatttttatatcgtcgtgtttcggttcggtcgcggagagtttcgttttatcgtagtgggttacgtggacgatacgtagttcgtgtagttcgatagcgacgtcgcgagtttaagaggggagtcgcgggcgtcgtgggtggagtaggaggggtcggagtattgggatcgggagatatagaagtataagcgttaggtatagattgatcgagtgagtttgcggaatttgcgcggttattataattagagcgaggtcggtgagtgatttcggttcggggcgtaggttacgatttttttttattttttacggacggttcgggtcgtttcgagtttttcggtttgagatttatttcgaggttgcggaattcgtttagattttcgatcggagagagttttagttatttttattcggttttatttttagtttaggttaaaattttcgcgggttggtcggggttggggcggggttcgggggacggggttgattacgggggcggggttagggttttatattttttagaggatgtatggttgcgattt

SEQ ID NO: 1162 - DNA, 631 bp, Artificial Sequence
  chemically treated genomic DNA (Homo sapiens) CpG-island No: 1162
aaatcgcaaccatacatcctctaaaaaatataaaaccctaaccccgcccccgtaatcaaccccgtcccccgaaccccgccccaaccccgaccaacccgcgaaaattttaacctaaactaaaaataaaaccgaataaaaataactaaaactctctccgatcgaaaatctaaacgaattccgcaacctcgaaataaatctcaaaccgaaaaactcgaaacgacccgaaccgtccgtaaaaaataaaaaaaaatcgtaacctacgccccgaaccgaaatcactcaccgacctcgctctaattataataaccgcgcaaattccgcaaactcactcgatcaatctatacctaacgcttatacttctatatctcccgatcccaatactccgacccctcctactccacccacgacgcccgcgactcccctcttaaactcgcgacgtcgctatcgaactacacgaactacgtatcgtccacgtaacccactacgataaaacgaaactctccgcgaccgaaccgaaacacgacgatataaaaatacctcataaaataaaaacctaaaaacgaaaaaaaactaaaacccgcccgaccctcctccctacgcgactccccgaatcctacgccctcgccgaacg

SEQ ID NO: 1163 - DNA, 631 bp, Artificial Sequence
  chemically treated genomic DNA (Homo sapiens) CpG-island No: 1163
aggtcgtagttatatattttttggagggtgtgagattttggtttcgttttcgtggttagtttcgtttttcgagtttcgttttagtttcgattaattcgcggggattttggtttaaattgaaaatgaaatcgggtaaaggtgattggggtttttttcggtcgagggtttgggcgggtttcgtagtttcggggtggattttagatcgggagattcggggcgattcgggtcgttcgtgggggatggggaggggtcgtgatttgcgtttcgggtcggggttatttatcggtttcgttttggttgtagtagtcgcgtaggtttcgtaggtttattcggttagtttgtgtttggcgtttgtatttttgtgtttttcggttttaatatttcggttttttttgttttatttacggcgttcgcggttttttttttggattcgcggcgtcgttgtcgaattgtacgaattgcgtgtcgtttacgtagtttattgcgatgaagcggggtttttcgcggtcgggtcgggatacggcggtgtagaaatattttatggagtgggagtttgggggcgaggaggggttgagattcgttcgatttttttttttgcgcggtttttcgggttttgcgttttcgtcgggcg

SEQ ID NO: 1164 - DNA, 631 bp, Artificial Sequence
  chemically treated genomic DNA (Homo sapiens) CpG-island No: 1164
cgcccgacgaaaacgcaaaacccgaaaaaccgcgcaaaaaaaaaaatcgaacgaatctcaacccctcctcgcccccaaactcccactccataaaatatttctacaccgccgtatcccgacccgaccgcgaaaaaccccgcttcatcgcaataaactacgtaaacgacacgcaattcgtacaattcgacaacgacgccgcgaatccaaaaaaaaaaccgcgaacgccgtaaataaaacaaaaaaaaccgaaatattaaaaccgaaaaacacaaaaatacaaacgccaaacacaaactaaccgaataaacctacgaaacctacgcgactactacaaccaaaacgaaaccgataaataaccccgacccgaaacgcaaatcacgacccctccccatcccccacgaacgacccgaatcgccccgaatctcccgatctaaaatccaccccgaaactacgaaacccgcccaaaccctcgaccgaaaaaaaccccaatcacctttacccgatttcattttcaatttaaaccaaaatccccgcgaattaatcgaaactaaaacgaaactcgaaaaacgaaactaaccacgaaaacgaaaccaaaatctcacaccctccaaaaaatatataactacgacct

SEQ ID NO: 1165 - DNA, 656 bp, Artificial Sequence
  chemically treated genomic DNA (Homo sapiens) CpG-island No: 1165
ggttttttcgggagcgtaaggtagtgatgatacgcgttttttttttttcgaacgcgagttggtagcgttcgtgacggagttagtttggtttttttacgcgcgttttttttttcgtcgtcggggcgttttttcggtgttattggtttttacgtgttagtagtttatttcgtattattttttcgtttcgtttttggagggaagtgattatatttttttcgttcgttttttatcgtcgtcgcggcggtaattttgtcgggttcgttcgttgacgttatttgttagtttcgttttttttagggtttcgggtttttgcggcgggggttgtttcggggggtagttagttgaggcggcgggagttcggcggagggcgggttaggtgattggttcgggttatgtcgaggaagaagttatttagcgtgaagtagaagaagaagtagttgtaggataaacgggagcggaagagaggttagtgcgggagcgggaggagggggcggggttcgggttttcgtatatttggaaggaggggtgtgttcgttgtatttttggggatcgtgggagggggtcgtgggatcgcgttaattttcgcggtttatcgcggaggggattttttattttttttatatttggaaggggtggggaaggatggagagttgggg

SEQ ID NO: 1166 - DNA, 656 bp, Artificial Sequence
  chemically treated genomic DNA (Homo sapiens) CpG-island No: 1166
ccccaactctccatccttccccaccccttccaaatataaaaaaaataaaaaatcccctccgcgataaaccgcgaaaattaacgcgatcccacgaccccctcccacgatccccaaaaatacaacgaacacacccctccttccaaatatacgaaaacccgaaccccgccccctcctcccgctcccgcactaacctctcttccgctcccgtttatcctacaactacttcttcttctacttcacgctaaataacttcttcctcgacataacccgaaccaatcacctaacccgccctccgccgaactcccgccgcctcaactaactaccccccgaaacaacccccgccgcaaaaacccgaaaccctaaaaaaaacgaaactaacaaataacgtcaacgaacgaacccgacaaaattaccgccgcgacgacgataaaaaacgaacgaaaaaaatataatcacttccctccaaaaacgaaacgaaaaaataatacgaaataaactactaacacgtaaaaaccaataacaccgaaaaaacgccccgacgacgaaaaaaaaaacgcgcgtaaaaaaaccaaactaactccgtcacgaacgctaccaactcgcgttcgaaaaaaaaaaaacgcgtatcatcactaccttacgctcccgaaaaaacc

SEQ ID NO: 1167 - DNA, 656 bp, Artificial Sequence
  chemically treated genomic DNA (Homo sapiens) CpG-island No: 1167
ttttaattttttatttttttttattttttttagatgtagggggggtgggggatttttttcgcgataggtcgcgagggttgacgcggttttacgatttttttttacgatttttagaggtgtagcgggtatatttttttttttagatgtgcggaagttcgagtttcgtttttttttttcgttttcgtattgatttttttttcgttttcgtttgttttgtaattgtttttttttttgttttacgttgaatggtttttttttcggtatggttcggattagttatttggttcgtttttcgtcgagttttcgtcgttttaattgattgtttttcggggtagttttcgtcgtaggggttcgggattttagaggaggcggggttagtaggtgacgttagcgggcgggttcgatagaattatcgtcgcggcggcgatggaaggcggacgggggagatatagttatttttttttaggagcgaggcgagaggatgatgcggggtgggttattggtacgtgagagttagtggtatcgagagggcgtttcggcggcgaggaaggaggcgcgcgtgggaggattaggttaatttcgttacggacgttattaattcgcgttcggaggagggggggcgcgtgttattattattttgcgttttcgggagaatt

SEQ ID NO: 1168 - DNA, 656 bp, Artificial Sequence
  chemically treated genomic DNA (Homo sapiens) CpG-island No: 1168
aattctcccgaaaacgcaaaataataataacacgcgccccccctcctccgaacgcgaattaataacgtccgtaacgaaattaacctaatcctcccacgcgcgcctccttcctcgccgccgaaacgccctctcgataccactaactctcacgtaccaataacccaccccgcatcatcctctcgcctcgctcctaaaaaaaaataactatatctcccccgtccgccttccatcgccgccgcgacgataattctatcgaacccgcccgctaacgtcacctactaaccccgcctcctctaaaatcccgaacccctacgacgaaaactaccccgaaaaacaatcaattaaaacgacgaaaactcgacgaaaaacgaaccaaataactaatccgaaccataccgaaaaaaaaaccattcaacgtaaaacaaaaaaaaaaacaattacaaaacaaacgaaaacgaaaaaaaaatcaatacgaaaacgaaaaaaaaaaacgaaactcgaacttccgcacatctaaaaaaaaaaatatacccgctacacctctaaaaatcgtaaaaaaaaatcgtaaaaccgcgtcaaccctcgcgacctatcgcgaaaaaaatcccccaccccccctacatctaaaaaaaataaaaaaaaataaaaaattaaaa

SEQ ID NO: 1169 - DNA, 1980 bp, Artificial Sequence
  chemically treated genomic DNA (Homo sapiens) CpG-island No: 1169
tgtagacgcggcggggattcggagggtgtcgtgcgggcgaggtcgtttaaatttggtaataaataaagtttgggaagtttggatttggtcgtttgggttttgttcgcgttttaacgtggatggggcggtagcggggcgggcgtcgttgatatgcggagggtagtggggattcggggcgcgggagggtcggggtcggtttttttagggtcggcggtagtagcggtggcggcgcggttattgttcggaggcggcgcgggttgtcgttagtatacgtcgtagtgaggtaaacggtttcggaggtcggtagttacggtgttgagtcgtttttcggtttagggcggcgaattcgtttgcgatcgttagcgtttcgcggttttcgttcgggcgagttcgcgtacgcgttcggtacgcggcggttttatcgggtttagtgggttgcgcgattttcgggtggcgggttttgcgattaagcggtcgtttcgttcgggattgagggcgagtgatcgttgtttttaggagttcgaagttgagagtcgtttacgttttttttttttcgtttagtcggggttttcgcggttcgcgttttacgacgtttagtattcggtaagtatcggaaagagtagtgtatatttcggcggcgcgagggcggtcggggttttgcgtttgcgttttgaagcggcgagcgcgttttcgtcgttcggcgcgtgcgcgaagggttcgcggttttcgcgtattcgcgtcggggcgtcgcgtttttacgtttttttcgtcgtcgaggtttcgtgcggcgtcggagaagttgttagagagatgggtttaggacgcgggatttaggtcgggttgtggtcgggggacgtgggggcggcggcgattaacgcgggagtcgttacgacgggttcggcgaggcgcggcggaaagagtttttcgtcgaggttagtcgttagtttgtttagtatcgattcggatggtaggacgtataggttcgagtcggggtatttttcgtcgttcggttttttttcgatgacggggatggcggggtcgtcgtcggcgtcgtttagggtgcgatcgtcgggcgggtcgtttacgttgtcgtcgcgtcgtaagggcgtacgcgcgggtcgggtcgcgtcggtaggcggtgtcggggtttcggttagggtcggggtcgcgcgggcgtcggggtcgttgtgttgtcggttacgttgttattgtttgcgggcgtgcgggtgcgcgcgggcgcggtgtcgcgcggtagtcggcgtgtcgtcgaagtgcgggtcgtggcgtaggaattcgtggaatagcgcgttcgttttttcgtcgatgttgtagtcgcggcgcgggcggcggggttaggcgcgcgggttgcggggtcgggcgggcgcggtaggtggttcggtgtcgtcgtttgcgtcgcggttttcgatgttggcgtagttattgtttatttgtagtagtcggcgcgtttcgtcgtttttgggtcgcggcgcgggcggggagggcggcgggaaggcgggcgtcgcgttttcggagtttgagttcgagttgtcgtcgttgcgtatcgagtcgcggtcgttgtcgttgttgttgtggttcgaggcggtcgtatgtagtttaagcgaggcgcgtaggttttataggtcgcggtagttggtttgggtttgttcggggttcgcgtttcgttcggcgttcggttttagtggcggttgttgttgtttaggtttcgcgttgttcgcgtcgcgtttcgggggggaatcggggttcgtttttttcgttgtttcggtcgtttttagtttgtaagttaggtcgcgtcgttagagtttcgtcgagtttcgcgttttttattcggtcggttatttcgtttttggattagggagggtggacgcgggtgggatttgggattcgggcgggttttggaaggtgagagttttaaaatgagttagtgtgttttgtaggggatgcgttttgtattgattttga

SEQ ID NO: 1170 - DNA, 1980 bp, Artificial Sequence
  chemically treated genomic DNA (Homo sapiens) CpG-island No: 1170
tcaaaatcaatacaaaacgcatcccctacaaaacacactaactcattttaaaactctcaccttccaaaacccgcccgaatcccaaatcccacccgcgtccaccctccctaatccaaaaacgaaataaccgaccgaataaaaaacgcgaaactcgacgaaactctaacgacgcgacctaacttacaaactaaaaacgaccgaaacaacgaaaaaaacgaaccccgattcccccccgaaacgcgacgcgaacaacgcgaaacctaaacaacaacaaccgccactaaaaccgaacgccgaacgaaacgcgaaccccgaacaaacccaaaccaactaccgcgacctataaaacctacgcgcctcgcttaaactacatacgaccgcctcgaaccacaacaacaacgacaacgaccgcgactcgatacgcaacgacgacaactcgaactcaaactccgaaaacgcgacgcccgccttcccgccgccctccccgcccgcgccgcgacccaaaaacgacgaaacgcgccgactactacaaataaacaataactacgccaacatcgaaaaccgcgacgcaaacgacgacaccgaaccacctaccgcgcccgcccgaccccgcaacccgcgcgcctaaccccgccgcccgcgccgcgactacaacatcgacgaaaaaacgaacgcgctattccacgaattcctacgccacgacccgcacttcgacgacacgccgactaccgcgcgacaccgcgcccgcgcgcacccgcacgcccgcaaacaataacaacgtaaccgacaacacaacgaccccgacgcccgcgcgaccccgaccctaaccgaaaccccgacaccgcctaccgacgcgacccgacccgcgcgtacgcccttacgacgcgacgacaacgtaaacgacccgcccgacgatcgcaccctaaacgacgccgacgacgaccccgccatccccgtcatcgaaaaaaaaccgaacgacgaaaaataccccgactcgaacctatacgtcctaccatccgaatcgatactaaacaaactaacgactaacctcgacgaaaaactctttccgccgcgcctcgccgaacccgtcgtaacgactcccgcgttaatcgccgccgcccccacgtcccccgaccacaacccgacctaaatcccgcgtcctaaacccatctctctaacaacttctccgacgccgcacgaaacctcgacgacgaaaaaaacgtaaaaacgcgacgccccgacgcgaatacgcgaaaaccgcgaacccttcgcgcacgcgccgaacgacgaaaacgcgctcgccgcttcaaaacgcaaacgcaaaaccccgaccgccctcgcgccgccgaaatatacactactctttccgatacttaccgaatactaaacgtcgtaaaacgcgaaccgcgaaaaccccgactaaacgaaaaaaaaaaaacgtaaacgactctcaacttcgaactcctaaaaacaacgatcactcgccctcaatcccgaacgaaacgaccgcttaatcgcaaaacccgccacccgaaaatcgcgcaacccactaaacccgataaaaccgccgcgtaccgaacgcgtacgcgaactcgcccgaacgaaaaccgcgaaacgctaacgatcgcaaacgaattcgccgccctaaaccgaaaaacgactcaacaccgtaactaccgacctccgaaaccgtttacctcactacgacgtatactaacgacaacccgcgccgcctccgaacaataaccgcgccgccaccgctactaccgccgaccctaaaaaaaccgaccccgaccctcccgcgccccgaatccccactaccctccgcatatcaacgacgcccgccccgctaccgccccatccacgttaaaacgcgaacaaaacccaaacgaccaaatccaaacttcccaaactttatttattaccaaatttaaacgacctcgcccgcacgacaccctccgaatccccgccgcgtctaca

SEQ ID NO: 1171 - DNA, 1980 bp, Artificial Sequence
  chemically treated genomic DNA (Homo sapiens) CpG-island No: 1171
ttagggttaatgtaagacgtattttttgtaaaatatattggtttattttaaagtttttattttttaaggttcgttcgagttttaagttttattcgcgtttattttttttgatttagaggcgggatggtcggtcgggtagggggcgcggggttcggcggggttttgacggcgcggtttggtttgtaggttagaggcggtcgaggtagcgggaggagcgagtttcgattttttttcggagcgcggcgcgggtagcgcggggtttgagtagtagtagtcgttattggagtcggacgtcgagcgggacgcgggtttcgagtaggtttagattagttatcgcgatttgtggagtttgcgcgtttcgtttgagttgtatgcggtcgtttcggattatagtagtagcggtaacgatcgcgattcggtgcgtagcggcgatagttcgggtttaggtttcgggggcgcggcgttcgttttttcgtcgtttttttcgttcgcgtcgcggtttaaggacggcgaggcgcgtcggttgttgtagatggatagtggttacgttagtatcgagggtcgcggcgtaggcgacgatatcgagttatttgtcgcgttcgttcggtttcgtagttcgcgcgtttggtttcgtcgttcgcgtcgcgattatagtatcgacgagaagacggacgcgttgttttacgagtttttgcgttacgattcgtatttcgacgatacgtcggttgtcgcgcgatatcgcgttcgcgcgtattcgtacgttcgtaaatagtggtagcgtggtcggtagtatagcgatttcggcgttcgcgcggtttcggttttggtcggaatttcggtatcgtttgtcggcgcggttcgattcgcgcgtgcgtttttgcggcgcggcgatagcgtggacggttcgttcgacggtcgtattttgggcggcgtcggcgacgatttcgttattttcgttatcgaggaggagtcgggcggcggggggtgtttcggttcgggtttgtgcgttttattattcgggtcggtgttggataagttggcggttggtttcgacgagagatttttttcgtcgcgtttcgtcgagttcgtcgtggcgattttcgcgttggtcgtcgtcgtttttacgtttttcgattatagttcggtttaagtttcgcgttttgggtttatttttttggtagttttttcggcgtcgtacggggtttcggcggcgggagagacgtgggggcgcgacgtttcgacgcgaatgcgcggggatcgcgggtttttcgcgtacgcgtcgggcgacggaggcgcgttcgtcgttttagggcgtaggcgtagagtttcggtcgttttcgcgtcgtcgaagtgtgtattgtttttttcggtgtttgtcgggtgttgggcgtcgtgaggcgcgggtcgcggagatttcggttgggcgggaaggaaggggcgtgaacggtttttagtttcgggtttttgaggataacgattattcgtttttagtttcggacggggcggtcgtttagtcgtagggttcgttattcgagggtcgcgtagtttattgggttcgatggagtcgtcgcgtgtcgggcgcgtgcgcgagttcgttcgggcgggggtcgcggggcgttaacggtcgtagacgagttcgtcgttttgggtcgggaggcggtttaatatcgtgattgtcgattttcgagatcgtttattttattgcggcgtgtgttggcggtagttcgcgtcgttttcgagtaataatcgcgtcgttatcgttgttgtcgtcggttttgagggagtcggtttcggttttttcgcgtttcgagtttttattgtttttcgtatgttaacggcgttcgtttcgttgtcgttttatttacgttgagacgcgaataaaatttagacggttaggtttaagttttttaagttttatttattgttaaatttgggcggtttcgttcgtacggtatttttcgagttttcgtcgcgtttgta

SEQ ID NO: 1172 - DNA, 1980 bp, Artificial Sequence
  chemically treated genomic DNA (Homo sapiens) CpG-island No: 1172
tacaaacgcgacgaaaactcgaaaaataccgtacgaacgaaaccgcccaaatttaacaataaataaaacttaaaaaacttaaacctaaccgtctaaattttattcgcgtctcaacgtaaataaaacgacaacgaaacgaacgccgttaacatacgaaaaacaataaaaactcgaaacgcgaaaaaaccgaaaccgactccctcaaaaccgacgacaacaacgataacgacgcgattattactcgaaaacgacgcgaactaccgccaacacacgccgcaataaaataaacgatctcgaaaatcgacaatcacgatattaaaccgcctcccgacccaaaacgacgaactcgtctacgaccgttaacgccccgcgacccccgcccgaacgaactcgcgcacgcgcccgacacgcgacgactccatcgaacccaataaactacgcgaccctcgaataacgaaccctacgactaaacgaccgccccgtccgaaactaaaaacgaataatcgttatcctcaaaaacccgaaactaaaaaccgttcacgccccttccttcccgcccaaccgaaatctccgcgacccgcgcctcacgacgcccaacacccgacaaacaccgaaaaaaacaatacacacttcgacgacgcgaaaacgaccgaaactctacgcctacgccctaaaacgacgaacgcgcctccgtcgcccgacgcgtacgcgaaaaacccgcgatccccgcgcattcgcgtcgaaacgtcgcgcccccacgtctctcccgccgccgaaaccccgtacgacgccgaaaaaactaccaaaaaaataaacccaaaacgcgaaacttaaaccgaactataatcgaaaaacgtaaaaacgacgacgaccaacgcgaaaatcgccacgacgaactcgacgaaacgcgacgaaaaaaatctctcgtcgaaaccaaccgccaacttatccaacaccgacccgaataataaaacgcacaaacccgaaccgaaacaccccccgccgcccgactcctcctcgataacgaaaataacgaaatcgtcgccgacgccgcccaaaatacgaccgtcgaacgaaccgtccacgctatcgccgcgccgcaaaaacgcacgcgcgaatcgaaccgcgccgacaaacgataccgaaattccgaccaaaaccgaaaccgcgcgaacgccgaaatcgctatactaccgaccacgctaccactatttacgaacgtacgaatacgcgcgaacgcgatatcgcgcgacaaccgacgtatcgtcgaaatacgaatcgtaacgcaaaaactcgtaaaacaacgcgtccgtcttctcgtcgatactataatcgcgacgcgaacgacgaaaccaaacgcgcgaactacgaaaccgaacgaacgcgacaaataactcgatatcgtcgcctacgccgcgaccctcgatactaacgtaaccactatccatctacaacaaccgacgcgcctcgccgtccttaaaccgcgacgcgaacgaaaaaaacgacgaaaaaacgaacgccgcgcccccgaaacctaaacccgaactatcgccgctacgcaccgaatcgcgatcgttaccgctactactataatccgaaacgaccgcatacaactcaaacgaaacgcgcaaactccacaaatcgcgataactaatctaaacctactcgaaacccgcgtcccgctcgacgtccgactccaataacgactactactactcaaaccccgcgctacccgcgccgcgctccgaaaaaaaatcgaaactcgctcctcccgctacctcgaccgcctctaacctacaaaccaaaccgcgccgtcaaaaccccgccgaaccccgcgccccctacccgaccgaccatcccgcctctaaatcaaaaaaaataaacgcgaataaaacttaaaactcgaacgaaccttaaaaaataaaaactttaaaataaaccaatatattttacaaaaaatacgtcttacattaaccctaa

SEQ ID NO: 1173 - DNA, 680 bp, Artificial Sequence
  chemically treated genomic DNA (Homo sapiens) CpG-island No: 1173
cgtcggattttttcgcgtttttttttcggtcgtttagtttatagtcggttgcgattttcggtttgtttttcgttcgtttttcgtagtttcgagttcgtcgcgtttattttagcgtcgggacgagcggtttatgggcggcgggttggcggcgggcggttgcgtggcgttcgcggttggtttcggcgttcggtggtcgcggagtaggcggagaatttatgaatggagagcgcggcgcgggggaggtcggcgcgagaggaggggtcgcgtacgtgatcgcgttggcggcgcgttcgtttcgcgcgttcggtgttgttcggttttcggttcgtcgttttcgttgcgttcgtcgttgggtttggttggtttcgcgtcggttatcgtttttttttttttttcggcggggcggggggcggagtttgcgttttcgggcgtttatttcgtacgcggagtcgtttttcgtattcgtcgcggcggtcgagtttcgttttcggtttatcggtacgatttatttcgttcggttttgaggttttagggacgtagttgggggtgttttggaatttacgattttgtagttcgaggtgcgtcgcgtgcgtaggagggggtggggttcgggggggtacggattttttttttacgttgtttggttcgtgggggttttggggcggtatagttagggtttt

SEQ ID NO: 1174 - DNA, 680 bp, Artificial Sequence
  chemically treated genomic DNA (Homo sapiens) CpG-island No: 1174
aaaaccctaactataccgccccaaaacccccacgaaccaaacaacgtaaaaaaaaaatccgtacccccccgaaccccaccccctcctacgcacgcgacgcacctcgaactacaaaatcgtaaattccaaaacacccccaactacgtccctaaaacctcaaaaccgaacgaaataaatcgtaccgataaaccgaaaacgaaactcgaccgccgcgacgaatacgaaaaacgactccgcgtacgaaataaacgcccgaaaacgcaaactccgccccccgccccgccgaaaaaaaaaaaaaaacgataaccgacgcgaaaccaaccaaacccaacgacgaacgcaacgaaaacgacgaaccgaaaaccgaacaacaccgaacgcgcgaaacgaacgcgccgccaacgcgatcacgtacgcgacccctcctctcgcgccgacctcccccgcgccgcgctctccattcataaattctccgcctactccgcgaccaccgaacgccgaaaccaaccgcgaacgccacgcaaccgcccgccgccaacccgccgcccataaaccgctcgtcccgacgctaaaataaacgcgacgaactcgaaactacgaaaaacgaacgaaaaacaaaccgaaaatcgcaaccgactataaactaaacgaccgaaaaaaaaacgcgaaaaaatccgacg

SEQ ID NO: 1175 - DNA, 680 bp, Artificial Sequence
  chemically treated genomic DNA (Homo sapiens) CpG-island No: 1175
ggggttttggttgtgtcgttttagaatttttacggattaagtaacgtgagaggggagttcgtgttttttcggattttatttttttttgcgtacgcggcgtatttcgggttgtagagtcgtgaattttaggatatttttagttgcgtttttgggattttaggatcgggcgaggtgaatcgtgtcgatgggtcgggggcggggttcggtcgtcgcggcgggtgcggggggcggtttcgcgtgcggagtgggcgttcgggagcgtaggtttcgtttttcgtttcgtcggaagggaaggggaggcggtggtcggcgcggagttagttagatttagcggcgagcgtagcgggggcggcgggtcggggatcgggtagtatcgggcgcgcggagcgggcgcgtcgttaacgcggttacgtgcgcggttttttttttcgcgtcggtttttttcgcgtcgcgttttttatttataaatttttcgtttgtttcgcggttatcgggcgtcggagttagtcgcgagcgttacgtagtcgttcgtcgttagttcgtcgtttatgggtcgttcgtttcggcgttgaggtaggcgcggcgggttcggggttgcggggggcggacgggggataggtcggggatcgtagtcggttgtgggttaagcggtcggagggagggcgcggaggagttcggcg

SEQ ID NO: 1176 - DNA, 680 bp, Artificial Sequence
  chemically treated genomic DNA (Homo sapiens) CpG-island No: 1176
cgccgaactcctccgcgccctccctccgaccgcttaacccacaaccgactacgatccccgacctatcccccgtccgccccccgcaaccccgaacccgccgcgcctacctcaacgccgaaacgaacgacccataaacgacgaactaacgacgaacgactacgtaacgctcgcgactaactccgacgcccgataaccgcgaaacaaacgaaaaatttataaataaaaaacgcgacgcgaaaaaaaccgacgcgaaaaaaaaaaccgcgcacgtaaccgcgttaacgacgcgcccgctccgcgcgcccgatactacccgatccccgacccgccgcccccgctacgctcgccgctaaatctaactaactccgcgccgaccaccgcctccccttcccttccgacgaaacgaaaaacgaaacctacgctcccgaacgcccactccgcacgcgaaaccgccccccgcacccgccgcgacgaccgaaccccgcccccgacccatcgacacgattcacctcgcccgatcctaaaatcccaaaaacgcaactaaaaatatcctaaaattcacgactctacaacccgaaatacgccgcgtacgcaaaaaaaaataaaatccgaaaaaacacgaactcccctctcacgttacttaatccgtaaaaattctaaaacgacacaaccaaaacccc

SEQ ID NO: 1177 - DNA, 609 bp, Artificial Sequence
  chemically treated genomic DNA (Homo sapiens) CpG-island No: 1177
gtagttcgggtcggaataaaattgtaatttttagaatattttacgacggggtattgcgtcgttaacgtcgcgtgcgttttgtcgggagtcgtagttcgcgtttgcgttttcgtcgggatttttttttttagacgtttttgcgcgtcgtttttttcgttttttaggtcgttcgcgtcgcgtcggagttcgttgttcgttagttattcgttttttgtcgttcgtcgttgttatgttgttcgtcgcgttgtttcgtcgttcgggatttggtcgtttcgttcgttacgttcgtgtttatgtcgaggtcgtcgtcgtttcggttgtcgtttttggttttaattagatgttttttattttcgttttttttacgtaggttcgggcgttgcgggtcgggatttttcgtggtcgtcgttttcggagtttagggtttttatttttagggcgcgattttcgttttcgggttttcggattcgcgcgtttcggaagtcgaggttatttagttttggattttcggttttgtttttgttgttcgagttttgcgttgttttcgtttcgggtattttttcgagataagcgttttttgggtgtttttttcgatttttttggttaaag

SEQ ID NO: 1178 - DNA, 609 bp, Artificial Sequence
  chemically treated genomic DNA (Homo sapiens) CpG-island No: 1178
ctttaaccaaaaaaatcgaaaaaaacacccaaaaaacgcttatctcgaaaaaatacccgaaacgaaaacaacgcaaaactcgaacaacaaaaacaaaaccgaaaatccaaaactaaataacctcgacttccgaaacgcgcgaatccgaaaacccgaaaacgaaaatcgcgccctaaaaataaaaaccctaaactccgaaaacgacgaccacgaaaaatcccgacccgcaacgcccgaacctacgtaaaaaaaacgaaaataaaaaacatctaattaaaaccaaaaacgacaaccgaaacgacgacgacctcgacataaacacgaacgtaacgaacgaaacgaccaaatcccgaacgacgaaacaacgcgacgaacaacataacaacgacgaacgacaaaaaacgaataactaacgaacaacgaactccgacgcgacgcgaacgacctaaaaaacgaaaaaaacgacgcgcaaaaacgtctaaaaaaaaaaatcccgacgaaaacgcaaacgcgaactacgactcccgacaaaacgcacgcgacgttaacgacgcaataccccgtcgtaaaatattctaaaaattacaattttattccgacccgaactac

SEQ ID NO: 1179 - DNA, 609 bp, Artificial Sequence
  chemically treated genomic DNA (Homo sapiens) CpG-island No: 1179
ttttggttagggagatcggggagggtatttaggagacgtttatttcggggaggtgttcgggacgagggtagcgtagggttcgggtagtagaggtagggtcgagggtttagggttgagtagtttcggttttcggggcgcgcgggttcgggggttcggaagcgggggtcgcgttttgggggtggggattttggatttcgggggcggcggttacggagggtttcgattcgtagcgttcgaatttgcgtgggagaggcgaaggtgaaggatatttggttggggttagaggcggtagtcggggcggcggcggtttcggtataggtacgggcgtggcggacgaggcggttaagtttcgggcggcggagtagcgcggcgggtagtatggtagcggcgggcggtaggaagcgggtagttggcggatagcggatttcggcgcggcgcgggcggtttggagggcgaggaggacgacgcgtagggacgtttgggaggaggagtttcggcgagagcgtaagcgcgaattacgattttcggtagggcgtacgcgacgttgacgacgtagtgtttcgtcgtgaggtattttgggggttgtagttttgtttcggttcgggttgt

SEQ ID NO: 1180 - DNA, 609 bp, Artificial Sequence
  chemically treated genomic DNA (Homo sapiens) CpG-island No: 1180
acaacccgaaccgaaacaaaactacaacccccaaaatacctcacgacgaaacactacgtcgtcaacgtcgcgtacgccctaccgaaaatcgtaattcgcgcttacgctctcgccgaaactcctcctcccaaacgtccctacgcgtcgtcctcctcgccctccaaaccgcccgcgccgcgccgaaatccgctatccgccaactacccgcttcctaccgcccgccgctaccatactacccgccgcgctactccgccgcccgaaacttaaccgcctcgtccgccacgcccgtacctataccgaaaccgccgccgccccgactaccgcctctaaccccaaccaaatatccttcaccttcgcctctcccacgcaaattcgaacgctacgaatcgaaaccctccgtaaccgccgcccccgaaatccaaaatccccacccccaaaacgcgacccccgcttccgaacccccgaacccgcgcgccccgaaaaccgaaactactcaaccctaaaccctcgaccctacctctactacccgaaccctacgctaccctcgtcccgaacacctccccgaaataaacgtctcctaaataccctccccgatctccctaaccaaaa

SEQ ID NO: 1181 - DNA, 2166 bp, Artificial Sequence
  chemically treated genomic DNA (Homo sapiens) CpG-island No: 1181
ttttatcgcgggtgattttgaattggttgtcgtttcgtttttcgttgtttagttatacggttttagtttttcgattatagtttttcgttttcgatcggggtttttttttcgcgcgtagtttagtcgttttttttttttgttaggggtagcgcggcgtttttttttcgggatttcgggcggcgtttttaggcgggttcggtagagggcgcgttcgagttgttgatttatcgtattttcgagcgcgcgcgggcgtagtcggggacgtcgcgttacgttacggttcgagcgggcgcgtttcggggaaacgggttttgttcgcggtcggcgggtgggcgcgcggggttttcggcggtagttattcggttacgttatcgaggtgcgggcgtttcgtttcggttataatttcgtttttacgtattacgtttttttcggggtcgcggttttagttttatcgtcgttcgttcgtttcgggatttcggttacgaggcgcggatttcgcgttttcgttttcgttcgcggtttttttcggacgaaggcggcggggtggttttacgattttttgtttttttcggcgtcgggaataatggttcgcgttttttttcgttttcggtcgtttttttgggatcgcgaggggtattagattcgtttttagatttgggtttcgcgtttttcggggcgcgttcgttttttgttgcgggtttcgggcgtttatgaatggttgcgggcgcgggcggggcgggggcgggcgcggagaggcgttagtttcgttttcgttgcgttttttttggtcgtttgggcgttgggggcggggcgagggggcgggttcggttgttacgtggggcggtgtcgcggcggtttttataggttcgggttcgcggtcgattgggcgttcggcgcgcggcgattggtcggcgttcggtcggcggagtaagtagtgaatgggagggggcggcggtttcgttttttggaacgttgatatattataattttttttttttgttatttttatttttagatttttcgagcggcggcgacggttgttgttaagggaggggacgcgcgaggaagcgcgattcgggcggtagacggtatttagcgttattagtcgagcggcgttttttttttaggatttttaatcgcgtcgcgtttcggtcgcgttcgtcgttttttgaaggagaagtaagtgtcgtttttattttcggaaggcgtttttaggagtcggagcgatttcggagcgttattcggattttggatttcggtttcgtatttcgcggtcgggattttttcgaggaggacgcgcgttgtttcgcgttttcgagtgttcggaggattcggtattcggggagtttttcgtttttgtttcggaggcgcggcgaggattggcggcgttcgtcgtttttagttttttagcgcgcgtcggggatggagtcgtagttcggcggcgttcggagttgtcggcgcggggttttcggcggcgtttgcgagttgggttcggcggtcgaggcggcgtttatgagtttcgttatttatagtattacgggtattcgttacgatttggtcgtgtcgttcgacgagacggtggaggggttgcgtaagcggttgttttagcgttttaaagtgtttaaggagcgtttggtttttttttataaagatacgtaggtatcgcgcgttttcggtcggtcgttttttcgggtttcggttttcgggcgggaataaagagcgcgtcgcgcggggaaggtagggggcggttagatagggggcgggggcgcgtcgcgcgttttcgggcgttttttgttcggtttcgtttgtttcggttttttttttcgttcggggtcgtcgtataaaggcggttgcgagggcgtttcgggtcgggtttcggcggttttttttgggggcgggtaggaattttagggcgttgcgggggtttcggttgcgggtgtgggggtcgttatcgttttttttcgtttgcgttcgcgtcggttttcgtatttgttcggcggttttttttgcgtttggttgtttttttttatttgcgtttttttttttttttttgttttcgttttcgagcgtttttcgtagtttttttttttttttggtatttaaatcgtttgtaggttcggagtttttttttcgcgggttttcggggatacgtagtgtttattttag

SEQ ID NO: 1182 - DNA, 2166 bp, Artificial Sequence
  chemically treated genomic DNA (Homo sapiens) CpG-island No: 1182
ctaaaataaacactacgtatccccgaaaacccgcgaaaaaaaaactccgaacctacaaacgatttaaataccaaaaaaaaaaaaaaactacgaaaaacgctcgaaaacgaaaacaaaaaaaaaaaaaaaaacgcaaataaaaaaaaacaaccaaacgcaaaaaaaaccgccgaacaaatacgaaaaccgacgcgaacgcaaacgaaaaaaaacgataacgacccccacacccgcaaccgaaacccccgcaacgccctaaaattcctacccgcccccaaaaaaaaccgccgaaacccgacccgaaacgccctcgcaaccgcctttatacgacgaccccgaacgaaaaaaaaaaccgaaacaaacgaaaccgaacaaaaaacgcccgaaaacgcgcgacgcgcccccgccccctatctaaccgccccctaccttccccgcgcgacgcgctctttattcccgcccgaaaaccgaaacccgaaaaaacgaccgaccgaaaacgcgcgatacctacgtatctttataaaaaaaaaccaaacgctccttaaacactttaaaacgctaaaacaaccgcttacgcaacccctccaccgtctcgtcgaacgacacgaccaaatcgtaacgaatacccgtaatactataaataacgaaactcataaacgccgcctcgaccgccgaacccaactcgcaaacgccgccgaaaaccccgcgccgacaactccgaacgccgccgaactacgactccatccccgacgcgcgctaaaaaactaaaaacgacgaacgccgccaatcctcgccgcgcctccgaaacaaaaacgaaaaactccccgaataccgaatcctccgaacactcgaaaacgcgaaacaacgcgcgtcctcctcgaaaaaatcccgaccgcgaaatacgaaaccgaaatccaaaatccgaataacgctccgaaatcgctccgactcctaaaaacgccttccgaaaataaaaacgacacttacttctccttcaaaaaacgacgaacgcgaccgaaacgcgacgcgattaaaaatcctaaaaaaaaaacgccgctcgactaataacgctaaataccgtctaccgcccgaatcgcgcttcctcgcgcgtcccctcccttaacaacaaccgtcgccgccgctcgaaaaatctaaaaataaaaataacaaaaaaaaaaaattataatatatcaacgttccaaaaaacgaaaccgccgccccctcccattcactacttactccgccgaccgaacgccgaccaatcgccgcgcgccgaacgcccaatcgaccgcgaacccgaacctataaaaaccgccgcgacaccgccccacgtaacaaccgaacccgccccctcgccccgcccccaacgcccaaacgaccaaaaaaaacgcaacgaaaacgaaactaacgcctctccgcgcccgcccccgccccgcccgcgcccgcaaccattcataaacgcccgaaacccgcaacaaaaaacgaacgcgccccgaaaaacgcgaaacccaaatctaaaaacgaatctaatacccctcgcgatcccaaaaaaacgaccgaaaacgaaaaaaaacgcgaaccattattcccgacgccgaaaaaaacaaaaaatcgtaaaaccaccccgccgccttcgtccgaaaaaaaccgcgaacgaaaacgaaaacgcgaaatccgcgcctcgtaaccgaaatcccgaaacgaacgaacgacgataaaactaaaaccgcgaccccgaaaaaaacgtaatacgtaaaaacgaaattataaccgaaacgaaacgcccgcacctcgataacgtaaccgaataactaccgccgaaaaccccgcgcgcccacccgccgaccgcgaacaaaacccgtttccccgaaacgcgcccgctcgaaccgtaacgtaacgcgacgtccccgactacgcccgcgcgcgctcgaaaatacgataaatcaacaactcgaacgcgccctctaccgaacccgcctaaaaacgccgcccgaaatcccgaaaaaaaaacgccgcgctacccctaacaaaaaaaaaaaacgactaaactacgcgcgaaaaaaaaaccccgatcgaaaacgaaaaactataatcgaaaaactaaaaccgtataactaaacaacgaaaaacgaaacgacaaccaattcaaaatcacccgcgataaaa

SEQ ID NO: 1183 - DNA, 2166 bp, Artificial Sequence
  chemically treated genomic DNA (Homo sapiens) CpG-island No: 1183
ttgggatggatattgcgtgttttcggaggttcgcggggggagggtttcgggtttgtaggcgatttaaatattaggggggaggggaggttgcggggagcgttcggaggcgagaataaagggggggagagagacgtaagtggggggagatagttagacgtagaggaggtcgtcgagtagatgcggaagtcggcgcggacgtaggcgggagggggcggtggcggtttttatattcgtagtcgggattttcgtaacgttttgggatttttgttcgtttttaaggggggtcgtcgaagttcggttcgggacgttttcgtagtcgtttttgtgcggcgatttcgggcgggggagggggtcgaggtaggcgaggtcgagtagagggcgttcgagagcgcgcggcgcgttttcgttttttgtttggtcgttttttgtttttttcgcgcggcgcgttttttgttttcgttcgggggtcggggttcgagggggcggtcggtcgggggcgcgcggtatttacgtgtttttgtggagaagagttaggcgttttttgggtattttgaggcgttgggataatcgtttgcgtagtttttttatcgtttcgtcgggcggtacggttaggtcgtagcgggtgttcgtggtgttgtggatggcgaggtttatgggcgtcgtttcggtcgtcgggtttagttcgtaggcgtcgtcgggggtttcgcgtcggtagtttcgggcgtcgtcgggttgcggttttattttcggcgcgcgttggggggttgggggcggcgggcgtcgttaattttcgtcgcgttttcgggataggggcgagaggtttttcggatgtcgggtttttcgggtattcgggggcgcggagtagcgcgcgtttttttcgagaaagtttcggtcgcggaatgcgagatcgaaatttaaaattcgagtggcgtttcgaggtcgtttcggtttttgggggcgtttttcgggggtggggacggtatttgttttttttttaaagggcggcgggcgcgatcgggacgcggcgcggttaagggttttggggagggggcgtcgttcggttggtggcgttgggtgtcgtttgtcgttcgggtcgcgttttttcgcgcgtttttttttttagtaatagtcgtcgtcgtcgttcggaggatttgggggtgaaagtaataagaaaaaaaagttataatgtattaacgttttagggggcggggtcgtcgtttttttttatttattatttatttcgtcggtcgggcgtcggttaatcgtcgcgcgtcgagcgtttagtcggtcgcgagttcgggtttatgagagtcgtcgcggtatcgttttacgtggtagtcgggttcgttttttcgtttcgtttttagcgtttaggcgattaaggggagcgtagcgggggcggggttggcgttttttcgcgttcgttttcgtttcgttcgcgttcgtagttatttataagcgttcggagttcgtaataaagggcgggcgcgtttcggggggcgcgggatttaggtttggagacgggtttggtatttttcgcgattttaagggagcggtcgggagcgggagggggcgcgggttattgttttcggcgtcgggaggggtaggaagtcgtggggttatttcgtcgttttcgttcgggaaaagtcgcgagcggaagcgggagcgcgaagttcgcgtttcgtggtcggggtttcggggcgggcgggcgacggtgaggttagggtcgcggtttcggggagggcgtggtgcgtgggggcggagttgtggtcggggcggggcgttcgtatttcggtgacgtggtcgggtggttgtcgtcgggggtttcgcgcgtttattcgtcggtcgcgggtagaattcgttttttcgaggcgcgttcgttcgagtcgtgacgtgacgcggcgttttcggttgcgttcgcgcgcgttcggggatgcggtgagttagtagttcgggcgcgttttttgtcgggttcgtttgggagcgtcgttcggagtttcggggagggggcgtcgcgttgtttttggtaggggaggaagacgattgggttgcgcgcgggggaggaatttcgatcgggaacgaaagattgtagtcgggagattgggatcgtgtggttgggtaacggagggcggaacggtaattagtttaaggttattcgcggtgaag

SEQ ID NO: 1184 - DNA, 2166 bp, Artificial Sequence
  chemically treated genomic DNA (Homo sapiens) CpG-island No: 1184
cttcaccgcgaataaccttaaactaattaccgttccgccctccgttacccaaccacacgatcccaatctcccgactacaatctttcgttcccgatcgaaattcctcccccgcgcgcaacccaatcgtcttcctcccctaccaaaaacaacgcgacgccccctccccgaaactccgaacgacgctcccaaacgaacccgacaaaaaacgcgcccgaactactaactcaccgcatccccgaacgcgcgcgaacgcaaccgaaaacgccgcgtcacgtcacgactcgaacgaacgcgcctcgaaaaaacgaattctacccgcgaccgacgaataaacgcgcgaaacccccgacgacaaccacccgaccacgtcaccgaaatacgaacgccccgccccgaccacaactccgcccccacgcaccacgccctccccgaaaccgcgaccctaacctcaccgtcgcccgcccgccccgaaaccccgaccacgaaacgcgaacttcgcgctcccgcttccgctcgcgacttttcccgaacgaaaacgacgaaataaccccacgacttcctacccctcccgacgccgaaaacaataacccgcgccccctcccgctcccgaccgctcccttaaaatcgcgaaaaataccaaacccgtctccaaacctaaatcccgcgccccccgaaacgcgcccgccctttattacgaactccgaacgcttataaataactacgaacgcgaacgaaacgaaaacgaacgcgaaaaaacgccaaccccgcccccgctacgctccccttaatcgcctaaacgctaaaaacgaaacgaaaaaacgaacccgactaccacgtaaaacgataccgcgacgactctcataaacccgaactcgcgaccgactaaacgctcgacgcgcgacgattaaccgacgcccgaccgacgaaataaataataaataaaaaaaaacgacgaccccgccccctaaaacgttaatacattataacttttttttcttattactttcacccccaaatcctccgaacgacgacgacgactattactaaaaaaaaaaacgcgcgaaaaaacgcgacccgaacgacaaacgacacccaacgccaccaaccgaacgacgccccctccccaaaacccttaaccgcgccgcgtcccgatcgcgcccgccgccctttaaaaaaaaaacaaataccgtccccacccccgaaaaacgcccccaaaaaccgaaacgacctcgaaacgccactcgaattttaaatttcgatctcgcattccgcgaccgaaactttctcgaaaaaaacgcgcgctactccgcgcccccgaatacccgaaaaacccgacatccgaaaaacctctcgcccctatcccgaaaacgcgacgaaaattaacgacgcccgccgcccccaaccccccaacgcgcgccgaaaataaaaccgcaacccgacgacgcccgaaactaccgacgcgaaacccccgacgacgcctacgaactaaacccgacgaccgaaacgacgcccataaacctcgccatccacaacaccacgaacacccgctacgacctaaccgtaccgcccgacgaaacgataaaaaaactacgcaaacgattatcccaacgcctcaaaatacccaaaaaacgcctaactcttctccacaaaaacacgtaaataccgcgcgcccccgaccgaccgccccctcgaaccccgacccccgaacgaaaacaaaaaacgcgccgcgcgaaaaaaacaaaaaacgaccaaacaaaaaacgaaaacgcgccgcgcgctctcgaacgccctctactcgacctcgcctacctcgaccccctcccccgcccgaaatcgccgcacaaaaacgactacgaaaacgtcccgaaccgaacttcgacgaccccccttaaaaacgaacaaaaatcccaaaacgttacgaaaatcccgactacgaatataaaaaccgccaccgccccctcccgcctacgtccgcgccgacttccgcatctactcgacgacctcctctacgtctaactatctccccccacttacgtctctctccccccctttattctcgcctccgaacgctccccgcaacctcccctcccccctaatatttaaatcgcctacaaacccgaaaccctccccccgcgaacctccgaaaacacgcaatatccatcccaa

SEQ ID NO: 1185 - DNA, 540 bp, Artificial Sequence
  chemically treated genomic DNA (Homo sapiens) CpG-island No: 1185
ggagggggcggttttcggaaattcgtcgggatggaaacgcggtttttagggtaacgcgtcgcgaaaggagtttgacgttatttcgggtagggcgttttgttcgttttcgttcgcgcgtcgcgcggtttaggtttcgtttattagcggggaagttttattggtgatcgtatcgttcgtttatcggcgtgttttagtagtagcgcgacgaagtttttagaaggcgggattttagttcggtagcgtcgagtgcgtaggcgtaagcgcggaggcgttgtagtttcgttttttttttcgcgcgtttgtaaagttgggggcgggaggcgtagtcgagggtttgacggttgcggcggggtttggacggaagagggggcgagtttcggggcgtcgtacgtggattttcggtacgggtacgtttacgtgtattcgtttttttacgttaacgcgttttttgttgtttttatttttgtattattgtacgttttagatttcggtttagttttttcgcggtttttaggttgggggagtttagataggaggtta

SEQ ID NO: 1186 - DNA, 540 bp, Artificial Sequence
  chemically treated genomic DNA (Homo sapiens) CpG-island No: 1186
taacctcctatctaaactcccccaacctaaaaaccgcgaaaaaactaaaccgaaatctaaaacgtacaataatacaaaaataaaaacaacaaaaaacgcgttaacgtaaaaaaacgaatacacgtaaacgtacccgtaccgaaaatccacgtacgacgccccgaaactcgccccctcttccgtccaaaccccgccgcaaccgtcaaaccctcgactacgcctcccgcccccaactttacaaacgcgcgaaaaaaaaaacgaaactacaacgcctccgcgcttacgcctacgcactcgacgctaccgaactaaaatcccgccttctaaaaacttcgtcgcgctactactaaaacacgccgataaacgaacgatacgatcaccaataaaacttccccgctaataaacgaaacctaaaccgcgcgacgcgcgaacgaaaacgaacaaaacgccctacccgaaataacgtcaaactcctttcgcgacgcgttaccctaaaaaccgcgtttccatcccgacgaatttccgaaaaccgccccctcc

SEQ ID NO: 1187 - DNA, 540 bp, Artificial Sequence
  chemically treated genomic DNA (Homo sapiens) CpG-island No: 1187
tagttttttgtttgagtttttttagtttagggatcgcggggaggttgggtcggggtttgggacgtgtagtggtgtaggggtgggggtagtaggaaacgcgttggcgtgaaaggacgggtgtacgtgagcgtgttcgtgtcgggggtttacgtgcggcgtttcggggttcgttttttttttcgtttaggtttcgtcgtagtcgttagattttcggttgcgtttttcgtttttaattttgtagacgcgcggggagagaggcggggttgtagcgttttcgcgtttgcgtttgcgtattcggcgttgtcgggttgaagtttcgttttttggaggtttcgtcgcgttgttattggggtacgtcgatgagcgagcggtgcgattattaatgaggttttttcgttggtgggcggggtttgggtcgcgcgacgcgcggacgggggcgggtagggcgttttattcggggtgacgttaggtttttttcgcggcgcgttgttttggaaatcgcgtttttatttcggcgggttttcgggggtcgtttttttt

SEQ ID NO: 1188 - DNA, 540 bp, Artificial Sequence
  chemically treated genomic DNA (Homo sapiens) CpG-island No: 1188
aaaaaaaacgacccccgaaaacccgccgaaataaaaacgcgatttccaaaacaacgcgccgcgaaaaaaacctaacgtcaccccgaataaaacgccctacccgcccccgtccgcgcgtcgcgcgacccaaaccccgcccaccaacgaaaaaacctcattaataatcgcaccgctcgctcatcgacgtaccccaataacaacgcgacgaaacctccaaaaaacgaaacttcaacccgacaacgccgaatacgcaaacgcaaacgcgaaaacgctacaaccccgcctctctccccgcgcgtctacaaaattaaaaacgaaaaacgcaaccgaaaatctaacgactacgacgaaacctaaacgaaaaaaaaaacgaaccccgaaacgccgcacgtaaacccccgacacgaacacgctcacgtacacccgtcctttcacgccaacgcgtttcctactacccccacccctacaccactacacgtcccaaaccccgacccaacctccccgcgatccctaaactaaaaaaactcaaacaaaaaacta

SEQ ID NO: 1189 - DNA, 838 bp, Artificial Sequence
  chemically treated genomic DNA (Homo sapiens) CpG-island No: 1189
cggtcgttaggtgtacggtttcggttttcgtttggttaggaggaggcggtaattatgcggtttcggggttttttttacgcgttttttattttcggttacgttcgtcgtaggtttagacgttttttatcgtttttcgttcggttattagtcggggtcgggggaggatttggcgttcggcgggcggggtttcgtggggagggcggagtgggcggtgcgggagcgagggagtttcgttttcgtttttatggcgacgtttcgtaggggaggaggttcgggaggagtattagggtgtaggaggtgcgcgtttttttcgagacggtaggttggaaagggggcggatttgtgaatgggtttacggggtttaagatagacgcgcggggagtaggttcggggattttgattgattttcgcgtttcgtcgggtaggggcgagtttcgcgcgtcgggttcggaatagtagtttcgttttcgttcggcgcggttattttgagttttttcgttggggtcgaggcgcgggggcggcgggaggttgggggtcgatacgtaggttgcgttttcgtttcgcgagattggatttttcgaggattgtgcgttgtggtcgcgtagggttgggcggcggggtttttttttttacgcgaggcgtttgcgtggagcggcggtatcgggagttcggtcgttcgagttaaacgtcgcggacggagcgaggtcgtagcgttttttggtgttcgtaacgggtagcgcgtttcggtcgggtttcgtatggttagtggttagtaggggtggatgaaggggttttagtcgtttgagattttcggtggggatataggatcgcggtgaga

SEQ ID NO: 1190 - DNA, 838 bp, Artificial Sequence
  chemically treated genomic DNA (Homo sapiens) CpG-island No: 1190
tctcaccgcgatcctatatccccaccgaaaatctcaaacgactaaaaccccttcatccacccctactaaccactaaccatacgaaacccgaccgaaacgcgctacccgttacgaacaccaaaaaacgctacgacctcgctccgtccgcgacgtttaactcgaacgaccgaactcccgataccgccgctccacgcaaacgcctcgcgtaaaaaaaaaaaccccgccgcccaaccctacgcgaccacaacgcacaatcctcgaaaaatccaatctcgcgaaacgaaaacgcaacctacgtatcgacccccaacctcccgccgcccccgcgcctcgaccccaacgaaaaaactcaaaataaccgcgccgaacgaaaacgaaactactattccgaacccgacgcgcgaaactcgcccctacccgacgaaacgcgaaaatcaatcaaaatccccgaacctactccccgcgcgtctatcttaaaccccgtaaacccattcacaaatccgccccctttccaacctaccgtctcgaaaaaaacgcgcacctcctacaccctaatactcctcccgaacctcctcccctacgaaacgtcgccataaaaacgaaaacgaaactccctcgctcccgcaccgcccactccgccctccccacgaaaccccgcccgccgaacgccaaatcctcccccgaccccgactaataaccgaacgaaaaacgataaaaaacgtctaaacctacgacgaacgtaaccgaaaataaaaaacgcgtaaaaaaaaccccgaaaccgcataattaccgcctcctcctaaccaaacgaaaaccgaaaccgtacacctaacgaccg

SEQ ID NO: 1191 - DNA, 838 bp, Artificial Sequence
  chemically treated genomic DNA (Homo sapiens) CpG-island No: 1191
ttttatcgcgattttgtgtttttatcgggggttttaggcggttgggatttttttatttatttttgttggttattgattatgcgggattcgatcgggacgcgttgttcgttgcggatattagggggcgttgcggtttcgtttcgttcgcggcgtttggttcgagcggtcgggttttcggtgtcgtcgttttacgtagacgtttcgcgtgggagagggggtttcgtcgtttagttttgcgcggttatagcgtatagttttcgaggggtttaatttcgcggggcgaggacgtagtttgcgtgtcgatttttagtttttcgtcgttttcgcgtttcggttttaacggaggagtttaaaatagtcgcgtcgggcgggggcgagattgttatttcgggttcgacgcgcggggttcgtttttgttcggcgaggcgcggggattagttagagttttcgaatttgtttttcgcgcgtttgttttgggtttcgtgggtttatttataaattcgttttttttttagtttgtcgtttcggaaggggcgcgtattttttgtattttgatatttttttcgggtttttttttttgcggggcgtcgttatggagacgagggcggagttttttcgttttcgtatcgtttatttcgttttttttacggggtttcgttcgtcggacgttaggttttttttcgatttcgattaatgatcgggcgggaggcggtagagagcgtttaggtttgcgacgggcgtggtcgaggatgaaaggcgcgtgggggggatttcggggtcgtataattatcgtttttttttagttaggcgggggtcgggatcgtgtatttggcggtcg

SEQ ID NO: 1192 - DNA, 838 bp, Artificial Sequence
  chemically treated genomic DNA (Homo sapiens) CpG-island No: 1192
cgaccgccaaatacacgatcccgacccccgcctaactaaaaaaaaacgataattatacgaccccgaaatcccccccacgcgcctttcatcctcgaccacgcccgtcgcaaacctaaacgctctctaccgcctcccgcccgatcattaatcgaaatcgaaaaaaaacctaacgtccgacgaacgaaaccccgtaaaaaaaacgaaataaacgatacgaaaacgaaaaaactccgccctcgtctccataacgacgccccgcaaaaaaaaaaacccgaaaaaaatatcaaaatacaaaaaatacgcgccccttccgaaacgacaaactaaaaaaaaaacgaatttataaataaacccacgaaacccaaaacaaacgcgcgaaaaacaaattcgaaaactctaactaatccccgcgcctcgccgaacaaaaacgaaccccgcgcgtcgaacccgaaataacaatctcgcccccgcccgacgcgactattttaaactcctccgttaaaaccgaaacgcgaaaacgacgaaaaactaaaaatcgacacgcaaactacgtcctcgccccgcgaaattaaacccctcgaaaactatacgctataaccgcgcaaaactaaacgacgaaaccccctctcccacgcgaaacgtctacgtaaaacgacgacaccgaaaacccgaccgctcgaaccaaacgccgcgaacgaaacgaaaccgcaacgccccctaatatccgcaacgaacaacgcgtcccgatcgaatcccgcataatcaataaccaacaaaaataaataaaaaaatcccaaccgcctaaaacccccgataaaaacacaaaatcgcgataaaa

SEQ ID NO: 1193 - DNA, 564 bp, Artificial Sequence
  chemically treated genomic DNA (Homo sapiens) CpG-island No: 1193
aaacgacgttttttacggttttacggtttaggttagttcggtttcgtcgtcgggagttttagtttcgttagggggcgcgagcggaggtcgcgttcgaggtcgtcgggcgtttcgtttttttttatggtggttcgggcgcggcgggagcggaggcgcgatttcgagagggggcggggtcgagttaggggcggggtcgcgcggagggcgggagcggtcgggtcgggtcgggtcggttggggatgggtgggagggggggtcgattttttggggtcgttcgtgaggatgtcgcgatcgttttcgggtgttttttagttttagagacgtcgtcgcggcggagttcgtagtttttttgtttgaggcgttcgcggtcgggattcggttttttttttcgtttttttttttaggtgtcggtcgggagggcggtcgtagtaggtgaggaggcggcggcggcggcgttgggggtcgttgggcgttcggtttggggaaggacgggaagggggacggtcgggtgtcgttaggttgtggtttgggggttttttttttgtgtggggcgcggtttgggat

SEQ ID NO: 1194 - DNA, 564 bp, Artificial Sequence
  chemically treated genomic DNA (Homo sapiens) CpG-island No: 1194
atcccaaaccgcgccccacacaaaaaaaaaacccccaaaccacaacctaacgacacccgaccgtcccccttcccgtccttccccaaaccgaacgcccaacgacccccaacgccgccgccgccgcctcctcacctactacgaccgccctcccgaccgacacctaaaaaaaaaaacgaaaaaaaaaaccgaatcccgaccgcgaacgcctcaaacaaaaaaactacgaactccgccgcgacgacgtctctaaaactaaaaaacacccgaaaacgatcgcgacatcctcacgaacgaccccaaaaaatcgaccccccctcccacccatccccaaccgacccgacccgacccgaccgctcccgccctccgcgcgaccccgcccctaactcgaccccgccccctctcgaaatcgcgcctccgctcccgccgcgcccgaaccaccataaaaaaaaacgaaacgcccgacgacctcgaacgcgacctccgctcgcgccccctaacgaaactaaaactcccgacgacgaaaccgaactaacctaaaccgtaaaaccgtaaaaaacgtcgttt

SEQ ID NO: 1195 - DNA, 564 bp, Artificial Sequence
  chemically treated genomic DNA (Homo sapiens) CpG-island No: 1195
gttttaggtcgcgttttatatagaggaagggtttttagattatagtttgacggtattcgatcgttttttttttcgtttttttttaggtcgggcgtttagcggtttttagcgtcgtcgtcgtcgtttttttatttgttgcggtcgttttttcggtcggtatttaggagaggaggcgaggggaggggtcggatttcggtcgcggacgttttaggtagggaggttgcggatttcgtcgcggcggcgtttttggggttgaggggtattcgggggcggtcgcgatatttttacgggcggttttaggaagtcggtttttttttttatttatttttagtcggttcggttcggttcggtcgttttcgtttttcgcgcggtttcgtttttgattcggtttcgttttttttcgggatcgcgttttcgttttcgtcgcgttcgagttattatagagaagagcgaggcgttcggcggtttcgagcgcggttttcgttcgcgttttttggcggagttgaggttttcgacggcggggtcgggttggtttgagtcgtggggtcgtaggaggcgtcgttt

SEQ ID NO: 1196 - DNA, 564 bp, Artificial Sequence
  chemically treated genomic DNA (Homo sapiens) CpG-island No: 1196
aaacgacgcctcctacgaccccacgactcaaaccaacccgaccccgccgtcgaaaacctcaactccgccaaaaaacgcgaacgaaaaccgcgctcgaaaccgccgaacgcctcgctcttctctataataactcgaacgcgacgaaaacgaaaacgcgatcccgaaaaaaaacgaaaccgaatcaaaaacgaaaccgcgcgaaaaacgaaaacgaccgaaccgaaccgaaccgactaaaaataaataaaaaaaaaaaccgacttcctaaaaccgcccgtaaaaatatcgcgaccgcccccgaatacccctcaaccccaaaaacgccgccgcgacgaaatccgcaacctccctacctaaaacgtccgcgaccgaaatccgacccctcccctcgcctcctctcctaaataccgaccgaaaaaacgaccgcaacaaataaaaaaacgacgacgacgacgctaaaaaccgctaaacgcccgacctaaaaaaaaacgaaaaaaaaaacgatcgaataccgtcaaactataatctaaaaacccttcctctatataaaacgcgacctaaaac

SEQ ID NO: 1197 - DNA, 770 bp, Artificial Sequence
  chemically treated genomic DNA (Homo sapiens) CpG-island No: 1197
attaggcgttttcgggttttttttcgaattagtcggtgtttggttcggagtgcgtaattttgttttttttgtatttagttttcggtttcgtttttttttgtgttttcgtttggttgcgtttatcgtggtattttgttcggcgtagtggttgatgattcgggagttttttggatgtcggcgggtgaattcgttgatgttgtatattttacggtcgattattagttatcgtttttcgtattttgagcgttgggttatttcgttttaggtgaagtagcgcggggtaggtttttgagtcgcggtttcggcggttatcgggtcgggggttatagttggtttggcgacgtcgcgcgtcgggttagtaggggttgttaggcgcgtgttcggggttcgcgggttttaggagtggatttgttggcgcgcgtttagagttagtcgtttgcgcgtcgggtttttagtatcgtagggtagatcggcgggtttcgtagcgcgcgtttttattggtcgagtttcgtggcgcggggagcgagatttcgtttttcggtgggttttgggtaatttatagttgggttgttaatacgcgttttttcgcgggttttttaaaggcgtcgtcgtcggattcgattttttgacgttaggcgggtatcgcggcgttggtttttagggggcgtcgcggtaggaatagcggttttagtgtaggttttgggtgcggggtcgcgttgtaggagtggatggattgaggggttagggttgcggggtggtcgtaggaaggg

SEQ ID NO: 1198 - DNA, 770 bp, Artificial Sequence
  chemically treated genomic DNA (Homo sapiens) CpG-island No: 1198
cccttcctacgaccaccccgcaaccctaacccctcaatccatccactcctacaacgcgaccccgcacccaaaacctacactaaaaccgctattcctaccgcgacgccccctaaaaaccaacgccgcgatacccgcctaacgtcaaaaaatcgaatccgacgacgacgcctttaaaaaacccgcgaaaaaacgcgtattaacaacccaactataaattacccaaaacccaccgaaaaacgaaatctcgctccccgcgccacgaaactcgaccaataaaaacgcgcgctacgaaacccgccgatctaccctacgatactaaaaacccgacgcgcaaacgactaactctaaacgcgcgccaacaaatccactcctaaaacccgcgaaccccgaacacgcgcctaacaacccctactaacccgacgcgcgacgtcgccaaaccaactataacccccgacccgataaccgccgaaaccgcgactcaaaaacctaccccgcgctacttcacctaaaacgaaataacccaacgctcaaaatacgaaaaacgataactaataatcgaccgtaaaatatacaacatcaacgaattcacccgccgacatccaaaaaactcccgaatcatcaaccactacgccgaacaaaataccacgataaacgcaaccaaacgaaaacacaaaaaaaaacgaaaccgaaaactaaatacaaaaaaaacaaaattacgcactccgaaccaaacaccgactaattcgaaaaaaaacccgaaaacgcctaat

SEQ ID NO: 1199 - DNA, 770 bp, Artificial Sequence
  chemically treated genomic DNA (Homo sapiens) CpG-island No: 1199
ttttttttgcggttatttcgtagttttggttttttagtttatttatttttgtagcgcggtttcgtatttagggtttgtattagaatcgttgtttttatcgcggcgttttttgggagttaacgtcgcgatgttcgtttgacgttaggaagtcgaattcggcggcgacgtttttagggagttcgcgagggggcgcgtgttggtagtttagttgtgagttgtttaagatttatcgggggacgggatttcgtttttcgcgttacgaggttcggttaatgggaacgcgcgttgcgaggttcgtcggtttgttttgcggtgttgaaaattcggcgcgtaggcggttggttttgggcgcgcgttagtaaatttatttttggagttcgcggatttcgagtacgcgtttgatagtttttgttggttcggcgcgcggcgtcgttaggttagttatggttttcgattcggtggtcgtcgagatcgcggtttagggatttatttcgcgttattttatttgggacgaggtggtttagcgtttagggtgcgaggagcggtggttagtgatcgatcgtaaggtgtataatattagcgagtttattcgtcggtatttagggggttttcgggttattagttattacgtcgggtaggatgttacggtgagcgtagttaggcgggggtataggagagggcgggatcggaggttgagtgtaggggagatagagttacgtatttcgagttaaatatcgattaattcggaggaaagttcggaggcgtttgat

SEQ ID NO: 1200 - DNA, 770 bp, Artificial Sequence
  chemically treated genomic DNA (Homo sapiens) CpG-island No: 1200
atcaaacgcctccgaactttcctccgaattaatcgatatttaactcgaaatacgtaactctatctcccctacactcaacctccgatcccgccctctcctatacccccgcctaactacgctcaccgtaacatcctacccgacgtaataactaataacccgaaaaccccctaaataccgacgaataaactcgctaatattatacaccttacgatcgatcactaaccaccgctcctcgcaccctaaacgctaaaccacctcgtcccaaataaaataacgcgaaataaatccctaaaccgcgatctcgacgaccaccgaatcgaaaaccataactaacctaacgacgccgcgcgccgaaccaacaaaaactatcaaacgcgtactcgaaatccgcgaactccaaaaataaatttactaacgcgcgcccaaaaccaaccgcctacgcgccgaattttcaacaccgcaaaacaaaccgacgaacctcgcaacgcgcgttcccattaaccgaacctcgtaacgcgaaaaacgaaatcccgtcccccgataaatcttaaacaactcacaactaaactaccaacacgcgccccctcgcgaactccctaaaaacgtcgccgccgaattcgacttcctaacgtcaaacgaacatcgcgacgttaactcccaaaaaacgccgcgataaaaacaacgattctaatacaaaccctaaatacgaaaccgcgctacaaaaataaataaactaaaaaaccaaaactacgaaataaccgcaaaaaaaa

SEQ ID NO: 1201 - DNA, 591 bp, Artificial Sequence
  chemically treated genomic DNA (Homo sapiens) CpG-island No: 1201
agtttcgattgtcgcgcgttaaggaagggcgttatttagttaagtcggttttggagttgagtgtttcgtagttcgtcggtttattcgttcggtcgtttgttggtattttggtggtcgcgtcggttttgtgtcggtattaggtgtaaatttttagagcgtcgggcgtgcgcgtacgcgtttcggagcgcgcggagtttattcgttgtttttatcgggattttttttaggatttttttcggcgttcggggtcggagagtgggggagggaggaggtcggatacgtagtttgtttcgtagtagggttcgattttacgcgggagggcgggggagtcggggattcgtcgttttagttcgttggttttcgaaagatttttttgggttaatggtaggcggggcgacgcgatcggattggtgtaggcgttttgttgatcgttgtggaaattcgggcggcggggaacgcgggaggatgtggaattcgaggcggggggagtcggaggggcgggtagaggaggtgtcgaggttttgagttttcggggagtttttattggaggtaaaagtttatagcgggagggttgagggaggggcggaggaa

SEQ ID NO: 1202 - DNA, 591 bp, Artificial Sequence
  chemically treated genomic DNA (Homo sapiens) CpG-island No: 1202
ttcctccgcccctccctcaaccctcccgctataaacttttacctccaataaaaactccccgaaaactcaaaacctcgacacctcctctacccgcccctccgactccccccgcctcgaattccacatcctcccgcgttccccgccgcccgaatttccacaacgatcaacaaaacgcctacaccaatccgatcgcgtcgccccgcctaccattaacccaaaaaaatctttcgaaaaccaacgaactaaaacgacgaatccccgactcccccgccctcccgcgtaaaatcgaaccctactacgaaacaaactacgtatccgacctcctccctcccccactctccgaccccgaacgccgaaaaaaatcctaaaaaaaatcccgataaaaacaacgaataaactccgcgcgctccgaaacgcgtacgcgcacgcccgacgctctaaaaatttacacctaataccgacacaaaaccgacgcgaccaccaaaataccaacaaacgaccgaacgaataaaccgacgaactacgaaacactcaactccaaaaccgacttaactaaataacgcccttccttaacgcgcgacaatcgaaact

SEQ ID NO: 1203 - DNA, 591 bp, Artificial Sequence
  chemically treated genomic DNA (Homo sapiens) CpG-island No: 1203
ttttttcgttttttttttagttttttcgttatggatttttgtttttagtaaaaatttttcgggagtttagggtttcgatattttttttgttcgttttttcggtttttttcgtttcgggttttatattttttcgcgtttttcgtcgttcgagtttttatagcgattagtagagcgtttgtattaattcggtcgcgtcgtttcgtttgttattggtttaggaggatttttcgaaggttagcgggttggagcggcgggttttcggttttttcgttttttcgcgtggagtcgagttttgttgcgaggtaggttacgtgttcgatttttttttttttttatttttcggtttcgggcgtcggaggagattttagaggagatttcggtgggggtaacgaatgggtttcgcgcgtttcggggcgcgtgcgcgtacgttcggcgttttgggggtttgtatttgatgtcgatataaagtcggcgcggttattagggtgttagtaagcggtcgggcgggtggatcggcgggttgcggggtatttaattttagggtcggtttggttaggtgacgtttttttttggcgcgcggtagtcgagatt

SEQ ID NO: 1204 - DNA, 591 bp, Artificial Sequence
  chemically treated genomic DNA (Homo sapiens) CpG-island No: 1204
aatctcgactaccgcgcgccaaaaaaaaacgtcacctaaccaaaccgaccctaaaattaaataccccgcaacccgccgatccacccgcccgaccgcttactaacaccctaataaccgcgccgactttatatcgacatcaaatacaaacccccaaaacgccgaacgtacgcgcacgcgccccgaaacgcgcgaaacccattcgttacccccaccgaaatctcctctaaaatctcctccgacgcccgaaaccgaaaaataaaaaaaaaaaaaaatcgaacacgtaacctacctcgcaacaaaactcgactccacgcgaaaaaacgaaaaaaccgaaaacccgccgctccaacccgctaaccttcgaaaaatcctcctaaaccaataacaaacgaaacgacgcgaccgaattaatacaaacgctctactaatcgctataaaaactcgaacgacgaaaaacgcgaaaaaatataaaacccgaaacgaaaaaaaccgaaaaaacgaacaaaaaaaatatcgaaaccctaaactcccgaaaaatttttactaaaaacaaaaatccataacgaaaaaactaaaaaaaaaacgaaaaaa

SEQ ID NO: 1205 - DNA, 567 bp, Artificial Sequence
  chemically treated genomic DNA (Homo sapiens) CpG-island No: 1205
atcggttatgtagtcgtttacggcggtgggtttttgggtcgttattacgtagttgtacgatatgtcgaggtttggagcggttcgtcgggattcgagcgcgatattataaagagggatataagcgaaaagataggtggtttttaatagcgcgtagcgaattttattgtcgttgttttcgttttagagatacgttgtaggttagagcggtcggggcgcggggtattacgggacggttttatttggttttttggaggattttcgaagttcgaggtcgttaatcgaaggaggtttcgttttcggaggtatcgtttcgttttttttcgttagcgttcgtaggattcggatgagagcgtacgtttcggggttttcgggaagtcgcggcgttttcggatgtggcggatgcggtcgtgagtcggcgggggaggtgcgttagtgtttttcgagttcgttcgtagattttttatttcgtttcgcgttttttgttttttttcgtatttagtttttttttcgttgttttaggagttttcgggttgttttttttttggggaacgggaaggattgcggagg

SEQ ID NO: 1206 - DNA, 567 bp, Artificial Sequence
  chemically treated genomic DNA (Homo sapiens) CpG-island No: 1206
cctccgcaatccttcccgttccccaaaaaaaaaacaacccgaaaactcctaaaacaacgaaaaaaaaactaaatacgaaaaaaaacaaaaaacgcgaaacgaaataaaaaatctacgaacgaactcgaaaaacactaacgcacctcccccgccgactcacgaccgcatccgccacatccgaaaacgccgcgacttcccgaaaaccccgaaacgtacgctctcatccgaatcctacgaacgctaacgaaaaaaaacgaaacgatacctccgaaaacgaaacctccttcgattaacgacctcgaacttcgaaaatcctccaaaaaaccaaataaaaccgtcccgtaataccccgcgccccgaccgctctaacctacaacgtatctctaaaacgaaaacaacgacaataaaattcgctacgcgctattaaaaaccacctatcttttcgcttatatccctctttataatatcgcgctcgaatcccgacgaaccgctccaaacctcgacatatcgtacaactacgtaataacgacccaaaaacccaccgccgtaaacgactacataaccgat

SEQ ID NO: 1207 - DNA, 567 bp, Artificial Sequence
  chemically treated genomic DNA (Homo sapiens) CpG-island No: 1207
ttttcgtagtttttttcgttttttaaaggaggaatagttcgagggtttttggagtaacggaaggaggattggatgcggggaagggtaaagggcgcggaacggggtggggagtttgcgggcgagttcggaggatattggcgtatttttttcgtcggtttacggtcgtattcgttatattcgaaggcgtcgcgatttttcggagatttcgaagcgtgcgtttttattcgggttttgcgggcgttggcggaaagaggcgaggcggtgttttcgggggcggggtttttttcggttggcggtttcgggtttcgggagttttttaagaggttaggtgaggtcgtttcgtgatgtttcgcgtttcggtcgttttggtttgtaacgtgtttttggggcggaggtagcggtagtggagttcgttgcgcgttgttgggggttatttgttttttcgtttgtgtttttttttgtagtgtcgcgttcgagtttcgacgggtcgttttaagtttcgatatgtcgtataattacgtggtaacggtttagaagtttatcgtcgtgaacggttgtatgatcggt

SEQ ID NO: 1208 - DNA, 567 bp, Artificial Sequence
  chemically treated genomic DNA (Homo sapiens) CpG-island No: 1208
accgatcatacaaccgttcacgacgataaacttctaaaccgttaccacgtaattatacgacatatcgaaacttaaaacgacccgtcgaaactcgaacgcgacactacaaaaaaaaacacaaacgaaaaaacaaataacccccaacaacgcgcaacgaactccactaccgctacctccgccccaaaaacacgttacaaaccaaaacgaccgaaacgcgaaacatcacgaaacgacctcacctaacctcttaaaaaactcccgaaacccgaaaccgccaaccgaaaaaaaccccgcccccgaaaacaccgcctcgcctctttccgccaacgcccgcaaaacccgaataaaaacgcacgcttcgaaatctccgaaaaatcgcgacgccttcgaatataacgaatacgaccgtaaaccgacgaaaaaaatacgccaatatcctccgaactcgcccgcaaactccccaccccgttccgcgccctttacccttccccgcatccaatcctccttccgttactccaaaaaccctcgaactattcctcctttaaaaaacgaaaaaaactacgaaaa

SEQ ID NO: 1209 - DNA, 652 bp, Artificial Sequence
  chemically treated genomic DNA (Homo sapiens) CpG-island No: 1209
tttgtcgttgtcgttggttttcgtggttttggaggttgcgtggttcggggttgtggcgttggttgatttcgtttttggtgggggttttttttggtttttcgtgggtcgtttttttgttgtgttttcgtttggggggtgggcgttttggtgtttcgtttttttgcgtgttttttttgtcgtggaggggggttaggggcgttttttttgttgttcgggggtgcgttgttgtcgtcgcggttcgttggggttttcgttttcgcggttcgagcggttcggcggttttttcggagtgtcgtggggtgtcggtggtgcgcgttcgcggttggcgtggttttgggggtgttggtggggggtgggggtttcgtcgtgttgggcgtggttgggcgtttggcgttttggtcgtcgggtggtgttggtcgtcgttggtcgtcgttgggtgtcggggggtgcggggggtagcggtcgggggtgtgggcgcgtcgtggtttttcgtggaggtgggagtcgatggtcgggcggggggtggtacgttttggtggtcgtcgtgtggttcgtatgtgaggtggttgtgttagtgttgtgtgtgatggggtgtgtgtcgggtgggcgttggggagtggggttgtgggttgtggaggtgatggttgtgggg

SEQ ID NO: 1210 - DNA, 652 bp, Artificial Sequence
  chemically treated genomic DNA (Homo sapiens) CpG-island No: 1210
ccccacaaccatcacctccacaacccacaaccccactccccaacgcccacccgacacacaccccatcacacacaacactaacacaaccacctcacatacgaaccacacgacgaccaccaaaacgtaccaccccccgcccgaccatcgactcccacctccacgaaaaaccacgacgcgcccacacccccgaccgctaccccccgcaccccccgacacccaacgacgaccaacgacgaccaacaccacccgacgaccaaaacgccaaacgcccaaccacgcccaacacgacgaaacccccaccccccaccaacacccccaaaaccacgccaaccgcgaacgcgcaccaccgacaccccacgacactccgaaaaaaccgccgaaccgctcgaaccgcgaaaacgaaaaccccaacgaaccgcgacgacaacaacgcacccccgaacaacaaaaaaaacgcccctaacccccctccacgacaaaaaaaacacgcaaaaaaacgaaacaccaaaacgcccaccccccaaacgaaaacacaacaaaaaaacgacccacgaaaaaccaaaaaaaacccccaccaaaaacgaaatcaaccaacgccacaaccccgaaccacgcaacctccaaaaccacgaaaaccaacgacaacgacaaa

SEQ ID NO: 1211 - DNA, 652 bp, Artificial Sequence
  chemically treated genomic DNA (Homo sapiens) CpG-island No: 1211
ttttataattattatttttatagtttataattttattttttaacgtttattcgatatatattttattatatataatattggtataattattttatatacgggttatacggcggttattagggcgtgttatttttcgttcggttatcgatttttatttttacgaggagttacggcgcgtttatattttcggtcgttatttttcgtatttttcggtatttaacggcggttaacggcggttagtattattcgacggttaggacgttaagcgtttagttacgtttaatacggcgaaatttttattttttattaatatttttaaaattacgttagtcgcgggcgcgtattatcggtattttacggtatttcgggagggtcgtcggatcgttcgaatcgcggaggcggaggttttagcgaatcgcgacggtaataacgtattttcgggtaatagagggagcgtttttggtttttttttacgataaaaaaaatacgtaagaagacgagatattagagcgtttattttttaagcgaggatatagtaagaagacggtttacggaaagttaggaagagtttttattagaaacggaattagttagcgttataatttcggattacgtagtttttagaattacgagaattaacgatagcggtaga

SEQ ID NO: 1212 - DNA, 652 bp, Artificial Sequence
  chemically treated genomic DNA (Homo sapiens) CpG-island No: 1212
tctaccgctatcgttaattctcgtaattctaaaaactacgtaatccgaaattataacgctaactaattccgtttctaataaaaactcttcctaactttccgtaaaccgtcttcttactatatcctcgcttaaaaaataaacgctctaatatctcgtcttcttacgtattttttttatcgtaaaaaaaaaccaaaaacgctccctctattacccgaaaatacgttattaccgtcgcgattcgctaaaacctccgcctccgcgattcgaacgatccgacgaccctcccgaaataccgtaaaataccgataatacgcgcccgcgactaacgtaattttaaaaatattaataaaaaataaaaatttcgccgtattaaacgtaactaaacgcttaacgtcctaaccgtcgaataatactaaccgccgttaaccgccgttaaataccgaaaaatacgaaaaataacgaccgaaaatataaacgcgccgtaactcctcgtaaaaataaaaatcgataaccgaacgaaaaataacacgccctaataaccgccgtataacccgtatataaaataattataccaatattatatataataaaatatatatcgaataaacgttaaaaaataaaattataaactataaaaataataattataaaa

SEQ ID NO: 1213 - DNA, 853 bp, Artificial Sequence
  chemically treated genomic DNA (Homo sapiens) CpG-island No: 1213
ttggcgtcgtgggttcgaatttttacggtttttatttcgttataataaggcgtttcgggttttatcgataggggttatgttcggggcgcgtagtttttggtgttagttttgttttcgaagtttgttttttttcggggtttcggtttgacgtttttagttagcgtttcgtaggaagtcgatttttaaatcggggtagggggtgtgggtcgagggcgaaatttcgtttttaggggtttttgatttttgttttcgtttcgggtttcgcgtttttcggagaggtattagtaggcgggcggcgttgtttttgtgtgtttcgtttcgaggtgttagagattttttttataatcgttcgtcgcgttttttcgcggttttcggttttttttttcggcgttttaagtttttttgtttagttttgcgtgttatttcggggatcgttggttcgttttttacggcgttaggaggaggggcgagggtcggtagttttttttttcgcgcgcggcgtaggagtcgagtttagttcgggggattcgtcgtcgtcggttatgtgggtcggattgttttttcgggtcgtttgtgtcgcgtttttgttgtcgggggtattagttcgaggttatatcgggaggaagtcgttcgggtatttcgcggtcgagaggtaagcgttcggagttttttttcgttttttcgttcgggagagcgttatcggcgtgtagtcgagaggcgcggaggggcgtttaggagtcgtaggtagtcgcgtgtcggggttttttttggggtgttattagcgcgggtatagttcggggacggtataaagagttagtaatttgtgtttttaggcgggtgtttatcgtgtttt

SEQ ID NO: 1214 - DNA, 853 bp, Artificial Sequence
  chemically treated genomic DNA (Homo sapiens) CpG-island No: 1214
aaaacacgataaacacccgcctaaaaacacaaattactaactctttataccgtccccgaactatacccgcgctaataacaccccaaaaaaaaccccgacacgcgactacctacgactcctaaacgcccctccgcgcctctcgactacacgccgataacgctctcccgaacgaaaaaacgaaaaaaaactccgaacgcttacctctcgaccgcgaaatacccgaacgacttcctcccgatataacctcgaactaatacccccgacaacaaaaacgcgacacaaacgacccgaaaaaacaatccgacccacataaccgacgacgacgaatcccccgaactaaactcgactcctacgccgcgcgcgaaaaaaaaaactaccgaccctcgcccctcctcctaacgccgtaaaaaacgaaccaacgatccccgaaataacacgcaaaactaaacaaaaaaacttaaaacgccgaaaaaaaaaaccgaaaaccgcgaaaaaacgcgacgaacgattataaaaaaaatctctaacacctcgaaacgaaacacacaaaaacaacgccgcccgcctactaatacctctccgaaaaacgcgaaacccgaaacgaaaacaaaaatcaaaaacccctaaaaacgaaatttcgccctcgacccacaccccctaccccgatttaaaaatcgacttcctacgaaacgctaactaaaaacgtcaaaccgaaaccccgaaaaaaaacaaacttcgaaaacaaaactaacaccaaaaactacgcgccccgaacataacccctatcgataaaacccgaaacgccttattataacgaaataaaaaccgtaaaaattcgaacccacgacgccaa

SEQ ID NO: 1215 - DNA, 853 bp, Artificial Sequence
  chemically treated genomic DNA (Homo sapiens) CpG-island No: 1215
ggggtacgatgagtattcgtttagaggtataagttgttgattttttgtgtcgttttcgagttgtgttcgcgttgatagtattttagaggaagtttcgatacgcggttgtttgcggtttttgagcgttttttcgcgtttttcgattgtacgtcggtagcgttttttcgggcgggggagcggggaggagtttcgggcgtttatttttcggtcgcgaagtgttcgggcggttttttttcggtgtagtttcgggttggtgttttcggtagtaggagcgcgatataggcggttcgaaggagtagttcggtttatatgatcggcggcggcgggtttttcgggttgggttcggtttttgcgtcgcgcgcgggagagggggttgtcggttttcgtttttttttttggcgtcgtggggagcgaattagcgattttcgaaatggtacgtagagttgagtaggggggtttgggacgtcgagaggaggggtcgagggtcgcgaggggacgcggcggacgattgtggggagggtttttggtatttcgaagcgaaatatataaaggtaacgtcgttcgtttgttgatgttttttcgagaggcgcggagttcggggcgggggtaaagattagggatttttgggggcggggtttcgttttcggtttatattttttgtttcggtttgggagtcggttttttgcgaagcgttgattgaaggcgttagatcgaggtttcgggaggaaatagatttcgggaataaggttagtattagaggttgcgcgtttcgggtatggtttttgtcggtgggattcgagacgttttgttgtgacgaggtgggaatcgtggaaattcgaatttacgacgttag

SEQ ID NO: 1216 - DNA, 853 bp, Artificial Sequence
  chemically treated genomic DNA (Homo sapiens) CpG-island No: 1216
ctaacgtcgtaaattcgaatttccacgattcccacctcgtcacaacaaaacgtctcgaatcccaccgacaaaaaccatacccgaaacgcgcaacctctaatactaaccttattcccgaaatctatttcctcccgaaacctcgatctaacgccttcaatcaacgcttcgcaaaaaaccgactcccaaaccgaaacaaaaaatataaaccgaaaacgaaaccccgcccccaaaaatccctaatctttacccccgccccgaactccgcgcctctcgaaaaaacatcaacaaacgaacgacgttacctttatatatttcgcttcgaaataccaaaaaccctccccacaatcgtccgccgcgtcccctcgcgaccctcgacccctcctctcgacgtcccaaacccccctactcaactctacgtaccatttcgaaaatcgctaattcgctccccacgacgccaaaaaaaaaaacgaaaaccgacaaccccctctcccgcgcgcgacgcaaaaaccgaacccaacccgaaaaacccgccgccgccgatcatataaaccgaactactccttcgaaccgcctatatcgcgctcctactaccgaaaacaccaacccgaaactacaccgaaaaaaaaccgcccgaacacttcgcgaccgaaaaataaacgcccgaaactcctccccgctcccccgcccgaaaaaacgctaccgacgtacaatcgaaaaacgcgaaaaaacgctcaaaaaccgcaaacaaccgcgtatcgaaacttcctctaaaatactatcaacgcgaacacaactcgaaaacgacacaaaaaatcaacaacttatacctctaaacgaatactcatcgtacccc

SEQ ID NO: 1217 - DNA, 805 bp, Artificial Sequence
  chemically treated genomic DNA (Homo sapiens) CpG-island No: 1217
  misc_feature (108)..(108): n is either a, c, g or t
  misc_feature (308)..(308): n is either a, c, g or t
  misc_feature (326)..(326): n is either a, c, g or t
gtcgttgtttggtgggtcgtgcgttcgttggggttgtcgtttggcggtgggggttgcggggtgttttttcggggggttttgttgtgggcgttgtgtttcgtgcgcgtnggttgcgtggtgcggcgtgtgcgcggcgtgttggttgtttcgttgggggcgtggcggtgcgtcgtgcggttgtggtgtcgcggtcgcgttggcgtgtcgttgtgcgtggttgtgtgtgttcgggcgttggtgcgttcggtgcgtgcgtcgggggggtggtgtcggcgggttggttggggttcgggtgtgcgtgtgtgtgntgcgcgcgtgggcggttncgggtggtgtgtgtcgcgtgcgtgtcggttggttggtgcggcgggtggggggtggcgtgtgcgttgggggcgggtgtggcgcgggcgtgcggtgcgcgttgtgtcgatttgttggcggcgtgtcgtgtgcgcgcggtggtcgtggcgtgcgtttgtgttggcgtggtgtgtggggttgttgttggtcggcgggtgggcgggtgggtcgcgcgggcgcgcgtgtgggcggtgttggcgggcggtgtgtgtgtgcgtggggtggtggtgttgggtcgtgtggttggtgcgttgtcgttcgtttggtgtcgcgtggcgggcgcgtgtgtgtgtgtggttcgcgcgtgtgtggttggggtgttggtgcgtcgtgttgggttgtggtgtgtgggtgggtgcgtgtcgtggtgtgtggttgcgtggttgtgggtgcgtggtgttgtggcggtgtcgggttgttcgttattatatttggttaattt

SEQ ID NO: 1218 - DNA, 805 bp, Artificial Sequence
  chemically treated genomic DNA (Homo sapiens) CpG-island No: 1218
  misc_feature (480)..(480): n is either a, c, g or t
  misc_feature (498)..(498): n is either a, c, g or t
  misc_feature (698)..(698): n is either a, c, g or t
aaattaaccaaatataataacgaacaacccgacaccgccacaacaccacgcacccacaaccacgcaaccacacaccacgacacgcacccacccacacaccacaacccaacacgacgcaccaacaccccaaccacacacgcgcgaaccacacacacacacgcgcccgccacgcgacaccaaacgaacgacaacgcaccaaccacacgacccaacaccaccaccccacgcacacacacaccgcccgccaacaccgcccacacgcgcgcccgcgcgacccacccgcccacccgccgaccaacaacaaccccacacaccacgccaacacaaacgcacgccacgaccaccgcgcgcacacgacacgccgccaacaaatcgacacaacgcgcaccgcacgcccgcgccacacccgcccccaacgcacacgccaccccccacccgccgcaccaaccaaccgacacgcacgcgacacacaccacccgnaaccgcccacgcgcgcancacacacacgcacacccgaaccccaaccaacccgccgacaccacccccccgacgcacgcaccgaacgcaccaacgcccgaacacacacaaccacgcacaacgacacgccaacgcgaccgcgacaccacaaccgcacgacgcaccgccacgcccccaacgaaacaaccaacacgccgcgcacacgccgcaccacgcaaccnacgcgcacgaaacacaacgcccacaacaaaaccccccgaaaaaacaccccgcaacccccaccgccaaacgacaaccccaacgaacgcacgacccaccaaacaacgac

SEQ ID NO: 1219 - DNA, 805 bp, Artificial Sequence
  chemically treated genomic DNA (Homo sapiens) CpG-island No: 1219
  misc_feature (480)..(480): n is either a, c, g or t
  misc_feature (498)..(498): n is either a, c, g or t
  misc_feature (698)..(698): n is either a, c, g or t
aaattagttaggtatgatggcgaatagttcggtatcgttataatattacgtatttatagttacgtagttatatattacgatacgtatttatttatatattatagtttagtacgacgtattagtattttagttatatacgcgcggattatatatatatacgcgttcgttacgcgatattaagcgaacgatagcgtattagttatacgatttagtattattattttacgtatatatatatcgttcgttaatatcgtttatacgcgcgttcgcgcgatttattcgtttattcgtcggttagtagtagttttatatattacgttagtataggcgtacgttacggttatcgcgcgtatacgatacgtcgttagtaggtcgatatagcgcgtatcgtacgttcgcgttatattcgtttttaacgtatacgttattttttattcgtcgtattagttagtcggtacgtacgcgatatatattattcgnggtcgtttacgcgcgtantatatatacgtatattcgggttttaattagttcgtcgatattattttttcgacgtacgtatcgagcgtattaacgttcgagtatatataattacgtataacggtacgttaacgcggtcgcggtattatagtcgtacgacgtatcgttacgtttttagcggagtaattaatacgtcgcgtatacgtcgtattacgtaattnacgcgtacgaaatataacgtttatagtaaagtttttcggggaaatatttcgtaatttttatcgttaggcggtagttttaacggacgtacgatttattaggtaacgat

SEQ ID NO: 1220 - DNA, 805 bp, Artificial Sequence
  chemically treated genomic DNA (Homo sapiens) CpG-island No: 1220
  misc_feature (108)..(108): n is either a, c, g or t
  misc_feature (308)..(308): n is either a, c, g or t
  misc_feature (326)..(326): n is either a, c, g or t
atcgttacctaataaatcgtacgtccgttaaaactaccgcctaacgataaaaattacgaaatatttccccgaaaaactttactataaacgttatatttcgtacgcgtnaattacgtaatacgacgtatacgcgacgtattaattactccgctaaaaacgtaacgatacgtcgtacgactataataccgcgaccgcgttaacgtaccgttatacgtaattatatatactcgaacgttaatacgctcgatacgtacgtcgaaaaaataatatcgacgaactaattaaaacccgaatatacgtatatatantacgcgcgtaaacgaccncgaataatatatatcgcgtacgtaccgactaactaatacgacgaataaaaaataacgtatacgttaaaaacgaatataacgcgaacgtacgatacgcgctatatcgacctactaacgacgtatcgtatacgcgcgataaccgtaacgtacgcctatactaacgtaatatataaaactactactaaccgacgaataaacgaataaatcgcgcgaacgcgcgtataaacgatattaacgaacgatatatatatacgtaaaataataatactaaatcgtataactaatacgctatcgttcgcttaatatcgcgtaacgaacgcgtatatatatataatccgcgcgtatataactaaaatactaatacgtcgtactaaactataatatataaataaatacgtatcgtaatatataactacgtaactataaatacgtaatattataacgataccgaactattcgccatcatacctaactaattt

SEQ ID NO: 1221 - DNA, 568 bp, Artificial Sequence
  chemically treated genomic DNA (Homo sapiens) CpG-island No: 1221
cggagcgattttttaattttaattaatttgcgttttaattttagaggtagaatttcgtttttagagagcgacgcgtcgtcgtttcgggtggtttcgtttgttttaaattgtttgaatttttatagtgatatttttaataacgcgttttgtcggagtatcgtaatttattttttcgcgattcgtttttggtgtttcggatttcgatggcgttacggtgcgtttggcgtttttatttgagggtttagttttagggtacggttatagtcggcgcgaggtttaaggttgcggtgttgcggttattggcggcgacgagtttcgtttcgggcgggtttggtagggcgggcggtgtagttttcgcggtagagtagtttcgagtggtcgggttttcgtgcgcggaggcggtttttgtaatttcggttcgggcgggcgggtttgttcggagttgtggggagagggcggggtcgggcggggtcggagcggggttgggattggcgagcggggtagattttggagggattcgggagtgggttgttggggaggggggtcgttgggggacgcggggatattt

SEQ ID NO: 1222 - DNA, 568 bp, Artificial Sequence
  chemically treated genomic DNA (Homo sapiens) CpG-island No: 1222
aaatatccccgcgtcccccaacgacccccctccccaacaacccactcccgaatccctccaaaatctaccccgctcgccaatcccaaccccgctccgaccccgcccgaccccgccctctccccacaactccgaacaaacccgcccgcccgaaccgaaattacaaaaaccgcctccgcgcacgaaaacccgaccactcgaaactactctaccgcgaaaactacaccgcccgccctaccaaacccgcccgaaacgaaactcgtcgccgccaataaccgcaacaccgcaaccttaaacctcgcgccgactataaccgtaccctaaaactaaaccctcaaataaaaacgccaaacgcaccgtaacgccatcgaaatccgaaacaccaaaaacgaatcgcgaaaaaataaattacgatactccgacaaaacgcgttattaaaaatatcactataaaaattcaaacaatttaaaacaaacgaaaccacccgaaacgacgacgcgtcgctctctaaaaacgaaattctacctctaaaattaaaacgcaaattaattaaaattaaaaaatcgctccg

SEQ ID NO: 1223 - DNA, 568 bp, Artificial Sequence
  chemically treated genomic DNA (Homo sapiens) CpG-island No: 1223
gaatgttttcgcgttttttagcggtttttttttttagtagtttattttcgggtttttttagggtttgtttcgttcgttagttttagtttcgtttcggtttcgttcggtttcgttttttttttatagtttcgggtagattcgttcgttcgagtcggagttataagagtcgttttcgcgtacgggggttcggttattcggagttgttttgtcgcggggattgtatcgttcgttttgttagattcgttcggaacggggttcgtcgtcgttagtagtcgtagtatcgtagttttgggtttcgcgtcggttatggtcgtgttttggggttgagtttttaggtaggggcgttaggcgtatcgtggcgttatcggggttcggggtattaagggcgggtcgcggggaggtgggttgcggtgtttcggtagggcgcgttgttgggggtgttattgtgaggatttaagtagtttggagtaagcggggttattcggggcggcgacgcgtcgttttttgggagcggagttttgtttttggagttggggcgtaagttggttaaagttggaaaatcgtttcg

SEQ ID NO: 1224 - DNA, 568 bp, Artificial Sequence
  chemically treated genomic DNA (Homo sapiens) CpG-island No: 1224
cgaaacgattttccaactttaaccaacttacgccccaactccaaaaacaaaactccgctcccaaaaaacgacgcgtcgccgccccgaataaccccgcttactccaaactacttaaatcctcacaataacacccccaacaacgcgccctaccgaaacaccgcaacccacctccccgcgacccgcccttaataccccgaaccccgataacgccacgatacgcctaacgcccctacctaaaaactcaaccccaaaacacgaccataaccgacgcgaaacccaaaactacgatactacgactactaacgacgacgaaccccgttccgaacgaatctaacaaaacgaacgatacaatccccgcgacaaaacaactccgaataaccgaacccccgtacgcgaaaacgactcttataactccgactcgaacgaacgaatctacccgaaactataaaaaaaaaacgaaaccgaacgaaaccgaaacgaaactaaaactaacgaacgaaacaaaccctaaaaaaacccgaaaataaactactaaaaaaaaaaaccgctaaaaaacgcgaaaacattc

SEQ ID NO: 1225 - DNA, 524 bp, Artificial Sequence
  chemically treated genomic DNA (Homo sapiens) CpG-island No: 1225
tacgcggtcgggtttacgagttttttttaatcgtcgtttcgggtttcggggttgtcgttttttttagcgtcggttttgtttttagaagcgaaggtcgttttgcgttcggtttcggtttttttttgttttttggtcggtttttttttcgcggtcgtttcgggatttgtgtttagatttttggggttacgattacgttttagtcgtttaagttatcgtttttttttttttttttagcgttttcgttcgggcggtgtatggtggtttcggtgtatggtggttttcgtacgtatagtcgtaggggtttttttttttagattcgaggcggtggcgtatttgtattttttaaaattttttcgtcggttttcgcggtttagcgggaggcgcggagggtcgagttggggtgcgtgcgagcgggcgttaggaaagcgcggggtcgttttaggggttaggtttttttttaaatagtgggaggtttacgaagtgtttgaagttcgaggtttttttttttgttttagttcgttttt

SEQ ID NO: 1226 - DNA, 524 bp, Artificial Sequence
  chemically treated genomic DNA (Homo sapiens) CpG-island No: 1226
aaaaacgaactaaaacaaaaaaaaaaacctcgaacttcaaacacttcgtaaacctcccactatttaaaaaaaaacctaacccctaaaacgaccccgcgctttcctaacgcccgctcgcacgcaccccaactcgaccctccgcgcctcccgctaaaccgcgaaaaccgacgaaaaaattttaaaaaatacaaatacgccaccgcctcgaatctaaaaaaaaaaacccctacgactatacgtacgaaaaccaccatacaccgaaaccaccatacaccgcccgaacgaaaacgctaaaaaaaaaaaaaaaaacgataacttaaacgactaaaacgtaatcgtaaccccaaaaatctaaacacaaatcccgaaacgaccgcgaaaaaaaaaccgaccaaaaaacaaaaaaaaaccgaaaccgaacgcaaaacgaccttcgcttctaaaaacaaaaccgacgctaaaaaaaacgacaaccccgaaacccgaaacgacgattaaaaaaaactcgtaaacccgaccgcgta

SEQ ID NO: 1227 - DNA, 524 bp, Artificial Sequence
  chemically treated genomic DNA (Homo sapiens) CpG-island No: 1227
gagagcgaattaaaataaaaaggggagtttcgggttttagatatttcgtgggttttttattgtttaaagaaaggtttagtttttagggcggtttcgcgtttttttggcgttcgttcgtacgtattttagttcggtttttcgcgtttttcgttagatcgcgagggtcgacgggggagttttagagggtgtaggtgcgttatcgtttcgagtttaggagaggaaatttttgcggttgtgcgtgcgagaattattatatatcggagttattatatatcgttcgggcgggaacgttggaagggaggggaggggcggtgatttgggcggttggggcgtgatcgtggttttaggggtttgggtataggtttcgggacggtcgcgggaggaggatcggttagagggtagggaaaggtcgggatcgggcgtagggcggttttcgtttttgggggtagagtcgacgttgaggggagcggtagtttcgaggttcggggcggcggttggaggaggttcgtgggttcggtcgcgtg

SEQ ID NO: 1228 - DNA, 524 bp, Artificial Sequence
  chemically treated genomic DNA (Homo sapiens) CpG-island No: 1228
cacgcgaccgaacccacgaacctcctccaaccgccgccccgaacctcgaaactaccgctcccctcaacgtcgactctacccccaaaaacgaaaaccgccctacgcccgatcccgacctttccctaccctctaaccgatcctcctcccgcgaccgtcccgaaacctatacccaaacccctaaaaccacgatcacgccccaaccgcccaaatcaccgcccctcccctcccttccaacgttcccgcccgaacgatatataataactccgatatataataattctcgcacgcacaaccgcaaaaatttcctctcctaaactcgaaacgataacgcacctacaccctctaaaactcccccgtcgaccctcgcgatctaacgaaaaacgcgaaaaaccgaactaaaatacgtacgaacgaacgccaaaaaaacgcgaaaccgccctaaaaactaaacctttctttaaacaataaaaaacccacgaaatatctaaaacccgaaactcccctttttattttaattcgctctc

SEQ ID NO: 1229 - DNA, 1009 bp, Artificial Sequence
  chemically treated genomic DNA (Homo sapiens) CpG-island No: 1229
gagtggttcgattcggataaaatgtttttttttcgaggaggcggcgacgagtttagtaatagttcgagtacggtcggtcgggtcgcgggaagttcgagaacgcggcgcgcgtagttgggaggcgatttttattcggcgaggttttcgggattaaacgtcgttcgatagttacgtagaatagacgcggtagtgcgacgttttttttattggggatacgagatagcgatagttacgcggtgagtcggtataaggttttttaggttttagcgggtttggatattcggtggtattaatttttttttatcgtcggggaagatagtagtttttttggcgaggaagtaggtcgggtttaggcgttttagttagagggcgggtttgcgttattttcggaaagcgttatttttattttcggtcggcgttttggttttgtatttggatagggttgcggtaggttagcggtgggttggcggttgcgttttttagatcggcggtttttcgggcggtggtttgcgtttgagttttagaaagcgaggagcggtttttacggaagttaagttggtcgaggtaatcgagaagcggttttttttatggtttcgattttggagtcgttggagcggcggcggtcgtagggaggtagttatttttcgtaggcggtggtcgcggcgttttcgggtcgcgcggttggagtttgaggcggggttatcgtcgggtacgagaaattatttttttttcgtttttcgtagttgtattttagaggcgcggttgaagttcgttgggatattgttcgtttgtttagtgtttacgggtacgtttgtcgtagatataggttgtggcgaattcgagtgttggcgggtagtagtgtttgtagttgcgttcgtagattttttttcgttttcgtcggtattttcgtgttcggtcgatgttatgcggtcggttgagttttagggttagtagtttttattgatgtaaaaatataggaagtgtttttttgtttttggaatcggggtgg

SEQ ID NO: 1230 - DNA, 1009 bp, Artificial Sequence
  chemically treated genomic DNA (Homo sapiens) CpG-island No: 1230
ccaccccgattccaaaaacaaaaaaacacttcctatatttttacatcaataaaaactactaaccctaaaactcaaccgaccgcataacatcgaccgaacacgaaaataccgacgaaaacgaaaaaaaatctacgaacgcaactacaaacactactacccgccaacactcgaattcgccacaacctatatctacgacaaacgtacccgtaaacactaaacaaacgaacaatatcccaacgaacttcaaccgcgcctctaaaatacaactacgaaaaacgaaaaaaaaataatttctcgtacccgacgataaccccgcctcaaactccaaccgcgcgacccgaaaacgccgcgaccaccgcctacgaaaaataactacctccctacgaccgccgccgctccaacgactccaaaatcgaaaccataaaaaaaaccgcttctcgattacctcgaccaacttaacttccgtaaaaaccgctcctcgctttctaaaactcaaacgcaaaccaccgcccgaaaaaccgccgatctaaaaaacgcaaccgccaacccaccgctaacctaccgcaaccctatccaaatacaaaaccaaaacgccgaccgaaaataaaaataacgctttccgaaaataacgcaaacccgccctctaactaaaacgcctaaacccgacctacttcctcgccaaaaaaactactatcttccccgacgataaaaaaaaattaataccaccgaatatccaaacccgctaaaacctaaaaaaccttataccgactcaccgcgtaactatcgctatctcgtatccccaataaaaaaaacgtcgcactaccgcgtctattctacgtaactatcgaacgacgtttaatcccgaaaacctcgccgaataaaaatcgcctcccaactacgcgcgccgcgttctcgaacttcccgcgacccgaccgaccgtactcgaactattactaaactcgtcgccgcctcctcgaaaaaaaaacattttatccgaatcgaaccactc

SEQ ID NO: 1231 - DNA, 1009 bp, Artificial Sequence
  chemically treated genomic DNA (Homo sapiens) CpG-island No: 1231
ttatttcggttttagaagtaaagagatattttttatgtttttgtattagtagaagttgttagttttgaggtttaatcgatcgtatgatatcggtcggatacggaaatgtcggcggaggcgggaaagagtttgcgggcgtagttgtaggtattgttgttcgttagtattcggattcgttatagtttgtgtttgcgataggcgtgttcgtgggtattgggtaagcgggtagtgttttagcgagttttagtcgcgtttttgggatatagttgcgaaaagcggggagagaatggtttttcgtgttcgacggtggtttcgttttaggttttagtcgcgcggttcggaagcgtcgcggttatcgtttacggaaaatggttgtttttttgcggtcgtcgtcgttttagcggttttagggtcgaagttataggggaagtcgtttttcggttatttcggttagtttggttttcgtggaggtcgtttttcgttttttgaggtttaaacgtaagttatcgttcgaaaggtcgtcgatttgaggagcgtaatcgttagtttatcgttggtttatcgtagttttgtttaggtatagagttagagcgtcggtcggaagtggaagtgacgtttttcgagggtggcgtaggttcgttttttggttaaggcgtttgagttcggtttattttttcgttagagaaattgttgtttttttcggcggtagggaagggttaatgttatcgagtatttagattcgttgaagtttagagggttttgtatcggtttatcgcgtggttgtcgttgtttcgtgtttttagtgggggaggcgtcgtattgtcgcgtttgttttgcgtggttgtcgggcggcgtttggtttcgggagtttcgtcgggtaagggtcgttttttagttgcgcgcgtcgcgttttcgggtttttcgcggttcggtcggtcgtgttcgagttgttgttgggttcgtcgtcgttttttcgaggaagaggtattttgttcgggtcgggttattt

SEQ ID NO: 1232 - DNA, 1009 bp, Artificial Sequence
  chemically treated genomic DNA (Homo sapiens) CpG-island No: 1232
aaataacccgacccgaacaaaatacctcttcctcgaaaaaacgacgacgaacccaacaacaactcgaacacgaccgaccgaaccgcgaaaaacccgaaaacgcgacgcgcgcaactaaaaaacgacccttacccgacgaaactcccgaaaccaaacgccgcccgacaaccacgcaaaacaaacgcgacaatacgacgcctcccccactaaaaacacgaaacaacgacaaccacgcgataaaccgatacaaaaccctctaaacttcaacgaatctaaatactcgataacattaacccttccctaccgccgaaaaaaacaacaatttctctaacgaaaaaataaaccgaactcaaacgccttaaccaaaaaacgaacctacgccaccctcgaaaaacgtcacttccacttccgaccgacgctctaactctatacctaaacaaaactacgataaaccaacgataaactaacgattacgctcctcaaatcgacgacctttcgaacgataacttacgtttaaacctcaaaaaacgaaaaacgacctccacgaaaaccaaactaaccgaaataaccgaaaaacgacttcccctataacttcgaccctaaaaccgctaaaacgacgacgaccgcaaaaaaacaaccattttccgtaaacgataaccgcgacgcttccgaaccgcgcgactaaaacctaaaacgaaaccaccgtcgaacacgaaaaaccattctctccccgcttttcgcaactatatcccaaaaacgcgactaaaactcgctaaaacactacccgcttacccaatacccacgaacacgcctatcgcaaacacaaactataacgaatccgaatactaacgaacaacaatacctacaactacgcccgcaaactctttcccgcctccgccgacatttccgtatccgaccgatatcatacgatcgattaaacctcaaaactaacaacttctactaatacaaaaacataaaaaatatctctttacttctaaaaccgaaataa

SEQ ID NO: 1233 - DNA, 832 bp, Artificial Sequence
  chemically treated genomic DNA (Homo sapiens) CpG-island No: 1233
gggagggcggcggcgcggggttgatggatagtaggcggggttttcgggaggggcgagtagggcgggatcgtcgttgggaaggggttcgaggtaagggaattaggaattggggaggacgggaggtaggggttcgcgggggcgggtttgaggggacgcgagcgggtcgtcggggaggtttgaggggtaggggtaacgtagatttggcgaggcggaggggagcggcgaggtggttacgtcgaggttttttacggcggggtttgggtttatttggggcgattgggcggggcgcgggttcgcgagggtttagatttcgggttcgcggaggttacgggatttttcgggtggtttagcgggtcggagtttgtcgtcgattgtttcggacgttcgggcggaggattttcgtgagggggaacggttcgtgaacgcgcgcggagttgttcgcgttaaaaattttaaatcggtttcgaggtttttttttttttttagtgtagttcgttaggggtgttcgggtttcgaggtttcgtttttcgtgttgcgtgcgcgtcgtcgagtcgtttcgtcgtttattgcgtaggcgtataggatttttcgcgttggttcggggcgtgggtggcggtttggttttgagtcgttgcgcggggttttagtcgtttagtttttgggacgtttattgttttttaggtttcgtattcgatatttatcgttttcgttgggttggcgtagtgtttgggtttataaaagggatcgttatttcggtgttcggagtaggcgtagttttagggttatttcgggtaggattaggaagtttttacggttttttgggtttcggtat

SEQ ID NO: 1234 - DNA, 832 bp, Artificial Sequence
  chemically treated genomic DNA (Homo sapiens) CpG-island No: 1234
ataccgaaacccaaaaaaccgtaaaaacttcctaatcctacccgaaataaccctaaaactacgcctactccgaacaccgaaataacgatcccttttataaacccaaacactacgccaacccaacgaaaacgataaatatcgaatacgaaacctaaaaaacaataaacgtcccaaaaactaaacgactaaaaccccgcgcaacgactcaaaaccaaaccgccacccacgccccgaaccaacgcgaaaaatcctatacgcctacgcaataaacgacgaaacgactcgacgacgcgcacgcaacacgaaaaacgaaacctcgaaacccgaacacccctaacgaactacactaaaaaaaaaaaaaaacctcgaaaccgatttaaaatttttaacgcgaacaactccgcgcgcgttcacgaaccgttccccctcacgaaaatcctccgcccgaacgtccgaaacaatcgacgacaaactccgacccgctaaaccacccgaaaaatcccgtaacctccgcgaacccgaaatctaaaccctcgcgaacccgcgccccgcccaatcgccccaaataaacccaaaccccgccgtaaaaaacctcgacgtaaccacctcgccgctcccctccgcctcgccaaatctacgttacccctacccctcaaacctccccgacgacccgctcgcgtcccctcaaacccgcccccgcgaacccctacctcccgtcctccccaattcctaattcccttacctcgaaccccttcccaacgacgatcccgccctactcgcccctcccgaaaaccccgcctactatccatcaaccccgcgccgccgccctccc

SEQ ID NO: 1235 - DNA, 832 bp, Artificial Sequence
  chemically treated genomic DNA (Homo sapiens) CpG-island No: 1235
gtgtcgggatttaggaggtcgtagggattttttggttttattcggagtaattttggggttacgtttgtttcgagtatcgggatggcggttttttttatggatttaaatattacgttagtttagcgagggcggtgggtgtcgggtgcgaggtttggagggtagtgggcgttttagggattgggcggttgaagtttcgcgtagcgatttagaattaggtcgttatttacgtttcgggttagcgcggagaattttgtgcgtttgcgtagtgagcggcggggcggttcggcggcgcgtacgtagtacgaggggcggagtttcggagttcgggtatttttgacgggttgtattggggagggggaggagtttcgaggtcggtttggaatttttggcgcgagtagtttcgcgcgcgtttacgggtcgtttttttttacgggagtttttcgttcgggcgttcggaatagtcgacggtagatttcggttcgttgagttattcgaggggtttcgtggttttcgcggattcggaatttgggttttcgcggattcgcgtttcgtttagtcgttttaggtgagtttagatttcgtcgtgaggggtttcggcgtggttatttcgtcgttttttttcgtttcgttaggtttgcgttatttttgttttttaggttttttcggcggttcgttcgcgtttttttaggttcgttttcgcgagtttttgtttttcgttttttttaatttttggtttttttgtttcgagtttttttttagcggcggtttcgttttattcgtttttttcggagatttcgtttgttgtttattaatttcgcgtcgtcgttttttt

SEQ ID NO: 1236 - DNA, 832 bp, Artificial Sequence
  chemically treated genomic DNA (Homo sapiens) CpG-island No: 1236
aaaaaaacgacgacgcgaaattaataaacaacaaacgaaatctccgaaaaaaacgaataaaacgaaaccgccgctaaaaaaaaactcgaaacaaaaaaaccaaaaattaaaaaaaacgaaaaacaaaaactcgcgaaaacgaacctaaaaaaacgcgaacgaaccgccgaaaaaacctaaaaaacaaaaataacgcaaacctaacgaaacgaaaaaaaacgacgaaataaccacgccgaaacccctcacgacgaaatctaaactcacctaaaacgactaaacgaaacgcgaatccgcgaaaacccaaattccgaatccgcgaaaaccacgaaacccctcgaataactcaacgaaccgaaatctaccgtcgactattccgaacgcccgaacgaaaaactcccgtaaaaaaaaacgacccgtaaacgcgcgcgaaactactcgcgccaaaaattccaaaccgacctcgaaactcctccccctccccaatacaacccgtcaaaaatacccgaactccgaaactccgcccctcgtactacgtacgcgccgccgaaccgccccgccgctcactacgcaaacgcacaaaattctccgcgctaacccgaaacgtaaataacgacctaattctaaatcgctacgcgaaacttcaaccgcccaatccctaaaacgcccactaccctccaaacctcgcacccgacacccaccgccctcgctaaactaacgtaatatttaaatccataaaaaaaaccgccatcccgatactcgaaacaaacgtaaccccaaaattactccgaataaaaccaaaaaatccctacgacctcctaaatcccgacac

SEQ ID NO: 1237 - DNA, 882 bp, Artificial Sequence
  chemically treated genomic DNA (Homo sapiens) CpG-island No: 1237
attcgtagatcgcgagcgtattggttcgtgattggttggggtgcggcggcgagtatttgcgattggttgggtcgttcggagtgcggcgtttggttatttttcgaggtattaggttacggttggcggcgcgttttggggttttgggttggcggtcgtaatcggggtggcggtcgtagttaagttggcggcgcggttgtttcgttttagttcgtattcgcggttcgttcgcgttcgcgtttattcgcgattgggtcgggttcgttcgacgttgtcgtttatttcgttgttttcgtcgtttttgtcgtattcgtcgttgttcggtttgtcgttcggtttgagtttcgggtcgtcgacgtttttcgttttcgttttggtcgagttgttatcgttgttcgcgttttcgttgcggttcgagtcgttggcgttttggggtttcggcgcgtatttggtattgttcgagttgtcgttcgaagtttgtttattcgcgtttttcgtcgtcgtgttcgtattgtaggatttgtcgcgtttgttcgcgttcgcgcgtttcgttcgcgtttttatcgttgttttcgttgttcgtgttcgtcgtcgttttagtttttgggttcgtgggcgcgttcgttcgttcgtttttggttttcgagtcgtcgtcgtattcgttttcgtcgttgttcgcgcgattttttttttttagtttgttgacggttttcgagattcgcgatttatggttgttgttcgttttttttttgttatcgttcgtgtttttgttttcgtatttttttttgtcgtcgttttgttgatttggtttttttcgcggcgggtgagtaggtagttttcgatagggttagtgttcgtagttatttttttcgggtatggatttag

SEQ ID NO: 1238 - DNA, 882 bp, Artificial Sequence
  chemically treated genomic DNA (Homo sapiens) CpG-island No: 1238
ctaaatccatacccgaaaaaaataactacgaacactaaccctatcgaaaactacctactcacccgccgcgaaaaaaaccaaatcaacaaaacgacgacaaaaaaaaatacgaaaacaaaaacacgaacgataacaaaaaaaaaacgaacaacaaccataaatcgcgaatctcgaaaaccgtcaacaaactaaaaaaaaaaaatcgcgcgaacaacgacgaaaacgaatacgacgacgactcgaaaaccaaaaacgaacgaacgaacgcgcccacgaacccaaaaactaaaacgacgacgaacacgaacaacgaaaacaacgataaaaacgcgaacgaaacgcgcgaacgcgaacaaacgcgacaaatcctacaatacgaacacgacgacgaaaaacgcgaataaacaaacttcgaacgacaactcgaacaataccaaatacgcgccgaaaccccaaaacgccaacgactcgaaccgcaacgaaaacgcgaacaacgataacaactcgaccaaaacgaaaacgaaaaacgtcgacgacccgaaactcaaaccgaacgacaaaccgaacaacgacgaatacgacaaaaacgacgaaaacaacgaaataaacgacaacgtcgaacgaacccgacccaatcgcgaataaacgcgaacgcgaacgaaccgcgaatacgaactaaaacgaaacaaccgcgccgccaacttaactacgaccgccaccccgattacgaccgccaacccaaaaccccaaaacgcgccgccaaccgtaacctaatacctcgaaaaataaccaaacgccgcactccgaacgacccaaccaatcgcaaatactcgccgccgcaccccaaccaatcacgaaccaatacgctcgcgatctacgaat

SEQ ID NO: 1239 - DNA, 882 bp, Artificial Sequence
  chemically treated genomic DNA (Homo sapiens) CpG-island No: 1239
ttgaatttatgttcggggaaggtggttacgggtattggttttgtcgggggttgtttatttattcgtcgcgggaggggttaggttagtagggcggcgataggaagaaatgcggggataggggtacgggcggtggtaggggaaaggcggatagtagttatgggtcgcgggtttcgggggtcgttagtaggttgaagggagagggtcgcgcgggtagcggcggaagcggatgcggcggcggttcggagattaggggcgggcggacgagcgcgtttacgggtttaggggttgaggcgacggcggatacgggtagcggaagtagcggtaggagcgcgggcggagcgcgcgggcgcgggtaggcgcggtaggttttgtagtgcgagtacggcggcggagagcgcgggtgagtaggtttcgggcggtagttcgggtagtgttagatgcgcgtcggggttttagggcgttagcggttcgggtcgtagcgggagcgcgggtagcggtggtagttcggttagggcgagagcggagggcgtcggcggttcggggtttaggtcgggcggtaggtcgggtaacggcgggtgcggtagggacggcgggggtagcggggtgggcggtagcgtcgagcgggttcggtttaatcgcgagtgggcgcgggcgcgggcgagtcgcgggtgcgagttggagcggggtagtcgcgtcgttagtttggttgcggtcgttatttcggttgcggtcgttagtttagggttttagagcgcgtcgttagtcgtgatttggtatttcgggaggtggttaagcgtcgtatttcgagcggtttagttaatcgtagatgttcgtcgtcgtattttaattaattacgggttagtgcgttcgcggtttacgggt

SEQ ID NO: 1240 - DNA, 882 bp, Artificial Sequence
  chemically treated genomic DNA (Homo sapiens) CpG-island No: 1240
acccgtaaaccgcgaacgcactaacccgtaattaattaaaatacgacgacgaacatctacgattaactaaaccgctcgaaatacgacgcttaaccacctcccgaaataccaaatcacgactaacgacgcgctctaaaaccctaaactaacgaccgcaaccgaaataacgaccgcaaccaaactaacgacgcgactaccccgctccaactcgcacccgcgactcgcccgcgcccgcgcccactcgcgattaaaccgaacccgctcgacgctaccgcccaccccgctacccccgccgtccctaccgcacccgccgttacccgacctaccgcccgacctaaaccccgaaccgccgacgccctccgctctcgccctaaccgaactaccaccgctacccgcgctcccgctacgacccgaaccgctaacgccctaaaaccccgacgcgcatctaacactacccgaactaccgcccgaaacctactcacccgcgctctccgccgccgtactcgcactacaaaacctaccgcgcctacccgcgcccgcgcgctccgcccgcgctcctaccgctacttccgctacccgtatccgccgtcgcctcaacccctaaacccgtaaacgcgctcgtccgcccgcccctaatctccgaaccgccgccgcatccgcttccgccgctacccgcgcgaccctctcccttcaacctactaacgacccccgaaacccgcgacccataactactatccgcctttcccctaccaccgcccgtacccctatccccgcatttcttcctatcgccgccctactaacctaacccctcccgcgacgaataaataaacaacccccgacaaaaccaatacccgtaaccaccttccccgaacataaattcaa

SEQ ID NO: 1241 - DNA, 721 bp, Artificial Sequence
  chemically treated genomic DNA (Homo sapiens) CpG-island No: 1241
gcggatgaggttgttgcgtcgttaaggatgtagagtttaaagtaaggtagtggtttttatgagtttaaatatttttttttcgtacgttcggtatcgcgacgggggagagtaaaatttttaaataaatgttttagtttttttcgtagagagtcggagttaaattcgtgaggaagttcgggggtcgtagtgaagtttaatttattggtgttgggataatttcgttcgtaattcggatttaggtcgtaggtttttcgaggtttcgtttttgacggcgatatttaatttcgggtgttttcgtttttttattgaattttggtttcgttttcgtttttcgattggtcggacgttagttttacgtcgtacgggtaagacgcggaggagcggttttagttagaagatagggtattcgcggttttgttgcgtatgttcgcgttgtgatttcggtttgaggtaatagcgcgagttgaggttggggtttttggcgcggaggttgagggattcgtcgcggcgttgtcgtcggagagggagggtatcgttgtcgtcggtgaggacgggttttggcgggcggggagggttttgcgttttcggtatggacgagttttcggttcggttttttcgggggtttcgagggttgcgggtgttgaggaggggttcgcgttttggtgtttaggtcgttttttgtggggtttttcgcgattttttttttgtttttcgttttttt

SEQ ID NO: 1242 - DNA, 721 bp, Artificial Sequence
  chemically treated genomic DNA (Homo sapiens) CpG-island No: 1242
aaaaaaacgaaaaacaaaaaaaaaatcgcgaaaaaccccacaaaaaacgacctaaacaccaaaacgcgaacccctcctcaacacccgcaaccctcgaaacccccgaaaaaaccgaaccgaaaactcgtccataccgaaaacgcaaaaccctccccgcccgccaaaacccgtcctcaccgacgacaacgataccctccctctccgacgacaacgccgcgacgaatccctcaacctccgcgccaaaaaccccaacctcaactcgcgctattacctcaaaccgaaatcacaacgcgaacatacgcaacaaaaccgcgaataccctatcttctaactaaaaccgctcctccgcgtcttacccgtacgacgtaaaactaacgtccgaccaatcgaaaaacgaaaacgaaaccaaaattcaataaaaaaacgaaaacacccgaaattaaatatcgccgtcaaaaacgaaacctcgaaaaacctacgacctaaatccgaattacgaacgaaattatcccaacaccaataaattaaacttcactacgacccccgaacttcctcacgaatttaactccgactctctacgaaaaaaactaaaacatttatttaaaaattttactctcccccgtcgcgataccgaacgtacgaaaaaaaaatatttaaactcataaaaaccactaccttactttaaactctacatccttaacgacgcaacaacctcatccgc

SEQ ID NO: 1243 - DNA, 721 bp, Artificial Sequence
  chemically treated genomic DNA (Homo sapiens) CpG-island No: 1243
ggaggggcgagaggtaaagagggaatcgcgggagattttataggaggcggtttgagtattaggacgcggatttttttttagtattcgtagttttcgggattttcgagagagtcgggtcggggattcgtttatgtcgaggacgtaggatttttttcgttcgttagggttcgtttttatcgacgatagcggtgtttttttttttcggcgatagcgtcgcggcgggttttttagttttcgcgttaagggttttagttttagttcgcgttgttattttaagtcggggttatagcgcgagtatgcgtagtaaggtcgcgggtgttttgttttttggttggggtcgttttttcgcgttttgttcgtgcggcgtagagttggcgttcggttaatcggagggcggaggcggggttaaaatttagtaagggggcggggatattcgggattgagtgtcgtcgttaggggcggagtttcgggggatttgcggtttggattcgggttgcgggcgaggttattttagtattagtgggttgggttttattgcgattttcgggtttttttacggatttgatttcggttttttgcggggaaaattggagtatttgtttaaaggttttgttttttttcgtcgcgatatcgagcgtgcggagggaaggtgtttaggtttatggaagttattgttttgttttaagttttgtatttttgacgacgtagtagttttattcgt

SEQ ID NO: 1244 - DNA, 721 bp, Artificial Sequence
  chemically treated genomic DNA (Homo sapiens) CpG-island No: 1244
acgaataaaactactacgtcgtcaaaaatacaaaacttaaaacaaaacaataacttccataaacctaaacaccttccctccgcacgctcgatatcgcgacgaaaaaaaacaaaacctttaaacaaatactccaattttccccgcaaaaaaccgaaatcaaatccgtaaaaaaacccgaaaatcgcaataaaacccaacccactaatactaaaataacctcgcccgcaacccgaatccaaaccgcaaatcccccgaaactccgcccctaacgacgacactcaatcccgaatatccccgcccccttactaaattttaaccccgcctccgccctccgattaaccgaacgccaactctacgccgcacgaacaaaacgcgaaaaaacgaccccaaccaaaaaacaaaacacccgcgaccttactacgcatactcgcgctataaccccgacttaaaataacaacgcgaactaaaactaaaacccttaacgcgaaaactaaaaaacccgccgcgacgctatcgccgaaaaaaaaaaacaccgctatcgtcgataaaaacgaaccctaacgaacgaaaaaaatcctacgtcctcgacataaacgaatccccgacccgactctctcgaaaatcccgaaaactacgaatactaaaaaaaaatccgcgtcctaatactcaaaccgcctcctataaaatctcccgcgattccctctttacctctcgcccctcc

SEQ ID NO: 1245 - DNA, 748 bp, Artificial Sequence
  chemically treated genomic DNA (Homo sapiens) CpG-island No: 1245
gaacgcggaggatatttaggggttgaggatgcggggacgaggagcgcgcggaagagtcgaggtttcggggttggggggtgcggattttagaggaatcgtcggggatgtggacggattcggaaggaaggggttttagagaggacgcgggcggttgtaggatataagaggtgcgggacgtaggaggtcgtggggtcgtgcgggagtttagggtatttcgatatggattcgttagatttgtggtttttttagcggtcgttttagagcgagaggaggtgcgtaggtcgtgaggcgggtttttttggggttttttagggaggagcggcgtttttttcgagttagtcgaggacgcgtagttagaggggggtcgggcggagagaagagtgcgggcggatcgggacgatttttgggtgataggagagtcgtagtgagtttagggtacggtgttggggtcgttttggtcgtcgtcgttaagcgttataggaaaatagtaattaggatttcgcggtttttggcgtttggatttagttcggtatcgtatcgcgttgttggagaatgtgtttttggcgcgcgttgagttaggaagggatagcgggaagggcggggttcgtgggtaggggagggattagtgggcggggatcgaattaattcgttagcggtgagttagtggtcgagggttaaattaatgggtaaggcgtggattaatgggcgagtgttggatattaatgaatggggtttgaattaatgggcg

SEQ ID NO: 1246 - DNA, 748 bp, Artificial Sequence
  chemically treated genomic DNA (Homo sapiens) CpG-island No: 1246
cgcccattaattcaaaccccattcattaatatccaacactcgcccattaatccacgccttacccattaatttaaccctcgaccactaactcaccgctaacgaattaattcgatccccgcccactaatccctcccctacccacgaaccccgcccttcccgctatcccttcctaactcaacgcgcgccaaaaacacattctccaacaacgcgatacgataccgaactaaatccaaacgccaaaaaccgcgaaatcctaattactattttcctataacgcttaacgacgacgaccaaaacgaccccaacaccgtaccctaaactcactacgactctcctatcacccaaaaatcgtcccgatccgcccgcactcttctctccgcccgacccccctctaactacgcgtcctcgactaactcgaaaaaaacgccgctcctccctaaaaaaccccaaaaaaacccgcctcacgacctacgcacctcctctcgctctaaaacgaccgctaaaaaaaccacaaatctaacgaatccatatcgaaataccctaaactcccgcacgaccccacgacctcctacgtcccgcacctcttatatcctacaaccgcccgcgtcctctctaaaaccccttccttccgaatccgtccacatccccgacgattcctctaaaatccgcaccccccaaccccgaaacctcgactcttccgcgcgctcctcgtccccgcatcctcaacccctaaatatcctccgcgttc

SEQ ID NO: 1247 - DNA, 748 bp, Artificial Sequence
  chemically treated genomic DNA (Homo sapiens) CpG-island No: 1247
cgtttattagtttaggttttatttattgatgtttagtattcgtttattggtttacgttttgtttattggtttagttttcgattattggtttatcgttagcgaattgattcggttttcgtttattggttttttttttgtttacgggtttcgtttttttcgttgtttttttttggtttagcgcgcgttaaggatatattttttagtaacgcggtgcggtatcgggttgagtttaagcgttaggagtcgcggggttttggttgttgtttttttgtgacgtttggcggcggcggttagagcggttttagtatcgtgttttgggtttattgcggtttttttattatttaggggtcgtttcggttcgttcgtattttttttttcgttcgatttttttttggttgcgcgttttcggttggttcggggagggcgtcgtttttttttgggagattttagggagattcgttttacggtttgcgtattttttttcgttttaaagcggtcgttggaggagttataggtttggcgggtttatgtcgaggtgttttgggttttcgtacgattttacggttttttgcgtttcgtattttttgtgttttgtagtcgttcgcgttttttttgggatttttttttttcgagttcgtttatattttcggcggtttttttgaaattcgtattttttaatttcggaatttcggttttttcgcgcgtttttcgttttcgtatttttagtttttagatgtttttcgcgttt

SEQ ID NO: 1248 - DNA, 748 bp, Artificial Sequence
  chemically treated genomic DNA (Homo sapiens) CpG-island No: 1248
aaacgcgaaaaacatctaaaaactaaaaatacgaaaacgaaaaacgcgcgaaaaaaccgaaattccgaaattaaaaaatacgaatttcaaaaaaaccgccgaaaatataaacgaactcgaaaaaaaaaaatcccaaaaaaaacgcgaacgactacaaaacacaaaaaatacgaaacgcaaaaaaccgtaaaatcgtacgaaaacccaaaacacctcgacataaacccgccaaacctataactcctccaacgaccgctttaaaacgaaaaaaaatacgcaaaccgtaaaacgaatctccctaaaatctcccaaaaaaaaacgacgccctccccgaaccaaccgaaaacgcgcaaccaaaaaaaaatcgaacgaaaaaaaaaatacgaacgaaccgaaacgacccctaaataataaaaaaaccgcaataaacccaaaacacgatactaaaaccgctctaaccgccgccgccaaacgtcacaaaaaaacaacaaccaaaaccccgcgactcctaacgcttaaactcaacccgataccgcaccgcgttactaaaaaatatatccttaacgcgcgctaaaccaaaaaaaaacaacgaaaaaaacgaaacccgtaaacaaaaaaaaaaccaataaacgaaaaccgaatcaattcgctaacgataaaccaataatcgaaaactaaaccaataaacaaaacgtaaaccaataaacgaatactaaacatcaataaataaaacctaaactaataaacg

SEQ ID NO: 1249 - DNA, 886 bp, Artificial Sequence
  chemically treated genomic DNA (Homo sapiens) CpG-island No: 1249
tggacgtcgtcgtttaatttcgggatggtttcgtttttttcgtgagttacgttttcgtttttatgcgttgataggttaggtttgcggttcggcgtcgcgtagggaagattcggagtagcggtttatttaaggaacgggtcgcgcggttttgttgcgtatgttttgaagtagcgcgtttgagcgtttcgtaaggtcggtttttcggcggggtcgcgcgcgcggttacggggttcgttttcgaggggtaggtcggggttgggagttggtgttcgggtcggggtggcggcggcggtttgggtcgcggggtcgacgttcgttgttgtagcggtagaggttgaaggattcgtcgcggcgttgtcgcgggagagggagggtttcgttgtcgtcggtgaggataggtttttgcgggcggggaatgtttcgcgttttcggcgtggacgcgttcgtagttcggttttttcgggggtttcgagggttgcgggtgttggggaggggtttgcgtttcggcgtttaggtcgttttttgtggggtttttcgcgattttttttttgtttttcgtttttttatttttattttttcgttttttggtttaagttcgatatttttatattaaggattttcgtattcgttcgtcgttttttggcggtgtttgtttcgtttagcgttgtttttttggattcgtagtattagtttcgttttacggttgtagttcgggcggttttagtgattttgtatttttgcgggtcgggacgtatttcgttttcgtttttgattttatagattttcggtgacggttttcgaattttgttgatttatagtcgatattgagaaatgttttttacgcgtgtattttgtgtttgtgggtttggatgattgaagtataagt

SEQ ID NO: 1250 - DNA, 886 bp, Artificial Sequence
  chemically treated genomic DNA (Homo sapiens) CpG-island No: 1250
acttatacttcaatcatccaaacccacaaacacaaaatacacgcgtaaaaaacatttctcaatatcgactataaatcaacaaaattcgaaaaccgtcaccgaaaatctataaaatcaaaaacgaaaacgaaatacgtcccgacccgcaaaaatacaaaatcactaaaaccgcccgaactacaaccgtaaaacgaaactaatactacgaatccaaaaaaacaacgctaaacgaaacaaacaccgccaaaaaacgacgaacgaatacgaaaatccttaatataaaaatatcgaacttaaaccaaaaaacgaaaaaataaaaataaaaaaacgaaaaacaaaaaaaaaatcgcgaaaaaccccacaaaaaacgacctaaacgccgaaacgcaaacccctccccaacacccgcaaccctcgaaacccccgaaaaaaccgaactacgaacgcgtccacgccgaaaacgcgaaacattccccgcccgcaaaaacctatcctcaccgacgacaacgaaaccctccctctcccgcgacaacgccgcgacgaatccttcaacctctaccgctacaacaacgaacgtcgaccccgcgacccaaaccgccgccgccaccccgacccgaacaccaactcccaaccccgacctacccctcgaaaacgaaccccgtaaccgcgcgcgcgaccccgccgaaaaaccgaccttacgaaacgctcaaacgcgctacttcaaaacatacgcaacaaaaccgcgcgacccgttccttaaataaaccgctactccgaatcttccctacgcgacgccgaaccgcaaacctaacctatcaacgcataaaaacgaaaacgtaactcacgaaaaaaacgaaaccatcccgaaattaaacgacgacgtcca

SEQ ID NO: 1251 - DNA, 886 bp, Artificial Sequence
  chemically treated genomic DNA (Homo sapiens) CpG-island No: 1251
atttgtgttttagttatttagatttataggtatagagtatacgcgtaaaaggtattttttagtgtcggttgtgggttaataaagttcgaaagtcgttatcggagatttatagggttagaagcgggagcggggtgcgtttcgattcgtaaaagtgtaaggttattgggatcgttcgagttgtaatcgtgggacggggttgatgttgcgggtttaggaaggtagcgttgggcggggtagatatcgttaggaaacggcggacgagtgcggggatttttgatgtgggggtgtcgggtttaggttaggggacgggggggtggggatggaggggcgaggagtaaggagggaatcgcgggagattttataggaggcggtttgagcgtcgggacgtagatttttttttagtattcgtaattttcgggattttcgggagagtcgggttgcgggcgcgtttacgtcggggacgcgggatatttttcgttcgtaggggtttgtttttatcgacggtagcggggttttttttttttcgcgatagcgtcgcggcggattttttagtttttgtcgttgtagtagcgagcgtcgatttcgcgatttaggtcgtcgtcgttatttcgattcgggtattagtttttagtttcgatttgtttttcgggagcgagtttcgtgatcgcgcgcgcgatttcgtcggggagtcggttttgcggaacgtttaggcgcgttattttagagtatgcgtagtaagatcgcgcggttcgttttttaggtaaatcgttgtttcgggttttttttgcgcggcgtcgagtcgtaggtttggtttgttagcgtatgggggcggggacgtaatttacggaaaaggcggggttatttcgagattggacggcggcgttta

SEQ ID NO: 1252 - DNA, 886 bp, Artificial Sequence
  chemically treated genomic DNA (Homo sapiens) CpG-island No: 1252
taaacgccgccgtccaatctcgaaataaccccgccttttccgtaaattacgtccccgcccccatacgctaacaaaccaaacctacgactcgacgccgcgcaaaaaaaacccgaaacaacgatttacctaaaaaacgaaccgcgcgatcttactacgcatactctaaaataacgcgcctaaacgttccgcaaaaccgactccccgacgaaatcgcgcgcgcgatcacgaaactcgctcccgaaaaacaaatcgaaactaaaaactaatacccgaatcgaaataacgacgacgacctaaatcgcgaaatcgacgctcgctactacaacgacaaaaactaaaaaatccgccgcgacgctatcgcgaaaaaaaaaaaaccccgctaccgtcgataaaaacaaacccctacgaacgaaaaatatcccgcgtccccgacgtaaacgcgcccgcaacccgactctcccgaaaatcccgaaaattacgaatactaaaaaaaaatctacgtcccgacgctcaaaccgcctcctataaaatctcccgcgattccctccttactcctcgcccctccatccccacccccccgtcccctaacctaaacccgacacccccacatcaaaaatccccgcactcgtccgccgtttcctaacgatatctaccccgcccaacgctaccttcctaaacccgcaacatcaaccccgtcccacgattacaactcgaacgatcccaataaccttacacttttacgaatcgaaacgcaccccgctcccgcttctaaccctataaatctccgataacgactttcgaactttattaacccacaaccgacactaaaaaataccttttacgcgtatactctatacctataaatctaaataactaaaacacaaat

SEQ ID NO: 1253 - DNA, 722 bp, Artificial Sequence
  chemically treated genomic DNA (Homo sapiens) CpG-island No: 1253
atttttcggacgagtacgggtcggatcggaattgtagttgggttttgggttcgttaggcgtcgcgttggagtttatttttcgttttttcgagttggtcgattcgcgcgatcggttggagttgcgcgacgcggtttcgggtagtttgtttcgcgttttcgatggcgttcgtttatcgtcgttcgggtcgttgcgtttgggtattgtcgcgttgttgtttatttttcgaagcgacgcgcgcggttacgcgtaaggtttcgcgtttatttatcgcggtgagttttagttcggcgcgttttgttcgttgtttttatttcgttttttttatttcgttttacgttttttttcgtagggttgtaggacgtcgttgaggatttagaggttttcgagggttcggtttagattttcgcggcgtttttcgacggggttaacgtgagttgtagttttaggtttggggtttcgtcggtcgcgattgggggtgaggcgggcgcgcgggacgggagtgagttagggagtcgttttttcgcgtttatttttatcgtagtcgtgtgttcgtagttcgggttttttcgacggtgacggttgtttcggtgttgttgttgttgtttttggggttgttgcgttcgttgcgtcgacggtgcggggcgttggggtagggtttgagggcggatcggtggtggggagttggagttttagaagggaatagagttaggaaggaattttt

SEQ ID NO: 1254 - DNA, 722 bp, Artificial Sequence
  chemically treated genomic DNA (Homo sapiens) CpG-island No: 1254
aaaaattccttcctaactctattcccttctaaaactccaactccccaccaccgatccgccctcaaaccctaccccaacgccccgcaccgtcgacgcaacgaacgcaacaaccccaaaaacaacaacaacaacaccgaaacaaccgtcaccgtcgaaaaaacccgaactacgaacacacgactacgataaaaataaacgcgaaaaaacgactccctaactcactcccgtcccgcgcgcccgcctcacccccaatcgcgaccgacgaaaccccaaacctaaaactacaactcacgttaaccccgtcgaaaaacgccgcgaaaatctaaaccgaaccctcgaaaacctctaaatcctcaacgacgtcctacaaccctacgaaaaaaaacgtaaaacgaaataaaaaaaacgaaataaaaacaacgaacaaaacgcgccgaactaaaactcaccgcgataaataaacgcgaaaccttacgcgtaaccgcgcgcgtcgcttcgaaaaataaacaacaacgcgacaatacccaaacgcaacgacccgaacgacgataaacgaacgccatcgaaaacgcgaaacaaactacccgaaaccgcgtcgcgcaactccaaccgatcgcgcgaatcgaccaactcgaaaaaacgaaaaataaactccaacgcgacgcctaacgaacccaaaacccaactacaattccgatccgacccgtactcgtccgaaaaat

SEQ ID NO: 1255 - DNA, 722 bp, Artificial Sequence
  chemically treated genomic DNA (Homo sapiens) CpG-island No: 1255
aggagtttttttttagttttgtttttttttggggttttagttttttattatcggttcgtttttaggttttgttttagcgtttcgtatcgtcggcgtagcggacgtagtagttttaggagtagtagtagtagtatcgagatagtcgttatcgtcgagaagattcgggttgcgggtatacggttgcggtgaggatgggcgcgagggggcggttttttgatttattttcgtttcgcgcgttcgttttatttttaatcgcggtcggcggagttttaggtttggggttgtagtttacgttggtttcgtcgaggggcgtcgcgggggtttgggtcgagttttcgggggtttttgggtttttagcggcgttttgtagttttgcggagaggggcgtgaggcggggtggggagagcggggtgggaatagcgggtagggcgcgtcgagttgaggtttatcgcggtaggtgagcgcgaagttttgcgcgtggtcgcgcgcgtcgtttcggaaggtgagtagtagcgcggtagtgtttaggcgtagcggttcggacggcggtgggcgggcgttatcgaaggcgcggagtaggttgttcgaagtcgcgtcgcgtagttttagtcggtcgcgcgggtcggttagttcgaagaggcggaaggtgagttttagcgcggcgtttggcgggtttagggtttagttgtagtttcggttcggttcgtattcgttcgggaagt

SEQ ID NO: 1256 - DNA, 722 bp, Artificial Sequence
  chemically treated genomic DNA (Homo sapiens) CpG-island No: 1256
acttcccgaacgaatacgaaccgaaccgaaactacaactaaaccctaaacccgccaaacgccgcgctaaaactcaccttccgcctcttcgaactaaccgacccgcgcgaccgactaaaactacgcgacgcgacttcgaacaacctactccgcgccttcgataacgcccgcccaccgccgtccgaaccgctacgcctaaacactaccgcgctactactcaccttccgaaacgacgcgcgcgaccacgcgcaaaacttcgcgctcacctaccgcgataaacctcaactcgacgcgccctacccgctattcccaccccgctctccccaccccgcctcacgcccctctccgcaaaactacaaaacgccgctaaaaacccaaaaacccccgaaaactcgacccaaacccccgcgacgcccctcgacgaaaccaacgtaaactacaaccccaaacctaaaactccgccgaccgcgattaaaaataaaacgaacgcgcgaaacgaaaataaatcaaaaaaccgccccctcgcgcccatcctcaccgcaaccgtatacccgcaacccgaatcttctcgacgataacgactatctcgatactactactactactcctaaaactactacgtccgctacgccgacgatacgaaacgctaaaacaaaacctaaaaacgaaccgataataaaaaactaaaaccccaaaaaaaaacaaaactaaaaaaaaactcct

SEQ ID NO: 1257 - DNA, 786 bp, Artificial Sequence
  chemically treated genomic DNA (Homo sapiens) CpG-island No: 1257
taggaggcgaggtttgggcggtttcggggcggagttttttcgtcggttacgtttattggttttcgttgcgtcgacgttaggagttcggcgcgcgaaacgttggtcggtcggcgggaattaggagtttgggcggagtttggcgttttttttcgcgttcggtcgcgttcgtttttttggttgtagagagattatcggttatcgtcgtcgtcgtcgtcgcgagttgtttttgcggcgcgtttgttttggcggagtcgatcgtagtgcgtttaggcgttcggtgcgtttttagttttcgtttcggcgcgggggcgacggattcgcgcgtgcgtagcgtcggaggggcgcgggttgggattttttagttagcgcgtgcgtcgatcgagcgtagggcgatgggtgggcgtcgggcgtcgggcgttaggtagtgatgggttttttcgcgttgcggttttattgaggaggaggttcggggatagtaggagtacgggttgttcgcgcggtgcggattatggcgtttttggtcgggtcgcgtttgttggattgggttagttcgtcgtcgtatttgtagtttaataagttcgtgttgatcgggtatcggttcgttagtagcggttcgggttgtttgcgtagttttttttatttgtataacgaattgggtaatatttatacgtacggtgagtcgcgtttcgtaacgcgttttttatattttcggtcgttttatttgcgttgggtcgggggtattgaggtcgaggagggttttagcgtttaagtttagggttgtttcgg

SEQ ID NO: 1258 - DNA, 786 bp, Artificial Sequence
  chemically treated genomic DNA (Homo sapiens) CpG-island No: 1258
ccgaaacaaccctaaacttaaacgctaaaaccctcctcgacctcaatacccccgacccaacgcaaataaaacgaccgaaaatataaaaaacgcgttacgaaacgcgactcaccgtacgtataaatattacccaattcgttatacaaataaaaaaaactacgcaaacaacccgaaccgctactaacgaaccgatacccgatcaacacgaacttattaaactacaaatacgacgacgaactaacccaatccaacaaacgcgacccgaccaaaaacgccataatccgcaccgcgcgaacaacccgtactcctactatccccgaacctcctcctcaataaaaccgcaacgcgaaaaaacccatcactacctaacgcccgacgcccgacgcccacccatcgccctacgctcgatcgacgcacgcgctaactaaaaaatcccaacccgcgcccctccgacgctacgcacgcgcgaatccgtcgcccccgcgccgaaacgaaaactaaaaacgcaccgaacgcctaaacgcactacgatcgactccgccaaaacaaacgcgccgcaaaaacaactcgcgacgacgacgacgacgataaccgataatctctctacaaccaaaaaaacgaacgcgaccgaacgcgaaaaaaaacgccaaactccgcccaaactcctaattcccgccgaccgaccaacgtttcgcgcgccgaactcctaacgtcgacgcaacgaaaaccaataaacgtaaccgacgaaaaaactccgccccgaaaccgcccaaacctcgcctccta

SEQ ID NO: 1259 - DNA, 786 bp, Artificial Sequence
  chemically treated genomic DNA (Homo sapiens) CpG-island No: 1259
tcggggtagttttggatttgggcgttggggtttttttcggttttagtgttttcggtttaacgtaggtagggcggtcgggggtgtgggaagcgcgttgcgggacgcggtttatcgtgcgtgtagatgttgtttagttcgttgtgtaggtagaagaggttgcgtaggtagttcgagtcgttgttggcgggtcggtattcggttagtacgaatttattgaattgtaggtgcggcggcgagttggtttagtttagtaggcgcggttcggttaggaacgttatggttcgtatcgcgcgggtagttcgtgtttttgttgttttcgagttttttttttagtggggtcgtagcgcgggaaggtttattattgtttggcgttcggcgttcggcgtttatttatcgttttgcgttcgatcggcgtacgcgttggttagggggttttagttcgcgttttttcggcgttgcgtacgcgcgagttcgtcgttttcgcgtcggggcggaggttggggacgtatcggacgtttgagcgtattgcggtcggtttcgttaaggtagacgcgtcgtagggatagttcgcggcggcggcggcggcggtggtcggtagtttttttgtagttaggaggacgggcgcggtcggacgcgggaggggacgttaggtttcgtttaggtttttagttttcgtcggtcggttagcgtttcgcgcgtcgggtttttgacgtcggcgtagcgagagttaatgggcgtggtcggcggggaggtttcgtttcgaggtcgtttaggtttcgtttttta

SEQ ID NO: 1260 - DNA, 786 bp, Artificial Sequence
  chemically treated genomic DNA (Homo sapiens) CpG-island No: 1260
taaaaaacgaaacctaaacgacctcgaaacgaaacctccccgccgaccacgcccattaactctcgctacgccgacgtcaaaaacccgacgcgcgaaacgctaaccgaccgacgaaaactaaaaacctaaacgaaacctaacgtcccctcccgcgtccgaccgcgcccgtcctcctaactacaaaaaaactaccgaccaccgccgccgccgccgccgcgaactatccctacgacgcgtctaccttaacgaaaccgaccgcaatacgctcaaacgtccgatacgtccccaacctccgccccgacgcgaaaacgacgaactcgcgcgtacgcaacgccgaaaaaacgcgaactaaaaccccctaaccaacgcgtacgccgatcgaacgcaaaacgataaataaacgccgaacgccgaacgccaaacaataataaaccttcccgcgctacgaccccactaaaaaaaaaactcgaaaacaacaaaaacacgaactacccgcgcgatacgaaccataacgttcctaaccgaaccgcgcctactaaactaaaccaactcgccgccgcacctacaattcaataaattcgtactaaccgaataccgacccgccaacaacgactcgaactacctacgcaacctcttctacctacacaacgaactaaacaacatctacacgcacgataaaccgcgtcccgcaacgcgcttcccacacccccgaccgccctacctacgttaaaccgaaaacactaaaaccgaaaaaaaccccaacgcccaaatccaaaactaccccga

SEQ ID NO: 1261 - DNA, 727 bp, Artificial Sequence
  chemically treated genomic DNA (Homo sapiens) CpG-island No: 1261
gggcgaagttagttggttgttgaaggcggtgtaggaatttttttggcgagttcgcgcgaggacgtgtcgtagcgtcgtttgtcgattattttgtttcgtcgtacgtcggcgcgttttcgggtaagttttttttttagttttggtcgagcgggaagcgaacgcgcgtttttttcggttatttttcgtttcggggaagggcgggggaagtggaagcgcgcgttcgcgagttgcgtgttcgcgtacgtcgtcggggttcggttgcgttcgtttcgtcgttcgttcgttgtcgtcgtcgtcgttgtcgtcgtgttttttttttgttcgtcgtcgtttaaggggggttggggtcggggttagttattattgtcgttgtcgggatgtcgcgggtgtatatcggtcgtttgagttattaggttcgggagcgcgatgtggagcgtttttttaagggttacgggaagattttggaggtggatttgaagaacgggtgaggagggcgaaagagggttcggtcgggcggggatagattttataggtggtggggaggtcgcggggacgggagagggacgtttggttcgcgcggagcggttatcggtttggttaggtttcgttatagtggcggcgtttcgggggcgcgggtaggtttcggtttttattgcgtttgcgcgggtgggggtggtggaggtataatgggagttgtgttgaggttttgagtgggacggggagaagg

SEQ ID NO: 1262 - DNA, 727 bp, Artificial Sequence
  chemically treated genomic DNA (Homo sapiens) CpG-island No: 1262
ccttctccccgtcccactcaaaacctcaacacaactcccattatacctccaccacccccacccgcgcaaacgcaataaaaaccgaaacctacccgcgcccccgaaacgccgccactataacgaaacctaaccaaaccgataaccgctccgcgcgaaccaaacgtccctctcccgtccccgcgacctccccaccacctataaaatctatccccgcccgaccgaaccctctttcgccctcctcacccgttcttcaaatccacctccaaaatcttcccgtaacccttaaaaaaacgctccacatcgcgctcccgaacctaataactcaaacgaccgatatacacccgcgacatcccgacaacgacaataataactaaccccgaccccaaccccccttaaacgacgacgaacaaaaaaaaaacacgacgacaacgacgacgacgacaacgaacgaacgacgaaacgaacgcaaccgaaccccgacgacgtacgcgaacacgcaactcgcgaacgcgcgcttccacttcccccgcccttccccgaaacgaaaaataaccgaaaaaaacgcgcgttcgcttcccgctcgaccaaaactaaaaaaaaaacttacccgaaaacgcgccgacgtacgacgaaacaaaataatcgacaaacgacgctacgacacgtcctcgcgcgaactcgccaaaaaaattcctacaccgccttcaacaaccaactaacttcgccc

SEQ ID NO: 1263 - DNA, 727 bp, Artificial Sequence
  chemically treated genomic DNA (Homo sapiens) CpG-island No: 1263
tttttttttcgttttatttagggttttagtatagtttttattatgtttttattatttttattcgcgtaggcgtagtgggaatcggggtttattcgcgttttcgaggcgtcgttattatggcggagtttggttaggtcggtagtcgtttcgcgcggattaggcgtttttttttcgttttcgcggtttttttattatttatggggtttgttttcgttcggtcggattttttttcgttttttttattcgttttttagatttatttttaggattttttcgtagtttttaaagaagcgttttatatcgcgttttcgggtttggtagtttaggcggtcgatgtatattcgcggtatttcggtaacggtagtgatggttggtttcggttttagttttttttaggcggcggcgggtaaagggagagtacggcggtagcggcggcggcggtaacgggcgggcggcgggacggacgtagtcgaatttcggcgacgtacgcgagtacgtagttcgcgagcgcgcgtttttatttttttcgttttttttcgaggcggaaggtaatcggagagagcgcgcgttcgtttttcgttcggttaggattgggggaggagtttgttcgggggcgcgtcgacgtgcggcggggtaaggtgatcgataggcggcgttgcggtacgttttcgcgcgagttcgttaaaggggtttttgtatcgtttttagtagttagttggtttcgttt

SEQ ID NO: 1264 - DNA, 727 bp, Artificial Sequence
  chemically treated genomic DNA (Homo sapiens) CpG-island No: 1264
aaacgaaaccaactaactactaaaaacgatacaaaaacccctttaacgaactcgcgcgaaaacgtaccgcaacgccgcctatcgatcaccttaccccgccgcacgtcgacgcgcccccgaacaaactcctcccccaatcctaaccgaacgaaaaacgaacgcgcgctctctccgattaccttccgcctcgaaaaaaaacgaaaaaaataaaaacgcgcgctcgcgaactacgtactcgcgtacgtcgccgaaattcgactacgtccgtcccgccgcccgcccgttaccgccgccgccgctaccgccgtactctccctttacccgccgccgcctaaaaaaaactaaaaccgaaaccaaccatcactaccgttaccgaaataccgcgaatatacatcgaccgcctaaactaccaaacccgaaaacgcgatataaaacgcttctttaaaaactacgaaaaaatcctaaaaataaatctaaaaaacgaataaaaaaaacgaaaaaaaatccgaccgaacgaaaacaaaccccataaataataaaaaaaccgcgaaaacgaaaaaaaaacgcctaatccgcgcgaaacgactaccgacctaaccaaactccgccataataacgacgcctcgaaaacgcgaataaaccccgattcccactacgcctacgcgaataaaaataataaaaacataataaaaactatactaaaaccctaaataaaacgaaaaaaaaa

SEQ ID NO: 1265 - DNA, 631 bp, Artificial Sequence
  chemically treated genomic DNA (Homo sapiens) CpG-island No: 1265
tgcgtacgcgcggttttagtttggcgttttaggagatggattcggaaagttttcgcgtaggcgtaatttaagggtcgagagagtttgagattgggtttggggcggggcgagttcggaatgcggttgcgtattgggcgttttcgttcgagaagtcgtagtttcgagagcgttaacgaggtgtttcggtagtttttggttattttttttgcgtattcggtgtcgttgggttgtatttcgggcggggacgttcgtcgggtacgggagggggttaagatgtcggtgaggagagtcgtttcgtttttggggtttttttttattttagcggtttggttcgggggcgcggtcgttgttatggaggcgcggagtcggtaggcggtttgggtggggcggggtaggttcggtcgtgcggtggaggtggttggagagtttggttggttagtttcggggtcgcgggggttcggtcggtttcgatagggatttggggttaggttttgtcgttttcgtcgttgttgtatttcgtggggtttgcgtcgtttattaaaaaggcgttgtgttggaggatgcgttttggttcgtagttttttttgttgagcggggcgtttgggggtggttacggtggggttttttggat

SEQ ID NO: 1266 - DNA, 631 bp, Artificial Sequence
  chemically treated genomic DNA (Homo sapiens) CpG-island No: 1266
atccaaaaaaccccaccgtaaccacccccaaacgccccgctcaacaaaaaaaactacgaaccaaaacgcatcctccaacacaacgcctttttaataaacgacgcaaaccccacgaaatacaacaacgacgaaaacgacaaaacctaaccccaaatccctatcgaaaccgaccgaacccccgcgaccccgaaactaaccaaccaaactctccaaccacctccaccgcacgaccgaacctaccccgccccacccaaaccgcctaccgactccgcgcctccataacaacgaccgcgcccccgaaccaaaccgctaaaataaaaaaaaaccccaaaaacgaaacgactctcctcaccgacatcttaaccccctcccgtacccgacgaacgtccccgcccgaaatacaacccaacgacaccgaatacgcaaaaaaaataaccaaaaactaccgaaacacctcgttaacgctctcgaaactacgacttctcgaacgaaaacgcccaatacgcaaccgcattccgaactcgccccgccccaaacccaatctcaaactctctcgacccttaaattacgcctacgcgaaaactttccgaatccatctcctaaaacgccaaactaaaaccgcgcgtacgca

SEQ ID NO: 1267 - DNA, 631 bp, Artificial Sequence
  chemically treated genomic DNA (Homo sapiens) CpG-island No: 1267
atttaaagagttttatcgtggttatttttagacgtttcgtttagtaggaagggttgcgagttagagcgtattttttagtatagcgtttttttgataagcggcgtaggttttacgggatgtagtagcgacgagggcggtagggtttgattttaggtttttgtcgaggtcggtcggattttcgcggtttcggggttgattagttaggttttttaattatttttatcgtacgatcgagtttgtttcgttttatttaggtcgtttgtcggtttcgcgtttttatggtaacggtcgcgttttcgggttaggtcgttaggatgagaagaaattttagaagcgaagcgattttttttatcggtattttggttttttttcgtgttcggcggacgttttcgttcggggtgtagtttagcgatatcgggtgcgtagaaaggatggttagagattatcgaaatatttcgttgacgttttcgagattgcggtttttcgggcgagagcgtttagtgcgtagtcgtatttcgagttcgtttcgttttaagtttagttttaggttttttcggtttttgaattacgtttgcgcggaggtttttcgagtttattttttaggacgttagattgaggtcgcgcgtgcgta

SEQ ID NO: 1268 - DNA, 631 bp, Artificial Sequence
  chemically treated genomic DNA (Homo sapiens) CpG-island No: 1268
tacgcacgcgcgacctcaatctaacgtcctaaaaaataaactcgaaaaacctccgcgcaaacgtaattcaaaaaccgaaaaaacctaaaactaaacttaaaacgaaacgaactcgaaatacgactacgcactaaacgctctcgcccgaaaaaccgcaatctcgaaaacgtcaacgaaatatttcgataatctctaaccatcctttctacgcacccgatatcgctaaactacaccccgaacgaaaacgtccgccgaacacgaaaaaaaaccaaaataccgataaaaaaaatcgcttcgcttctaaaatttcttctcatcctaacgacctaacccgaaaacgcgaccgttaccataaaaacgcgaaaccgacaaacgacctaaataaaacgaaacaaactcgatcgtacgataaaaataattaaaaaacctaactaatcaaccccgaaaccgcgaaaatccgaccgacctcgacaaaaacctaaaatcaaaccctaccgccctcgtcgctactacatcccgtaaaacctacgccgcttatcaaaaaaacgctatactaaaaaatacgctctaactcgcaacccttcctactaaacgaaacgtctaaaaataaccacgataaaactctttaaat

SEQ ID NO: 1269 - DNA, 573 bp, Artificial Sequence
  chemically treated genomic DNA (Homo sapiens) CpG-island No: 1269
aagggggcggggcgaggtcgcgggggtttgtggggaagcgtaggaggcggggttttgcgtgagttattgtcgggttcggcgtgagtcgttgcggggttgacggggtggtagtgcggcgggttacggtttggttaggtgagcgggcgttgcggttttcgttgttcggagtagcgtaggagatttttggggtggtcggtgggaggaggggtagcggttatgggtatcggtgaggcggggcgggtcggggttggcggtggaggcgcgcgttgaggcggcgcgtcggtgtttagggtagcggcgtttcgggtcgcgcgttttcggaggggttcgttttcgtaattcgggtttgcgcgttttgttttgtaggcggattttttattttgttgcgattttgtagtgttcgggaaggtagagtcgttttttcgtaaagatcgaggtggggttcgtttttttgcggcgtgggtgtgcggtgttcgtcgggatagcgggtgtgaaagtgatatttttagcgttggaagtttttgattgttggttcgtattttcgttttatcgtagggtttttgggagagtttt

SEQ ID NO: 1270 - DNA, 573 bp, Artificial Sequence
  chemically treated genomic DNA (Homo sapiens) CpG-island No: 1270
aaaactctcccaaaaaccctacgataaaacgaaaatacgaaccaacaatcaaaaacttccaacgctaaaaatatcactttcacacccgctatcccgacgaacaccgcacacccacgccgcaaaaaaacgaaccccacctcgatctttacgaaaaaacgactctaccttcccgaacactacaaaatcgcaacaaaataaaaaatccgcctacaaaacaaaacgcgcaaacccgaattacgaaaacgaacccctccgaaaacgcgcgacccgaaacgccgctaccctaaacaccgacgcgccgcctcaacgcgcgcctccaccgccaaccccgacccgccccgcctcaccgatacccataaccgctacccctcctcccaccgaccaccccaaaaatctcctacgctactccgaacaacgaaaaccgcaacgcccgctcacctaaccaaaccgtaacccgccgcactaccaccccgtcaaccccgcaacgactcacgccgaacccgacaataactcacgcaaaaccccgcctcctacgcttccccacaaacccccgcgacctcgccccgccccctt

SEQ ID NO: 1271 - DNA, 573 bp, Artificial Sequence
  chemically treated genomic DNA (Homo sapiens) CpG-island No: 1271
aaaatttttttagggattttgcgatggggcgggggtgcgagttagtaattaaaaatttttagcgttgggggtattatttttatattcgttgtttcggcgaatatcgtatatttacgtcgtaagggggcgggttttatttcggtttttgcgggagggcggttttgttttttcgagtattgtaaaatcgtagtagggtggagggttcgtttgtaaagtagagcgcgtaggttcgggttgcgggggcgagttttttcgggaacgcgcgattcgagacgtcgttgttttggatatcgacgcgtcgttttaacgcgcgtttttatcgttagtttcggttcgtttcgttttatcggtatttataatcgttatttttttttttatcggttattttaaggattttttacgttgtttcgggtagcgagaatcgtaacgttcgtttatttgattaggtcgtaattcgtcgtattgttatttcgttagtttcgtagcgatttacgtcgagttcggtagtgatttacgtaaagtttcgttttttgcgtttttttataagttttcgcggtttcgtttcgttttttt

SEQ ID NO: 1272 - DNA, 573 bp, Artificial Sequence
  chemically treated genomic DNA (Homo sapiens) CpG-island No: 1272
aaaaaaacgaaacgaaaccgcgaaaacttataaaaaaacgcaaaaaacgaaactttacgtaaatcactaccgaactcgacgtaaatcgctacgaaactaacgaaataacaatacgacgaattacgacctaatcaaataaacgaacgttacgattctcgctacccgaaacaacgtaaaaaatccttaaaataaccgataaaaaaaaaaataacgattataaataccgataaaacgaaacgaaccgaaactaacgataaaaacgcgcgttaaaacgacgcgtcgatatccaaaacaacgacgtctcgaatcgcgcgttcccgaaaaaactcgcccccgcaacccgaacctacgcgctctactttacaaacgaaccctccaccctactacgattttacaatactcgaaaaaacaaaaccgccctcccgcaaaaaccgaaataaaacccgcccccttacgacgtaaatatacgatattcgccgaaacaacgaatataaaaataatacccccaacgctaaaaatttttaattactaactcgcacccccgccccatcgcaaaatccctaaaaaaatttt

SEQ ID NO: 1273 - DNA, 818 bp, Artificial Sequence
  chemically treated genomic DNA (Homo sapiens) CpG-island No: 1273
agcgttattttttatttattaaattcgtagcggcgtttagcgggcggatagtcgtttttgttgatttagagcgtttatttacgttttcggtttttttcgtttcgtagtttcgcggtttcgcggtttggtcgtttttagttcgagcgcgagtttaaatagcgtttcgtgtcgcggggcggttcgaggtcggttagaggcgttttttcggtttcgcggttttcgtttagttcggtttcgcgatttttcgttttaggttgcggttggttgttgtttttggtttttacgcggcgtttattttcgggttggggggcgtttttcgcgcgttaggtagcggcgggtttcgagacggtttcgcggttttttgcgtttgggtttcggcggtttgaaggtttatgttttgcggttcgcggttggtcgttttggacgtcgtgggttacgtgacgcgtcggttcggttgttcgttcgaggattcgtcgtagaagcgttaattagtttggggagggggtgggtatcggttaagagggcggggcgcgggggtgttacgagtaagcgggggcggggcggcgtagggggcggggcgcgcggtttcgcggagttcgttttttttttttagcgcgaaatttgaaataatttcggagacggattttggaaatttttttcggtgtatattttaaggttgtacgattagttgcgtgtgaaacgttaagcgtattttattcggttattcggggtgtgttttagttttaaaatttcgcgtgggtaagatatatgagtaatttagtgatttttattttgagttaatgatcgtttttgaagtt

SEQ ID NO: 1274 - DNA, 818 bp, Artificial Sequence
  chemically treated genomic DNA (Homo sapiens) CpG-island No: 1274
aacttcaaaaacgatcattaactcaaaataaaaatcactaaattactcatatatcttacccacgcgaaattttaaaactaaaacacaccccgaataaccgaataaaatacgcttaacgtttcacacgcaactaatcgtacaaccttaaaatatacaccgaaaaaaatttccaaaatccgtctccgaaattatttcaaatttcgcgctaaaaaaaaaaaacgaactccgcgaaaccgcgcgccccgccccctacgccgccccgcccccgcttactcgtaacacccccgcgccccgccctcttaaccgatacccaccccctccccaaactaattaacgcttctacgacgaatcctcgaacgaacaaccgaaccgacgcgtcacgtaacccacgacgtccaaaacgaccaaccgcgaaccgcaaaacataaaccttcaaaccgccgaaacccaaacgcaaaaaaccgcgaaaccgtctcgaaacccgccgctacctaacgcgcgaaaaacgccccccaacccgaaaataaacgccgcgtaaaaaccaaaaacaacaaccaaccgcaacctaaaacgaaaaatcgcgaaaccgaactaaacgaaaaccgcgaaaccgaaaaaacgcctctaaccgacctcgaaccgccccgcgacacgaaacgctatttaaactcgcgctcgaactaaaaacgaccaaaccgcgaaaccgcgaaactacgaaacgaaaaaaaccgaaaacgtaaataaacgctctaaatcaacaaaaacgactatccgcccgctaaacgccgctacgaatttaataaataaaaaataacgct

SEQ ID NO: 1275 - DNA, 818 bp, Artificial Sequence
  chemically treated genomic DNA (Homo sapiens) CpG-island No: 1275
aattttaaagacgattattagtttaaggtggaggttattgggttgtttatgtgttttatttacgcggggttttgaagttggagtatatttcgagtggtcgagtagggtacgtttggcgttttatacgtagttagtcgtgtagttttaggatatgtatcgagaggagtttttaaaattcgttttcgagattgttttagatttcgcgttgggagggaggggcgggtttcgcgaggtcgcgcgtttcgttttttgcgtcgtttcgttttcgtttgttcgtgatattttcgcgtttcgtttttttggtcggtatttattttttttttaggttgattggcgtttttgcggcggattttcgggcgggtagtcgggtcggcgcgttacgtggtttacggcgtttagggcgattagtcgcgggtcgtagggtatggatttttaggtcgtcggggtttaggcgtagggggtcgcggagtcgtttcggggttcgtcgttgtttagcgcgcggggggcgttttttagttcggaggtgagcgtcgcgtgggggttaggagtaatagttagtcgtagtttggggcgggaagtcgcggggtcgggttgggcgggggtcgcggggtcggggaagcgtttttggtcggtttcgggtcgtttcgcgatacggagcgttgtttgggttcgcgttcgagttgaaaacggttaggtcgcggggtcgcggggttgcggggcggggaaagtcgagggcgtgggtgggcgttttgggttagtagagacggttgttcgttcgttgggcgtcgttgcggatttggtaaatgggaggtgacgtt

SEQ ID NO: 1276 - DNA, 818 bp, Artificial Sequence
  chemically treated genomic DNA (Homo sapiens) CpG-island No: 1276
aacgtcacctcccatttaccaaatccgcaacgacgcccaacgaacgaacaaccgtctctactaacccaaaacgcccacccacgccctcgactttccccgccccgcaaccccgcgaccccgcgacctaaccgttttcaactcgaacgcgaacccaaacaacgctccgtatcgcgaaacgacccgaaaccgaccaaaaacgcttccccgaccccgcgacccccgcccaacccgaccccgcgacttcccgccccaaactacgactaactattactcctaacccccacgcgacgctcacctccgaactaaaaaacgccccccgcgcgctaaacaacgacgaaccccgaaacgactccgcgaccccctacgcctaaaccccgacgacctaaaaatccataccctacgacccgcgactaatcgccctaaacgccgtaaaccacgtaacgcgccgacccgactacccgcccgaaaatccgccgcaaaaacgccaatcaacctaaaaaaaaaataaataccgaccaaaaaaacgaaacgcgaaaatatcacgaacaaacgaaaacgaaacgacgcaaaaaacgaaacgcgcgacctcgcgaaacccgcccctccctcccaacgcgaaatctaaaacaatctcgaaaacgaattttaaaaactcctctcgatacatatcctaaaactacacgactaactacgtataaaacgccaaacgtaccctactcgaccactcgaaatatactccaacttcaaaaccccgcgtaaataaaacacataaacaacccaataacctccaccttaaactaataatcgtctttaaaatt

SEQ ID NO: 1277 - DNA, 514 bp, Artificial Sequence
  chemically treated genomic DNA (Homo sapiens) CpG-island No: 1277
cggcgtcgggattggagtttttggatgcgttacggtttagttggtttcgttttcgcggtggtcgcggttttacgtttatcgtcgtcgaatagttcgtttttttttcgcggttcgggtgcgtcggttcggtttttcgttcgttacgttcgcgatttagggttgggttttcgtggtgtaggtggtattgggttacgttacgttcgcgggttgtgtaatcggtagtgttttggagcgggtaggaggcgtttcgttttttgtttcgatatatagtttttcgattttggtaggcgttttttcggttcgggtagtttacgtttcgggtcgtttggtggaattggttttttcgtagttcgcggtggtggaattgggtttcgcgtaggttttggtattggttttcgcggttcgggttatttcgcgcgtcgtgggggtttcggtgtagtttttcgcggtgtagttggtttttttttcgtaggtcgcggtttttttgggtgagttggtttagttggttttttag

SEQ ID NO: 1278 - DNA, 514 bp, Artificial Sequence
  chemically treated genomic DNA (Homo sapiens) CpG-island No: 1278
ctaaaaaaccaactaaaccaactcacccaaaaaaaccgcgacctacgaaaaaaaaaccaactacaccgcgaaaaactacaccgaaacccccacgacgcgcgaaataacccgaaccgcgaaaaccaataccaaaacctacgcgaaacccaattccaccaccgcgaactacgaaaaaaccaattccaccaaacgacccgaaacgtaaactacccgaaccgaaaaaacgcctaccaaaatcgaaaaactatatatcgaaacaaaaaacgaaacgcctcctacccgctccaaaacactaccgattacacaacccgcgaacgtaacgtaacccaataccacctacaccacgaaaacccaaccctaaatcgcgaacgtaacgaacgaaaaaccgaaccgacgcacccgaaccgcgaaaaaaaaacgaactattcgacgacgataaacgtaaaaccgcgaccaccgcgaaaacgaaaccaactaaaccgtaacgcatccaaaaactccaatcccgacgccg

SEQ ID NO: 1279 - DNA, 514 bp, Artificial Sequence
  chemically treated genomic DNA (Homo sapiens) CpG-island No: 1279
ttggagggttagttggattagtttatttaggagaatcgcgatttgcgagaggagagttagttgtatcgcggggagttgtatcgggatttttacggcgcgcgggatagttcgggtcgcgagagttagtattagaatttgcgcgagatttagttttattatcgcgagttgcgggagagttagttttattaggcggttcgggacgtgggttattcgaatcgggaaggcgtttattagaatcgggaggttgtgtatcgggataaggagcgggacgttttttattcgttttaggatattatcggttatatagttcgcgagcgtgacgtggtttagtgttatttgtattacgagaatttagttttgggtcgcgagcgtggcgggcgggaggtcgggtcggcgtattcgggtcgcgagaaggaagcgggttattcggcggcggtgggcgtggggtcgcggttatcgcgggagcggggttagttgagtcgtggcgtatttaggagttttagtttcggcgtcg

SEQ ID NO: 1280 - DNA, 514 bp, Artificial Sequence
  chemically treated genomic DNA (Homo sapiens) CpG-island No: 1280
cgacgccgaaactaaaactcctaaatacgccacgactcaactaaccccgctcccgcgataaccgcgaccccacgcccaccgccgccgaataacccgcttccttctcgcgacccgaatacgccgacccgacctcccgcccgccacgctcgcgacccaaaactaaattctcgtaatacaaataacactaaaccacgtcacgctcgcgaactatataaccgataatatcctaaaacgaataaaaaacgtcccgctccttatcccgatacacaacctcccgattctaataaacgccttcccgattcgaataacccacgtcccgaaccgcctaataaaactaactctcccgcaactcgcgataataaaactaaatctcgcgcaaattctaatactaactctcgcgacccgaactatcccgcgcgccgtaaaaatcccgatacaactccccgcgatacaactaactctcctctcgcaaatcgcgattctcctaaataaactaatccaactaaccctccaa

SEQ ID NO: 1281 - DNA, 940 bp, Artificial Sequence
  chemically treated genomic DNA (Homo sapiens) CpG-island No: 1281
tagcgtttcgttttgtttcgtaattttacggaaatgtttttcgcgtgttttaatattacgttcgattataattttgggcgtaattagattgttattattatagttcgcgttttaaataaggtatttttcgttagtaagttttttcgttaatttttcgatacgaaatcgttttttcgtttataaagtattttagatcggtttgttttattcgtttttggtttaattttcgtcgttattttttttatttttttttttttcggattttttttttttttaattaacgtttttttttcgttacggtttttattattacgatatttcggaatttatcgtacgacgtcgttttcggtttttttttaatttttatattttttttttttttttttttttttttttttttttttttattatttttttttattttttttttatttcgtatcgttattttttttttttttttcgtcgttatttttttattttttttgtttttattttttttttttttttttttttatagtattttattttttttggcgcgatttttcgtttttttatgattttttttgtgcgtttattttttttacgttttagttttttatttttttttatattagtttcgcgttaagtttttttagttttacgtttttttatattttgtcgtcgttatattattacggttcgtttgttattatttattcgtacgcgattttttattatattcgttagcgttttttttattattttgtttttatacgtgtcgcgtttttttttatcgttttttttcgttataattgtttattttttattttcgttatttttagtttgtcgttttcgttttatttatttattttttttttttcgaaatttttttatatttttttttttttatttatttttttattttttttttcgtttttttcgtattttttttgtttattag

SEQ ID NO: 1282 - DNA, 940 bp, Artificial Sequence
  chemically treated genomic DNA (Homo sapiens) CpG-island No: 1282
ctaataaacaaaaaaaatacgaaaaaaacgaaaaaaaaaataaaaaaataaataaaaaaaaaaaaatataaaaaaatttcgaaaaaaaaaaaataaataaataaaacgaaaacgacaaactaaaaataacgaaaataaaaaataaacaattataacgaaaaaaaacgataaaaaaaaacgcgacacgtataaaaacaaaataataaaaaaaacgctaacgaatataataaaaaatcgcgtacgaataaataataacaaacgaaccgtaataatataacgacgacaaaatataaaaaaacgtaaaactaaaaaaacttaacgcgaaactaatataaaaaaaaataaaaaactaaaacgtaaaaaaaataaacgcacaaaaaaaatcataaaaaaacgaaaaatcgcgccaaaaaaaataaaatactataaaaaaaaaaaaaaaaaaaaaataaaaacaaaaaaaataaaaaaataacgacgaaaaaaaaaaaaaaaataacgatacgaaataaaaaaaaaataaaaaaaaataataaaaaaaaaaaaaaaaaaaaaaaaaaaaaaaaaaaaaatataaaaattaaaaaaaaaccgaaaacgacgtcgtacgataaattccgaaatatcgtaataataaaaaccgtaacgaaaaaaaaacgttaattaaaaaaaaaaaaaatccgaaaaaaaaaaaaataaaaaaaataacgacgaaaattaaaccaaaaacgaataaaacaaaccgatctaaaatactttataaacgaaaaaacgatttcgtatcgaaaaattaacgaaaaaacttactaacgaaaaataccttatttaaaacgcgaactataataataacaatctaattacgcccaaaattataatcgaacgtaatattaaaacacgcgaaaaacatttccgtaaaattacgaaacaaaacgaaacgcta

SEQ ID NO: 1283 - DNA, 940 bp, Artificial Sequence
  chemically treated genomic DNA (Homo sapiens) CpG-island No: 1283
ttggtaggtaggaggagtgcggggagggcgggaggagaagtggggaggtaggtgggaggggggaagtatggaggggtttcgagggggaggagatgagtgggtaaggcggaggcgataggttggagatggcgagaatggaaggtaggtagttatggcgagagagagcgatagaagagagcgcggtacgtataggagtagggtagtgagaagggcgttggcggatgtaatagagagtcgcgtgcgagtagatagtggtagacgagtcgtagtagtgtgacggcggtagagtgtagaggagcgtggagttaagaagatttagcgcgaggttagtgtgggagagagtaggaggttgaggcgtggagaaagtgggcgtatagagaaggttatggggagacggaagatcgcgttagaggagatagggtgttgtggagggggaggaggagagggggtgggggtaggggaggtgggggagtagcggcgggagaagggggaggagtggcgatgcgaggtgaggagaaggtgggaggaggtggtggggaagaggggggggggggggaggagaggaggggggatgtgggagttgggggggagtcgggagcggcgtcgtgcgatgagtttcggaatgtcgtggtggtgggagtcgtggcgggaggggagcgttggttgggaggggagggagttcggggagggggggaatagagggggtggcgacggaggttgggttaggggcgggtgggatagatcggtttaaaatattttgtgggcggaagagcgatttcgtgtcggggaattggcgagggaatttgttgacgaaggatgttttatttagaacgcggattgtggtagtggtagtttaattgcgtttaaggttatggtcgagcgtggtattaggatacgcggagagtattttcgtgaggttgcgaggtaaggcgaagcgttg

SEQ ID NO: 1284 - DNA, 940 bp, Artificial Sequence
  chemically treated genomic DNA (Homo sapiens) CpG-island No: 1284
caacgcttcgccttacctcgcaacctcacgaaaatactctccgcgtatcctaataccacgctcgaccataaccttaaacgcaattaaactaccactaccacaatccgcgttctaaataaaacatccttcgtcaacaaattccctcgccaattccccgacacgaaatcgctcttccgcccacaaaatattttaaaccgatctatcccacccgcccctaacccaacctccgtcgccaccccctctattccccccctccccgaactccctcccctcccaaccaacgctcccctcccgccacgactcccaccaccacgacattccgaaactcatcgcacgacgccgctcccgactcccccccaactcccacatcccccctcctctcctcccccccccccccctcttccccaccacctcctcccaccttctcctcacctcgcatcgccactcctcccccttctcccgccgctactcccccacctcccctacccccaccccctctcctcctccccctccacaacaccctatctcctctaacgcgatcttccgtctccccataaccttctctatacgcccactttctccacgcctcaacctcctactctctcccacactaacctcgcgctaaatcttcttaactccacgctcctctacactctaccgccgtcacactactacgactcgtctaccactatctactcgcacgcgactctctattacatccgccaacgcccttctcactaccctactcctatacgtaccgcgctctcttctatcgctctctctcgccataactacctaccttccattctcgccatctccaacctatcgcctccgccttacccactcatctcctccccctcgaaacccctccatacttcccccctcccacctacctccccacttctcctcccgccctccccgcactcctcctacctaccaa

SEQ ID NO: 1285 - DNA, 1511 bp, Artificial Sequence
  chemically treated genomic DNA (Homo sapiens) CpG-island No: 1285
gttcgcgttaggttggttacggttattagcgggattatttttgtcgtatcgtaggttattttgcgtataatcggcgttagggtggtcgatttgtttttgggtacgattatagtcgtggtatcggtcgtatcggtcgtgcgtaggtacgcgtcgaggttatgcgggtcggttatatcgtttaggattaggattagcggcggcgtttcggtgcgtttaagtaatttttcgagtattaattcgttttatatttggtttgggttgatttcggcgattacgttttggtgtacgttttttatttaggtatttagtttacggcgtttagtttggtcgatcggtacgcggtttttcgttgttagcgttagtaaggtttttaggcgtggttcgttgcgttttttcgatagttagatttgtttgacgcgtttcggatggtgttttagtaatgtttgtacggcgtgtacgtcgtagattttttttagttgatttatgatttgtttttgtttttgcgtggcgtatcggatttcggcgggtttttacggtgtttggtcggtttgtcggagtcggaggttttgttatttttgttcgatttgttgttggtatggtcgttattgcgtgtttcgtttattagcgttttttttatttcgcggtttttgcgtatttcggcgttacgttgtacggcgtttttcgggaagtacgtttcggcggtttcgtttttgcggttacgcggtttaggcgtggttttcgtttcggttatcggttgttgtttaattttgtcggttgttgacgcggcgtcgcgttgtttgcggtcgatcggtgcggcgagggtttttttcgatatttcgaagtcgattttgcgttcgtttaggtttatacgtatgatttttattttaatggtgtcgtttaggcggaagttgcgttcggtgcgttcgttcgatagacggtggtgtatagggtcgaagtggtagtagtcgttcggtagcgtattgacgtgtattaggttttttacgtaaatgtcggttagttcgacgaataggtcgaaatcggttacggcggtgattatattcgggaaggtttcgtttacgcgattttttatgaattcgtatttgagttagtttattacgttacgggtagtttcgtcggttcgacgttcggttatcgagtattgttcgtcgagttgttttagggtgttttcgtcgtacgggtagatacgcgttttgggaatgtttatggcgttagtacgtttgacgtgcggggtatcgattttggaacggatgatgttgcggatggcgcggtgtattagtaggttcgggtaacggcggatcggcgaggtaaagtgggtgtacgtttcgtagtttaggtcgaagtggttattgttttcggtgttgtatacggtttggtttagcgaacgtagtattacggtttggattaggtggaagttcgggcgttcggcgatgttcgttagtagggtttggtaatttttcggtgaagggtttttgtttttgtgtaggtttagg

SEQ ID NO: 1286 - DNA, 1511 bp, Artificial Sequence
  chemically treated genomic DNA (Homo sapiens) CpG-island No: 1286
cctaaacctacacaaaaacaaaaacccttcaccgaaaaattaccaaaccctactaacgaacatcgccgaacgcccgaacttccacctaatccaaaccgtaatactacgttcgctaaaccaaaccgtatacaacaccgaaaacaataaccacttcgacctaaactacgaaacgtacacccactttacctcgccgatccgccgttacccgaacctactaatacaccgcgccatccgcaacatcatccgttccaaaatcgataccccgcacgtcaaacgtactaacgccataaacattcccaaaacgcgtatctacccgtacgacgaaaacaccctaaaacaactcgacgaacaatactcgataaccgaacgtcgaaccgacgaaactacccgtaacgtaataaactaactcaaatacgaattcataaaaaatcgcgtaaacgaaaccttcccgaatataatcaccgccgtaaccgatttcgacctattcgtcgaactaaccgacatttacgtaaaaaacctaatacacgtcaatacgctaccgaacgactactaccacttcgaccctatacaccaccgtctatcgaacgaacgcaccgaacgcaacttccgcctaaacgacaccattaaaataaaaatcatacgtataaacctaaacgaacgcaaaatcgacttcgaaatatcgaaaaaaaccctcgccgcaccgatcgaccgcaaacaacgcgacgccgcgtcaacaaccgacaaaattaaacaacaaccgataaccgaaacgaaaaccacgcctaaaccgcgtaaccgcaaaaacgaaaccgccgaaacgtacttcccgaaaaacgccgtacaacgtaacgccgaaatacgcaaaaaccgcgaaataaaaaaaacgctaataaacgaaacacgcaataacgaccataccaacaacaaatcgaacaaaaataacaaaacctccgactccgacaaaccgaccaaacaccgtaaaaacccgccgaaatccgatacgccacgcaaaaacaaaaacaaatcataaatcaactaaaaaaaatctacgacgtacacgccgtacaaacattactaaaacaccatccgaaacgcgtcaaacaaatctaactatcgaaaaaacgcaacgaaccacgcctaaaaaccttactaacgctaacaacgaaaaaccgcgtaccgatcgaccaaactaaacgccgtaaactaaatacctaaataaaaaacgtacaccaaaacgtaatcgccgaaatcaacccaaaccaaatataaaacgaattaatactcgaaaaattacttaaacgcaccgaaacgccgccgctaatcctaatcctaaacgatataaccgacccgcataacctcgacgcgtacctacgcacgaccgatacgaccgataccacgactataatcgtacccaaaaacaaatcgaccaccctaacgccgattatacgcaaaataacctacgatacgacaaaaataatcccgctaataaccgtaaccaacctaacgcgaac

SEQ ID NO: 1287 - DNA, 1511 bp, Artificial Sequence
  chemically treated genomic DNA (Homo sapiens) CpG-island No: 1287
tttgagtttgtataaaggtaaggattttttatcgaaggattattaggttttgttggcgagtatcgtcgggcgttcggatttttatttgatttagatcgtgatgttgcgttcgttgagttaggtcgtgtatagtatcgagaataatggttatttcggtttgaattacgaggcgtatatttattttatttcgtcgattcgtcgttattcggatttgttggtgtatcgcgttattcgtagtattattcgttttaaggtcgatatttcgtacgttaagcgtgttggcgttatgagtatttttaaggcgcgtatttattcgtacgacgagaatattttggagtagttcggcgagtagtgttcgatgatcgagcgtcgggtcgacgaagttattcgtgacgtggtgaattggtttaagtgcgagtttatgaaggatcgcgtgggcgagattttttcgggtgtgattatcgtcgtgatcggtttcggtttgttcgtcgagttgatcgatatttacgtagagggtttggtgtacgttagtgcgttgtcgggcgattattattatttcgattttgtgtattatcgtttgtcgggcgagcgtatcgggcgtagttttcgtttgggcgatattattgaagtgaaggttatgcgtgtggatttggacgagcgtaagatcgatttcgaggtgtcggaaaaaattttcgtcgtatcgatcggtcgtaagtagcgcggcgtcgcgttagtagtcgataaggttgaatagtagtcggtaatcgaagcgaaagttacgtttaaatcgcgtagtcgtaagagcgaaatcgtcgaggcgtatttttcgaaagacgtcgtgtagcgtaacgtcgaagtgcgtaagagtcgcgaaatgaaaaaggcgttgatgagcgaggtacgtagtggcggttatgttagtagtaagtcggataaaggtggtaaggttttcggtttcggtaagtcgattaagtatcgtaaaggttcgtcgaagttcggtgcgttacgtaagagtaagagtaagttatgagttagttggaaaagatttacggcgtgtacgtcgtgtaggtattgttgaagtattattcgaagcgcgttaagtagatttggttgtcggaagggcgtagcgagttacgtttggaaattttgttggcgttggtagcggagaatcgcgtgtcggtcggttaggttgagcgtcgtgagttggatgtttgggtagagggcgtgtattagggcgtggtcgtcgaggttagtttaagttaggtgtggggcgagttgatgttcgaagagttgtttgagcgtatcgaaacgtcgtcgttgattttggttttggacggtgtgatcgattcgtataatttcggcgcgtgtttgcgtacggtcgatgcggtcggtgttacggttgtgatcgtgtttaaggataagtcggttattttgacgtcggttgtgcgtaaggtggtttgcggtgcggtagaggtgatttcgttggtggtcgtgattaatttggcgcggat

SEQ ID NO: 1288 - DNA, 1511 bp, Artificial Sequence
  chemically treated genomic DNA (Homo sapiens) CpG-island No: 1288
atccgcgccaaattaatcacgaccaccaacgaaatcacctctaccgcaccgcaaaccaccttacgcacaaccgacgtcaaaataaccgacttatccttaaacacgatcacaaccgtaacaccgaccgcatcgaccgtacgcaaacacgcgccgaaattatacgaatcgatcacaccgtccaaaaccaaaatcaacgacgacgtttcgatacgctcaaacaactcttcgaacatcaactcgccccacacctaacttaaactaacctcgacgaccacgccctaatacacgccctctacccaaacatccaactcacgacgctcaacctaaccgaccgacacgcgattctccgctaccaacgccaacaaaatttccaaacgtaactcgctacgcccttccgacaaccaaatctacttaacgcgcttcgaataatacttcaacaatacctacacgacgtacacgccgtaaatcttttccaactaactcataacttactcttactcttacgtaacgcaccgaacttcgacgaacctttacgatacttaatcgacttaccgaaaccgaaaaccttaccacctttatccgacttactactaacataaccgccactacgtacctcgctcatcaacgcctttttcatttcgcgactcttacgcacttcgacgttacgctacacgacgtctttcgaaaaatacgcctcgacgatttcgctcttacgactacgcgatttaaacgtaactttcgcttcgattaccgactactattcaaccttatcgactactaacgcgacgccgcgctacttacgaccgatcgatacgacgaaaattttttccgacacctcgaaatcgatcttacgctcgtccaaatccacacgcataaccttcacttcaataatatcgcccaaacgaaaactacgcccgatacgctcgcccgacaaacgataatacacaaaatcgaaataataataatcgcccgacaacgcactaacgtacaccaaaccctctacgtaaatatcgatcaactcgacgaacaaaccgaaaccgatcacgacgataatcacacccgaaaaaatctcgcccacgcgatccttcataaactcgcacttaaaccaattcaccacgtcacgaataacttcgtcgacccgacgctcgatcatcgaacactactcgccgaactactccaaaatattctcgtcgtacgaataaatacgcgccttaaaaatactcataacgccaacacgcttaacgtacgaaatatcgaccttaaaacgaataatactacgaataacgcgatacaccaacaaatccgaataacgacgaatcgacgaaataaaataaatatacgcctcgtaattcaaaccgaaataaccattattctcgatactatacacgacctaactcaacgaacgcaacatcacgatctaaatcaaataaaaatccgaacgcccgacgatactcgccaacaaaacctaataatccttcgataaaaaatccttacctttatacaaactcaaa

SEQ ID NO: 1289 - DNA, 1583 bp, Artificial Sequence
  chemically treated genomic DNA (Homo sapiens) CpG-island No: 1289
gtttcggcggcgggtcgtcgtgtacgcggtatagggttggtacgttatgtttttgtaggaattcggcggtggttacgttggtcgttagtatgtatttttcgattagtttgtgggtatcgttgcgtacggtcgggcggattttcgcgattttgcgttggtcgtcgaagatgatgcgggttttttgcgtttcgaagtcgatggcgttacgggtgtgacgggtatttattagtattttgtataggttgtataggttttttaggttcggtacgatttttttgtatttttcgcgtagcgttttgttttcgcgggtgcgggcgtgttcgagtatgttgttgattttgttgtaggttaggcgggcgtgggagtggataacgttttcgtagaattggtagtcgattatttggtcggttttgtttatggttattttatagattatggttagacggtcgacgtgcgggtttagcgagtataggtcgttggatagtttttcgggaagtatcggtattatacgttcggggaagtatatcgagttgtcgcgttgttgagtttcgacgtttagggtcgagtttaggcgaacgtagttggatacgtcggtaatcgttatatataggcgttagttatcggagaataggcgtagtttgtttagcggttcgtagtagacggcgtcgtcgaagtttcgagtatttttatcgtcgatggtgacgaacggtaggtggcgtaggtcgacgcgtttttttttgttttttttttcgatttcggagcggaatttgcgcgtttttttgacgatagtattaggttagacgtgcggaatgtcgtagttgcgtaaggtaacgtcgatttttatgttcggtgttatgtagttgtcgatgatttcgattacgtcgttttgcggttggaagcgcggggttggttagtgggtgattttgatttcgacgaattgatcgattttcgcgtcgtcgttacgttcggcggttattagtattttttgttggattttcgggttgttcggggttacgtagttaatgttatttttttcgaagtaacggtcgattacgttttcgtgggtacgggagatgatttcgattagcgtattttcgcggcggttacggcggtcgacgttagagatacgggttaggtcgcggttatcgtcgaatattaggcgtatttgcgacgggttgaggaataggttttcgttgtcgttatcgggaataaggaagtcgaagttatcgcggtggtcggagacgcgattatagattaggtttagtttgtttatcggggtataagtgttacgtcgggtatagataagttggtcgtcgcgttttatggtacgtaggcggcggcgtagggtttcgatttggtttttttcgtatagatcgaattcggtcgttagttttttacgcgcggtcggttcgttacggtcggcgaggcgttgtaggattagtttacggttggggatagggttgtcgtattttttcgtttcgcgagcggtttcgggatcgagggattgttaatcggttattagaaggggtttattttggggtatatagatatgaattttggtataggcgtattgaaatcggaaa

SEQ ID NO: 1290 - DNA, 1583 bp, Artificial Sequence
  chemically treated genomic DNA (Homo sapiens) CpG-island No: 1290
tttccgatttcaatacgcctataccaaaattcatatctatataccccaaaataaaccccttctaataaccgattaacaatccctcgatcccgaaaccgctcgcgaaacgaaaaaatacgacaaccctatccccaaccgtaaactaatcctacaacgcctcgccgaccgtaacgaaccgaccgcgcgtaaaaaactaacgaccgaattcgatctatacgaaaaaaaccaaatcgaaaccctacgccgccgcctacgtaccataaaacgcgacgaccaacttatctatacccgacgtaacacttataccccgataaacaaactaaacctaatctataatcgcgtctccgaccaccgcgataacttcgacttccttattcccgataacgacaacgaaaacctattcctcaacccgtcgcaaatacgcctaatattcgacgataaccgcgacctaacccgtatctctaacgtcgaccgccgtaaccgccgcgaaaatacgctaatcgaaatcatctcccgtacccacgaaaacgtaatcgaccgttacttcgaaaaaaataacattaactacgtaaccccgaacaacccgaaaatccaacaaaaaatactaataaccgccgaacgtaacgacgacgcgaaaatcgatcaattcgtcgaaatcaaaatcacccactaaccaaccccgcgcttccaaccgcaaaacgacgtaatcgaaatcatcgacaactacataacaccgaacataaaaatcgacgttaccttacgcaactacgacattccgcacgtctaacctaatactatcgtcaaaaaaacgcgcaaattccgctccgaaatcgaaaaaaaaaacaaaaaaaaacgcgtcgacctacgccacctaccgttcgtcaccatcgacgataaaaatactcgaaacttcgacgacgccgtctactacgaaccgctaaacaaactacgcctattctccgataactaacgcctatatataacgattaccgacgtatccaactacgttcgcctaaactcgaccctaaacgtcgaaactcaacaacgcgacaactcgatatacttccccgaacgtataataccgatacttcccgaaaaactatccaacgacctatactcgctaaacccgcacgtcgaccgtctaaccataatctataaaataaccataaacaaaaccgaccaaataatcgactaccaattctacgaaaacgttatccactcccacgcccgcctaacctacaacaaaatcaacaacatactcgaacacgcccgcacccgcgaaaacaaaacgctacgcgaaaaatacaaaaaaatcgtaccgaacctaaaaaacctatacaacctatacaaaatactaataaatacccgtcacacccgtaacgccatcgacttcgaaacgcaaaaaacccgcatcatcttcgacgaccaacgcaaaatcgcgaaaatccgcccgaccgtacgcaacgatacccacaaactaatcgaaaaatacatactaacgaccaacgtaaccaccgccgaattcctacaaaaacataacgtaccaaccctataccgcgtacacgacgacccgccgccgaaac

SEQ ID NO: 1291 - DNA, 1583 bp, Artificial Sequence
  chemically treated genomic DNA (Homo sapiens) CpG-island No: 1291
ttttcggttttaatacgtttatgttagaatttatatttatatattttaaggtgaattttttttgatggtcgattggtaatttttcgatttcgaggtcgttcgcgaagcggaaaaatacgataattttatttttagtcgtgagttgattttgtagcgtttcgtcgatcgtggcgaatcggtcgcgcgtgaggagttggcggtcgagttcggtttgtacgaagaagattagatcgaagttttgcgtcgtcgtttgcgtgttatggagcgcgacggttagtttatttatattcggcgtggtatttatgtttcggtagataagttggatttgatttgtggtcgcgttttcggttatcgcgatggtttcggtttttttattttcgatgacggtagcgaagatttgttttttagttcgtcgtagatgcgtttggtgttcgacggtgatcgcggtttggttcgtgtttttggcgtcgatcgtcgtggtcgtcgcgaaggtgcgttggtcgaggttatttttcgtgtttacgaaagcgtggtcggtcgttatttcgaagaaggtggtattggttacgtaatttcggataattcgaagatttagtaggaagtgttagtaatcgtcgggcgtaacggcggcgcgaagatcggttagttcgtcgagattaagattatttattggttaatttcgcgtttttagtcgtaaggcgacgtggtcgaggttatcggtaattatatggtatcgggtatggaaatcgacgttgttttgcgtagttacgatatttcgtacgtttggtttgatgttgtcgttaaggaagcgcgtaagtttcgtttcgaagtcgaagagaaggataaagagaagcgcgtcgatttgcgttatttgtcgttcgttattatcgacggtgaggatgttcgggatttcgacgacgtcgtttattgcgaatcgttgggtaagttgcgtttgtttttcggtggttggcgtttgtatgtggcgattgtcgacgtgtttagttacgttcgtttgggttcggttttggacgtcgaggtttagtagcgcggtaattcggtgtattttttcgagcgtgtagtgtcgatgtttttcgaagagttgtttaacggtttgtgttcgttgaattcgtacgtcgatcgtttggttatggtttgtgaaatgattatgaataaagtcggttaaatggtcgattattagttttacgaaggcgttatttatttttacgttcgtttgatttataataaggttagtagtatgttcgagtacgttcgtattcgcgaaggtaaggcgttgcgcgaggaatataaggaagtcgtatcggatttgaagaatttgtataatttgtataaggtgttggtggatgttcgttatattcgtggcgttatcgatttcgaaacgtaggaaattcgtattattttcggcgattagcgtaagatcgcggaaattcgttcgatcgtgcgtaacgatgtttataagttgatcgaggaatgtatgttggcggttaacgtggttatcgtcgagtttttgtaaaagtatggcgtgttagttttgtatcgcgtgtacgacggttcgtcgtcggagt

SEQ ID NO: 1292 - DNA, 1583 bp, Artificial Sequence
  chemically treated genomic DNA (Homo sapiens) CpG-island No: 1292
actccgacgacgaaccgtcgtacacgcgatacaaaactaacacgccatacttttacaaaaactcgacgataaccacgttaaccgccaacatacattcctcgatcaacttataaacatcgttacgcacgatcgaacgaatttccgcgatcttacgctaatcgccgaaaataatacgaatttcctacgtttcgaaatcgataacgccacgaatataacgaacatccaccaacaccttatacaaattatacaaattcttcaaatccgatacgacttccttatattcctcgcgcaacgccttaccttcgcgaatacgaacgtactcgaacatactactaaccttattataaatcaaacgaacgtaaaaataaataacgccttcgtaaaactaataatcgaccatttaaccgactttattcataatcatttcacaaaccataaccaaacgatcgacgtacgaattcaacgaacacaaaccgttaaacaactcttcgaaaaacatcgacactacacgctcgaaaaaatacaccgaattaccgcgctactaaacctcgacgtccaaaaccgaacccaaacgaacgtaactaaacacgtcgacaatcgccacatacaaacgccaaccaccgaaaaacaaacgcaacttacccaacgattcgcaataaacgacgtcgtcgaaatcccgaacatcctcaccgtcgataataacgaacgacaaataacgcaaatcgacgcgcttctctttatccttctcttcgacttcgaaacgaaacttacgcgcttccttaacgacaacatcaaaccaaacgtacgaaatatcgtaactacgcaaaacaacgtcgatttccatacccgataccatataattaccgataacctcgaccacgtcgccttacgactaaaaacgcgaaattaaccaataaataatcttaatctcgacgaactaaccgatcttcgcgccgccgttacgcccgacgattactaacacttcctactaaatcttcgaattatccgaaattacgtaaccaataccaccttcttcgaaataacgaccgaccacgctttcgtaaacacgaaaaataacctcgaccaacgcaccttcgcgacgaccacgacgatcgacgccaaaaacacgaaccaaaccgcgatcaccgtcgaacaccaaacgcatctacgacgaactaaaaaacaaatcttcgctaccgtcatcgaaaataaaaaaaccgaaaccatcgcgataaccgaaaacgcgaccacaaatcaaatccaacttatctaccgaaacataaataccacgccgaatataaataaactaaccgtcgcgctccataacacgcaaacgacgacgcaaaacttcgatctaatcttcttcgtacaaaccgaactcgaccgccaactcctcacgcgcgaccgattcgccacgatcgacgaaacgctacaaaatcaactcacgactaaaaataaaattatcgtatttttccgcttcgcgaacgacctcgaaatcgaaaaattaccaatcgaccatcaaaaaaaattcaccttaaaatatataaatataaattctaacataaacgtattaaaaccgaaaa

SEQ ID NO: 1293 - DNA, 664 bp, Artificial Sequence
  chemically treated genomic DNA (Homo sapiens) CpG-island No: 1293
tcgtaatcgttgatgcgtattttggtcgtcgtcgtgttgagtttggttatcggcgtttcggtcgttatggtagacgtatcggttattttgattatgtataacggttagtataaggaaatcggcgaagttatcgttaaggtttacgaggttaagatcggtatttatatcgatattcgtaagggtagtagtaattagttggttagttagattatcgaggagggcgatcgttcgttagtcgattttatttatatcgaagagttttcgtttttgaataatttgggcgaattgggtttgttggcgaagatcgacgacgttatcgcgaatatggtgtttaaggagtatgtgggcgttaacggtatttggatgggtattatcgcgcgtacgcgtatcgtggtgtataattcgaagaaggtcgatgaaaaagatttgtcgattatagtgatggatttcgttaattttgagtgggaaggtcgcgtcggttacgtatttattagcggtgtattttaggagtaggtcgtggttattttgaagatgtatggtcgtgaagttatcgaagaatggttgatcggttttaaagttttcggtaaaatatatattaataatatggtcgtttttaaagtcgtggaaaaaggtgaagtggttgcggtattggtgaataattatt

SEQ ID NO: 1294 - DNA, 664 bp, Artificial Sequence
  chemically treated genomic DNA (Homo sapiens) CpG-island No: 1294
aataattattcaccaataccgcaaccacttcacctttttccacgactttaaaaacgaccatattattaatatatattttaccgaaaactttaaaaccgatcaaccattcttcgataacttcacgaccatacatcttcaaaataaccacgacctactcctaaaatacaccgctaataaatacgtaaccgacgcgaccttcccactcaaaattaacgaaatccatcactataatcgacaaatctttttcatcgaccttcttcgaattatacaccacgatacgcgtacgcgcgataatacccatccaaataccgttaacgcccacatactccttaaacaccatattcgcgataacgtcgtcgatcttcgccaacaaacccaattcgcccaaattattcaaaaacgaaaactcttcgatataaataaaatcgactaacgaacgatcgccctcctcgataatctaactaaccaactaattactactacccttacgaatatcgatataaataccgatcttaacctcgtaaaccttaacgataacttcgccgatttccttatactaaccgttatacataatcaaaataaccgatacgtctaccataacgaccgaaacgccgataaccaaactcaacacgacgacgaccaaaatacgcatcaacgattacga

SEQ ID NO: 1295 - DNA, 664 bp, Artificial Sequence
  chemically treated genomic DNA (Homo sapiens) CpG-island No: 1295
agtagttgtttattagtatcgtagttattttatttttttttacggttttgagggcgattatgttgttggtgtatgttttgtcgaaggttttaaggtcggttagttatttttcggtggttttacgattatgtatttttaggatggttacggtttgtttttggaatgtatcgttggtgggtacgtagtcgacgcggtttttttatttagggttggcgaagtttattattgtggtcggtaggttttttttatcgatttttttcgggttgtatattacgatgcgcgtgcgcgcggtgatgtttatttaggtgtcgttggcgtttatatattttttgggtattatgttcgcggtggcgtcgtcgattttcgttagtaggtttagttcgtttaggttgtttaggggcggggatttttcggtgtagatgaggtcggttggcgaacggtcgtttttttcgatgatttggttggttagttggttgttgttgtttttgcggatatcgatgtggatgtcggttttggtttcgtaggttttggcgatggtttcgtcgatttttttgtgttgatcgttgtatatggttagggtgatcggtgcgtttgttatggcggtcggagcgtcgatgattaggtttagtacggcggcggttaaggtacgtattagcggttgcgg

SEQ ID NO: 1296 - DNA, 664 bp, Artificial Sequence
  chemically treated genomic DNA (Homo sapiens) CpG-island No: 1296
ccgcaaccgctaatacgtaccttaaccgccgccgtactaaacctaatcatcgacgctccgaccgccataacaaacgcaccgatcaccctaaccatatacaacgatcaacacaaaaaaatcgacgaaaccatcgccaaaacctacgaaaccaaaaccgacatccacatcgatatccgcaaaaacaacaacaaccaactaaccaaccaaatcatcgaaaaaaacgaccgttcgccaaccgacctcatctacaccgaaaaatccccgcccctaaacaacctaaacgaactaaacctactaacgaaaatcgacgacgccaccgcgaacataatacccaaaaaatatataaacgccaacgacacctaaataaacatcaccgcgcgcacgcgcatcgtaatatacaacccgaaaaaaatcgataaaaaaaacctaccgaccacaataataaacttcgccaaccctaaataaaaaaaccgcgtcgactacgtacccaccaacgatacattccaaaaacaaaccgtaaccatcctaaaaatacataatcgtaaaaccaccgaaaaataactaaccgaccttaaaaccttcgacaaaacatacaccaacaacataatcgccctcaaaaccgtaaaaaaaaataaaataactacgatactaataaacaactact

SEQ ID NO: 1297 - DNA, 1265 bp, Artificial Sequence
  chemically treated genomic DNA (Homo sapiens) CpG-island No: 1297
cggttaacgtcgagttcgcggcggcggcgttttatgtagttttgttgatcgtggtgttaggtttgtcggtttatttgttgattacgcggatgtatttgaataaggtataaatttcgtagtttttatcgtcggtaagttagtttttataggtatagtatcgtttttaaggtttgtgtaatatttgcgggagcgggtacgttcgtttttataaagttcgggttacgttttgaattgatttaggttcgttcgtaattgcgtagttaggttatttagtattttgttgttggtcgtggtttgtattattatttcggtcgatcgttcggtttgggtatggatagtttttattcgattacgtatcgtttgcgtttcgttcgtttgttgttcggtcgtacgggtagttaggtcgatagttgcgtgaatttgttttatcgtcgtttgtatagattgttgacggcgttcgttgttacgtagtattagtagtttttcgttggtttttagatcggtttggttgatcgtcgttacggtttttttggcgtttttttgtagcgtagcgatatgcgtttggatatttttcgtggagttttgcgttttgttcgttaacgttcgtattttattagttattacggtaaagtcgcgttcggttttatcggttcgggtcgtttcgatggtcgtatttaacgttagtaggttggtttgttcggcgatgtcgtggattatcgttagtattatttcgatttgtttattttgtttggttaggcgttcgattatttgagagttcgtttttatttggttagttaggttttcgattagttttgcgagttgggtcgaggtgcggttgtttttatcggtggtttggcggatatttattatttgttttaatgttgtttgtatcgtatggttttcggtttgggttttatcggttatgttcgaaaggttacgtaggttggtcgttatttcgttacgttgtagcgtagtagtagtatcggtatcggtattacgttgggttatcgcgttaatttttatatcggtacgttgggcgatttcgttcgtttcgcgtacgatcggttgtaatttgtcgataaagcggtttacggtcgaagttatgtcgtcgatttcgtttcggttgtcgagtggtatacgtttggttaggtcgttttcgtttgtcgttaggtcgttaagggtagtaattagtaggcgtagtttgtttagtatacgacgattaagtattacggttattattagtaatacgtttaggttaattagta

SEQ ID NO: 1298 - DNA, 1265 bp, Artificial Sequence
  chemically treated genomic DNA (Homo sapiens) CpG-island No: 1298
tactaattaacctaaacgtattactaataataaccgtaatacttaatcgtcgtatactaaacaaactacgcctactaattactacccttaacgacctaacgacaaacgaaaacgacctaaccaaacgtataccactcgacaaccgaaacgaaatcgacgacataacttcgaccgtaaaccgctttatcgacaaattacaaccgatcgtacgcgaaacgaacgaaatcgcccaacgtaccgatataaaaattaacgcgataacccaacgtaataccgataccgatactactactacgctacaacgtaacgaaataacgaccaacctacgtaacctttcgaacataaccgataaaacccaaaccgaaaaccatacgatacaaacaacattaaaacaaataataaatatccgccaaaccaccgataaaaacaaccgcacctcgacccaactcgcaaaactaatcgaaaacctaactaaccaaataaaaacgaactctcaaataatcgaacgcctaaccaaacaaaataaacaaatcgaaataatactaacgataatccacgacatcgccgaacaaaccaacctactaacgttaaatacgaccatcgaaacgacccgaaccgataaaaccgaacgcgactttaccgtaataactaataaaatacgaacgttaacgaacaaaacgcaaaactccacgaaaaatatccaaacgcatatcgctacgctacaaaaaaacgccaaaaaaaccgtaacgacgatcaaccaaaccgatctaaaaaccaacgaaaaactactaatactacgtaacaacgaacgccgtcaacaatctatacaaacgacgataaaacaaattcacgcaactatcgacctaactacccgtacgaccgaacaacaaacgaacgaaacgcaaacgatacgtaatcgaataaaaactatccatacccaaaccgaacgatcgaccgaaataataatacaaaccacgaccaacaacaaaatactaaataacctaactacgcaattacgaacgaacctaaatcaattcaaaacgtaacccgaactttataaaaacgaacgtacccgctcccgcaaatattacacaaaccttaaaaacgatactatacctataaaaactaacttaccgacgataaaaactacgaaatttataccttattcaaatacatccgcgtaatcaacaaataaaccgacaaacctaacaccacgatcaacaaaactacataaaacgccgccgccgcgaactcgacgttaaccg

SEQ ID NO: 1299 - DNA, 1265 bp, Artificial Sequence
  chemically treated genomic DNA (Homo sapiens) CpG-island No: 1299
tgttggttggtttgggcgtgttgttggtggtggtcgtggtgtttggtcgtcgtgtgttgagtaagttgcgtttgttgattgttgtttttgacgatttggcggtaggcgagggcgatttgattaagcgtgtgttattcgatagtcgggacgagatcggcgatatggtttcggtcgtgaatcgttttgtcgataagttgtaatcgatcgtgcgcgaggcgggcgaggtcgtttagcgtatcggtgtggaaattggcgcgatggtttagcgtaatgtcggtgtcgatgttgttgttgcgttgtagcgtgacgaagtggcggttagtttgcgtgatttttcgagtatggtcgatgaagtttaggtcgaaagttatgcgatgtaggtagtattgaaataggtggtggatattcgttaggttatcgatgaaaatagtcgtatttcgatttagttcgtagggttgatcgaaaatttggttggttaggtagagacgggtttttaggtgatcgagcgtttggttaagtagagtgagtagatcgaagtagtgttgacggtgatttacggtatcgtcgagtagattaatttgttggcgttgaatgcggttatcgaagcggttcgggtcggtgagatcgggcgcggttttgtcgtggtggttgatgaggtgcgggcgttggcgagtaagacgtaaagttttacgggggatatttaggcgtatatcgttgcgttgtagaagggcgttaaggaggtcgtggcgacgattagttaggtcggtttgaaggttagcgaagggttgttggtgttgcgtgataacgagcgtcgttagtagtttgtgtaggcggcggtggagtaggtttacgtagttatcggtttggttattcgtgcggtcgagtagtaggcgagcggggcgtaggcggtgcgtggtcgggtggagattatttatgtttaggtcgagcggtcggtcgaagtagtgatgtagattacggttagtagtaaggtgttggatgatttggttgcgtagttgcgggcgagtttgggttagtttagggcgtaattcgggttttgtgggagcgggcgtgttcgttttcgtaggtattatataggttttgagggcggtgttgtatttgtgggagttggtttgtcggcgatgagggttgcgaggtttatgttttgtttaggtatattcgcgtggttagtagataaatcggtaggtttgatattacgattagtaaggttgtatagggcgtcgtcgtcgcgaattcgacgttggtcg

SEQ ID NO: 1300 - DNA, 1265 bp, Artificial Sequence
  chemically treated genomic DNA (Homo sapiens) CpG-island No: 1300
cgaccaacgtcgaattcgcgacgacgacgccctatacaaccttactaatcgtaatatcaaacctaccgatttatctactaaccacgcgaatatacctaaacaaaacataaacctcgcaaccctcatcgccgacaaaccaactcccacaaatacaacaccgccctcaaaacctatataatacctacgaaaacgaacacgcccgctcccacaaaacccgaattacgccctaaactaacccaaactcgcccgcaactacgcaaccaaatcatccaacaccttactactaaccgtaatctacatcactacttcgaccgaccgctcgacctaaacataaataatctccacccgaccacgcaccgcctacgccccgctcgcctactactcgaccgcacgaataaccaaaccgataactacgtaaacctactccaccgccgcctacacaaactactaacgacgctcgttatcacgcaacaccaacaacccttcgctaaccttcaaaccgacctaactaatcgtcgccacgacctccttaacgcccttctacaacgcaacgatatacgcctaaatatcccccgtaaaactttacgtcttactcgccaacgcccgcacctcatcaaccaccacgacaaaaccgcgcccgatctcaccgacccgaaccgcttcgataaccgcattcaacgccaacaaattaatctactcgacgataccgtaaatcaccgtcaacactacttcgatctactcactctacttaaccaaacgctcgatcacctaaaaacccgtctctacctaaccaaccaaattttcgatcaaccctacgaactaaatcgaaatacgactattttcatcgataacctaacgaatatccaccacctatttcaatactacctacatcgcataactttcgacctaaacttcatcgaccatactcgaaaaatcacgcaaactaaccgccacttcgtcacgctacaacgcaacaacaacatcgacaccgacattacgctaaaccatcgcgccaatttccacaccgatacgctaaacgacctcgcccgcctcgcgcacgatcgattacaacttatcgacaaaacgattcacgaccgaaaccatatcgccgatctcgtcccgactatcgaataacacacgcttaatcaaatcgccctcgcctaccgccaaatcgtcaaaaacaacaatcaacaaacgcaacttactcaacacacgacgaccaaacaccacgaccaccaccaacaacacgcccaaaccaaccaaca

SEQ ID NO: 1301 - DNA, 928 bp, Artificial Sequence
  chemically treated genomic DNA (Homo sapiens) CpG-island No: 1301
tgcgttagcgtagttcgtcggtagtatcgcgaacggtttgcgcggtgttggtttgtatggtagtagtattgttttgtgttttttttagtcgtttacgtagggttttgtcgttgttcgcggtagtatcgattaggttgtcgtttattagttgttcgttattggcgattagtgtcgcgaagcgttgatcgagcgtttttagtttttgttcgatattcgttgtggaaatttttattattattttgtcgatttcggcgttattggggttgatcgaagtttcgacgaaataaacggtaggatcgcgtcgagttgtatcgattattttgtttagcgttcgttcgttttggtttttttttattaacgtttggttgatcgggttttgtcggtttagatagcgggtgaggtgttggttttgggcgtcgtcgtatattacgaatagtacgttgggattgcgttgggtacgtcgtgtaaagtttgagagtatcggtatatcgttgttttagatggtacgcggggtaatcgaggttagtagttttgttatatcgttggcggagttttttaggtttttttttagggtgttacgtagttgttgttgttcgttttgtaggcgtgtcgataattttgtatttaggcgttgacgggtattgttggatagattgtttaggttcgagcgtatattttgttcggtttgttttagttcgtcggttaattgacggttgttattgtttaggcgttcgttaaggtcggtttttagggtagtgatcgtgtttcgggtaagcgtaacggtaattagtatttgtattaaaagagcgatattaagggtaataaatataggtcgtaaaaggcggtttcgtaatagtgagaggatggtagatacggtgtaattttcgtgttttttggcgttattattttgatggtatttatagaaatt

SEQ ID NO: 1302 - DNA, 928 bp, Artificial Sequence
  chemically treated genomic DNA (Homo sapiens) CpG-island No: 1302
aatttctataaataccatcaaaataataacgccaaaaaacacgaaaattacaccgtatctaccatcctctcactattacgaaaccgccttttacgacctatatttattacccttaatatcgctcttttaatacaaatactaattaccgttacgcttacccgaaacacgatcactaccctaaaaaccgaccttaacgaacgcctaaacaataacaaccgtcaattaaccgacgaactaaaacaaaccgaacaaaatatacgctcgaacctaaacaatctatccaacaatacccgtcaacgcctaaatacaaaattatcgacacgcctacaaaacgaacaacaacaactacgtaacaccctaaaaaaaaacctaaaaaactccgccaacgatataacaaaactactaacctcgattaccccgcgtaccatctaaaacaacgatataccgatactctcaaactttacacgacgtacccaacgcaatcccaacgtactattcgtaatatacgacgacgcccaaaaccaacacctcacccgctatctaaaccgacaaaacccgatcaaccaaacgttaataaaaaaaaaccaaaacgaacgaacgctaaacaaaataatcgatacaactcgacgcgatcctaccgtttatttcgtcgaaacttcgatcaaccccaataacgccgaaatcgacaaaataataataaaaatttccacaacgaatatcgaacaaaaactaaaaacgctcgatcaacgcttcgcgacactaatcgccaataacgaacaactaataaacgacaacctaatcgatactaccgcgaacaacgacaaaaccctacgtaaacgactaaaaaaaacacaaaacaatactactaccatacaaaccaacaccgcgcaaaccgttcgcgatactaccgacgaactacgctaacgca

SEQ ID NO: 1303 - DNA, 928 bp, Artificial Sequence
  chemically treated genomic DNA (Homo sapiens) CpG-island No: 1303
agtttttgtagatgttattaaaatagtggcgttagaaaatacgagggttatatcgtgtttgttatttttttattgttacgaagtcgttttttgcggtttgtgtttgttgtttttggtatcgtttttttggtgtaggtgttggttgtcgttgcgtttattcgaagtacggttattgttttggaggtcgattttggcgaacgtttgggtaatgatagtcgttagttggtcggcgaattggagtaagtcgggtaagatgtgcgttcgggtttggatagtttgtttagtagtattcgttagcgtttgagtgtagggttgtcggtacgtttgtaaagcgaatagtagtaattgcgtagtattttggaaaagaatttgaaggatttcgttaacgatatggtagagttgttggtttcggttgtttcgcgtgttatttgggataacgatgtgtcggtgtttttagattttgtacggcgtgtttagcgtaattttaacgtgttgttcgtggtgtacgacgacgtttagggttagtattttattcgttatttgaatcggtaaaattcgattaattaggcgttgatggaaaaaggttagggcgagcgagcgttggataaagtgatcgatgtagttcggcgcgattttgtcgtttatttcgtcgaggtttcgattagttttaatggcgtcgaaatcggtaaggtagtgatgggggtttttatagcgggtatcgagtaggaattgaaggcgttcgattagcgtttcgcggtattgatcgttagtggcgagtaattggtaggcgatagtttggtcggtgttgtcgcggatagcggtaaaattttgcgtgaacggttggaaaaagtatagggtagtgttgttgttatgtaggttaatatcgcgtaaatcgttcgcgatgttgtcggcgagttgcgttggcgta

SEQ ID NO: 1304 - DNA, 928 bp, Artificial Sequence
  chemically treated genomic DNA (Homo sapiens) CpG-island No: 1304
tacgccaacgcaactcgccgacaacatcgcgaacgatttacgcgatattaacctacataacaacaacactaccctatactttttccaaccgttcacgcaaaattttaccgctatccgcgacaacaccgaccaaactatcgcctaccaattactcgccactaacgatcaataccgcgaaacgctaatcgaacgccttcaattcctactcgatacccgctataaaaacccccatcactaccttaccgatttcgacgccattaaaactaatcgaaacctcgacgaaataaacgacaaaatcgcgccgaactacatcgatcactttatccaacgctcgctcgccctaacctttttccatcaacgcctaattaatcgaattttaccgattcaaataacgaataaaatactaaccctaaacgtcgtcgtacaccacgaacaacacgttaaaattacgctaaacacgccgtacaaaatctaaaaacaccgacacatcgttatcccaaataacacgcgaaacaaccgaaaccaacaactctaccatatcgttaacgaaatccttcaaattcttttccaaaatactacgcaattactactattcgctttacaaacgtaccgacaaccctacactcaaacgctaacgaatactactaaacaaactatccaaacccgaacgcacatcttacccgacttactccaattcgccgaccaactaacgactatcattacccaaacgttcgccaaaatcgacctccaaaacaataaccgtacttcgaataaacgcaacgacaaccaacacctacaccaaaaaaacgataccaaaaacaacaaacacaaaccgcaaaaaacgacttcgtaacaataaaaaaataacaaacacgatataaccctcgtattttctaacgccactattttaataacatctacaaaaact

SEQ ID NO: 1305 - DNA, 860 bp, Artificial Sequence
  chemically treated genomic DNA (Homo sapiens) CpG-island No: 1305
ttcggcgtagaaatgaaaacgtcgtagttttttttagggttacggcgttagattagtttggagggtagattaggcgaacggatggcgtagtacgatggtttcgttgcggttcgggtcggtagaaatgatgtcgatcggcgcgtcgattaggttttcgatgcgtttgatgtaggcgcgagcgttggtcggtagtttttttagggttttaacgtttacggtcgattcgttttagtttggtattttttcgtatatcggttttaggtcgatgtagttgtcggtatcggacggcgcgtcgatgatagtatcgttttcgtttttgtagttaacgtagatgttgatggtttttaggtcgtttagtacgtttagtttggttaggtagatgttcgagatgttgttgacgtcgatggcgcgacgtaggattacggtatcgaattagtcgtaacgacgggtacggttagtggtggaatcgaattcgtggttacgtttggttagggtagcgtcggtttcgtcgaatagttcggtcgggaacggatcggaatttacgcgagtggtgtaggttttggtaatatttaggatgtagtttaggtatatcgggttaatatcggagtcggtggagatatcgttagcggtggtgttggagttggtgacgtacgggtaggtatcgtggtcgatgtttagtagcgagttttgggtattttcgaatatgatgtttttgttagcgcggcgtaggttgtgtagttcggcggtgacgtttagtattatcggtttgagttgtttagcgtaggttatgtattcgtttagggtttgttggaagtcgatggtcggttttttgtagtagtttattagttggaagttgtggt

SEQ ID NO: 1306 - DNA, 860 bp, Artificial Sequence
  chemically treated genomic DNA (Homo sapiens) CpG-island No: 1306
accacaacttccaactaataaactactacaaaaaaccgaccatcgacttccaacaaaccctaaacgaatacataacctacgctaaacaactcaaaccgataatactaaacgtcaccgccgaactacacaacctacgccgcgctaacaaaaacatcatattcgaaaatacccaaaactcgctactaaacatcgaccacgatacctacccgtacgtcaccaactccaacaccaccgctaacgatatctccaccgactccgatattaacccgatatacctaaactacatcctaaatattaccaaaacctacaccactcgcgtaaattccgatccgttcccgaccgaactattcgacgaaaccgacgctaccctaaccaaacgtaaccacgaattcgattccaccactaaccgtacccgtcgttacgactaattcgataccgtaatcctacgtcgcgccatcgacgtcaacaacatctcgaacatctacctaaccaaactaaacgtactaaacgacctaaaaaccatcaacatctacgttaactacaaaaacgaaaacgatactatcatcgacgcgccgtccgataccgacaactacatcgacctaaaaccgatatacgaaaaaataccaaactaaaacgaatcgaccgtaaacgttaaaaccctaaaaaaactaccgaccaacgctcgcgcctacatcaaacgcatcgaaaacctaatcgacgcgccgatcgacatcatttctaccgacccgaaccgcaacgaaaccatcgtactacgccatccgttcgcctaatctaccctccaaactaatctaacgccgtaaccctaaaaaaaactacgacgttttcatttctacgccgaa

SEQ ID NO: 1307 - DNA, 860 bp, Artificial Sequence
  chemically treated genomic DNA (Homo sapiens) CpG-island No: 1307
attataatttttagttggtgaattattataaagagtcggttatcgatttttagtaaattttggacgagtgtatggtttacgttgaatagtttaagtcgatgatgttggacgttatcgtcgaattgtataatttgcgtcgcgttggtaaggatattatgttcgaaggtgtttagggttcgttgttggatatcgattacggtatttattcgtacgttattagttttaatattatcgttggcggtatttttatcggtttcggtgttggttcgatgtatttggattatattttgggtattattaaggtttatattattcgcgtaggtttcggttcgttttcgatcgaattgttcgacgaaatcggcgttattttggttaagcgtggttacgagttcggttttattattggtcgtgttcgtcgttgcggttggttcgatgtcgtgattttgcgtcgcgttatcgacgttaatagtatttcgggtatttgtttgattaagttggacgtattggacggtttggaaattattaatatttgcgttggttataagaacgagaacggtgttgttatcgacgcgtcgttcgatgtcgatagttatatcggtttggagtcggtgtacgaagagatgttaggttggagcgagtcgatcgtgggcgttaaaattttggaagagttgtcggttaacgttcgcgtttatattaagcgtatcgaagatttgatcggcgcgtcgatcgatattatttttatcggttcggatcgtaacgagattatcgtgttgcgttattcgttcgtttgatttgttttttaggttgatttgacgtcgtggttttgaaaggggttgcggcgtttttatttttgcgtcgag

SEQ ID NO: 1308 - DNA, 860 bp, Artificial Sequence
  chemically treated genomic DNA (Homo sapiens) CpG-island No: 1308
ctcgacgcaaaaataaaaacgccgcaacccctttcaaaaccacgacgtcaaatcaacctaaaaaacaaatcaaacgaacgaataacgcaacacgataatctcgttacgatccgaaccgataaaaataatatcgatcgacgcgccgatcaaatcttcgatacgcttaatataaacgcgaacgttaaccgacaactcttccaaaattttaacgcccacgatcgactcgctccaacctaacatctcttcgtacaccgactccaaaccgatataactatcgacatcgaacgacgcgtcgataacaacaccgttctcgttcttataaccaacgcaaatattaataatttccaaaccgtccaatacgtccaacttaatcaaacaaatacccgaaatactattaacgtcgataacgcgacgcaaaatcacgacatcgaaccaaccgcaacgacgaacacgaccaataataaaaccgaactcgtaaccacgcttaaccaaaataacgccgatttcgtcgaacaattcgatcgaaaacgaaccgaaacctacgcgaataatataaaccttaataatacccaaaatataatccaaatacatcgaaccaacaccgaaaccgataaaaataccgccaacgataatattaaaactaataacgtacgaataaataccgtaatcgatatccaacaacgaaccctaaacaccttcgaacataatatccttaccaacgcgacgcaaattatacaattcgacgataacgtccaacatcatcgacttaaactattcaacgtaaaccatacactcgtccaaaatttactaaaaatcgataaccgactctttataataattcaccaactaaaaattataat

SEQ ID NO: 1309 - DNA, 680 bp, Artificial Sequence
  chemically treated genomic DNA (Homo sapiens) CpG-island No: 1309
gcgaaacgttcgcggtggaataggtcgtttacgcgtaggtcgcggcgcgtaattttgttttcgtaggtagggtcgatgttacggtcggtggtgtcgattttggtttcgttacgggttttttcgcgggtttggtttagggttacgtggtacgataggattagcggcgtagtcggggagatgcgtaggcgttcgcgtatcggtacgttttttttttttagtttggtgattttacgtattagggtattcggggtaacgattacgtcgttgtcgattaggtattgtacgtttttacgtaggatgtcggacggaattaggtgtagaacggtttttttatcgttgattattagggtgtgattcgcgttgtggttattttggtagcgtattacggcggtagtatgttcggttagtagatcgacgattttgtttttgtttttattattttattgggtgtttaggacgacgatatttttatttattatattggtttttatttacgtaaatttggttgtcggtttgttgtcgacgtagaaatttattgggttagcggtagaatttgttagcgttcgttttgttgaattaattgtcgattataattcgtttcgagagtagtatttaacggttggttaggtagggtttggattatacgttggttttcgttgcgtaattggtagatttgttgt

SEQ ID NO: 1310 - DNA, 680 bp, Artificial Sequence
  chemically treated genomic DNA (Homo sapiens) CpG-island No: 1310
acaacaaatctaccaattacgcaacgaaaaccaacgtataatccaaaccctacctaaccaaccgttaaatactactctcgaaacgaattataatcgacaattaattcaacaaaacgaacgctaacaaattctaccgctaacccaataaatttctacgtcgacaacaaaccgacaaccaaatttacgtaaataaaaaccaatataataaataaaaatatcgtcgtcctaaacacccaataaaataataaaaacaaaaacaaaatcgtcgatctactaaccgaacatactaccgccgtaatacgctaccaaaataaccacaacgcgaatcacaccctaataatcaacgataaaaaaaccgttctacacctaattccgtccgacatcctacgtaaaaacgtacaatacctaatcgacaacgacgtaatcgttaccccgaataccctaatacgtaaaatcaccaaactaaaaaaaaaaaacgtaccgatacgcgaacgcctacgcatctccccgactacgccgctaatcctatcgtaccacgtaaccctaaaccaaacccgcgaaaaaacccgtaacgaaaccaaaatcgacaccaccgaccgtaacatcgaccctacctacgaaaacaaaattacgcgccgcgacctacgcgtaaacgacctattccaccgcgaacgtttcgc

SEQ ID NO: 1311 - DNA, 680 bp, Artificial Sequence
  chemically treated genomic DNA (Homo sapiens) CpG-island No: 1311
gtagtaagtttgttagttgcgtagcgagggttagcgtgtggtttaggttttgtttggttagtcgttgagtgttgttttcgaggcggattgtgatcggtaattgatttagtaagacgggcgttggtaggttttgtcgttggtttagtgagtttttgcgtcggtaataggtcggtaattaagtttgcgtgaatgaggattaatgtaatgggtaagaatgtcgtcgttttgggtatttagtggggtgatgagggtaaaggtaagatcgtcgatttgttgatcgaatatgttgtcgtcgtagtgcgttattagggtggttataacgcgggttatattttggtgattaacggtgaaaagatcgttttgtatttgatttcgttcggtattttgcgtgaaggcgtatagtgtttgatcggtaacggcgtggtcgttgtttcggatgttttgatgcgtgaaattattaagttggaagagaagggcgtatcggtgcgcgagcgtttgcgtattttttcggttgcgtcgttgattttgtcgtattacgtggttttggattaggttcgcgaaaaagttcgtggcgaagttaagatcggtattatcggtcgtggtatcggttttgtttacgaagataaggttgcgcgtcgcggtttgcgcgtaggcgatttgttttatcgcgagcgtttcgt

SEQ ID NO: 1312 - DNA, 680 bp, Artificial Sequence
  chemically treated genomic DNA (Homo sapiens) CpG-island No: 1312
acgaaacgctcgcgataaaacaaatcgcctacgcgcaaaccgcgacgcgcaaccttatcttcgtaaacaaaaccgataccacgaccgataataccgatcttaacttcgccacgaactttttcgcgaacctaatccaaaaccacgtaatacgacaaaatcaacgacgcaaccgaaaaaatacgcaaacgctcgcgcaccgatacgcccttctcttccaacttaataatttcacgcatcaaaacatccgaaacaacgaccacgccgttaccgatcaaacactatacgccttcacgcaaaataccgaacgaaatcaaatacaaaacgatcttttcaccgttaatcaccaaaatataacccgcgttataaccaccctaataacgcactacgacgacaacatattcgatcaacaaatcgacgatcttacctttaccctcatcaccccactaaatacccaaaacgacgacattcttacccattacattaatcctcattcacgcaaacttaattaccgacctattaccgacgcaaaaactcactaaaccaacgacaaaacctaccaacgcccgtcttactaaatcaattaccgatcacaatccgcctcgaaaacaacactcaacgactaaccaaacaaaacctaaaccacacgctaaccctcgctacgcaactaacaaacttactac

SEQ ID NO: 1313 - DNA, 1286 bp, Artificial Sequence
  chemically treated genomic DNA (Homo sapiens) CpG-island No: 1313
tggtaatacgattttcgttcgttttagtgtgattagggtttttaaattcgtggagaaatcggtggtcgggcgcgttcggttaaagtcggcgtcgatgtcgtcgtaacgttcgttttgggcgatcgattgattttcgttcggtacgaatacggcgaatattacgttcgtgtgatagtggtaatcgcgtaattcgtcgaggtcgaagtatagcggtaggttcgggtagcgcgacgttaggcggttagcgatcgttagtaggtcgtttagcgcggttagtacgttggtcggggtacggtttaggcgtacgcgggtttcggttagtattttacggttatcgtatagttcgattagagcgcgtagtatgttgtttaggtttttcggtaggtcggcggttagcgtttgtattttatcgatagttttgcgttgtatggcgtcgaatagttgttgttttatcgtatcggataggtcggcggtacgggttaggttacggtagatattaacgtggtttaggtttatgtgtatattcggtatatcggttagttgtagcgtggcgagtattaggttgatgatttcgatattattggtagggttggtatcgtcgtaaagttcggtatttagttggatcgggttgcgcgaggtcgatagtgtacgcggttgggcgtgtagtacgttatcggtatagtataggcggttcgggtttttacggcgtagggtgtgggcgttaatgcgcgttatttgcggagtgaagtcggcgcggaagtttattaggcggtcggattgtgggtttattattttgaaggtgcgttgatttaggttttggtcggcgtcggtgagtagcgattttaggtattcgatatgcggggtgacgattagttcgtagttttaattttggaataggtttaatatttggcggcgcgcgatttcgatgcgcgtagttttaggtggtagtattttttcgatgttatttggtagtagttagcggtttatcgttgttattacgttattttttttttggttcgggcggtttgttagtaggcgagtcgttagtaaagtcggtatcgcgtatagtagcgggtagtattgattttagcgtagttatcgtattcgatattttcgaattgttttgcgagttgattaaatcgttaattggcgcgttgttaattaattttgtagacgtaaaaaagtcgggaaatttttcggttgttttattatatatttttttttatttaggatgtatttcgtttggtgttttagttgttaggcggggcgtcgttgtatgaaaatta

SEQ ID NO: 1314 - DNA, 1286 bp, Artificial Sequence
  chemically treated genomic DNA (Homo sapiens) CpG-island No: 1314
taattttcatacaacgacgccccgcctaacaactaaaacaccaaacgaaatacatcctaaataaaaaaaaatatataataaaacaaccgaaaaatttcccgacttttttacgtctacaaaattaattaacaacgcgccaattaacgatttaatcaactcgcaaaacaattcgaaaatatcgaatacgataactacgctaaaatcaatactacccgctactatacgcgataccgactttactaacgactcgcctactaacaaaccgcccgaaccaaaaaaaaaataacgtaataacaacgataaaccgctaactactaccaaataacatcgaaaaaatactaccacctaaaactacgcgcatcgaaatcgcgcgccgccaaatattaaacctattccaaaattaaaactacgaactaatcgtcaccccgcatatcgaatacctaaaatcgctactcaccgacgccgaccaaaacctaaatcaacgcaccttcaaaataataaacccacaatccgaccgcctaataaacttccgcgccgacttcactccgcaaataacgcgcattaacgcccacaccctacgccgtaaaaacccgaaccgcctatactataccgataacgtactacacgcccaaccgcgtacactatcgacctcgcgcaacccgatccaactaaataccgaactttacgacgataccaaccctaccaataatatcgaaatcatcaacctaatactcgccacgctacaactaaccgatataccgaatatacacataaacctaaaccacgttaatatctaccgtaacctaacccgtaccgccgacctatccgatacgataaaacaacaactattcgacgccatacaacgcaaaactatcgataaaatacaaacgctaaccgccgacctaccgaaaaacctaaacaacatactacgcgctctaatcgaactatacgataaccgtaaaatactaaccgaaacccgcgtacgcctaaaccgtaccccgaccaacgtactaaccgcgctaaacgacctactaacgatcgctaaccgcctaacgtcgcgctacccgaacctaccgctatacttcgacctcgacgaattacgcgattaccactatcacacgaacgtaatattcgccgtattcgtaccgaacgaaaatcaatcgatcgcccaaaacgaacgttacgacgacatcgacgccgactttaaccgaacgcgcccgaccaccgatttctccacgaatttaaaaaccctaatcacactaaaacgaacgaaaatcgtattacca

SEQ ID NO: 1315 - DNA, 1286 bp, Artificial Sequence
  chemically treated genomic DNA (Homo sapiens) CpG-island No: 1315
tgatttttatgtagcggcgtttcgtttggtagttaaaatattaggcggggtgtattttgaatgaaaaggggtgtatgatgaggtagtcgggaaatttttcggtttttttgcgtttgtaaggttgattggtaacgcgttagttgacggtttggttagttcgtaaggtaattcgagggtatcgggtacggtggttgcgttgggattagtgttgttcgttgttgtgcgcgatatcggttttattgacggttcgtttgttggtaagtcgttcggattagaggggaaatggcgtaatggtaacggtagatcgttggttgttgttagatggtatcgaggaagtattgttatttgaagttgcgcgtatcgagatcgcgcgtcgttaggtgttggatttgttttagagttggggttacgaattggtcgttatttcgtatatcgagtatttggagtcgttgtttatcggcgtcggttaggatttggattagcgtatttttaaggtggtggatttatagttcggtcgtttgatgggttttcgcgtcgattttatttcgtaggtggcgcgtattgacgtttatattttgcgtcgtgaaggttcgagtcgtttgtgttatgtcggtagcgtgttgtacgtttagtcgcgtgtattgtcgatttcgcgtagttcgatttagttgggtgtcgagttttacggcgatgttagttttattagtgatgtcgaagttattagtttgatgttcgttacgttgtagttggtcgatgtgtcggatgtgtatatggatttgggttacgttggtatttatcgtggtttggttcgtgtcgtcggtttgttcggtgcggtggagtagtagttgttcgacgttatgtaacgtaaggttgtcgatgaagtgtaggcgttgatcgtcgatttgtcgaaagatttgggtaatatgttgcgcgttttggtcgagttgtgcggtggtcgtgaagtgttggtcgaagttcgcgtgcgtttgggtcgtgtttcggttagcgtgttggtcgcgttggacgatttgttggcgatcgttgatcgtttggcgtcgcgttattcggatttgtcgttgtatttcgatttcggcgaattgcgcggttattattattatacgggcgtggtgttcgtcgtgttcgtatcgggcgaaggttagtcgatcgtttagggcgggcgttacgacgatatcggcgtcgattttggtcgggcgcgttcggttatcggtttttttacggatttgaagattttggttatattggggcgagcggaggtcgtattgtta

SEQ ID NO: 1316 - DNA, 1286 bp, Artificial Sequence
  chemically treated genomic DNA (Homo sapiens) CpG-island No: 1316
taacaatacgacctccgctcgccccaatataaccaaaatcttcaaatccgtaaaaaaaccgataaccgaacgcgcccgaccaaaatcgacgccgatatcgtcgtaacgcccgccctaaacgatcgactaaccttcgcccgatacgaacacgacgaacaccacgcccgtataataataataaccgcgcaattcgccgaaatcgaaatacaacgacaaatccgaataacgcgacgccaaacgatcaacgatcgccaacaaatcgtccaacgcgaccaacacgctaaccgaaacacgacccaaacgcacgcgaacttcgaccaacacttcacgaccaccgcacaactcgaccaaaacgcgcaacatattacccaaatctttcgacaaatcgacgatcaacgcctacacttcatcgacaaccttacgttacataacgtcgaacaactactactccaccgcaccgaacaaaccgacgacacgaaccaaaccacgataaataccaacgtaacccaaatccatatacacatccgacacatcgaccaactacaacgtaacgaacatcaaactaataacttcgacatcactaataaaactaacatcgccgtaaaactcgacacccaactaaatcgaactacgcgaaatcgacaatacacgcgactaaacgtacaacacgctaccgacataacacaaacgactcgaaccttcacgacgcaaaatataaacgtcaatacgcgccacctacgaaataaaatcgacgcgaaaacccatcaaacgaccgaactataaatccaccaccttaaaaatacgctaatccaaatcctaaccgacgccgataaacaacgactccaaatactcgatatacgaaataacgaccaattcgtaaccccaactctaaaacaaatccaacacctaacgacgcgcgatctcgatacgcgcaacttcaaataacaatacttcctcgataccatctaacaacaaccaacgatctaccgttaccattacgccatttcccctctaatccgaacgacttaccaacaaacgaaccgtcaataaaaccgatatcgcgcacaacaacgaacaacactaatcccaacgcaaccaccgtacccgataccctcgaattaccttacgaactaaccaaaccgtcaactaacgcgttaccaatcaaccttacaaacgcaaaaaaaccgaaaaatttcccgactacctcatcatacaccccttttcattcaaaatacaccccgcctaatattttaactaccaaacgaaacgccgctacataaaaatca

SEQ ID NO: 1317 - DNA, 1057 bp, Artificial Sequence
  chemically treated genomic DNA (Homo sapiens) CpG-island No: 1317
ggtaacggaagaattcgtttttcgggtttaggattagtacgtcgtttttgttcgagaagttttcgcggtatgtttgtaggttacggtggaacgtatagaaattagcgttttggttgtaggttttggtatagatggcggtcgtttgagcgtcgtcgttattacgggttttttttgtttcgcggtaggtttcggttagtagtatacggcgttgacggtcggcgtcggtacgaatatttttagttagttcgttatttttggtacggtgttcgcgcgttttacgtttacgttttgtgtttatgcggtcgaatacgttgcggttgatttttttcggtaggtcgatggttttgacgcgtacgtcgattattttaatgtttagttttttgttggttatgcggtttaatgatgtagtgatgttagttattagtgcgttacgtttatcggaaattatttcgtgtagggtacgtttatcgaattggtcgcgtaggtcgttttttagacgacgcgatagacgttcgtcggcgatttgttttatgtcggacgtggcggtgtagaagcgtttcgtatttttgacgcgttatttggcgtaggcgtcgattattatcgtttttttttttagggttaggaatcgttgggtcggggcgtcgagggttatgaggcgggcgtcgaatttgcgtatttggtttacgtacgggatttttacgtgtaggttcggttgaatatttgtttggattattttatcgaagcgtagtagtatcgtacgttcggtttgggatacgatgtagaagttgttttaggttacgatggttagaattacggcggcgattagggcgattagcgatttattgtttattagcggttttttttagtacgtagcggttgttgttgttgttgtaggttttgcgtcgtacgggcggtcgtatcgttgatcgatggcgatacgttggtggttggcgcggacgggttgcggttgttttcgattattttgtttagtggtaggtagagtaggttgttttgttcgtttttggtcgttattatgattttgttcgaattgttgtag

SEQ ID NO: 1318 - DNA, 1057 bp, Artificial Sequence
  chemically treated genomic DNA (Homo sapiens) CpG-island No: 1318
ctacaacaattcgaacaaaatcataataacgaccaaaaacgaacaaaacaacctactctacctaccactaaacaaaataatcgaaaacaaccgcaacccgtccgcgccaaccaccaacgtatcgccatcgatcaacgatacgaccgcccgtacgacgcaaaacctacaacaacaacaacaaccgctacgtactaaaaaaaaccgctaataaacaataaatcgctaatcgccctaatcgccgccgtaattctaaccatcgtaacctaaaacaacttctacatcgtatcccaaaccgaacgtacgatactactacgcttcgataaaataatccaaacaaatattcaaccgaacctacacgtaaaaatcccgtacgtaaaccaaatacgcaaattcgacgcccgcctcataaccctcgacgccccgacccaacgattcctaaccctaaaaaaaaaaacgataataatcgacgcctacgccaaataacgcgtcaaaaatacgaaacgcttctacaccgccacgtccgacataaaacaaatcgccgacgaacgtctatcgcgtcgtctaaaaaacgacctacgcgaccaattcgataaacgtaccctacacgaaataatttccgataaacgtaacgcactaataactaacatcactacatcattaaaccgcataaccaacaaaaaactaaacattaaaataatcgacgtacgcgtcaaaaccatcgacctaccgaaaaaaatcaaccgcaacgtattcgaccgcataaacacaaaacgtaaacgtaaaacgcgcgaacaccgtaccaaaaataacgaactaactaaaaatattcgtaccgacgccgaccgtcaacgccgtatactactaaccgaaacctaccgcgaaacaaaaaaaacccgtaataacgacgacgctcaaacgaccgccatctataccaaaacctacaaccaaaacgctaatttctatacgttccaccgtaacctacaaacataccgcgaaaacttctcgaacaaaaacgacgtactaatcctaaacccgaaaaacgaattcttccgttacc

SEQ ID NO: 1319 - DNA, 1057 bp, Artificial Sequence
  chemically treated genomic DNA (Homo sapiens) CpG-island No: 1319
ttatagtaattcgagtaaggttatggtggcgattaaggacgggtagaataatttgttttatttgttattggataagatggtcgaaggtagtcgtaattcgttcgcgttaattattagcgtgtcgttatcggttaacgatgcggtcgttcgtgcggcgtaggatttgtaatagtaatagtagtcgttgcgtattagggagagtcgttgatgagtaatagatcgttgatcgttttgatcgtcgtcgtggttttggttatcgtggtttggaatagtttttatatcgtgttttagatcgagcgtgcggtattgttgcgtttcggtaaggtggtttaggtagatgtttagtcgggtttgtacgtgaagatttcgtacgtgaattaggtgcgtaagttcgacgttcgttttatgattttcgacgtttcgatttagcggtttttgattttggagaagaaagcggtgatggtcgacgtttacgttaagtggcgcgttaaggatgcggagcgtttttatatcgttacgttcggtatgaagtagatcgtcgacgagcgtttgtcgcgtcgtttggaaagcggtttgcgcgattagttcggtaaacgtattttgtacgaggtggttttcggtgagcgtgacgtattgatggttgatattattgtattattgaatcgtatggttaataaggagttgggtattgaagtggtcgacgtgcgcgttaaggttatcgatttgtcgaaggaagttaatcgtagcgtgttcgatcgtatgagtatagagcgtgagcgtgaagcgcgcgagtatcgtgttaagggtaacgagttggttgaaggtattcgtgtcgacgtcgatcgttagcgtcgtgtgttgttggtcgaggtttatcgcgaagtagaagaaattcgtggtgacggcgacgtttaggcggtcgttatttatgttaaggtttatagttaggacgttgatttttatgcgttttatcgtagtttgtaggtatatcgcgagagtttttcgagtaagagcgacgtgttggttttggattcgaagaacgaattttttcgttatt

SEQ ID NO: 1320 - DNA, 1057 bp, Artificial Sequence
  chemically treated genomic DNA (Homo sapiens) CpG-island No: 1320
aataacgaaaaaattcgttcttcgaatccaaaaccaacacgtcgctcttactcgaaaaactctcgcgatatacctacaaactacgataaaacgcataaaaatcaacgtcctaactataaaccttaacataaataacgaccgcctaaacgtcgccgtcaccacgaatttcttctacttcgcgataaacctcgaccaacaacacacgacgctaacgatcgacgtcgacacgaataccttcaaccaactcgttacccttaacacgatactcgcgcgcttcacgctcacgctctatactcatacgatcgaacacgctacgattaacttccttcgacaaatcgataaccttaacgcgcacgtcgaccacttcaatacccaactccttattaaccatacgattcaataatacaataatatcaaccatcaatacgtcacgctcaccgaaaaccacctcgtacaaaatacgtttaccgaactaatcgcgcaaaccgctttccaaacgacgcgacaaacgctcgtcgacgatctacttcataccgaacgtaacgatataaaaacgctccgcatccttaacgcgccacttaacgtaaacgtcgaccatcaccgctttcttctccaaaatcaaaaaccgctaaatcgaaacgtcgaaaatcataaaacgaacgtcgaacttacgcacctaattcacgtacgaaatcttcacgtacaaacccgactaaacatctacctaaaccaccttaccgaaacgcaacaataccgcacgctcgatctaaaacacgatataaaaactattccaaaccacgataaccaaaaccacgacgacgatcaaaacgatcaacgatctattactcatcaacgactctccctaatacgcaacgactactattactattacaaatcctacgccgcacgaacgaccgcatcgttaaccgataacgacacgctaataattaacgcgaacgaattacgactaccttcgaccatcttatccaataacaaataaaacaaattattctacccgtccttaatcgccaccataaccttactcgaattactataa

SEQ ID NO: 1321 - DNA, 4704 bp, Artificial Sequence
  chemically treated genomic DNA (Homo sapiens) CpG-island No: 1321
acgggttacgttaggtgttttgtggtattcggcgattagtttggtgaagcggtcggttttatttttggttcgggtaatgatttcgtcgcggtaatcgttggcgttttcgatgatgcgttgggtttgattacgggttttcggtattacgttattggcgtaggattcggtttggttgcgggtacgttgttcgttttcgcgggtacggattacgtcgtcgaaggttttttgtattttacgcggggtcgtcgcgttttgtacgttgatttgggtgacggtgatatcggtacggtagttgtcgaggaagcgttgtaggcgttcgcggatatttacggttatttgtttacggttttcggtgagtatttgatttatcgaggtggaatttattacgtggcgtagggtattgtcggtcgcgtgttgtaggtttattttaggttggtcgatattgagtacgaagttttgtaggttgttgattttgtattggacggttagcggtatttcgacgatgttttcgttttcggttagtatttggttttgtttggtgtaggtacgtttacgcgtgacgttttttatgtatttgcgatcgatcggcgggaagtagatgtttaggtcgggatcgatcgttttatagtatttgtcgaagcgtagtattacggtttgtttttgttcgtcgattacgtatacggcgttgtatagttagatggtagttagtatcgttaggttaatgtttagtaggttaaggttatcgtttttgtcgatattgcggttatcgtcgttacgttttttgttattgtcgaatatgttatttaggttgttttgtaatttgcggaaggtttcgtttagattcggcggattttttttgttattattatcgttatcgttattacggcggtcgttttagggattttcggtgacgatttttttagcggcgatgaattcgttggtgataatgttttcggcgattttacgtagggtaataacggttggtttgtcgtttttttacgtaacgcgtggttttttgtcgtcggtcgttagttggcgagcgcgtttggtcgagagtatgattagtttaaagcggttatttacgtgttttaggtagtttttaatagttacgcgggttatggttttttttagtagtaaatgcggtgggcgtgtagtttagtaatgggtaggcggattcgatagtataaaaatttattagttaatagggaagcgttgttttgtcgggtggatcggtgtggaattttttacgggtatgttcgtttttataagttttgtttattttttatcgtcgtcgttttatttgtgggagcgggtaagttcgcgaaagggtcggaatagatagttttaaatttgaattcgacgataattttagagtatcgcgttacgtaatcgcggcgtaagttttttaaataaggtttgtatcgagcgtagcgttcggtagttcggtcgggttagtagttataattgggtgtcgtaattcggtagcggtttatttagcgtatttacgttcggtagggtatgtattatataattcggtagcgtcgttacgtttaggttagcggttattagttgggcgatggtcgatatgttgttgtattgatagcgcggatttagtttcgggtgttgttggttgcgttagattatcgtagggtggtttattatcgagttatcgggggcgatttacggtacgttggcgggcgattcggttagacgttcgcgttattgtggttggtcgtagacgatataggaggtagaatttaggttgcggtttattaggtgtttcggtggcgtgttggttaggcgtagggcgatgtcggtatcgcgtcgattgaggttggtaaacgtgttggaggtgtttatttttagcgataacgtcgggtagttgggtatgaattcggttagcgtcggtagtaagagattgtgtattatcgtttcggtataggttagtcgtatcgtgtcgtttattatttgttcgttattggttatggtaatgcgcgtcgtttttagtgtttgtttcgcgcgttcggtttgttcggttagcgtttgagcggtgtcggtcggtaggtagtttttgcggtttttgacgaataaggcggtgtttagcgtcgattttagtcggcggatcgagcggaatattgtcgaaatatcgatttttagtagttcggcggttttggttagcgagcggtttcgttttagtgttaggattagggaaaggttcgcgtgggtgatttgatattgtattggtgtacgttttgtttgtcgaattgttaatgtttgttgcgttagggttattttatagtgaaacggtttttcggaattaatgcgttcggtcgggtaattagtttttacgatgggaaagtgaaaagaataatagttgtaattatcgtcgttcgtgaggcgttagtcgtattttatatcgtcgtagtatattaaaggatgtatattatgacgtcggtaatttcgtgcgttagtttttttagcgagatgaatgattttttttaggtttattcggatacgtagtacgtcgatttgttgattttcgatatgaatggcgtggtacgtggtaagcgtattgagcgggttagtttgtataaggtgtacgagaagggtattaatttgttcgtatcgttgttcgttttggatattaatggttttatcgtcgagagtatcggttttggtttggatatcggcgatgtcgatcgtatttgtttttcgatttcgggtacgttgtcggatgagtcgtggtagaagcgttttacggtttagttgttgatgattatgtacgagttggatggttagtcgtttttcgtcgattcgcgcgaagtgttgcgttaggtggtgagtaagttcgacgatttgggtttggatatttgcgcggcgttcgagttggagttttatttgatcgattaggataattttaacggtcgttcgtagtcgtcgcgttcgtttattttcggtaaacgttcgtagtcgatttaggtgtatttgatcgacgatttcgatgaatacgtcgattgtttgtaggatatgtttgaagtcgttaaggaataaggtttgttcgtcgacgttatcgttaaggaaagcgtttcggcgtagttcgaagttaatttgtattacgtggtcgattcgttgaaggtttgtgattacgcgattttgtttaagcgtttgattaagaacgtggtttacgattatgaaatggatattacgtttatggttaagttttattcgggttaggtaggtaatggtttgtacgtatatatttcgttgttggataagaaaatcggtaagaatatttttgttagtgatgattcgttgtaaagcgatacgttgcgttacgttatcggtggtgtgttggaaattatgtcggcgtcgatggcgtttttgtgttcgaatattaatttttatcgtcgttttggcgcgtagttttacgtgtttaatgcgttaagttggggtttggataatcgtatcgtggtcgtacgcgtgtttatcgatagtagcgataacgtgcgtttggagtatcgtgtggttggcgtcgacgttaattcgtatttgatgttggtagttattttggtcggcgtgtattacgggttgattaataaggtcgagtcggaggcgtcgatcgaaggtaatttttacgaatagttggagtaaagtttgtcgaataatttgcgcgatgttttgcgcgcgttggacgatagcgaagtttttaattaatatattagttcggattatatcgatattttcgtggtttgtaaggaaagcgaattggtcgagttcgaagtgtcgattttcgattttgagtataattggtatttgtatacggtgtaagtttatgagcgtaattgcggtttttttgatcggtgttagcgtttgtcgttagtaggtggggaagaattcgtcgtatacggtaggcgataagtatgtcgaggcggtcggttttgtcggtttgtcgttgattttgtcggttcgcgacggaggtagcgatttataggcgttgttggtttgtttgtacggtattgtttttataggttcgtttttaaatatcgaatcgtattattataatggcgtttttagcgtggcgggtattcggtacgatttggcgcgtgatcggttgattttgttattgttgtaggcggcgattgtcgtcggtgtgtcggtgttttgtatttgtcgtggttattaggaattgaacgtggtttttggcggtagtttgtattaacgcgtgtaggagttgtttggttattttgattatcgcgaatttgaggacgtatttttggaggtgtaatacggttttcgttattcggtcggtatcgagtttggcgggttgttcgagcgtttgggtttggcggcgtagttcgaggttaattcgttgtatagttagggtatcgatcgtttggttttcggtttgcgcgtcgaggtacgggtttcggatggtttgatcgaagtagtgtttatgttcgatgcgtcgggttttgtgttcggtgtgtagtggtattcggagtggcgttttaacgaaaattcggtttcgttgcgtttgttttaggcgtttcgcgaggtttgtattgtttacgtagtacgggagggcgtacggtaggaatgattttgacgttagtcgaaggtttcggatgatttgttttcgatagtaagtttttaatgagtgaaagcgggttttgtacgtaaggtttgtgaaaataattttaaaat

SEQ ID NO: 1322 - DNA, 4704 bp, Artificial Sequence
  chemically treated genomic DNA (Homo sapiens) CpG-island No: 1322
attttaaaattattttcacaaaccttacgtacaaaacccgctttcactcattaaaaacttactatcgaaaacaaatcatccgaaaccttcgactaacgtcaaaatcattcctaccgtacgccctcccgtactacgtaaacaatacaaacctcgcgaaacgcctaaaacaaacgcaacgaaaccgaattttcgttaaaacgccactccgaataccactacacaccgaacacaaaacccgacgcatcgaacataaacactacttcgatcaaaccatccgaaacccgtacctcgacgcgcaaaccgaaaaccaaacgatcgataccctaactatacaacgaattaacctcgaactacgccgccaaacccaaacgctcgaacaacccgccaaactcgataccgaccgaataacgaaaaccgtattacacctccaaaaatacgtcctcaaattcgcgataatcaaaataaccaaacaactcctacacgcgttaatacaaactaccgccaaaaaccacgttcaattcctaataaccacgacaaatacaaaacaccgacacaccgacgacaatcgccgcctacaacaataacaaaatcaaccgatcacgcgccaaatcgtaccgaatacccgccacgctaaaaacgccattataataatacgattcgatatttaaaaacgaacctataaaaacaataccgtacaaacaaaccaacaacgcctataaatcgctacctccgtcgcgaaccgacaaaatcaacgacaaaccgacaaaaccgaccgcctcgacatacttatcgcctaccgtatacgacgaattcttccccacctactaacgacaaacgctaacaccgatcaaaaaaaccgcaattacgctcataaacttacaccgtatacaaataccaattatactcaaaatcgaaaatcgacacttcgaactcgaccaattcgctttccttacaaaccacgaaaatatcgatataatccgaactaatatattaattaaaaacttcgctatcgtccaacgcgcgcaaaacatcgcgcaaattattcgacaaactttactccaactattcgtaaaaattaccttcgatcgacgcctccgactcgaccttattaatcaacccgtaatacacgccgaccaaaataactaccaacatcaaatacgaattaacgtcgacgccaaccacacgatactccaaacgcacgttatcgctactatcgataaacacgcgtacgaccacgatacgattatccaaaccccaacttaacgcattaaacacgtaaaactacgcgccaaaacgacgataaaaattaatattcgaacacaaaaacgccatcgacgccgacataatttccaacacaccaccgataacgtaacgcaacgtatcgctttacaacgaatcatcactaacaaaaatattcttaccgattttcttatccaacaacgaaatatatacgtacaaaccattacctacctaacccgaataaaacttaaccataaacgtaatatccatttcataatcgtaaaccacgttcttaatcaaacgcttaaacaaaatcgcgtaatcacaaaccttcaacgaatcgaccacgtaatacaaattaacttcgaactacgccgaaacgctttccttaacgataacgtcgacgaacaaaccttattccttaacgacttcaaacatatcctacaaacaatcgacgtattcatcgaaatcgtcgatcaaatacacctaaatcgactacgaacgtttaccgaaaataaacgaacgcgacgactacgaacgaccgttaaaattatcctaatcgatcaaataaaactccaactcgaacgccgcgcaaatatccaaacccaaatcgtcgaacttactcaccacctaacgcaacacttcgcgcgaatcgacgaaaaacgactaaccatccaactcgtacataatcatcaacaactaaaccgtaaaacgcttctaccacgactcatccgacaacgtacccgaaatcgaaaaacaaatacgatcgacatcgccgatatccaaaccaaaaccgatactctcgacgataaaaccattaatatccaaaacgaacaacgatacgaacaaattaatacccttctcgtacaccttatacaaactaacccgctcaatacgcttaccacgtaccacgccattcatatcgaaaatcaacaaatcgacgtactacgtatccgaataaacctaaaaaaaatcattcatctcgctaaaaaaactaacgcacgaaattaccgacgtcataatatacatcctttaatatactacgacgatataaaatacgactaacgcctcacgaacgacgataattacaactattattcttttcactttcccatcgtaaaaactaattacccgaccgaacgcattaattccgaaaaaccgtttcactataaaataaccctaacgcaacaaacattaacaattcgacaaacaaaacgtacaccaatacaatatcaaatcacccacgcgaacctttccctaatcctaacactaaaacgaaaccgctcgctaaccaaaaccgccgaactactaaaaatcgatatttcgacaatattccgctcgatccgccgactaaaatcgacgctaaacaccgccttattcgtcaaaaaccgcaaaaactacctaccgaccgacaccgctcaaacgctaaccgaacaaaccgaacgcgcgaaacaaacactaaaaacgacgcgcattaccataaccaataacgaacaaataataaacgacacgatacgactaacctataccgaaacgataatacacaatctcttactaccgacgctaaccgaattcatacccaactacccgacgttatcgctaaaaataaacacctccaacacgtttaccaacctcaatcgacgcgataccgacatcgccctacgcctaaccaacacgccaccgaaacacctaataaaccgcaacctaaattctacctcctatatcgtctacgaccaaccacaataacgcgaacgtctaaccgaatcgcccgccaacgtaccgtaaatcgcccccgataactcgataataaaccaccctacgataatctaacgcaaccaacaacacccgaaactaaatccgcgctatcaatacaacaacatatcgaccatcgcccaactaataaccgctaacctaaacgtaacgacgctaccgaattatataatacataccctaccgaacgtaaatacgctaaataaaccgctaccgaattacgacacccaattataactactaacccgaccgaactaccgaacgctacgctcgatacaaaccttatttaaaaaacttacgccgcgattacgtaacgcgatactctaaaattatcgtcgaattcaaatttaaaactatctattccgaccctttcgcgaacttacccgctcccacaaataaaacgacgacgataaaaaataaacaaaacttataaaaacgaacatacccgtaaaaaattccacaccgatccacccgacaaaacaacgcttccctattaactaataaatttttatactatcgaatccgcctacccattactaaactacacgcccaccgcatttactactaaaaaaaaccataacccgcgtaactattaaaaactacctaaaacacgtaaataaccgctttaaactaatcatactctcgaccaaacgcgctcgccaactaacgaccgacgacaaaaaaccacgcgttacgtaaaaaaacgacaaaccaaccgttattaccctacgtaaaatcgccgaaaacattatcaccaacgaattcatcgccgctaaaaaaatcgtcaccgaaaatccctaaaacgaccgccgtaataacgataacgataataataacaaaaaaaatccgccgaatctaaacgaaaccttccgcaaattacaaaacaacctaaataacatattcgacaataacaaaaaacgtaacgacgataaccgcaatatcgacaaaaacgataaccttaacctactaaacattaacctaacgatactaactaccatctaactatacaacgccgtatacgtaatcgacgaacaaaaacaaaccgtaatactacgcttcgacaaatactataaaacgatcgatcccgacctaaacatctacttcccgccgatcgatcgcaaatacataaaaaacgtcacgcgtaaacgtacctacaccaaacaaaaccaaatactaaccgaaaacgaaaacatcgtcgaaataccgctaaccgtccaatacaaaatcaacaacctacaaaacttcgtactcaatatcgaccaacctaaaataaacctacaacacgcgaccgacaataccctacgccacgtaataaattccacctcgataaatcaaatactcaccgaaaaccgtaaacaaataaccgtaaatatccgcgaacgcctacaacgcttcctcgacaactaccgtaccgatatcaccgtcacccaaatcaacgtacaaaacgcgacgaccccgcgtaaaatacaaaaaaccttcgacgacgtaatccgtacccgcgaaaacgaacaacgtacccgcaaccaaaccgaatcctacgccaataacgtaataccgaaaacccgtaatcaaacccaacgcatcatcgaaaacgccaacgattaccgcgacgaaatcattacccgaaccaaaaataaaaccgaccgcttcaccaaactaatcgccgaataccacaaaacacctaacgtaacccgt

SEQ ID NO: 1323 - DNA, 4704 bp, Artificial Sequence
  chemically treated genomic DNA (Homo sapiens) CpG-island No: 1323
attttggaattgtttttataggttttgcgtataaggttcgtttttatttattgaaagtttgttgtcggggataagttattcgagattttcggttgacgttagaattatttttgtcgtgcgttttttcgtgttgcgtaggtaatgtaggtttcgcgaaacgtttgaaataggcgtagcgagatcgggttttcgttgaagcgttatttcgggtgttattgtatatcgagtataaagttcggcgtatcgggtatggatattgtttcgattaggttattcggggttcgtgtttcgacgcgtaagtcgggggttaggcggtcgatgttttggttgtgtaacgagttgatttcgaattgcgtcgttagatttaggcgttcgaataattcgttaggttcgatgtcgatcgggtgacgagggtcgtattgtatttttaggggtgcgtttttaggttcgcgatgattaaggtagttaggtagtttttgtacgcgttggtgtaggttgtcgttaagggttacgtttagtttttgatagttacggtaaatgtagaatatcggtatatcggcggtaatcgtcgtttgtagtagtggtaaggttagtcgattacgcgttaggtcgtgtcgggtattcgttacgttgggggcgttattgtaatgatgcggttcgatatttgaaggcgagtttgtaaaaataatgtcgtgtagataggttagtagcgtttgtgggtcgttgttttcgtcgcgggtcggtaagattagcggtaagtcgataaagtcggtcgtttcgatatatttgtcgtttatcgtgtgcgacgagtttttttttatttgttggcggtaggcgttgatatcgattaaggggatcgtagttgcgtttatgggtttatatcgtgtgtaggtattagttgtatttaaggtcggaaatcgatatttcgaattcggttagttcgttttttttgtaggttacgaagatatcgatgtagttcgggttgatgtattggttgaggatttcgttgtcgtttagcgcgcgtagggtatcgcgtaggttgttcggtaggttttgttttagttgttcgtaggagttgttttcgatcggcgttttcggttcgattttgttggttagttcgtgatgtacgtcggttaggatggttgttagtattaggtacgggttggcgtcggcgttagttatacggtgttttaggcgtacgttgtcgttgttgtcggtgggtacgcgtacggttacggtgcggttatttaggttttagtttggcgtattgggtacgtagaattgcgcgttaaagcggcgataagagttgatgttcgggtataggaacgttatcgacgtcggtatggtttttagtatattatcgatggcgtggcgtagcgtgtcgttttgtaacggattattattggtaaagatgtttttgtcggtttttttgtttagtaacgaaatgtgtacgtgtaggttattatttgtttggttcgggtagggtttggttatgaacgtggtgtttattttatggtcgtaggttacgtttttgattaggcgtttgagtaggatcgcgtaattataggtttttagcgggtcggttacgtggtgtaggttgatttcgaattgcgtcggggcgttttttttgacgatggcgtcggcgggtaggttttgttttttggcggttttaagtatgttttgtaggtagtcggcgtatttatcgagatcgtcgattaggtatatttgggtcgattgcgggcgtttgtcggaaatgggcgaacgcggcggttgcgggcgatcgttgaggttgttttggtcgattaggtagaattttagttcgaacgtcgcgtagatatttaggtttaagtcgtcgaatttgtttattatttggcgtaatatttcgcgcgggtcggcgaagaacggttggttatttagttcgtgtatggttattagtaattgggtcgtggggcgtttttgttacggtttattcgataacgtgttcgggatcgggaagtagatgcggtcggtatcgtcgatgtttaggttaaggtcggtgttttcgacggtggagttattgatgtttagggcgaatagcgatgcgggtaggttgatgtttttttcgtatattttgtgtaggttggttcgtttaatgcgtttgttacgtattacgttatttatgtcggagattagtaggtcgacgtattgcgtgttcggatgggtttggaggaagttatttatttcgttggaagaattggcgtacggggttatcgacgttatggtgtatattttttgatgtgttgcggcgatgtgggatacggttggcgttttacgggcgacgatggttgtagttgttgttttttttatttttttatcgtggggattggttattcgatcgggcgtattgatttcggggggtcgttttattataaaatggttttgacgtaatagatattggtaattcggtaagtagagcgtgtattaatgtaatattagattatttacgcggatttttttttggttttggtattggagcggggtcgttcgttggttaaggtcgtcgagttgttgaaagtcgatgtttcgatagtatttcgttcgattcgtcggttggagtcggcgttgggtatcgttttgttcgttaagagtcgtaagggttatttgtcgatcgatatcgtttaggcgttggtcgagtaggtcgaacgcgcggaataggtattggaggcggcgcgtattgttatgattagtggcgagtaggtggtaagcggtacggtgcggttgatttgtatcgaggcggtgatgtatagttttttgttgtcggcgttggtcgagtttatgtttaattattcggcgttatcgttggagatgggtatttttaatacgtttgttaattttagtcggcgcgatgtcgatatcgttttgcgtttgattaatacgttatcggagtatttggtgggtcgtaatttgggttttattttttatgtcgtttgcggttagttatagtggcgcgagcgtttggtcgagtcgttcgttaacgtgtcgtggatcgttttcgatgattcgatggtggattattttacggtggtttggcgtaattagtagtattcggggttgagttcgcgttattagtgtagtagtatgtcgattatcgtttaattggtgatcgttggtttaggcgtggcggcgttgtcggattatatggtgtatgttttgtcgggcgtggatgcgttgagtgggtcgttatcgggttgcgatatttaattgtggttgttgattcggtcggattgtcgggcgttgcgttcggtgtagattttgtttgaagagtttacgtcgcggttgcgtggcgcgatgttttgaggttatcgtcgagtttaggtttgaggttgtttgtttcggttttttcgcgggtttgttcgtttttataggtaaagcggcggcggtgagaaatgggtagaatttgtgggagcgggtatgttcgtgaagaattttatatcgatttattcgataaaatagcgtttttttattggttggtgaatttttatattatcgagttcgtttgtttattattgggttgtacgtttatcgtatttgttattgaggaagattatggttcgcgtaattgttgaagattgtttggaatacgtggataatcgttttgagttggttatgttttcgattaagcgcgttcgttagttggcgatcggcggtaaagagttacgcgttgcgtgggagaacgataagttaatcgttgttgttttgcgtgaaatcgtcgaaggtattgttattaacgagtttatcgtcgttgaagagatcgttatcgaggatttttggggcggtcgtcgtggtggcggtggcggtggtggtgataagaaaggttcgtcggatttggacgaggtttttcgtaaattgtaggatagtttgaatggtatgttcggtagtggtaagaaacgtggcggcggtgatcgtaatgtcggtaagggcggtggttttggtttgttgggtattggtttggcggtgttggttgttatttggttgtatagcgtcgtgtacgtggtcgacgagtaggagtaggtcgtggtgttgcgtttcggtaagtattatgagacggtcggtttcggtttgaatatttatttttcgtcgatcgatcgtaagtatatggaaaacgttacgcgtgagcgtgtttatattaagtagggttagatgttgatcgaagacgagaatatcgtcgaggtgtcgttgatcgtttagtataagattagtaatttgtaggatttcgtgtttaatgtcgattagtttgaggtaagtttgtagtacgcgatcgatagtgttttgcgttacgtggtgggttttatttcgatggattaggtgtttatcgaaggtcgtgagtagatggtcgtggatattcgcgagcgtttgtagcgttttttcgataattatcgtatcggtattatcgttatttaggttaacgtatagagcgcggcggtttcgcgtgaagtgtaggaagttttcgacgacgtgattcgtgttcgcgaagacgagtagcgtgttcgtaattaggtcgagttttacgttaatggcgtggtgtcggaagttcgtggttaggtttagcgtattatcgaggacgttaacggttatcgcgacgaagttattgttcgggttaagggtgaggtcgatcgttttattaagttggtcgtcgagtattataaggtatttgacgtgattcgt

SEQ ID NO: 1324 - DNA, 4704 bp, Artificial Sequence
  chemically treated genomic DNA (Homo sapiens) CpG-island No: 1324
acgaatcacgtcaaataccttataatactcgacgaccaacttaataaaacgatcgacctcacccttaacccgaacaataacttcgtcgcgataaccgttaacgtcctcgataatacgctaaacctaaccacgaacttccgacaccacgccattaacgtaaaactcgacctaattacgaacacgctactcgtcttcgcgaacacgaatcacgtcgtcgaaaacttcctacacttcacgcgaaaccgccgcgctctatacgttaacctaaataacgataataccgatacgataattatcgaaaaaacgctacaaacgctcgcgaatatccacgaccatctactcacgaccttcgataaacacctaatccatcgaaataaaacccaccacgtaacgcaaaacactatcgatcgcgtactacaaacttacctcaaactaatcgacattaaacacgaaatcctacaaattactaatcttatactaaacgatcaacgacacctcgacgatattctcgtcttcgatcaacatctaaccctacttaatataaacacgctcacgcgtaacgttttccatatacttacgatcgatcgacgaaaaataaatattcaaaccgaaaccgaccgtctcataatacttaccgaaacgcaacaccacgacctactcctactcgtcgaccacgtacacgacgctatacaaccaaataacaaccaacaccgccaaaccaatacccaacaaaccaaaaccaccgcccttaccgacattacgatcaccgccgccacgtttcttaccactaccgaacataccattcaaactatcctacaatttacgaaaaacctcgtccaaatccgacgaacctttcttatcaccaccaccgccaccgccaccacgacgaccgccccaaaaatcctcgataacgatctcttcaacgacgataaactcgttaataacaataccttcgacgatttcacgcaaaacaacaacgattaacttatcgttctcccacgcaacgcgtaactctttaccgccgatcgccaactaacgaacgcgcttaatcgaaaacataaccaactcaaaacgattatccacgtattccaaacaatcttcaacaattacgcgaaccataatcttcctcaataacaaatacgataaacgtacaacccaataataaacaaacgaactcgataatataaaaattcaccaaccaataaaaaaacgctattttatcgaataaatcgatataaaattcttcacgaacatacccgctcccacaaattctacccatttctcaccgccgccgctttacctataaaaacgaacaaacccgcgaaaaaaccgaaacaaacaacctcaaacctaaactcgacgataacctcaaaacatcgcgccacgcaaccgcgacgtaaactcttcaaacaaaatctacaccgaacgcaacgcccgacaatccgaccgaatcaacaaccacaattaaatatcgcaacccgataacgacccactcaacgcatccacgcccgacaaaacatacaccatataatccgacaacgccgccacgcctaaaccaacgatcaccaattaaacgataatcgacatactactacactaataacgcgaactcaaccccgaatactactaattacgccaaaccaccgtaaaataatccaccatcgaatcatcgaaaacgatccacgacacgttaacgaacgactcgaccaaacgctcgcgccactataactaaccgcaaacgacataaaaaataaaacccaaattacgacccaccaaatactccgataacgtattaatcaaacgcaaaacgatatcgacatcgcgccgactaaaattaacaaacgtattaaaaatacccatctccaacgataacgccgaataattaaacataaactcgaccaacgccgacaacaaaaaactatacatcaccgcctcgatacaaatcaaccgcaccgtaccgcttaccacctactcgccactaatcataacaatacgcgccgcctccaatacctattccgcgcgttcgacctactcgaccaacgcctaaacgatatcgatcgacaaataacccttacgactcttaacgaacaaaacgatacccaacgccgactccaaccgacgaatcgaacgaaatactatcgaaacatcgactttcaacaactcgacgaccttaaccaacgaacgaccccgctccaataccaaaaccaaaaaaaaatccgcgtaaataatctaatattacattaatacacgctctacttaccgaattaccaatatctattacgtcaaaaccattttataataaaacgaccccccgaaatcaatacgcccgatcgaataaccaatccccacgataaaaaaataaaaaaaacaacaactacaaccatcgtcgcccgtaaaacgccaaccgtatcccacatcgccgcaacacatcaaaaaatatacaccataacgtcgataaccccgtacgccaattcttccaacgaaataaataacttcctccaaacccatccgaacacgcaatacgtcgacctactaatctccgacataaataacgtaatacgtaacaaacgcattaaacgaaccaacctacacaaaatatacgaaaaaaacatcaacctacccgcatcgctattcgccctaaacatcaataactccaccgtcgaaaacaccgaccttaacctaaacatcgacgataccgaccgcatctacttcccgatcccgaacacgttatcgaataaaccgtaacaaaaacgccccacgacccaattactaataaccatacacgaactaaataaccaaccgttcttcgccgacccgcgcgaaatattacgccaaataataaacaaattcgacgacttaaacctaaatatctacgcgacgttcgaactaaaattctacctaatcgaccaaaacaacctcaacgatcgcccgcaaccgccgcgttcgcccatttccgacaaacgcccgcaatcgacccaaatatacctaatcgacgatctcgataaatacgccgactacctacaaaacatacttaaaaccgccaaaaaacaaaacctacccgccgacgccatcgtcaaaaaaaacgccccgacgcaattcgaaatcaacctacaccacgtaaccgacccgctaaaaacctataattacgcgatcctactcaaacgcctaatcaaaaacgtaacctacgaccataaaataaacaccacgttcataaccaaaccctacccgaaccaaacaaataataacctacacgtacacatttcgttactaaacaaaaaaaccgacaaaaacatctttaccaataataatccgttacaaaacgacacgctacgccacgccatcgataatatactaaaaaccataccgacgtcgataacgttcctatacccgaacatcaactcttatcgccgctttaacgcgcaattctacgtacccaatacgccaaactaaaacctaaataaccgcaccgtaaccgtacgcgtacccaccgacaacaacgacaacgtacgcctaaaacaccgtataactaacgccgacgccaacccgtacctaatactaacaaccatcctaaccgacgtacatcacgaactaaccaacaaaatcgaaccgaaaacgccgatcgaaaacaactcctacgaacaactaaaacaaaacctaccgaacaacctacgcgataccctacgcgcgctaaacgacaacgaaatcctcaaccaatacatcaacccgaactacatcgatatcttcgtaacctacaaaaaaaacgaactaaccgaattcgaaatatcgatttccgaccttaaatacaactaatacctacacacgatataaacccataaacgcaactacgatccccttaatcgatatcaacgcctaccgccaacaaataaaaaaaaactcgtcgcacacgataaacgacaaatatatcgaaacgaccgactttatcgacttaccgctaatcttaccgacccgcgacgaaaacaacgacccacaaacgctactaacctatctacacgacattatttttacaaactcgccttcaaatatcgaaccgcatcattacaataacgcccccaacgtaacgaatacccgacacgacctaacgcgtaatcgactaaccttaccactactacaaacgacgattaccgccgatataccgatattctacatttaccgtaactatcaaaaactaaacgtaacccttaacgacaacctacaccaacgcgtacaaaaactacctaactaccttaatcatcgcgaacctaaaaacgcacccctaaaaatacaatacgaccctcgtcacccgatcgacatcgaacctaacgaattattcgaacgcctaaatctaacgacgcaattcgaaatcaactcgttacacaaccaaaacatcgaccgcctaacccccgacttacgcgtcgaaacacgaaccccgaataacctaatcgaaacaatatccatacccgatacgccgaactttatactcgatatacaataacacccgaaataacgcttcaacgaaaacccgatctcgctacgcctatttcaaacgtttcgcgaaacctacattacctacgcaacacgaaaaaacgcacgacaaaaataattctaacgtcaaccgaaaatctcgaataacttatccccgacaacaaactttcaataaataaaaacgaaccttatacgcaaaacctataaaaacaattccaaaat

SEQ ID NO: 1325 - DNA, 1215 bp, Artificial Sequence
  chemically treated genomic DNA (Homo sapiens) CpG-island No: 1325
ggcgttggtcgataatttgttgattaatatcgttatttgttgcgtgtttatcgttttggcggtgtggatttgttgtcgcggtatcgttattattatgatcgtgtagtatggtttggtggttttgtagttggtggtgttgatcggttttgtcgtcgtcgttttcggcggtattatcgcgtcgttatcgttggcgtttgatttcgtttggtttaattcgttcggtgtcgagtcgttttcggtttttgtcgtcgggttgtcgttttcgatttttattttttggggttgggatatatgtttgatcgttagcgaggagtcggtgggtagcgaagaggtgtcgggtaaggtcgttatttggatcgtgatgttgattttcggtttgtatttgtttatcgttatcgttattttgtagtttgtcggtattagcgaaacgggttttggtttgaataattcgcgtatttaggagaacgtttttgtttatttggtcggttcggttatggggtcgttggcgattttgatgtttattgtcgtgttggttagtacggcggcgtcgttgtagtcgattttcgtggcgtcggcgcggatttttttggcgatggggtattacggtgcggtgtcgtcgaagttcgttagcgtttgtttacgttcgtaaatttttcgttacgttattatttgcgtaggtttggtagtaggtttgttttacgtgattatgcgtagtttgagcgagaacgtgttggtagatattattatcgcgttgggtatgatgatttgtttttattattcgttgatcgtatttgtttgcgtttggtattttcgtggtagtttgttcgatagtttgcgttattttattatgcgcggtttgtgttcgttggtgggtggggtgattttatcggtgattttcgtacggattgttatcgatagcgtttcgtcggatttcggtagtggttcgtatgtgggtgggttggggttggtgttcgtgattgtcgcgattatttcggtgttgggtatcgggttgatgatgttgtcgcgtatgcgcgcgtcggtttattttttgggggcgattttgcgttagtaggttattttgttattgtaggaataaatagttggggtcgttttgcggttttaattcgttttttagtcgattatttgttttagaagcgtcgtatgacgttgttgttgtttttttaatagtaagcgattcgagcggaatatcgtttt

SEQ ID NO: 1326 - DNA, 1215 bp, Artificial Sequence
  chemically treated genomic DNA (Homo sapiens) CpG-island No: 1326
aaaacgatattccgctcgaatcgcttactattaaaaaaacaacaacaacgtcatacgacgcttctaaaacaaataatcgactaaaaaacgaattaaaaccgcaaaacgaccccaactatttattcctacaataacaaaataacctactaacgcaaaatcgcccccaaaaaataaaccgacgcgcgcatacgcgacaacatcatcaacccgatacccaacaccgaaataatcgcgacaatcacgaacaccaaccccaacccacccacatacgaaccactaccgaaatccgacgaaacgctatcgataacaatccgtacgaaaatcaccgataaaatcaccccacccaccaacgaacacaaaccgcgcataataaaataacgcaaactatcgaacaaactaccacgaaaataccaaacgcaaacaaatacgatcaacgaataataaaaacaaatcatcatacccaacgcgataataatatctaccaacacgttctcgctcaaactacgcataatcacgtaaaacaaacctactaccaaacctacgcaaataataacgtaacgaaaaatttacgaacgtaaacaaacgctaacgaacttcgacgacaccgcaccgtaataccccatcgccaaaaaaatccgcgccgacgccacgaaaatcgactacaacgacgccgccgtactaaccaacacgacaataaacatcaaaatcgccaacgaccccataaccgaaccgaccaaataaacaaaaacgttctcctaaatacgcgaattattcaaaccaaaacccgtttcgctaataccgacaaactacaaaataacgataacgataaacaaatacaaaccgaaaatcaacatcacgatccaaataacgaccttacccgacacctcttcgctacccaccgactcctcgctaacgatcaaacatatatcccaaccccaaaaaataaaaatcgaaaacgacaacccgacgacaaaaaccgaaaacgactcgacaccgaacgaattaaaccaaacgaaatcaaacgccaacgataacgacgcgataataccgccgaaaacgacgacgacaaaaccgatcaacaccaccaactacaaaaccaccaaaccatactacacgatcataataataacgataccgcgacaacaaatccacaccgccaaaacgataaacacgcaacaaataacgatattaatcaacaaattatcgaccaacgcc

SEQ ID NO: 1327 - DNA, 1215 bp, Artificial Sequence
  chemically treated genomic DNA (Homo sapiens) CpG-island No: 1327
aaggcggtgtttcgttcgaatcgtttgttgttgaagaaatagtaataacgttatgcgacgtttttgaagtaaatgatcggttgaaaaacgagttggggtcgtagagcggttttaattatttatttttgtagtggtaaggtagtttgttgacgtagagtcgtttttaggaagtaagtcggcgcgcgtatgcgcgatagtattattagttcgatgtttagtatcgagatgatcgcggtaattacgaatattagttttaatttatttatatgcgagttattgtcgaagttcggcgaggcgttgtcgatggtagttcgtacgaagattatcgataggattattttatttattagcgggtataggtcgcgtatgatgaagtggcgtaggttgtcgaataggttgttacggaaatattagacgtaggtaaatgcggttagcgaataatagaagtagattattatgtttagcgcggtgatggtatttgttaatacgttttcgtttaggttacgtatggttacgtagaatagatttgttgttaggtttgcgtaaatagtggcgtagcggggggtttgcgaacgtgggtagacgttggcgaatttcggcggtatcgtatcgtagtattttatcgttaagagggttcgcgtcggcgttacgaaggtcgattgtaacgacgtcgtcgtattggttagtacggtaatggatattaggatcgttagcggttttatgatcgggtcggttaggtgggtaaagacgtttttttggatgcgcgggttgtttaggttaaggttcgtttcgttgatatcggtaaattgtagggtggcgatggcggtgaataggtataggtcgaggattagtattacggtttaggtggcggttttgttcggtattttttcgttgtttatcgatttttcgttgacggttaggtatgtgttttagttttagaagatgaagatcgaaagcgatagttcggcggtaaaggtcgagaacgattcgatatcgaacgggttgaattaggcgaaattaaacgttagcggtggcggcgcggtggtatcgtcgaaggcggcgacggtaaagtcgattaatattattaattgtaaggttattaggttatattgtacggttatggtggtggcgatgtcgcgatagtagatttatatcgttagggcgatgaatacgtaataggtaacgatgttgattaataggttatcggttaacgtt

SEQ ID NO: 1328 - DNA, 1215 bp, Artificial Sequence
  chemically treated genomic DNA (Homo sapiens) CpG-island No: 1328
aacgttaaccgataacctattaatcaacatcgttacctattacgtattcatcgccctaacgatataaatctactatcgcgacatcgccaccaccataaccgtacaatataacctaataaccttacaattaataatattaatcgactttaccgtcgccgccttcgacgataccaccgcgccgccaccgctaacgtttaatttcgcctaattcaacccgttcgatatcgaatcgttctcgacctttaccgccgaactatcgctttcgatcttcatcttctaaaactaaaacacatacctaaccgtcaacgaaaaatcgataaacaacgaaaaaataccgaacaaaaccgccacctaaaccgtaatactaatcctcgacctatacctattcaccgccatcgccaccctacaatttaccgatatcaacgaaacgaaccttaacctaaacaacccgcgcatccaaaaaaacgtctttacccacctaaccgacccgatcataaaaccgctaacgatcctaatatccattaccgtactaaccaatacgacgacgtcgttacaatcgaccttcgtaacgccgacgcgaaccctcttaacgataaaatactacgatacgataccgccgaaattcgccaacgtctacccacgttcgcaaaccccccgctacgccactatttacgcaaacctaacaacaaatctattctacgtaaccatacgtaacctaaacgaaaacgtattaacaaataccatcaccgcgctaaacataataatctacttctattattcgctaaccgcatttacctacgtctaatatttccgtaacaacctattcgacaacctacgccacttcatcatacgcgacctatacccgctaataaataaaataatcctatcgataatcttcgtacgaactaccatcgacaacgcctcgccgaacttcgacaataactcgcatataaataaattaaaactaatattcgtaattaccgcgatcatctcgatactaaacatcgaactaataatactatcgcgcatacgcgcgccgacttacttcctaaaaacgactctacgtcaacaaactaccttaccactacaaaaataaataattaaaaccgctctacgaccccaactcgtttttcaaccgatcatttacttcaaaaacgtcgcataacgttattactatttcttcaacaacaaacgattcgaacgaaacaccgcctt

SEQ ID NO: 1329 - DNA, 2354 bp, Artificial Sequence
  chemically treated genomic DNA (Homo sapiens) CpG-island No: 1329
cgtcgtagtgtattatttcgttgatcgttttttttatgcgttcggtaatgattttttcgttgttttgtttacggtcgtttaggcggtggcgtagcgttttttggttcggtggtaggatgaatatcgatagtgtttgtggtattagtttgcgtatttgttgggcgttttgttagtcgatttttaggattaggtcgtagttttgatttagcgtttgttgtagcgcgttgcgcgaggtgtcgtagaagttgtcgaatatttcggtatgttttaggaagtcgttttgcgcgattagcgttttgaatttttcgtggacgacgaagtggtagtttatttcgtgtttttcgttcgggcgtatggcgcgggtggtgtgcgagatcgaaacgcggatttgtcggtcgtttttggttagggtcgttattaggttggttttgtcggcgttcgaaggggtcgaaacgatgtagagggtgtcgttgttgtggtttatggtcggggtggttttattcgatgttttgtatttgtttacgtatttgttcgattaatatttttaggttgatcgtcgtttgcgtgttgcgtgggtcgaaggttttggagtcgagggtgttggtttcgcggttgagtttttgtattaggaagtttaggcgacgttttgcggtatcgttatttttgaggattcggcgtattttagtgacgtgggtgttgaggcggtcgagtttttcggttacgtcgtttttttgcgttagtagtattattttttgttcgaggcgttgtgggtcgagttcggtttgtatgtcgtcgaaacggtcgagaattttttgtcgttgcgtcgttagtatttgcggtattaaggcgcgtagggtggtgattttattggatatgttgtttagacgttcgttgattagtcgggttagtttttggttttcgcgtaggcgatcggttttgagttcggttagggtttcgtcgaatagcgttatggtttcggcgtttagtgtttgcgggtcgttggtgtcggttattagtacgttaggttacgatagtatttttagcgggtttaggggtgttggttgtttgattaggtcggttattttttcggcggcggtaattagttgcgcggcgcgttcgcggtttatttttagtggtttgtcgttgttgttttcgttgaggcgtaaggtgtattttattttgtttcgcgataagttttggcgtaggtttttacgtacggcgttttcgaggtcgcgtagggtttttggtaggcgtaggtgcggttttaggtaacggtggttgatcgaacgtagtttttagattagggtgttttggttgtcggcgcgttcgatacgagtaaaagcggttatgttgtgtattatggggagtatttcgtttagttgaatgaacggtgggagtttttcggttgtaaggcgtaggattgtagcgtagtggggtcgtggcgtttaatttgtttatgttatcgacgggcggtcgcgttagtaggaaaaggcgacgggttgtggcgggtacgataataggtatgtttttttcgggttgcgggttttataatgttcggtagatttaaagttttagtataggtattttagatgaaacgtttaagtggtcgcgtcgtcgattagtttcgttcgattcgtattattcgtaattatattaagtacgtcgaagggtcggtattggtcgagttcggtgatatttaggttatttgtacggttagcgttgaaaacggtgtatcgcgttttttgaaaggttaaggttaaggttggttgatcgtcgaatacggtatgttgtcgcgtgttatcggtgagcgtaattagcgcgaagttagtcgtggtaaatagggtggtcgtattttggaaatttagcgtttgatcggtcgttcgttgcgcgtcgcgttggatatgagtaagttgggcgatattattttgtacgtcgattgcgacgtgatttaggtcgatggcggtattcgtatcgcgtttattatcggtgttatggtcgttttgtgcgatgcgttggcggtgattaagaagcgtggtggtttgaaggtcggtagttcgtttaagtatatgatcgttgtcgtgtcggtgggtatgtattagggcgaagtcgtgttcgatttggattatttggaagatttcgtcgtcgaaatcgatttgaacgtggttatgattagcgtcggtggttttatcgaggtgtagggtattgtcgaaggtgcgtcgttttagtttgaagattttaacgttatgttggcgttggcgtataagggtatgatcgaaattttcgagttgtagtaggttgtattggcggattgattgatttcgtagatataaaaaagtcgatattattgtcggttt

SEQ ID NO: 1330 - DNA, 2354 bp, Artificial Sequence
  chemically treated genomic DNA (Homo sapiens) CpG-island No: 1330
aaaccgacaataatatcgacttttttatatctacgaaatcaatcaatccgccaatacaacctactacaactcgaaaatttcgatcatacccttatacgccaacgccaacataacgttaaaatcttcaaactaaaacgacgcaccttcgacaataccctacacctcgataaaaccaccgacgctaatcataaccacgttcaaatcgatttcgacgacgaaatcttccaaataatccaaatcgaacacgacttcgccctaatacatacccaccgacacgacaacgatcatatacttaaacgaactaccgaccttcaaaccaccacgcttcttaatcaccgccaacgcatcgcacaaaacgaccataacaccgataataaacgcgatacgaataccgccatcgacctaaatcacgtcgcaatcgacgtacaaaataatatcgcccaacttactcatatccaacgcgacgcgcaacgaacgaccgatcaaacgctaaatttccaaaatacgaccaccctatttaccacgactaacttcgcgctaattacgctcaccgataacacgcgacaacataccgtattcgacgatcaaccaaccttaaccttaacctttcaaaaaacgcgatacaccgttttcaacgctaaccgtacaaataacctaaatatcaccgaactcgaccaataccgacccttcgacgtacttaatataattacgaataatacgaatcgaacgaaactaatcgacgacgcgaccacttaaacgtttcatctaaaatacctatactaaaactttaaatctaccgaacattataaaacccgcaacccgaaaaaaacatacctattatcgtacccgccacaacccgtcgccttttcctactaacgcgaccgcccgtcgataacataaacaaattaaacgccacgaccccactacgctacaatcctacgccttacaaccgaaaaactcccaccgttcattcaactaaacgaaatactccccataatacacaacataaccgcttttactcgtatcgaacgcgccgacaaccaaaacaccctaatctaaaaactacgttcgatcaaccaccgttacctaaaaccgcacctacgcctaccaaaaaccctacgcgacctcgaaaacgccgtacgtaaaaacctacgccaaaacttatcgcgaaacaaaataaaatacaccttacgcctcaacgaaaacaacaacgacaaaccactaaaaataaaccgcgaacgcgccgcgcaactaattaccgccgccgaaaaaataaccgacctaatcaaacaaccaacacccctaaacccgctaaaaatactatcgtaacctaacgtactaataaccgacaccaacgacccgcaaacactaaacgccgaaaccataacgctattcgacgaaaccctaaccgaactcaaaaccgatcgcctacgcgaaaaccaaaaactaacccgactaatcaacgaacgtctaaacaacatatccaataaaatcaccaccctacgcgccttaataccgcaaatactaacgacgcaacgacaaaaaattctcgaccgtttcgacgacatacaaaccgaactcgacccacaacgcctcgaacaaaaaataatactactaacgcaaaaaaacgacgtaaccgaaaaactcgaccgcctcaacacccacgtcactaaaatacgccgaatcctcaaaaataacgataccgcaaaacgtcgcctaaacttcctaatacaaaaactcaaccgcgaaaccaacaccctcgactccaaaaccttcgacccacgcaacacgcaaacgacgatcaacctaaaaatattaatcgaacaaatacgtaaacaaatacaaaacatcgaataaaaccaccccgaccataaaccacaacaacgacaccctctacatcgtttcgaccccttcgaacgccgacaaaaccaacctaataacgaccctaaccaaaaacgaccgacaaatccgcgtttcgatctcgcacaccacccgcgccatacgcccgaacgaaaaacacgaaataaactaccacttcgtcgtccacgaaaaattcaaaacgctaatcgcgcaaaacgacttcctaaaacataccgaaatattcgacaacttctacgacacctcgcgcaacgcgctacaacaaacgctaaatcaaaactacgacctaatcctaaaaatcgactaacaaaacgcccaacaaatacgcaaactaataccacaaacactatcgatattcatcctaccaccgaaccaaaaaacgctacgccaccgcctaaacgaccgtaaacaaaacaacgaaaaaatcattaccgaacgcataaaaaaaacgatcaacgaaataatacactacgacg

SEQ ID NO: 1331 - DNA, 2354 bp, Artificial Sequence
  chemically treated genomic DNA (Homo sapiens) CpG-island No: 1331
aagtcgatagtaatgtcggtttttttgtatttacgaaattagttagttcgttagtgtagtttgttgtagttcgaagatttcggttatgtttttgtgcgttagcgttagtatggcgttgaagtttttaggttggaacggcgtattttcggtagtgttttgtatttcgatgaagttatcggcgttggttatgattacgtttaggtcggtttcggcggcggagttttttaggtagtttaggtcgagtacggtttcgttttggtatatgtttatcgatacggtagcgattatgtgtttgagcgggttgtcggtttttaggttattacgttttttgattatcgttagcgtatcgtatagggcgattatggtatcggtgatggacgcggtacgggtatcgttatcggtttggattacgtcgtagtcgacgtatagggtgatgtcgtttagtttgtttatgtttagcgcggcgcgtagcgaacggtcgattaggcgttggatttttagggtgcggttattttgtttgttacggttggtttcgcgttggttacgtttatcggtagtacgcggtagtatgtcgtattcggcggttagttagttttggttttggttttttaggaagcgcggtatatcgtttttaacgttgatcgtgtagatgatttaggtgttatcgaattcgattagtatcgatttttcggcgtgtttggtgtagttgcgggtgatgcggatcgagcggagttgatcggcggcgcgattatttggacgttttatttgggatatttgtattgggattttgaatttgtcgagtattatagagttcgtagttcggggaagatatgtttattgtcgtattcgttatagttcgtcgtttttttttattggcgcggtcgttcgtcggtaatataggtagattgggcgttacggttttattgcgttataattttgcgttttgtagtcgagaggtttttatcgtttatttaattaagcgaggtattttttatggtgtatagtatgatcgtttttgttcgtgtcgagcgcgtcggtagttaaggtattttgatttgggagttgcgttcggttaattatcgttatttggaatcgtatttgcgtttgttagaggttttgcgcgatttcgaaggcgtcgtacgtgaaggtttgcgttagggtttgtcgcggggtaaggtggaatgtattttgcgttttaacgaagatagtaacggtaagttattgaaggtagatcgcgagcgcgtcgcgtagttggttgtcgtcgtcgaggaagtggtcggtttgattaagtagttagtatttttgaattcgttggaagtgttgtcgtggtttggcgtgttggtggtcgatattagcgattcgtaggtattgaacgtcgaagttatggcgttgttcgacgaagttttggtcgaatttaaggtcggtcgtttgcgcgaaggttaggaattggttcggttgattaacgaacgtttggatagtatgtttagtgaagttattattttgcgcgttttggtgtcgtagatgttggcggcgtagcggtagaaaattttcgatcgtttcggcgatatgtaagtcgagttcgatttatagcgtttcgaataagagatggtgttgttggcgtagaagagcgacgtggtcgaggagttcgatcgttttagtatttacgttattgaagtgcgtcgggtttttaagggtggcggtgtcgtagggcgtcgtttggattttttgatgtaggaatttaatcgcgaagttaatattttcggttttaaggttttcgatttacgtagtacgtaagcggcggttaatttgaaggtattgatcgaatagatgcgtgaataagtatagaatatcgagtaaggttatttcgattatgaattatagtagcggtattttttatatcgtttcggttttttcgggcgtcggtaagattagtttggtaacggttttgattaaggacgatcggtagattcgcgtttcggtttcgtatattattcgcgttatgcgttcgggcgaggaatacggggtgaattattatttcgtcgtttacgaagaatttaaggcgttgatcgcgtagggcgattttttggagtatgtcgaagtgttcggtaatttttacggtatttcgcgtagcgcgttgtagtagacgttggattagggttacgatttgattttggaaatcgattggtaaggcgtttagtaggtgcgtaagttgatgttataggtattgtcggtgtttattttgttatcgagttaggaagcgttacgttatcgtttggacggtcgtgggtaggatagcgaagaaattattgtcgggcgtatgaaagaagcggttagcgagatggtgtattacgacg

SEQ ID NO: 1332 - DNA, 2354 bp, Artificial Sequence
  chemically treated genomic DNA (Homo sapiens) CpG-island No: 1332
cgtcgtaatacaccatctcgctaaccgcttctttcatacgcccgacaataatttcttcgctatcctacccacgaccgtccaaacgataacgtaacgcttcctaactcgataacaaaataaacaccgacaatacctataacatcaacttacgcacctactaaacgccttaccaatcgatttccaaaatcaaatcgtaaccctaatccaacgtctactacaacgcgctacgcgaaataccgtaaaaattaccgaacacttcgacatactccaaaaaatcgccctacgcgatcaacgccttaaattcttcgtaaacgacgaaataataattcaccccgtattcctcgcccgaacgcataacgcgaataatatacgaaaccgaaacgcgaatctaccgatcgtccttaatcaaaaccgttaccaaactaatcttaccgacgcccgaaaaaaccgaaacgatataaaaaataccgctactataattcataatcgaaataaccttactcgatattctatacttattcacgcatctattcgatcaataccttcaaattaaccgccgcttacgtactacgtaaatcgaaaaccttaaaaccgaaaatattaacttcgcgattaaattcctacatcaaaaaatccaaacgacgccctacgacaccgccacccttaaaaacccgacgcacttcaataacgtaaatactaaaacgatcgaactcctcgaccacgtcgctcttctacgccaacaacaccatctcttattcgaaacgctataaatcgaactcgacttacatatcgccgaaacgatcgaaaattttctaccgctacgccgccaacatctacgacaccaaaacgcgcaaaataataacttcactaaacatactatccaaacgttcgttaatcaaccgaaccaattcctaaccttcgcgcaaacgaccgaccttaaattcgaccaaaacttcgtcgaacaacgccataacttcgacgttcaatacctacgaatcgctaatatcgaccaccaacacgccaaaccacgacaacacttccaacgaattcaaaaatactaactacttaatcaaaccgaccacttcctcgacgacgacaaccaactacgcgacgcgctcgcgatctaccttcaataacttaccgttactatcttcgttaaaacgcaaaatacattccaccttaccccgcgacaaaccctaacgcaaaccttcacgtacgacgccttcgaaatcgcgcaaaacctctaacaaacgcaaatacgattccaaataacgataattaaccgaacgcaactcccaaatcaaaataccttaactaccgacgcgctcgacacgaacaaaaacgatcatactatacaccataaaaaatacctcgcttaattaaataaacgataaaaacctctcgactacaaaacgcaaaattataacgcaataaaaccgtaacgcccaatctacctatattaccgacgaacgaccgcgccaataaaaaaaaacgacgaactataacgaatacgacaataaacatatcttccccgaactacgaactctataatactcgacaaattcaaaatcccaatacaaatatcccaaataaaacgtccaaataatcgcgccgccgatcaactccgctcgatccgcatcacccgcaactacaccaaacacgccgaaaaatcgatactaatcgaattcgataacacctaaatcatctacacgatcaacgttaaaaacgatataccgcgcttcctaaaaaaccaaaaccaaaactaactaaccgccgaatacgacatactaccgcgtactaccgataaacgtaaccaacgcgaaaccaaccgtaacaaacaaaataaccgcaccctaaaaatccaacgcctaatcgaccgttcgctacgcgccgcgctaaacataaacaaactaaacgacatcaccctatacgtcgactacgacgtaatccaaaccgataacgatacccgtaccgcgtccatcaccgataccataatcgccctatacgatacgctaacgataatcaaaaaacgtaataacctaaaaaccgacaacccgctcaaacacataatcgctaccgtatcgataaacatataccaaaacgaaaccgtactcgacctaaactacctaaaaaactccgccgccgaaaccgacctaaacgtaatcataaccaacgccgataacttcatcgaaatacaaaacactaccgaaaatacgccgttccaacctaaaaacttcaacgccatactaacgctaacgcacaaaaacataaccgaaatcttcgaactacaacaaactacactaacgaactaactaatttcgtaaatacaaaaaaaccgacattactatcgactt

SEQ ID NO: 1333 - DNA, 781 bp, Artificial Sequence
  chemically treated genomic DNA (Homo sapiens) CpG-island No: 1333
ggagaagcgcggttgacgcggtaggcgggcgttacgtacgaaacggcgtaggtttggcgtgaggatttggtagtcgaatcggtagtttaggttgagtatttcggtttgttcgttgttcggttattagttgtattggtcgtttttacggttgatttcgcgtagggtatcgacgtattttatttcgttagtgatcgtatttatttaggcgcgtttcggcgttaggaagttcggcgattgttggttgttacgttagtttttgatgtcgagtttttgttgcgttacgtagaacgagtcgtaatagatgtattcgcgacgtttgcgacgttgtttgtttaggtatttggcgaagtcgtttattaatttgaatttttggtttaagttttcgtcgtcgtttatgttcgaaggtagtagtaggttggtaatattgattttgtcgaaatttgtttgtaggtaacgttcgtagcggtcggttgtttcgaaatttaggtcggtgatgattgttttgggttgtatgcgcgaataaagggttatattattttgggtaggtattttcgcgtcgtaggtataaaggaaatagttatcgagttggaaagttgggttatcgagtttaaaggtcgaggcgcgggtattttgaaggtagatgacgtcggtattttgggtttgtagttagttgagtaaattacgttcggtcgtagtttgaatgttatttacgtttatattgatgattcgtataaatggttttaaaaatttcgtgcgtgtatgatattcgagtttaatttat

SEQ ID NO: 1334 - DNA, 781 bp, Artificial Sequence
  chemically treated genomic DNA (Homo sapiens) CpG-island No: 1334
ataaattaaactcgaatatcatacacgcacgaaatttttaaaaccatttatacgaatcatcaatataaacgtaaataacattcaaactacgaccgaacgtaatttactcaactaactacaaacccaaaataccgacgtcatctaccttcaaaatacccgcgcctcgacctttaaactcgataacccaactttccaactcgataactatttcctttatacctacgacgcgaaaatacctacccaaaataatataaccctttattcgcgcatacaacccaaaacaatcatcaccgacctaaatttcgaaacaaccgaccgctacgaacgttacctacaaacaaatttcgacaaaatcaatattaccaacctactactaccttcgaacataaacgacgacgaaaacttaaaccaaaaattcaaattaataaacgacttcgccaaatacctaaacaaacaacgtcgcaaacgtcgcgaatacatctattacgactcgttctacgtaacgcaacaaaaactcgacatcaaaaactaacgtaacaaccaacaatcgccgaacttcctaacgccgaaacgcgcctaaataaatacgatcactaacgaaataaaatacgtcgataccctacgcgaaatcaaccgtaaaaacgaccaatacaactaataaccgaacaacgaacaaaccgaaatactcaacctaaactaccgattcgactaccaaatcctcacgccaaacctacgccgtttcgtacgtaacgcccgcctaccgcgtcaaccgcgcttctcc

SEQ ID NO: 1335 - DNA, 781 bp, Artificial Sequence
  chemically treated genomic DNA (Homo sapiens) CpG-island No: 1335
atgggttgagttcgggtattatatacgtacgagatttttggggttatttatgcggattattagtgtgaacgtaaatggtatttaggttgcggtcgagcgtggtttgtttagttggttgtaagtttagaatgtcgacgttatttgtttttaggatattcgcgtttcggtttttgaattcgatgatttagttttttagttcgatggttattttttttatgtttgcgacgcggaggtgtttgtttaaggtggtgtggttttttattcgcgtatgtagtttaaggtagttattatcggtttgggtttcgagatagtcgatcgttacgggcgttatttgtaagtagatttcgataaagttagtattgttagtttgttgttgttttcgggtatgaacggcgacgaagatttgaattagaagtttaagttgatggacgatttcgttaagtatttggataagtagcgtcgtaagcgtcgcgagtatatttattgcggttcgttttacgtggcgtagtagaagttcgatattaagaattggcgtgatagttagtagtcgtcgggttttttggcgtcggagcgcgtttggatggatgcgattattggcgagatggggtacgtcgatgttttgcgcgaagttagtcgtgaaggcgattagtatagttggtggtcggataacgagtaggtcgagatgtttaatttgggttatcggttcgattattagatttttacgttaggtttgcgtcgtttcgtgcgtaacgttcgtttgtcgcgttagtcgcgttttttt

SEQ ID NO: 1336 - DNA, 781 bp, Artificial Sequence
  chemically treated genomic DNA (Homo sapiens) CpG-island No: 1336
aaaaaaacgcgactaacgcgacaaacgaacgttacgcacgaaacgacgcaaacctaacgtaaaaatctaataatcgaaccgataacccaaattaaacatctcgacctactcgttatccgaccaccaactatactaatcgccttcacgactaacttcgcgcaaaacatcgacgtaccccatctcgccaataatcgcatccatccaaacgcgctccgacgccaaaaaacccgacgactactaactatcacgccaattcttaatatcgaacttctactacgccacgtaaaacgaaccgcaataaatatactcgcgacgcttacgacgctacttatccaaatacttaacgaaatcgtccatcaacttaaacttctaattcaaatcttcgtcgccgttcatacccgaaaacaacaacaaactaacaatactaactttatcgaaatctacttacaaataacgcccgtaacgatcgactatctcgaaacccaaaccgataataactaccttaaactacatacgcgaataaaaaaccacaccaccttaaacaaacacctccgcgtcgcaaacataaaaaaaataaccatcgaactaaaaaactaaatcatcgaattcaaaaaccgaaacgcgaatatcctaaaaacaaataacgtcgacattctaaacttacaaccaactaaacaaaccacgctcgaccgcaacctaaataccatttacgttcacactaataatccgcataaataaccccaaaaatctcgtacgtatataatacccgaactcaacccat

SEQ ID NO: 1337 - DNA, 1676 bp, Artificial Sequence
  chemically treated genomic DNA (Homo sapiens) CpG-island No: 1337
ttttgttatcgatcgcggggtattgcgtttcggtgaatttattttgaaatcggggcgtattagttcgtatttttttaatgtcggtttgtttaatatcggttttgtattggtcgaattggggcggtgttatgtcgtagttattgtcgatagtaagatttcgttcgacgtgttgttcggttcggtttataagggtatttcgttggcggcgattattgtcgtggttttggtagattagtataagttcgacgtgttttggtgttttaatcgtaaggaagttaaggattacggcgaaggcggtagtttggtgggtgcgttattggtcggtgacgtgttgattatcgacgacgtgattatcgtcggtattgttattcgtgaggttatgtagattattaacgtttagtaggttaaggtcgtcggcgtgttgatcgcgttgaatcgcgaagagcgtggtaatggcgagttgtcggcgatttaggaagtggaacgcgatttcggtatttcggtagttagtatcgtttcgttgatttaggtgttggagtttttggtcgatgatttttagttgaagtagtatttgtcggttgtcgaggtttatcgcgcgtagtacgggatttgattttggtttggaaatgaaaaaggcgatttttttgtgaaggtcgtttttttttgtcgttcgtttcggtcgattagcgcggtttgcggttggtaattagggtatttacgtcgttgtcggtgaaaatttttagtagtatagtattcggtatacggtcgtcgatgatgtgcgagttgtttacgtcgttttgtatcgtatttagtgcgtatttgattttcggtagtatgtcgtcgtagatggtgtcgttcgcgattagttcgttgatttgttcggtggttaggtcggttagaatttgattttgtttgtttattaaatcggcgatgttggttagtagtattagtttttcggtttttagcgttttcgcgattttgtttgttattaggtcggcgttgatgttgtacgatttttcgttggtatttacgtcgatcggcgcgatgatcgggatgaagtcgttttttattagtatgtttagtagatcggtgtttacgtttattatttcgtttacgtggtcgatgtcgatgattttcggggtggttatttcgggcgtttggcggttgacggttagtttgcgggcgcggattagtttcgcgtttttgtcggttaggtcgatggcgttgtcgtcgtggcggttgattaggttgacgatgtttttgttgatttggttatttagtattatttttattacgtttatggtcgtcgagtcggtgacgcgtatgtcgtcgatgaagtggttttcgatcgataggcgtttgagtaggtcgtcgatttgcgggttattatcgtggattattatcgggttgatgtttatagtttttattagtacgatgttacgggcgaagtcggttttgagtttttcgttttttatcgcgttgtcgtcgtatttgattattagggttttgtcgataaagcggcggatgtaaggtagtgtttcggataaaatttcggttatatgggaagcggtatcgcgatcgagggttatgtagggtttttgtaaggaatagatagtcggttagaacggtagttgtagtttaggggtaattcgtagtaattgggtacggaaaatatt

SEQ ID NO: 1338 - DNA, 1676 bp, Artificial Sequence
  chemically treated genomic DNA (Homo sapiens) CpG-island No: 1338
aatattttccgtacccaattactacgaattacccctaaactacaactaccgttctaaccgactatctattccttacaaaaaccctacataaccctcgatcgcgataccgcttcccatataaccgaaattttatccgaaacactaccttacatccgccgctttatcgacaaaaccctaataatcaaatacgacgacaacgcgataaaaaacgaaaaactcaaaaccgacttcgcccgtaacatcgtactaataaaaactataaacatcaacccgataataatccacgataataacccgcaaatcgacgacctactcaaacgcctatcgatcgaaaaccacttcatcgacgacatacgcgtcaccgactcgacgaccataaacgtaataaaaataatactaaataaccaaatcaacaaaaacatcgtcaacctaatcaaccgccacgacgacaacgccatcgacctaaccgacaaaaacgcgaaactaatccgcgcccgcaaactaaccgtcaaccgccaaacgcccgaaataaccaccccgaaaatcatcgacatcgaccacgtaaacgaaataataaacgtaaacaccgatctactaaacatactaataaaaaacgacttcatcccgatcatcgcgccgatcgacgtaaataccaacgaaaaatcgtacaacatcaacgccgacctaataacaaacaaaatcgcgaaaacgctaaaaaccgaaaaactaatactactaaccaacatcgccgatttaataaacaaacaaaatcaaattctaaccgacctaaccaccgaacaaatcaacgaactaatcgcgaacgacaccatctacgacgacatactaccgaaaatcaaatacgcactaaatacgatacaaaacgacgtaaacaactcgcacatcatcgacgaccgtataccgaatactatactactaaaaattttcaccgacaacgacgtaaataccctaattaccaaccgcaaaccgcgctaatcgaccgaaacgaacgacaaaaaaaaacgaccttcacaaaaaaatcgcctttttcatttccaaaccaaaatcaaatcccgtactacgcgcgataaacctcgacaaccgacaaatactacttcaactaaaaatcatcgaccaaaaactccaacacctaaatcaacgaaacgatactaactaccgaaataccgaaatcgcgttccacttcctaaatcgccgacaactcgccattaccacgctcttcgcgattcaacgcgatcaacacgccgacgaccttaacctactaaacgttaataatctacataacctcacgaataacaataccgacgataatcacgtcgtcgataatcaacacgtcaccgaccaataacgcacccaccaaactaccgccttcgccgtaatccttaacttccttacgattaaaacaccaaaacacgtcgaacttatactaatctaccaaaaccacgacaataatcgccgccaacgaaatacccttataaaccgaaccgaacaacacgtcgaacgaaatcttactatcgacaataactacgacataacaccgccccaattcgaccaatacaaaaccgatattaaacaaaccgacattaaaaaaatacgaactaatacgccccgatttcaaaataaattcaccgaaacgcaataccccgcgatcgataacaaaa

SEQ ID NO: 1339 - DNA, 1676 bp, Artificial Sequence
  chemically treated genomic DNA (Homo sapiens) CpG-island No: 1339
gatgtttttcgtatttagttgttgcgggttgtttttgagttgtaattgtcgttttgatcgattatttgttttttataggagttttgtatgattttcgatcgcgatgtcgttttttatgtagtcgaggttttgttcgaagtattgttttatattcgtcgttttgtcggtaagattttggtgattaagtacggcggtaacgcgatggagagcgaggagtttaaaatcggtttcgttcgtgatatcgtgttgatgaaggttgtgggtattaattcggtggtggtttacggtggtggttcgtagatcggcgatttgtttaagcgtttgtcgatcgaaagttattttatcgacggtatgcgcgttatcgattcggcgattatggacgtggtggagatggtgttgggtggttaggttaataaggatatcgttaatttgattaatcgttacggcggtagcgttatcggtttgatcggtaaggacgcggaattgattcgcgttcgtaagttgatcgttagtcgttagacgttcgagatgattatttcggaaattatcgatatcggttacgtgggcgaagtggtgagcgtgaatatcgatttgttgaatatgttggtgaagggcgattttatttcggttatcgcgtcgatcggcgtgggtgttaacggagagtcgtataatattaacgtcgatttggtagtaggtaaggtcgcggaagcgttgaaagtcgagaagttgatgttgttgattaatatcgtcggtttgatggataagtaaggttaggttttgatcggtttgattatcgaataggttaacgaattgatcgcggacggtattatttacggcggtatgttgtcgaagattaagtgcgtattggatgcggtgtagggcggcgtgaatagttcgtatattatcgacggtcgtgtgtcgaatgttgtgttgttggaaatttttatcgatagcggcgtgggtattttgattattaatcgtaagtcgcgttgatcggtcgaaacgggcgataaaaaaaggcgatttttataagaaggtcgttttttttatttttaggttaggattagatttcgtattgcgcgcggtaagtttcgatagtcggtagatgttgttttagttgagggttatcggttaggaattttagtatttgggttagcgaaacgatgttgattatcgggatatcgaagtcgcgttttattttttggatcgtcgatagttcgttattgttacgtttttcgcggtttagcgcgattagtacgtcggcggttttggtttgttgggcgttgatgatttgtatgattttacggatggtagtatcggcggtgattacgtcgtcgatgattagtacgttatcggttagtggcgtatttattaggttgtcgttttcgtcgtggtttttggtttttttgcggttgaagtattaaggtacgtcgagtttatgttggtttgttagggttacggtagtggtcgtcgttaacggaatatttttgtaggtcgggtcgaatagtacgtcgaacgggattttgttgtcgataatggttgcggtatagtatcgttttagttcggttaatgtagaatcggtgttgaataggtcggtattgaagaaatacgggttggtacgtttcgattttagggtgaatttatcgaaacgtagtatttcgcgatcgatggtaaaa

SEQ ID NO: 1340 - DNA, 1676 bp, Artificial Sequence
  chemically treated genomic DNA (Homo sapiens) CpG-island No: 1340
ttttaccatcgatcgcgaaatactacgtttcgataaattcaccctaaaatcgaaacgtaccaacccgtatttcttcaataccgacctattcaacaccgattctacattaaccgaactaaaacgatactataccgcaaccattatcgacaacaaaatcccgttcgacgtactattcgacccgacctacaaaaatattccgttaacgacgaccactaccgtaaccctaacaaaccaacataaactcgacgtaccttaatacttcaaccgcaaaaaaaccaaaaaccacgacgaaaacgacaacctaataaatacgccactaaccgataacgtactaatcatcgacgacgtaatcaccgccgatactaccatccgtaaaatcatacaaatcatcaacgcccaacaaaccaaaaccgccgacgtactaatcgcgctaaaccgcgaaaaacgtaacaataacgaactatcgacgatccaaaaaataaaacgcgacttcgatatcccgataatcaacatcgtttcgctaacccaaatactaaaattcctaaccgataaccctcaactaaaacaacatctaccgactatcgaaacttaccgcgcgcaatacgaaatctaatcctaacctaaaaataaaaaaaacgaccttcttataaaaatcgcctttttttatcgcccgtttcgaccgatcaacgcgacttacgattaataatcaaaatacccacgccgctatcgataaaaatttccaacaacacaacattcgacacacgaccgtcgataatatacgaactattcacgccgccctacaccgcatccaatacgcacttaatcttcgacaacataccgccgtaaataataccgtccgcgatcaattcgttaacctattcgataatcaaaccgatcaaaacctaaccttacttatccatcaaaccgacgatattaatcaacaacatcaacttctcgactttcaacgcttccgcgaccttacctactaccaaatcgacgttaatattatacgactctccgttaacacccacgccgatcgacgcgataaccgaaataaaatcgcccttcaccaacatattcaacaaatcgatattcacgctcaccacttcgcccacgtaaccgatatcgataatttccgaaataatcatctcgaacgtctaacgactaacgatcaacttacgaacgcgaatcaattccgcgtccttaccgatcaaaccgataacgctaccgccgtaacgattaatcaaattaacgatatccttattaacctaaccacccaacaccatctccaccacgtccataatcgccgaatcgataacgcgcataccgtcgataaaataactttcgatcgacaaacgcttaaacaaatcgccgatctacgaaccaccaccgtaaaccaccaccgaattaatacccacaaccttcatcaacacgatatcacgaacgaaaccgattttaaactcctcgctctccatcgcgttaccgccgtacttaatcaccaaaatcttaccgacaaaacgacgaatataaaacaatacttcgaacaaaacctcgactacataaaaaacgacatcgcgatcgaaaatcatacaaaactcctataaaaaacaaataatcgatcaaaacgacaattacaactcaaaaacaacccgcaacaactaaatacgaaaaacatc

SEQ ID NO: 1341 - DNA, 1570 bp, Artificial Sequence
  chemically treated genomic DNA (Homo sapiens) CpG-island No: 1341
gttcggttttgttgaggatttttagtaggcgtgcggtattgtagatgtcgtcgtcgaaatcgtattagcgttttttgatgaagatgtgatcgtttatttcgtcggttagtagcgagtttgtttgttttattttttttttgattaacgaatgatcggttttttatattagtgcgcggtcgttatgttgttcgattagcggggttaggcgacgggtgtatttgacgtcgaagatgatttcggcgttagggttgcgcgttagtacgttttgggtaaatagtattagtaggcggtcggggtagacgatgttgtcggtattggttattatatcgacgcggtcgttatcgtcgtcgaaggttaggtcgatatcggcgtcggtttttttgattttggcgattaggtttttaaggtttttcggtttgttcgggttcgggtggtggttggggaagttgtcgtttatttcgtagaatagcgggattattttatagtttaaggtttcgattaattgcggtgcgattacgttagcggtatcgttgtcgtagtttattattattttgagttttttcgttagttttacgttttcgacgatttgttggaaatagcggttaaggatttcgattttttttacgcggttttcggttaaggttaggtcgttggtttttaggcgggtgagtagggtttggatttgttcgttggttagcgtgtcgttagcgatgacgattttgaagtcgttgtagttcgacgggttgtggttgttagttagtattacgttcgatttgtttgttagtacgttggtcgcgtagtaaagggtcggggtgggtattaggtcgacgtcgttgacgtggtagtcggtatcgattaggtttttgattagttgttcgattagtatcgggtcggataggcggttattacggtcgatcgaaatttgcggttcgttttgggttaggttttgcgtatcgatggcgcggtttatttagtaggcggtttcggcgtgaagggttttgtcgattacgtcgcggatgttatacgcgcggaaaatgttgtcgggtaatgcggcggggattaggtgggttatgtcgtttatttttggaagttttattagttaaaggttttttgggtaggcgtaaattgaacgtttggacggtgttttcgttagagagttcgttatttttggtttgaacggttatttgtcggtttagtggttgtcggagtgatcgaagtcgttagtattacgttggtttttatcgaaggtttcgacgatgtcgaaatgggtttgtattatcggtattagtattagttgggcgatacgttcgttaacggcgatggtgaatggcgtgttgtcgcggttttagtacgatattattagttcgttttggtaattcgagtcgattaggtcgattaggttgtttagtacgatgtcgtgtttatggtttaggttcgagcgcggtaggattatcgtcgttaggttcgggtcgtcgatgtagatcgataggtcggtagggattagtagggtttggtttggtttaaggatagtgttttttttgagtagggcgcgtaggtttaggttcgcgga

SEQ ID NO: 1342 - DNA, 1570 bp, Artificial Sequence
  chemically treated genomic DNA (Homo sapiens) CpG-island No: 1342
tccgcgaacctaaacctacgcgccctactcaaaaaaaacactatccttaaaccaaaccaaaccctactaatccctaccgacctatcgatctacatcgacgacccgaacctaacgacgataatcctaccgcgctcgaacctaaaccataaacacgacatcgtactaaacaacctaatcgacctaatcgactcgaattaccaaaacgaactaataatatcgtactaaaaccgcgacaacacgccattcaccatcgccgttaacgaacgtatcgcccaactaatactaataccgataatacaaacccatttcgacatcgtcgaaaccttcgataaaaaccaacgtaatactaacgacttcgatcactccgacaaccactaaaccgacaaataaccgttcaaaccaaaaataacgaactctctaacgaaaacaccgtccaaacgttcaatttacgcctacccaaaaaacctttaactaataaaacttccaaaaataaacgacataacccacctaatccccgccgcattacccgacaacattttccgcgcgtataacatccgcgacgtaatcgacaaaacccttcacgccgaaaccgcctactaaataaaccgcgccatcgatacgcaaaacctaacccaaaacgaaccgcaaatttcgatcgaccgtaataaccgcctatccgacccgatactaatcgaacaactaatcaaaaacctaatcgataccgactaccacgtcaacgacgtcgacctaatacccaccccgaccctttactacgcgaccaacgtactaacaaacaaatcgaacgtaatactaactaacaaccacaacccgtcgaactacaacgacttcaaaatcgtcatcgctaacgacacgctaaccaacgaacaaatccaaaccctactcacccgcctaaaaaccaacgacctaaccttaaccgaaaaccgcgtaaaaaaaatcgaaatccttaaccgctatttccaacaaatcgtcgaaaacgtaaaactaacgaaaaaactcaaaataataataaactacgacaacgataccgctaacgtaatcgcaccgcaattaatcgaaaccttaaactataaaataatcccgctattctacgaaataaacgacaacttccccaaccaccacccgaacccgaacaaaccgaaaaaccttaaaaacctaatcgccaaaatcaaaaaaaccgacgccgatatcgacctaaccttcgacgacgataacgaccgcgtcgatataataaccaataccgacaacatcgtctaccccgaccgcctactaatactatttacccaaaacgtactaacgcgcaaccctaacgccgaaatcatcttcgacgtcaaatacacccgtcgcctaaccccgctaatcgaacaacataacgaccgcgcactaatataaaaaaccgatcattcgttaatcaaaaaaaaaataaaacaaacaaactcgctactaaccgacgaaataaacgatcacatcttcatcaaaaaacgctaatacgatttcgacgacgacatctacaataccgcacgcctactaaaaatcctcaacaaaaccgaac

SEQ ID NO: 1343 - DNA, 1570 bp, Artificial Sequence
  chemically treated genomic DNA (Homo sapiens) CpG-island No: 1343
ttcgcgggtttggatttgcgcgttttgtttaaggaggatattgtttttgagttaggttagattttgttgatttttatcggtttgtcgatttatatcggcgattcgggtttggcggcggtgattttgtcgcgttcgggtttgggttataagtacggtatcgtgttgggtaatttggtcggtttgatcgattcggattattagggcgagttgatggtgtcgtgttggaatcgcggtaatacgttatttattatcgtcgttggcgagcgtatcgtttagttggtattggtgtcggtggtataggtttatttcgatatcgtcgaagttttcgatgaaagttagcgtggtgttggcggtttcggttatttcggtagttattgagtcggtaaatgatcgtttaggttaaggatggcgaattttttggcgaaagtatcgtttaagcgtttagtttgcgtttgtttagaaagtttttgattaatggagtttttagagatgaacgatatggtttatttggttttcgtcgtattgttcgatagtatttttcgcgcgtatgatattcgcggcgtggtcggtaaaattttttacgtcgaaatcgtttattggataggtcgcgttatcggtgcgtaaagtttggtttagggcgaatcgtaggtttcggtcggtcgtgatggtcgtttgttcggttcgatgttggtcgaatagttgattaagggtttggtcgatgtcggttgttacgttagcgacgtcggtttggtgtttatttcggttttttattacgcggttaacgtgttggtaggtaagtcgggcgtgatgttgattggtagttataattcgtcggattataacggttttaagatcgttatcgttggcgatacgttggttaacgaatagatttaggttttgtttattcgtttgaaaattaacgatttgattttggtcgaaggtcgcgtggaaaaggtcgagatttttgatcgttatttttagtagatcgtcgaggacgtgaagttggcgaaaaagtttaaggtggtggtggattgcggtaacggtgtcgttggcgtgatcgtatcgtaattgatcgaagttttgggttgtgaagtgatttcgttgttttgcgaagtagacggtaatttttttaattattattcggattcgggtaagtcggaaaattttgaagatttgatcgttagggttaaggaaatcggcgtcgatatcggtttggttttcgacggcgatggcgatcgcgtcggtgtggtgattaatatcggtagtatcgtttatttcgatcgtttgttgatgttgtttgtttaggacgtgttggcgcgtaattttggcgtcgaaattattttcgacgttaaatgtattcgtcgtttgatttcgttgatcgaatagtatggcggtcgcgtattgatgtggaagatcggttattcgttgattaaaaagaagatgaaatagataggttcgttgttggtcggcgagatgagcggttatatttttattaaggaacgttggtacggtttcgacgacggtatttatagtgtcgtacgtttgttggagatttttagtaaggtcgggt

SEQ ID NO: 1344 - DNA, 1570 bp, Artificial Sequence
  chemically treated genomic DNA (Homo sapiens) CpG-island No: 1344
acccgaccttactaaaaatctccaacaaacgtacgacactataaataccgtcgtcgaaaccgtaccaacgttccttaataaaaatataaccgctcatctcgccgaccaacaacgaacctatctatttcatcttctttttaatcaacgaataaccgatcttccacatcaatacgcgaccgccatactattcgatcaacgaaatcaaacgacgaatacatttaacgtcgaaaataatttcgacgccaaaattacgcgccaacacgtcctaaacaaacaacatcaacaaacgatcgaaataaacgatactaccgatattaatcaccacaccgacgcgatcgccatcgccgtcgaaaaccaaaccgatatcgacgccgatttccttaaccctaacgatcaaatcttcaaaattttccgacttacccgaatccgaataataattaaaaaaattaccgtctacttcgcaaaacaacgaaatcacttcacaacccaaaacttcgatcaattacgatacgatcacgccaacgacaccgttaccgcaatccaccaccaccttaaactttttcgccaacttcacgtcctcgacgatctactaaaaataacgatcaaaaatctcgaccttttccacgcgaccttcgaccaaaatcaaatcgttaattttcaaacgaataaacaaaacctaaatctattcgttaaccaacgtatcgccaacgataacgatcttaaaaccgttataatccgacgaattataactaccaatcaacatcacgcccgacttacctaccaacacgttaaccgcgtaataaaaaaccgaaataaacaccaaaccgacgtcgctaacgtaacaaccgacatcgaccaaacccttaatcaactattcgaccaacatcgaaccgaacaaacgaccatcacgaccgaccgaaacctacgattcgccctaaaccaaactttacgcaccgataacgcgacctatccaataaacgatttcgacgtaaaaaattttaccgaccacgccgcgaatatcatacgcgcgaaaaatactatcgaacaatacgacgaaaaccaaataaaccatatcgttcatctctaaaaactccattaatcaaaaactttctaaacaaacgcaaactaaacgcttaaacgatactttcgccaaaaaattcgccatccttaacctaaacgatcatttaccgactcaataactaccgaaataaccgaaaccgccaacaccacgctaactttcatcgaaaacttcgacgatatcgaaataaacctataccaccgacaccaataccaactaaacgatacgctcgccaacgacgataataaataacgtattaccgcgattccaacacgacaccatcaactcgccctaataatccgaatcgatcaaaccgaccaaattacccaacacgataccgtacttataacccaaacccgaacgcgacaaaatcaccgccgccaaacccgaatcgccgatataaatcgacaaaccgataaaaatcaacaaaatctaacctaactcaaaaacaatatcctccttaaacaaaacgcgcaaatccaaacccgcgaa

SEQ ID NO: 1345 - DNA, 2088 bp, Artificial Sequence
  chemically treated genomic DNA (Homo sapiens) CpG-island No: 1345
cggaatttaggcgtgggtcgaggattttggtttgaagagcgtgtatgtaatttattgaatttggttgagtcgttcggcgatgaaggcgattagttgtcgggcgattttgtttttgttggtttgcgcgaagagggtttggtgttgttggcggtcgattacggttaaggcgtttttttcgttgttaaagtcgatgttggggttggttatattattggcgacgattaggtcgaggtttttgtttttgagtttgcgcgtggcgtaatcgagtaggtgttcggtttcggcggcgaagtcgacgttgaacgggcggtcgttgcggttagtaatggtggtaaggatatcgggattgcgtattatttgtagtagtatatcgtcgtcggtcgtaggatttttttttagtttttgtgtggtaattattttcgggcggtagttcgcgatcgttgtcgaggcgatgaataggtcgtatggtatggttgttttataggtcgcgagtatgtttcgcgcgttgattacgtcgatgcggttgattcggtcgggggttggtaggtgtatcgggttcgtgacgagggttattcgagtttcggtttcggtagtcgtttcggttagggcgaagtttattttgtcggagttatgattggtgatgtagcgtatcgggtcgatgtttttttgggtcggttcggcggtgattaatacgtgtttgtcggtgagtgtttggcgtttgaagttttttgcggcgtattaggttaggtcggtggtttcgagtatgcggtttaggtttacgtcgttataggtttggttatcggaggtcgggtcgaatatttgaatgttacggtttttgagtagtttaaggttagtttgggtggtcgggtcgcgttatatggtttggtttatggtcggggttacggcgacggtggcgtcggtggttagtattagggtggttagtaggtcgtcggttatgttttgggttatgcgcgttatgaggtcggcggtggtcggggcgattagtattaggtcggtttatttggttagttcgatatggtttatggttgtttcggcggtagggtcgagtaggtttatgtgtatcgggtggttcgatagcgtttgtagggttagcggggtgatgaattcggtattattacgggttatgacgacgcgtatttgcgcgtcgtgttttaggagtcggcgaattagttcggcgtttttgtaggcggtaatgtcgttatttacgtcgagaacgatgcgtttgcgatatagtcgttgtataggtttgtttttttttagtgagagcgggcggcgacgttcgaaatgtttgcggtagaacgtcgtatgtacgaggcgaaatagattaatatagggtcgaaatgggtcgtagtaagggtagggggcggggatgaatattagggagtggtcggttgaagagcggtcgagggagaagttgttgtagcgtggtgcggcggtatttacggatgtcgaattgtttgtcgtgttgttgggtttaggggtggtcgggcgtaatgtattggattttgcgcgggggttgttgatgcgttttggcgggttgaggtagtttttggaggtcgagcgcgacgcgttgttgcgcgagtcgggtatcggggtcgtgaagtatgtatagttataggcgttgttggagatcggtcggcgttatttgggtgagaatattaagcgcgtagaggttttggatgggttagcggcggtgcggcgttattttaaggttatgttgcggtatgaggttagtgaagtgttcggatgtttgtttttggatattaagtatcggtcgttggcgttcgagattttgtttaggggtacgatagatcgggcgagtgtttattcgcgggaggtagtgcggcgggttttgttgtataacgcggcggcgttgattttttgttataattattttttaggtaatagtgaatcgagttaggacgatgtgtatttgattttgttgttgaagcgcgggttggtattgatcgatgtgcgggtgttggattatattattattggcgatggggagtcgttgtcgatggttgagtatgggtggattgtggtttgaggtaggttaatgggggt

SEQ ID NO: 1346 - DNA, 2088 bp, Artificial Sequence
  chemically treated genomic DNA (Homo sapiens) CpG-island No: 1346
acccccattaacctacctcaaaccacaatccacccatactcaaccatcgacaacgactccccatcgccaataataatataatccaacacccgcacatcgatcaataccaacccgcgcttcaacaacaaaatcaaatacacatcgtcctaactcgattcactattacctaaaaaataattataacaaaaaatcaacgccgccgcgttatacaacaaaacccgccgcactacctcccgcgaataaacactcgcccgatctatcgtacccctaaacaaaatctcgaacgccaacgaccgatacttaatatccaaaaacaaacatccgaacacttcactaacctcataccgcaacataaccttaaaataacgccgcaccgccgctaacccatccaaaacctctacgcgcttaatattctcacccaaataacgccgaccgatctccaacaacgcctataactatacatacttcacgaccccgatacccgactcgcgcaacaacgcgtcgcgctcgacctccaaaaactacctcaacccgccaaaacgcatcaacaacccccgcgcaaaatccaatacattacgcccgaccacccctaaacccaacaacacgacaaacaattcgacatccgtaaataccgccgcaccacgctacaacaacttctccctcgaccgctcttcaaccgaccactccctaatattcatccccgccccctacccttactacgacccatttcgaccctatattaatctatttcgcctcgtacatacgacgttctaccgcaaacatttcgaacgtcgccgcccgctctcactaaaaaaaaacaaacctatacaacgactatatcgcaaacgcatcgttctcgacgtaaataacgacattaccgcctacaaaaacgccgaactaattcgccgactcctaaaacacgacgcgcaaatacgcgtcgtcataacccgtaataataccgaattcatcaccccgctaaccctacaaacgctatcgaaccacccgatacacataaacctactcgaccctaccgccgaaacaaccataaaccatatcgaactaaccaaataaaccgacctaatactaatcgccccgaccaccgccgacctcataacgcgcataacccaaaacataaccgacgacctactaaccaccctaatactaaccaccgacgccaccgtcgccgtaaccccgaccataaaccaaaccatataacgcgacccgaccacccaaactaaccttaaactactcaaaaaccgtaacattcaaatattcgacccgacctccgataaccaaacctataacgacgtaaacctaaaccgcatactcgaaaccaccgacctaacctaatacgccgcaaaaaacttcaaacgccaaacactcaccgacaaacacgtattaatcaccgccgaaccgacccaaaaaaacatcgacccgatacgctacatcaccaatcataactccgacaaaataaacttcgccctaaccgaaacgactaccgaaaccgaaactcgaataaccctcgtcacgaacccgatacacctaccaacccccgaccgaatcaaccgcatcgacgtaatcaacgcgcgaaacatactcgcgacctataaaacaaccataccatacgacctattcatcgcctcgacaacgatcgcgaactaccgcccgaaaataattaccacacaaaaactaaaaaaaaatcctacgaccgacgacgatatactactacaaataatacgcaatcccgatatccttaccaccattactaaccgcaacgaccgcccgttcaacgtcgacttcgccgccgaaaccgaacacctactcgattacgccacgcgcaaactcaaaaacaaaaacctcgacctaatcgtcgccaataatataaccaaccccaacatcgactttaacaacgaaaaaaacgccttaaccgtaatcgaccgccaacaacaccaaaccctcttcgcgcaaaccaacaaaaacaaaatcgcccgacaactaatcgccttcatcgccgaacgactcaaccaaattcaataaattacatacacgctcttcaaaccaaaatcctcgacccacgcctaaattccg

SEQ ID NO: 1347 - DNA, 2088 bp, Artificial Sequence
  chemically treated genomic DNA (Homo sapiens) CpG-island No: 1347
gtttttattgatttgttttaggttataatttatttatgtttaattatcgataacggttttttatcgttaatgatgatgtgatttagtattcgtatatcgattaatgttaattcgcgttttagtaataaggttagatgtatatcgttttggttcggtttattgttgtttgaggggtggttgtggtaaaggattaacgtcgtcgcgttatgtagtaaagttcgtcgtattatttttcgcgggtaaatattcgttcggtttatcgtgtttttgaataggatttcgaacgttaacggtcggtgtttggtgtttagaaataggtattcgaatattttattggttttatgtcgtagtatggttttgagataacgtcgtatcgtcgttggtttatttagagtttttgcgcgtttgatgtttttatttagataacgtcggtcgatttttagtagcgtttgtaattgtgtatattttacggtttcgatgttcggttcgcgtagtagcgcgtcgcgttcggtttttagaaattgttttagttcgttaaaacgtattagtagttttcgcgtaaggtttagtatattacgttcggttatttttgagtttagtagtacggtaagtaattcggtattcgtgagtatcgtcgtattacgttgtaatagtttttttttcggtcgttttttagtcggttattttttgatatttattttcgttttttgtttttgttgcggtttatttcgattttgtgttaatttatttcgtttcgtatatgcgacgttttgtcgtaggtatttcgaacgtcgtcgttcgtttttattggaaaaaggtaagtttatgtagcggttgtatcgtaagcgtatcgttttcggcgtgggtggcggtattgtcgtttataaaagcgtcgagttgattcgtcgatttttggagtacggcgcgtaggtgcgcgtcgttatgattcgtggtggtgtcgagtttattatttcgttgattttgtaggcgttgtcgggttattcggtgtatatggatttgttcgattttgtcgtcgaagtagttatgggttatatcgaattggttaagtgggtcgatttggtgttgatcgtttcggttatcgtcgattttatggcgcgtatggtttagggtatggtcgacgatttgttgattattttggtattggttatcgacgttatcgtcgtcgtggtttcggttatgaattaggttatgtggcgcgattcggttatttaggttaattttgagttgtttaagagtcgtggtatttaggtattcggttcggttttcggtagttaggtttgtggcgacgtgggtttgggtcgtatgttcgaagttatcgatttggtttggtgcgtcgtagaaagttttaagcgttaggtatttatcggtaaatacgtattgattatcgtcgggtcgatttaggaaaatatcgattcggtgcgttatattattaattatagtttcggtaagatgggtttcgttttggtcgaagcggttgtcgaagtcggggttcgggtgattttcgttacgggttcggtgtatttgttaattttcgatcgggttagtcgtatcgacgtggttagcgcgcgggatatgttcgcggtttgtgaagtagttatgttatgcgatttgtttatcgtttcggtagcggtcgcggattatcgttcggaagtggttgttatataaaaattgaagaaagattttacgatcggcgacggtatgttgttgtagatggtgcgtaatttcgatatttttgttattattgttggtcgtagcgatcgttcgtttagcgtcggtttcgtcgtcgaaatcgaatatttgttcgattacgttacgcgtaagtttaaggataagaatttcgatttgatcgtcgttaatgatgtggttaattttagtatcggttttaatagcgaagaaaacgttttgatcgtgatcgatcgttagtagtattagatttttttcgcgtagattagtaagggtaagatcgttcggtaattggtcgtttttatcgtcgaacggtttaattaggtttaataagttatatgtacgttttttaagttaagattttcgatttacgtttgggtttcg

SEQ ID NO: 1348 - DNA, 2088 bp, Artificial Sequence
  chemically treated genomic DNA (Homo sapiens) CpG-island No: 1348
cgaaacccaaacgtaaatcgaaaatcttaacttaaaaaacgtacatataacttattaaacctaattaaaccgttcgacgataaaaacgaccaattaccgaacgatcttacccttactaatctacgcgaaaaaaatctaatactactaacgatcgatcacgatcaaaacgttttcttcgctattaaaaccgatactaaaattaaccacatcattaacgacgatcaaatcgaaattcttatccttaaacttacgcgtaacgtaatcgaacaaatattcgatttcgacgacgaaaccgacgctaaacgaacgatcgctacgaccaacaataataacaaaaatatcgaaattacgcaccatctacaacaacataccgtcgccgatcgtaaaatctttcttcaatttttatataacaaccacttccgaacgataatccgcgaccgctaccgaaacgataaacaaatcgcataacataactacttcacaaaccgcgaacatatcccgcgcgctaaccacgtcgatacgactaacccgatcgaaaattaacaaatacaccgaacccgtaacgaaaatcacccgaaccccgacttcgacaaccgcttcgaccaaaacgaaacccatcttaccgaaactataattaataatataacgcaccgaatcgatattttcctaaatcgacccgacgataatcaatacgtatttaccgataaatacctaacgcttaaaactttctacgacgcaccaaaccaaatcgataacttcgaacatacgacccaaacccacgtcgccacaaacctaactaccgaaaaccgaaccgaatacctaaataccacgactcttaaacaactcaaaattaacctaaataaccgaatcgcgccacataacctaattcataaccgaaaccacgacgacgataacgtcgataaccaataccaaaataatcaacaaatcgtcgaccataccctaaaccatacgcgccataaaatcgacgataaccgaaacgatcaacaccaaatcgacccacttaaccaattcgatataacccataactacttcgacgacaaaatcgaacaaatccatatacaccgaataacccgacaacgcctacaaaatcaacgaaataataaactcgacaccaccacgaatcataacgacgcgcacctacgcgccgtactccaaaaatcgacgaatcaactcgacgcttttataaacgacaataccgccacccacgccgaaaacgatacgcttacgatacaaccgctacataaacttacctttttccaataaaaacgaacgacgacgttcgaaatacctacgacaaaacgtcgcatatacgaaacgaaataaattaacacaaaatcgaaataaaccgcaacaaaaacaaaaaacgaaaataaatatcaaaaaataaccgactaaaaaacgaccgaaaaaaaaactattacaacgtaatacgacgatactcacgaataccgaattacttaccgtactactaaactcaaaaataaccgaacgtaatatactaaaccttacgcgaaaactactaatacgttttaacgaactaaaacaatttctaaaaaccgaacgcgacgcgctactacgcgaaccgaacatcgaaaccgtaaaatatacacaattacaaacgctactaaaaatcgaccgacgttatctaaataaaaacatcaaacgcgcaaaaactctaaataaaccaacgacgatacgacgttatctcaaaaccatactacgacataaaaccaataaaatattcgaatacctatttctaaacaccaaacaccgaccgttaacgttcgaaatcctattcaaaaacacgataaaccgaacgaatatttacccgcgaaaaataatacgacgaactttactacataacgcgacgacgttaatcctttaccacaaccacccctcaaacaacaataaaccgaaccaaaacgatatacatctaaccttattactaaaacgcgaattaacattaatcgatatacgaatactaaatcacatcatcattaacgataaaaaaccgttatcgataattaaacataaataaattataacctaaaacaaatcaataaaaac

SEQ ID NO: 1349 - DNA, 568 bp, Artificial Sequence
  chemically treated genomic DNA (Homo sapiens) CpG-island No: 1349
ttttgcggagttttcgtcgcgtgcgcgatttatggcggtcgtggaggttaaggatttcgcgcgagtgtaagagttgatcgaggcgcgtggagttaagtcggcggttgattatgtttttgcgtagttcgtcgtggtcgaaggtttggatcgtaagtttggtgcgcgcgtcgtggtcgggaaagcggcgggtagtatggtaatgtcgtttgcggcgttgggttttacgttaaggggagaagcggtatacgttatcgagcggttagtttatggtgagtcgaggtttagtattgcgaagtagtattagtaggaatggaatcggaaggcggcgatttggtgggcgatggtcggtgtggtcggtattatcggcgcgattttggcggcggcggtaatcggttttgttgggttggtagtgtcgattcgtaatcgagtgaagcgcgtgcgcgatttgttggtgatggagtcgggtgtagagttataagcggtaagagacgaaagttcggttttcgggtttttgttttgttacgttaaggacgagttttagcggttaaaggtgttgacgtgcgagaaa

SEQ ID NO: 1350 - DNA, 568 bp, Artificial Sequence
  chemically treated genomic DNA (Homo sapiens) CpG-island No: 1350
tttctcgcacgtcaacacctttaaccgctaaaactcgtccttaacgtaacaaaacaaaaacccgaaaaccgaactttcgtctcttaccgcttataactctacacccgactccatcaccaacaaatcgcgcacgcgcttcactcgattacgaatcgacactaccaacccaacaaaaccgattaccgccgccgccaaaatcgcgccgataataccgaccacaccgaccatcgcccaccaaatcgccgccttccgattccattcctactaatactacttcgcaatactaaacctcgactcaccataaactaaccgctcgataacgtataccgcttctccccttaacgtaaaacccaacgccgcaaacgacattaccatactacccgccgctttcccgaccacgacgcgcgcaccaaacttacgatccaaaccttcgaccacgacgaactacgcaaaaacataatcaaccgccgacttaactccacgcgcctcgatcaactcttacactcgcgcgaaatccttaacctccacgaccgccataaatcgcgcacgcgacgaaaactccgcaaaa

SEQ ID NO: 1351 - DNA, 568 bp, Artificial Sequence
  chemically treated genomic DNA (Homo sapiens) CpG-island No: 1351
tttttcgtacgttaatatttttagtcgttaaaattcgtttttggcgtaataaaataaaagttcggaaatcgggttttcgttttttgtcgtttatggttttgtattcggttttattattaataggtcgcgtacgcgttttattcggttgcggatcgatattgttagtttaataaagtcggttgtcgtcgtcgttaggatcgcgtcgatgatgtcggttatatcggttatcgtttattaggtcgtcgtttttcggttttatttttgttggtattgtttcgtaatgttggatttcggtttattataggttgatcgttcgatggcgtatgtcgtttttttttttggcgtaaaatttagcgtcgtaggcggtattgttatgttgttcgtcgttttttcgattacgacgcgcgtattaggtttgcggtttagattttcggttacggcgagttgcgtaaggatataattagtcgtcgatttggttttacgcgtttcgattagtttttgtattcgcgcgaaatttttggtttttacggtcgttatgaatcgcgtacgcggcgaaggtttcgtaggg

SEQ ID NO: 1352 - DNA, 568 bp, Artificial Sequence
  chemically treated genomic DNA (Homo sapiens) CpG-island No: 1352
ccctacgaaaccttcgccgcgtacgcgattcataacgaccgtaaaaaccaaaaatttcgcgcgaatacaaaaactaatcgaaacgcgtaaaaccaaatcgacgactaattatatccttacgcaactcgccgtaaccgaaaatctaaaccgcaaacctaatacgcgcgtcgtaatcgaaaaaacgacgaacaacataacaataccgcctacgacgctaaattttacgccaaaaaaaaaaacgacatacgccatcgaacgatcaacctataataaaccgaaatccaacattacgaaacaataccaacaaaaataaaaccgaaaaacgacgacctaataaacgataaccgatataaccgacatcatcgacgcgatcctaacgacgacgacaaccgactttattaaactaacaatatcgatccgcaaccgaataaaacgcgtacgcgacctattaataataaaaccgaatacaaaaccataaacgacaaaaaacgaaaacccgatttccgaacttttattttattacgccaaaaacgaattttaacgactaaaaatattaacgtacgaaaaa

SEQ ID NO: 1353 - DNA, 3034 bp, Artificial Sequence
  chemically treated genomic DNA (Homo sapiens) CpG-island No: 1353
ttcgagcgcggtttgcgggttgtcgtgatcgatttggatttttagggtaatgcgttttatacgtttaaggattttgttatcggtttgtatgtaagtaagttgttcggcgttgtttttgtcggcggttggatcgaaatcgtattcgtagtcggcgacggttaggtcgcgcgtttcgtttttatcgagtttaattcggtattggcgaacgtcgaacggttgtcgttggacgacgttcgcgagttgttcggggcgaatattaaggttttggcgaattaaggtttcgacgtgtgtttgatcgatacggtttcgatttttggcgtcggtttggcggtcgtttttttcgcggtcgattatgtgttgttttttatcgagtttgaggcgtatagtatttagggtattaagaagatggttacgattattgcgaacgtgcgttagaagaacgttaagttgtaattttttggtatggtgtttagtaaggtcgatgcgcggaattcgcgttacgcgcgttattaagtcgagttgttggtcgcgtattttaagatgatgatttcggttatcgttggtttgcgtagtagtatcgtcgatgttttcgtattcggtgtgtcggtttggaagattaagaaaacggtcgcgcgtaaggtatcgaaagaggttcgcgttttggttgattacgtgtttacgaagatggagattttttaatgattgcggtttaagttaagattattaagaaaaatatcgttgcggtcgtttaggaagtcgtaggcgcggcgtagtcgttcggtttggggttggatagtatcggcgatttgtcgagttttttggacgtttttgcggcgttttagggcggtttcggttttatcgagttggatttggatttgatcgacgaagattcgtattagtcgcggacggtcgataatttcggttttttttcggagagtatcgcggaaatcggtgttacgattaaagagcgcggggtgaagttatttatttcggtgcgcgagaattaggagtagtcgggtcgttatattattaattacggcgttcgtcgttatcgtggttcgaagtgggtcggtaagaagtttatttcggcgtttatcgataacgattataacgaagtcgattaggttatcgagaatttgtaacgtaacgagttgatttcgcgcgaaattgtcgattttattggtcgcgagttggcgaagggtaagaagaaaggcgatatcgttaaggaaatcggtaagtcgtcggcgtttattatttagtacgttacgttgttggatttgtcggagaagatcgtcgatgcgtttaatatcggtcgcgtgcgcgacgtgatcgtggtgaacgagttggtgacggtttttaagaagcgttcggaggaagtcgaggcgtggtttgacgacgatatttaggaaattacgcgcggtacggttaagttgttgcgcgagtttttggacgagaagggtcgcgattttaatatcgtcgatgtttttaacggttagattgatgtcgagcgtgacgcggaggtcggcgacggttaggacggcgaggacggcgattaggacggtaaggacgttaaggaaaagggcgcgaaggagtcggattcggataagttgaaaaaggttatcgtttaggtcgagtacgacgagcgttttgttcgttttatttttaatcgtcggtcgtcggcggaaggttatgtttggttgaagtacgaggacgacggttaggagttcgaggcgaattttgtcgacgtgaaattggtcgcgtttatcgagggttgatttttaaagatagcggcgcgggttattcgcgtcgtatagataacggtttcgttataaggaggatcgaagaatgaattcgatgttgttttatatcgcgggaggcgtaggcgcggcgttgttgttggttttcgcgattatgttgtttaagttgcgcgagtcgaagaaggaatatcgatcgtagcgtaaggcggcggtttcgacgtcgtagtcggtcgataacgagttgttgcgtatttttcgtcggtcgtcgtaggttagttaattcgagttatttacgacgtcgtcggcgcggcgtattgtttcgtcgagtagcgaataatttagagggaatgacggcgatttcgttacgtcggttttggtggtcggggcgattaatagtattatgttgggttatttggtcggcggttcgttgatcggggttatgttgggcgatgcgttgcggtcggatacgtcgtttgcggcgttcgcggatttttcgtcgtgtttcggtagtagcgatacggatagcggttggatcgatatcggtagtttttgcgattttagttcgttcgatatcgatacgaataattggtgagggcggattatgattgacgaataaaagaaacggtttttgatgttgtaagttattcggcgtagtatttaggtaatgcgtaggggtgtttcggggtcggatagttttaagggttggttgatcggtatcggtattatcgcggcggggtttttggttggcgagttgttgttattttttgttttcggcgtcggtttggttgtgttaggggtttgtattgtcggtttcgtcgtcggttgttggtttaataggaaaggtcgtttatggtcgatagttatttacgattaattggttcgttattagtcgtttaacgagcgggcgtatcgcgatttgtaagagacggtgaaggaacgcggtttcgattgcgatgcggttatggagtggatttatatcgagtaggtcgagtttatgtttttggtgtttattagggaggatttagcgcgcgataagtttttgatcgcgacgcgggtcgatagggtcgaggacgatgcgcgtgcgcgtttcgtcgtgttttattttaagaagcgcggtttcgacgtatgaagaagttcgacgttcgttaatttttttttcgttgattttttgttttcgtcgatcgtgcggggttttttttgtttgttttttagtcgttaaaaaatttgtcgttaagtcgagaattgtttagttaaatttttgcgttgataaggtaggt

SEQ ID NO: 1354 - DNA, 3034 bp, Artificial Sequence
  chemically treated genomic DNA (Homo sapiens) CpG-island No: 1354
acctaccttatcaacgcaaaaatttaactaaacaattctcgacttaacgacaaattttttaacgactaaaaaacaaacaaaaaaaaccccgcacgatcgacgaaaacaaaaaatcaacgaaaaaaaaattaacgaacgtcgaacttcttcatacgtcgaaaccgcgcttcttaaaataaaacacgacgaaacgcgcacgcgcatcgtcctcgaccctatcgacccgcgtcgcgatcaaaaacttatcgcgcgctaaatcctccctaataaacaccaaaaacataaactcgacctactcgatataaatccactccataaccgcatcgcaatcgaaaccgcgttccttcaccgtctcttacaaatcgcgatacgcccgctcgttaaacgactaataacgaaccaattaatcgtaaataactatcgaccataaacgacctttcctattaaaccaacaaccgacgacgaaaccgacaatacaaacccctaacacaaccaaaccgacgccgaaaacaaaaaataacaacaactcgccaaccaaaaaccccgccgcgataataccgataccgatcaaccaacccttaaaactatccgaccccgaaacacccctacgcattacctaaatactacgccgaataacttacaacatcaaaaaccgtttcttttattcgtcaatcataatccgccctcaccaattattcgtatcgatatcgaacgaactaaaatcgcaaaaactaccgatatcgatccaaccgctatccgtatcgctactaccgaaacacgacgaaaaatccgcgaacgccgcaaacgacgtatccgaccgcaacgcatcgcccaacataaccccgatcaacgaaccgccgaccaaataacccaacataatactattaatcgccccgaccaccaaaaccgacgtaacgaaatcgccgtcattccctctaaattattcgctactcgacgaaacaatacgccgcgccgacgacgtcgtaaataactcgaattaactaacctacgacgaccgacgaaaaatacgcaacaactcgttatcgaccgactacgacgtcgaaaccgccgccttacgctacgatcgatattccttcttcgactcgcgcaacttaaacaacataatcgcgaaaaccaacaacaacgccgcgcctacgcctcccgcgatataaaacaacatcgaattcattcttcgatcctccttataacgaaaccgttatctatacgacgcgaataacccgcgccgctatctttaaaaatcaaccctcgataaacgcgaccaatttcacgtcgacaaaattcgcctcgaactcctaaccgtcgtcctcgtacttcaaccaaacataaccttccgccgacgaccgacgattaaaaataaaacgaacaaaacgctcgtcgtactcgacctaaacgataacctttttcaacttatccgaatccgactccttcgcgcccttttccttaacgtccttaccgtcctaatcgccgtcctcgccgtcctaaccgtcgccgacctccgcgtcacgctcgacatcaatctaaccgttaaaaacatcgacgatattaaaatcgcgacccttctcgtccaaaaactcgcgcaacaacttaaccgtaccgcgcgtaatttcctaaatatcgtcgtcaaaccacgcctcgacttcctccgaacgcttcttaaaaaccgtcaccaactcgttcaccacgatcacgtcgcgcacgcgaccgatattaaacgcatcgacgatcttctccgacaaatccaacaacgtaacgtactaaataataaacgccgacgacttaccgatttccttaacgatatcgcctttcttcttacccttcgccaactcgcgaccaataaaatcgacaatttcgcgcgaaatcaactcgttacgttacaaattctcgataacctaatcgacttcgttataatcgttatcgataaacgccgaaataaacttcttaccgacccacttcgaaccacgataacgacgaacgccgtaattaataatataacgacccgactactcctaattctcgcgcaccgaaataaataacttcaccccgcgctctttaatcgtaacaccgatttccgcgatactctccgaaaaaaaaccgaaattatcgaccgtccgcgactaatacgaatcttcgtcgatcaaatccaaatccaactcgataaaaccgaaaccgccctaaaacgccgcaaaaacgtccaaaaaactcgacaaatcgccgatactatccaaccccaaaccgaacgactacgccgcgcctacgacttcctaaacgaccgcaacgatatttttcttaataatcttaacttaaaccgcaatcattaaaaaatctccatcttcgtaaacacgtaatcaaccaaaacgcgaacctctttcgataccttacgcgcgaccgttttcttaatcttccaaaccgacacaccgaatacgaaaacatcgacgatactactacgcaaaccaacgataaccgaaatcatcatcttaaaatacgcgaccaacaactcgacttaataacgcgcgtaacgcgaattccgcgcatcgaccttactaaacaccataccaaaaaattacaacttaacgttcttctaacgcacgttcgcaataatcgtaaccatcttcttaataccctaaatactatacgcctcaaactcgataaaaaacaacacataatcgaccgcgaaaaaaacgaccgccaaaccgacgccaaaaatcgaaaccgtatcgatcaaacacacgtcgaaaccttaattcgccaaaaccttaatattcgccccgaacaactcgcgaacgtcgtccaacgacaaccgttcgacgttcgccaataccgaattaaactcgataaaaacgaaacgcgcgacctaaccgtcgccgactacgaatacgatttcgatccaaccgccgacaaaaacaacgccgaacaacttacttacatacaaaccgataacaaaatccttaaacgtataaaacgcattaccctaaaaatccaaatcgatcacgacaacccgcaaaccgcgctcgaa

SEQ ID NO: 1355 - DNA, 3034 bp, Artificial Sequence
  chemically treated genomic DNA (Homo sapiens) CpG-island No: 1355
atttattttattagcgtaagagtttagttgaatagttttcgatttaacggtaggttttttagcggttgaagggtaggtaaaaaaagtttcgtacggtcggcgggggtaaagggttagcgggaaggggattagcgggcgtcgggtttttttatgcgtcggggtcgcgttttttgggatggagtacgacgaagcgcgtacgcgtatcgttttcggttttatcggttcgcgtcgcggttaggaatttgtcgcgcgttaggttttttttggtgggtattaggggtatgaattcggtttgttcgatgtaggtttattttatgatcgtatcgtagtcgaggtcgcgtttttttatcgttttttgtaggtcgcggtacgttcgttcgttgagcggttggtaacgggttaattggtcgtaaatggttgtcggttatgagcggttttttttgttgagttagtagtcgacgacgaagtcggtaatgtaggtttttggtataattaggtcgacgtcgggggtaggggatggtagtagttcgttaattaggaatttcgtcgcgatgatgtcgatgtcggttaattagtttttgaaattattcggtttcgaaatatttttgcgtattgtttggatgttgcgtcggatagtttgtaatattaggagtcgttttttttgttcgttagttatggttcgtttttattagttgttcgtatcggtgtcggacgaattgaaatcgtaagagttgtcggtatcggtttagtcgttgttcgtgtcgttgttgtcgaagtacggcgaggggttcgcgaacgtcgtagacggcgtattcggtcgtagcgtatcgtttagtatggtttcggttagcgagtcgtcggttaggtagtttagtatggtgttgttggtcgtttcggttattagggtcgacgtgacgaaatcgtcgttattttttttggattgttcgttgttcggcggggtagtgcgtcgcgtcggcggcgtcgtggatggttcgggttggttggtttgcgacggtcggcgaaaggtgcgtagtagttcgttatcgatcggttgcggcgtcggggtcgtcgttttgcgttgcggtcggtgtttttttttcggttcgcgtagtttgaatagtatgatcgcggaaattagtagtaacgtcgcgtttacgtttttcgcgatgtagaatagtatcggatttatttttcggttttttttgtagcggaatcgttgtttgtgcggcgcgggtggttcgcgtcgttgtttttggggattagttttcgatgagcgcgattagttttacgtcggtaaggttcgtttcgaatttttggtcgtcgttttcgtattttaattaggtatagtttttcgtcggcggtcgacggttgaggataaggcgggtagggcgttcgtcgtgttcgatttggacgatggttttttttagtttgttcgggttcggttttttcgcgtttttttttttggcgtttttatcgttttggtcgtcgttttcgtcgttttggtcgtcgtcggttttcgcgttacgttcggtattagtttggtcgttgaaggtatcgacggtgttgggatcgcggtttttttcgtttaggaattcgcgtagtagtttgatcgtgtcgcgcgtgattttttgggtgtcgtcgttaagttacgtttcgatttttttcgggcgttttttgaaggtcgttattagttcgtttattacggttacgtcgcgtacgcggtcggtgttgaacgtatcggcgatttttttcggtaggtttagtagcgtgacgtgttgggtgatgaacgtcggcgatttgtcgatttttttggcgatatcgtttttttttttgtttttcgttagttcgcggttaatgaagtcggtaatttcgcgcggggttagttcgttgcgttgtaggttttcgataatttggtcggtttcgttgtagtcgttgtcgatgaacgtcgggatggattttttgtcggtttatttcgagttacggtagcggcgggcgtcgtgattgatgatatagcggttcggttgtttttggttttcgcgtatcgaaatgggtgattttatttcgcgttttttgatcgtggtatcgattttcgcgatgtttttcggggaaaagtcggggttgtcggtcgttcgcggttgatgcggattttcgtcgattaggtttaggtttagttcgatagggtcggaatcgttttgagacgtcgtaggagcgtttaggaggttcgataggtcgtcgatgttatttaattttaggtcggacggttgcgtcgcgtttgcggttttttgagcggtcgtagcggtgttttttttggtggttttggtttgagtcgtagttattgggaaatttttattttcgtgaatacgtaattagttagggcgcgaatttttttcgatgttttgcgcgcggtcgtttttttgattttttagatcggtatatcggatgcgagggtatcggcgatgttgttgcgtaggttaacggtggtcggaattattattttggggtacgcggttagtagttcggtttggtggcgcgcgtggcgcggatttcgcgtatcgattttgttgggtattatgttaaggaattgtagtttggcgtttttttggcgtacgttcgtaatggtcgtgattatttttttgatgttttggatgttgtacgttttaagttcgatgggggatagtatatagtcggtcgcgaagagggcggtcgttaggtcgacgttaagggtcggggtcgtgtcgattaggtatacgtcgaagttttggttcgttagggttttgatgttcgtttcgaatagttcgcgggcgtcgtttagcgatagtcgttcggcgttcgttagtatcgggttggattcgatgagggcgaggcgcgcggtttggtcgtcgtcggttgcgggtgcggtttcggtttagtcgtcggtagggatagcgtcgaatagtttgtttgtatgtaggtcggtagtaaagtttttgagcgtgtaggacgtattgttttgggggtttaggtcgattacggtaattcgtaagtcgcgttcgaa

SEQ ID NO: 1356 - DNA, 3034 bp, Artificial Sequence
  chemically treated genomic DNA (Homo sapiens) CpG-island No: 1356
ttcgaacgcgacttacgaattaccgtaatcgacctaaacccccaaaacaatacgtcctacacgctcaaaaactttactaccgacctacatacaaacaaactattcgacgctatccctaccgacgactaaaccgaaaccgcacccgcaaccgacgacgaccaaaccgcgcgcctcgccctcatcgaatccaacccgatactaacgaacgccgaacgactatcgctaaacgacgcccgcgaactattcgaaacgaacatcaaaaccctaacgaaccaaaacttcgacgtatacctaatcgacacgaccccgacccttaacgtcgacctaacgaccgccctcttcgcgaccgactatatactatcccccatcgaacttaaaacgtacaacatccaaaacatcaaaaaaataatcacgaccattacgaacgtacgccaaaaaaacgccaaactacaattccttaacataatacccaacaaaatcgatacgcgaaatccgcgccacgcgcgccaccaaaccgaactactaaccgcgtaccccaaaataataattccgaccaccgttaacctacgcaacaacatcgccgataccctcgcatccgatataccgatctaaaaaatcaaaaaaacgaccgcgcgcaaaacatcgaaaaaaattcgcgccctaactaattacgtattcacgaaaataaaaatttcccaataactacgactcaaaccaaaaccaccaaaaaaaacaccgctacgaccgctcaaaaaaccgcaaacgcgacgcaaccgtccgacctaaaattaaataacatcgacgacctatcgaacctcctaaacgctcctacgacgtctcaaaacgattccgaccctatcgaactaaacctaaacctaatcgacgaaaatccgcatcaaccgcgaacgaccgacaaccccgacttttccccgaaaaacatcgcgaaaatcgataccacgatcaaaaaacgcgaaataaaatcacccatttcgatacgcgaaaaccaaaaacaaccgaaccgctatatcatcaatcacgacgcccgccgctaccgtaactcgaaataaaccgacaaaaaatccatcccgacgttcatcgacaacgactacaacgaaaccgaccaaattatcgaaaacctacaacgcaacgaactaaccccgcgcgaaattaccgacttcattaaccgcgaactaacgaaaaacaaaaaaaaaaacgatatcgccaaaaaaatcgacaaatcgccgacgttcatcacccaacacgtcacgctactaaacctaccgaaaaaaatcgccgatacgttcaacaccgaccgcgtacgcgacgtaaccgtaataaacgaactaataacgaccttcaaaaaacgcccgaaaaaaatcgaaacgtaacttaacgacgacacccaaaaaatcacgcgcgacacgatcaaactactacgcgaattcctaaacgaaaaaaaccgcgatcccaacaccgtcgataccttcaacgaccaaactaataccgaacgtaacgcgaaaaccgacgacgaccaaaacgacgaaaacgacgaccaaaacgataaaaacgccaaaaaaaaaaacgcgaaaaaaccgaacccgaacaaactaaaaaaaaccatcgtccaaatcgaacacgacgaacgccctacccgccttatcctcaaccgtcgaccgccgacgaaaaactatacctaattaaaatacgaaaacgacgaccaaaaattcgaaacgaaccttaccgacgtaaaactaatcgcgctcatcgaaaactaatccccaaaaacaacgacgcgaaccacccgcgccgcacaaacaacgattccgctacaaaaaaaaccgaaaaataaatccgatactattctacatcgcgaaaaacgtaaacgcgacgttactactaatttccgcgatcatactattcaaactacgcgaaccgaaaaaaaaacaccgaccgcaacgcaaaacgacgaccccgacgccgcaaccgatcgataacgaactactacgcacctttcgccgaccgtcgcaaaccaaccaacccgaaccatccacgacgccgccgacgcgacgcactaccccgccgaacaacgaacaatccaaaaaaaataacgacgatttcgtcacgtcgaccctaataaccgaaacgaccaacaacaccatactaaactacctaaccgacgactcgctaaccgaaaccatactaaacgatacgctacgaccgaatacgccgtctacgacgttcgcgaacccctcgccgtacttcgacaacaacgacacgaacaacgactaaaccgataccgacaactcttacgatttcaattcgtccgacaccgatacgaacaactaataaaaacgaaccataactaacgaacaaaaaaaacgactcctaatattacaaactatccgacgcaacatccaaacaatacgcaaaaatatttcgaaaccgaataatttcaaaaactaattaaccgacatcgacatcatcgcgacgaaattcctaattaacgaactactaccatcccctacccccgacgtcgacctaattataccaaaaacctacattaccgacttcgtcgtcgactactaactcaacaaaaaaaaccgctcataaccgacaaccatttacgaccaattaacccgttaccaaccgctcaacgaacgaacgtaccgcgacctacaaaaaacgataaaaaaacgcgacctcgactacgatacgatcataaaataaacctacatcgaacaaaccgaattcatacccctaatacccaccaaaaaaaacctaacgcgcgacaaattcctaaccgcgacgcgaaccgataaaaccgaaaacgatacgcgtacgcgcttcgtcgtactccatcccaaaaaacgcgaccccgacgcataaaaaaacccgacgcccgctaatccccttcccgctaaccctttacccccgccgaccgtacgaaactttttttacctacccttcaaccgctaaaaaacctaccgttaaatcgaaaactattcaactaaactcttacgctaataaaataaat

SEQ ID NO: 1357 - DNA, 890 bp, Artificial Sequence
  chemically treated genomic DNA (Homo sapiens) CpG-island No: 1357
aggcgatcgggagaatttttcgatcgtggatgtagtgcgtaaggtcgttcgcgttaatatgaacgacgttagcgtcggtatgcgcgaatggcgacgttagcgtacggcgtaggtcgtttcgttggtagtttaggtgtcggacgcggtgtagtaggtcggtaattaggtcgtggtcgttttttggtaagtcgtttaggtttttgttaatgaatcgttgtaggtagcgtaagtcggttgggatcgtgagcgtaacgagttggaagtcgtgcgcggggagttggtcgacgttttcgaggcgtaggttcgcgagttggaagaagtttaggcgcgcgttatattgttagagtagtaggtcgtcgaggcggtcgagttggtcgtacgttagcggtaagttttggtcgaagtacgtatcgttttggtaggagtcgagtagcgggtcgcgttggcgacgtagcgggtcgacgaggtggagcgtcgagcgtaggagttgcgcgtcgagttggattacgtttattaggacgttcgcgtatttaaagaagagagtcgtaagattttggacgcggttaattaggaaatgtaggcgtttcgcggcgagcgcgacgttattaggcgcgaagcggagagtttgcgtacggagttggtagcggtgaaagcgaaggcgtaggtcgacgtcgaggtttattaggagtaaaggaagttggcggcgtaagaggcggttaggtaggtcgagcgttttacgacggtgtaagtcgagcgtgacgaagcgcggtaagaggtaaaggtagtttaagaagaggtcgttatgttgaggggtcggttagacgcggaaacgagtgggaggaaatataaagcgggaggaaagtaattgataaatcgaacgtagtttatta

SEQ ID NO: 1358 - DNA, 890 bp, Artificial Sequence
  chemically treated genomic DNA (Homo sapiens) CpG-island No: 1358
taataaactacgttcgatttatcaattactttcctcccgctttatatttcctcccactcgtttccgcgtctaaccgacccctcaacataacgacctcttcttaaactacctttacctcttaccgcgcttcgtcacgctcgacttacaccgtcgtaaaacgctcgacctacctaaccgcctcttacgccgccaacttcctttactcctaataaacctcgacgtcgacctacgccttcgctttcaccgctaccaactccgtacgcaaactctccgcttcgcgcctaataacgtcgcgctcgccgcgaaacgcctacatttcctaattaaccgcgtccaaaatcttacgactctcttctttaaatacgcgaacgtcctaataaacgtaatccaactcgacgcgcaactcctacgctcgacgctccacctcgtcgacccgctacgtcgccaacgcgacccgctactcgactcctaccaaaacgatacgtacttcgaccaaaacttaccgctaacgtacgaccaactcgaccgcctcgacgacctactactctaacaatataacgcgcgcctaaacttcttccaactcgcgaacctacgcctcgaaaacgtcgaccaactccccgcgcacgacttccaactcgttacgctcacgatcccaaccgacttacgctacctacaacgattcattaacaaaaacctaaacgacttaccaaaaaacgaccacgacctaattaccgacctactacaccgcgtccgacacctaaactaccaacgaaacgacctacgccgtacgctaacgtcgccattcgcgcataccgacgctaacgtcgttcatattaacgcgaacgaccttacgcactacatccacgatcgaaaaattctcccgatcgcct

SEQ ID NO: 1359 - DNA, 890 bp, Artificial Sequence
  chemically treated genomic DNA (Homo sapiens) CpG-island No: 1359
tagtgaattgcgttcgatttattagttatttttttttcgttttgtgtttttttttattcgttttcgcgtttagtcgattttttaatatagcggtttttttttgggttgtttttgttttttgtcgcgtttcgttacgttcggtttgtatcgtcgtaaagcgttcggtttgtttggtcgttttttgcgtcgttaattttttttgtttttggtgggtttcggcgtcggtttgcgttttcgtttttatcgttgttaatttcgtgcgtaaatttttcgtttcgcgtttggtggcgtcgcgttcgtcgcgaagcgtttgtattttttggttggtcgcgtttagggttttgcggtttttttttttgaatgcgcgggcgttttggtgagcgtagtttagttcggcgcgtagtttttgcgttcgacgttttatttcgtcggttcgttgcgtcgttagcgcggttcgttgttcggtttttgttagggcggtgcgtgtttcggttagggtttgtcgttggcgtgcggttagttcggtcgtttcggcggtttgttgttttagtaatgtaacgcgcgtttgggttttttttagttcgcgggtttgcgtttcgaaggcgtcggttagtttttcgcgtacggtttttaattcgttgcgtttacgattttagtcggtttgcgttgtttgtaacgatttattggtaagggtttgggcggtttgttagagggcggttacggtttggttgtcggtttgttgtatcgcgttcggtatttggattgttagcggggcggtttgcgtcgtgcgttggcgtcgttattcgcgtatgtcggcgttggcgtcgtttatgttgacgcgggcggttttacgtattgtatttacggtcgggaagttttttcggtcgttt

SEQ ID NO: 1360 - DNA, 890 bp, Artificial Sequence
  chemically treated genomic DNA (Homo sapiens) CpG-island No: 1360
aaacgaccgaaaaaacttcccgaccgtaaatacaatacgtaaaaccgcccgcgtcaacataaacgacgccaacgccgacatacgcgaataacgacgccaacgcacgacgcaaaccgccccgctaacaatccaaataccgaacgcgatacaacaaaccgacaaccaaaccgtaaccgccctctaacaaaccgcccaaacccttaccaataaatcgttacaaacaacgcaaaccgactaaaatcgtaaacgcaacgaattaaaaaccgtacgcgaaaaactaaccgacgccttcgaaacgcaaacccgcgaactaaaaaaaacccaaacgcgcgttacattactaaaacaacaaaccgccgaaacgaccgaactaaccgcacgccaacgacaaaccctaaccgaaacacgcaccgccctaacaaaaaccgaacaacgaaccgcgctaacgacgcaacgaaccgacgaaataaaacgtcgaacgcaaaaactacgcgccgaactaaactacgctcaccaaaacgcccgcgcattcaaaaaaaaaaaccgcaaaaccctaaacgcgaccaaccaaaaaatacaaacgcttcgcgacgaacgcgacgccaccaaacgcgaaacgaaaaatttacgcacgaaattaacaacgataaaaacgaaaacgcaaaccgacgccgaaacccaccaaaaacaaaaaaaattaacgacgcaaaaaacgaccaaacaaaccgaacgctttacgacgatacaaaccgaacgtaacgaaacgcgacaaaaaacaaaaacaacccaaaaaaaaaccgctatattaaaaaatcgactaaacgcgaaaacgaataaaaaaaaacacaaaacgaaaaaaaaataactaataaatcgaacgcaattcacta

SEQ ID NO: 1361 - DNA, 1123 bp, Artificial Sequence
  chemically treated genomic DNA (Homo sapiens) CpG-island No: 1361
cgcgggcgtattcgttagagttttagcggttaaaaagggaggcgttttgagtagttatagtagagtcgagcgcgtatcgtggggagatttttcgaaggtggttcgtaacggcgattttggttttttgattaacgagtttgaatattaggttgcgaagtagggcgacgcggaagcggcgtttaatttggtcgagcgtttgatttcggacgatattgttgtttagtttaagacgttgatcggcgacgataagtttcgtatcgttttagttttcgtcgtcgaggcggcggggaataataagatttcggttatgatggcggtcgttttggtcgatcgttttggttttgaggtcgaaacggatattgtgtagcgggagaaggtcgttcgaatcggagtcggtttagattatcgtttggcgtttaattcgattttcgagggggaggtgattttcggttagaagtatatcgttgtcgatgatacgttgacgatgggcggtattattgttttattacgcggttatatcgagaataacggcggtaaggttatggcggcgttcgttatgatcgtttatgaaggcgcgtttgatttggcggttaagtcgaagatgtttgcgggtattaatgagaaatacggtttagtaatggacgtattttggaaggaaatttttggttatggtatcgatcgatttatttaaggagaagtcggatattttcgcgttgtttcgttcgttgacgtaattcgagatcgtatcgttgcggttcgaaatgaagtagttaatcgagtgggggtaagtcgaattgcgacgacggcgcgagtagggtaatagtagttttcggtagtaaagtagtttagcggtaatagcggcgaggatttgttataggcggtttaggaggtcgagacggaatagtaggtttttttagaattcgcgtttatcgagtagatttattagtagatttttgcgttttacgtgtaggtaaagtatgattaggtggagcgtatcgaggatcgtttagaatagttcgtagatcgttagtaggcgcgtttgtagtagttatagtttaatgttttcggtttgttgtttttgtcgcgtataaaggtcgtttggtagtagtagtaggtttaatag

SEQ ID NO: 1362 - DNA, 1123 bp, Artificial Sequence
  chemically treated genomic DNA (Homo sapiens) CpG-island No: 1362
ctattaaacctactactactaccaaacgacctttatacgcgacaaaaacaacaaaccgaaaacattaaactataactactacaaacgcgcctactaacgatctacgaactattctaaacgatcctcgatacgctccacctaatcatactttacctacacgtaaaacgcaaaaatctactaataaatctactcgataaacgcgaattctaaaaaaacctactattccgtctcgacctcctaaaccgcctataacaaatcctcgccgctattaccgctaaactactttactaccgaaaactactattaccctactcgcgccgtcgtcgcaattcgacttacccccactcgattaactacttcatttcgaaccgcaacgatacgatctcgaattacgtcaacgaacgaaacaacgcgaaaatatccgacttctccttaaataaatcgatcgataccataaccaaaaatttccttccaaaatacgtccattactaaaccgtatttctcattaatacccgcaaacatcttcgacttaaccgccaaatcaaacgcgccttcataaacgatcataacgaacgccgccataaccttaccgccgttattctcgatataaccgcgtaataaaacaataataccgcccatcgtcaacgtatcatcgacaacgatatacttctaaccgaaaatcacctccccctcgaaaatcgaattaaacgccaaacgataatctaaaccgactccgattcgaacgaccttctcccgctacacaatatccgtttcgacctcaaaaccaaaacgatcgaccaaaacgaccgccatcataaccgaaatcttattattccccgccgcctcgacgacgaaaactaaaacgatacgaaacttatcgtcgccgatcaacgtcttaaactaaacaacaatatcgtccgaaatcaaacgctcgaccaaattaaacgccgcttccgcgtcgccctacttcgcaacctaatattcaaactcgttaatcaaaaaaccaaaatcgccgttacgaaccaccttcgaaaaatctccccacgatacgcgctcgactctactataactactcaaaacgcctccctttttaaccgctaaaactctaacgaatacgcccgcg

SEQ ID NO: 1363 - DNA, 1123 bp, Artificial Sequence
  chemically treated genomic DNA (Homo sapiens) CpG-island No: 1363
ttgttgggtttgttgttgttgttaggcggtttttgtacgcggtagggatagtaagtcgggggtattggattgtagttgttgtaaacgcgtttgttgacggtttacgagttgttttaggcggttttcgatgcgttttatttggttatgttttgtttgtacgtagagcgtaagggtttgttggtaggtttgttcgatgggcgcggattttaagagggtttgttgtttcgtttcggttttttgggtcgtttgtagtaaattttcgtcgttgttgtcgttggattgttttattgtcggggattgttgttgttttgttcgcgtcgtcgtcgtagttcggtttgtttttattcgattgattgttttatttcgagtcgtagcgatgcgatttcggattgcgttaacggacggggtagcgcggaggtgttcggtttttttttgggtgagtcggtcgatgttatagttaaaggtttttttttaaaatgcgtttattgttggatcgtgttttttattgatgttcgtaagtattttcggtttgatcgttaggttaagcgcgtttttatgggcggttatgacggacgtcgttatgattttgtcgtcgttgttttcgatgtagtcgcgtaatgaggtaatggtgtcgtttatcgttagcgtgttatcgataacgatgtatttttggtcggggattatttttttttcgaaagtcgggttgaacgttaggcgatgatttgaatcggtttcggttcgggcgattttttttcgttgtataatgttcgtttcgattttaaggttaaggcggtcggttagaacgatcgttattatggtcggaattttgttgtttttcgtcgtttcgacggcgaggattggaacgatgcggggtttgtcgtcgtcgattagcgttttgagttgggtaatagtgtcgttcgaaattaggcgttcgattaaattaagcgtcgttttcgcgtcgttttgtttcgtagtttggtatttaggttcgttggttaaagaattaaggtcgtcgttgcgaattattttcgggaagtttttttacggtgcgcgttcggttttgttgtagttgtttaagacgtttttttttttagtcgttaaaattttaacgagtgcgttcgcg

SEQ ID NO: 1364 - DNA, 1123 bp, Artificial Sequence
  chemically treated genomic DNA (Homo sapiens) CpG-island No: 1364
cgcgaacgcactcgttaaaattttaacgactaaaaaaaaaaacgtcttaaacaactacaacaaaaccgaacgcgcaccgtaaaaaaacttcccgaaaataattcgcaacgacgaccttaattctttaaccaacgaacctaaataccaaactacgaaacaaaacgacgcgaaaacgacgcttaatttaatcgaacgcctaatttcgaacgacactattacccaactcaaaacgctaatcgacgacgacaaaccccgcatcgttccaatcctcgccgtcgaaacgacgaaaaacaacaaaattccgaccataataacgatcgttctaaccgaccgccttaaccttaaaatcgaaacgaacattatacaacgaaaaaaaatcgcccgaaccgaaaccgattcaaatcatcgcctaacgttcaacccgactttcgaaaaaaaaataatccccgaccaaaaatacatcgttatcgataacacgctaacgataaacgacaccattacctcattacgcgactacatcgaaaacaacgacgacaaaatcataacgacgtccgtcataaccgcccataaaaacgcgcttaacctaacgatcaaaccgaaaatacttacgaacatcaataaaaaacacgatccaacaataaacgcattttaaaaaaaaacctttaactataacatcgaccgactcacccaaaaaaaaaccgaacacctccgcgctaccccgtccgttaacgcaatccgaaatcgcatcgctacgactcgaaataaaacaatcaatcgaataaaaacaaaccgaactacgacgacgacgcgaacaaaacaacaacaatccccgacaataaaacaatccaacgacaacaacgacgaaaatttactacaaacgacccaaaaaaccgaaacgaaacaacaaaccctcttaaaatccgcgcccatcgaacaaacctaccaacaaacccttacgctctacgtacaaacaaaacataaccaaataaaacgcatcgaaaaccgcctaaaacaactcgtaaaccgtcaacaaacgcgtttacaacaactacaatccaatacccccgacttactatccctaccgcgtacaaaaaccgcctaacaacaacaacaaacccaacaa

SEQ ID NO: 1365 - DNA, 1891 bp, Artificial Sequence
  chemically treated genomic DNA (Homo sapiens) CpG-island No: 1365
atttacgcgtttaagatcgaggaattggcgacgcgtaagatgcgcgcggagtatttcgagttggtcggcgattgggattcgatgcgtgaagtagttcgacggtattaggttttgatgcgtaagtaggagtaggagaagaaataggtttaggagcgcgagcgcgggcgtagttagagtttgggtttgttaaataagtttagttaacgtaaaaataaagttcggtaacgtcgggtttttttatttgcgtttttgcgatttataacgaggtttatattattagggcggtcgcgaataatattatgtcgtcggcgattatgtttattatcgttacgcgtcgcgcgttcgcgattttggtcgcgagttggcggttaaggtcgtcgtcgatttttttgcggatcgtttcggtcgtttgcgcggcgttgttttttattattttcgttattgcgtttttgttggtcgttagggtcgcgtttagtattcgtttcgttttggttttggcgttttcgttttaacgatgggcgattttttttagtttttttttgaacgcggtaaggatttttttttgtttggtcgtattgtcggttatgagtcgggcgttgatggtatgtaggattagtatcgggtcgtcgcggtcgacggcgatgtcgtgtttggtcgtaatttttcggattagttttttaatttggtcgtttatagtacggtcgtcgcgtcgagttgtttaaataggtcgcgtcgtacgattttgaggcgttgtcgcgttatgatcgtgagcgatttatcggttagcgtttggtcgaacgttagtcgtttttgtagtatgtcgttgaaatcgcggtcgtaggttttttttttgagggtcggaatttggatgatggacgatacgcgggttttgttggtcgtgtacgtttttatttgtttaaagtttttgtttttatgttcgataggtttttaatacgggtttagttagattacgaaaagcgtttcggtcgggaattggttggcgagttgggcgaagtcgtttatcgtgtttaggagagtttggtcgtcggtgacgacggtatggatgattagtttatgttttattttttgtagtagagtcggtatttggttgttgatgaggtaatgcgatagaggtacgaacgagttggtatcgttgtcgattattacgttatttttggtcggcgtaattagttcgattagggtgtcgaagttgcgcgagttaatttcgtcgtcggttatgatgtttagtcggcggacgtttagggttttgtagttttcgaacgtcgcgtttatcgggtcggtgtcgatgtataagggtgtttgttttttgtttattttgtattgcgtaatgatcgcggcgatggtcgatttgtcgatttcgtttttgttttgtaaaattatgtgaattttcgttattatagtagattttttttgttcggtgttgggttgaaggtgaagtcggtcggggtcgtagcgggggtcggttttttagttttgtttttttgtttcggtcgtcgtggtttcggcgttttgggtgtcggcgcgggtttcgtagttttggtttgcggtgcgggtatatcggcgggtttggttttgatgtgtcgtttggcgtgcgagcggaacgtttcgtaggagaatttgatttttttcgtttttcgtatgtgtttttaaatggtgacgagcgtatagtcggacgttaacgtcgtttcgatattcgtttttatcgttaggaacgtaatcgtagttttattacgtcggcgttttttggtcgcgcgggatttaatttattcggttagttcgtcggtgtagttttttggtatcgtttttcgtttgtttttttagtttagtaattttttgtatttgtttgtttttagtcggtagatattttata

SEQ ID NO: 1366 - DNA, 1891 bp, Artificial Sequence
  chemically treated genomic DNA (Homo sapiens) CpG-island No: 1366
tataaaatatctaccgactaaaaacaaacaaatacaaaaaattactaaactaaaaaaacaaacgaaaaacgataccaaaaaactacaccgacgaactaaccgaataaattaaatcccgcgcgaccaaaaaacgccgacgtaataaaactacgattacgttcctaacgataaaaacgaatatcgaaacgacgttaacgtccgactatacgctcgtcaccatttaaaaacacatacgaaaaacgaaaaaaatcaaattctcctacgaaacgttccgctcgcacgccaaacgacacatcaaaaccaaacccgccgatatacccgcaccgcaaaccaaaactacgaaacccgcgccgacacccaaaacgccgaaaccacgacgaccgaaacaaaaaaacaaaactaaaaaaccgacccccgctacgaccccgaccgacttcaccttcaacccaacaccgaacaaaaaaaatctactataataacgaaaattcacataattttacaaaacaaaaacgaaatcgacaaatcgaccatcgccgcgatcattacgcaatacaaaataaacaaaaaacaaacacccttatacatcgacaccgacccgataaacgcgacgttcgaaaactacaaaaccctaaacgtccgccgactaaacatcataaccgacgacgaaattaactcgcgcaacttcgacaccctaatcgaactaattacgccgaccaaaaataacgtaataatcgacaacgataccaactcgttcgtacctctatcgcattacctcatcaacaaccaaataccgactctactacaaaaaataaaacataaactaatcatccataccgtcgtcaccgacgaccaaactctcctaaacacgataaacgacttcgcccaactcgccaaccaattcccgaccgaaacgcttttcgtaatctaactaaacccgtattaaaaacctatcgaacataaaaacaaaaactttaaacaaataaaaacgtacacgaccaacaaaacccgcgtatcgtccatcatccaaattccgaccctcaaaaaaaaaacctacgaccgcgatttcaacgacatactacaaaaacgactaacgttcgaccaaacgctaaccgataaatcgctcacgatcataacgcgacaacgcctcaaaatcgtacgacgcgacctatttaaacaactcgacgcgacgaccgtactataaacgaccaaattaaaaaactaatccgaaaaattacgaccaaacacgacatcgccgtcgaccgcgacgacccgatactaatcctacataccatcaacgcccgactcataaccgacaatacgaccaaacaaaaaaaaatccttaccgcgttcaaaaaaaaactaaaaaaaatcgcccatcgttaaaacgaaaacgccaaaaccaaaacgaaacgaatactaaacgcgaccctaacgaccaacaaaaacgcaataacgaaaataataaaaaacaacgccgcgcaaacgaccgaaacgatccgcaaaaaaatcgacgacgaccttaaccgccaactcgcgaccaaaatcgcgaacgcgcgacgcgtaacgataataaacataatcgccgacgacataatattattcgcgaccgccctaataatataaacctcgttataaatcgcaaaaacgcaaataaaaaaacccgacgttaccgaactttatttttacgttaactaaacttatttaacaaacccaaactctaactacgcccgcgctcgcgctcctaaacctatttcttctcctactcctacttacgcatcaaaacctaataccgtcgaactacttcacgcatcgaatcccaatcgccgaccaactcgaaatactccgcgcgcatcttacgcgtcgccaattcctcgatcttaaacgcgtaaat

SEQ ID NO: 1367 - DNA, 1891 bp, Artificial Sequence
  chemically treated genomic DNA (Homo sapiens) CpG-island No: 1367
tgtggaatatttatcgattggaaataggtaaatgtaggaaattattgaattgaggggataggcgagagacgatgttaaagagttatatcgacgagttggtcgagtgggttgaatttcgcgcggttaagaagcgtcggcgtgatgaggttgcggttgcgtttttggcggtgagggcggatgtcgaggcggcgttagcgttcggttatgcgttcgttattatttgggagtatatgcgggaaacggggaaggttaagtttttttacgagacgtttcgttcgtacgttaggcggtatattaaggttaagttcgtcgatgtgttcgtatcgtaggttaaggttgcggaattcgcgtcggtatttaagacgtcggagttacggcggtcgaagtaggggggtaaggttgaaaagtcggttttcgttgcggtttcgatcggttttatttttaatttaatatcggataaaaaggatttattgtaatggcgaaaatttatatggttttgtagggtaagggcggggtcggtaagtcggttatcgtcgcgattattgcgtagtataagatggataaggggtagatatttttgtgtatcgatatcgattcggtgaacgcgacgttcgagggttataaggttttgaacgttcgtcggttgaatattatggtcggcgacgaaattaattcgcgtaatttcgatattttggtcgagttgattgcgtcgattaaggatgacgtggtgatcgataacggtgttagttcgttcgtgtttttgtcgtattattttattagtaattaggtgtcggttttgttgtaagaaatggggtatgagttggttatttatatcgtcgttatcggcggttaggtttttttggatacggtgagcggtttcgtttagttcgttagttagttttcggtcgaagcgtttttcgtggtttggttgaattcgtattgggggtttatcgagtatgagggtaagagttttgagtagatgaaggcgtatacggttaataaggttcgcgtgtcgtttattatttagatttcggtttttaaggaagaaatttacggtcgcgattttagcgatatgttgtaagagcggttgacgttcgattaggcgttggtcgatgaatcgtttacgattatgacgcggtaacgttttaagatcgtgcggcgcggtttgtttgaatagttcgacgcggcggtcgtgttatgagcgattagattgaagagttgattcgggagattgcggttaagtacggtatcgtcgtcggtcgcgacgattcggtgttgattttgtatattattaacgttcggtttatggtcgatagtgcggttaagtaagaggaaatttttgtcgcgtttaaggaagagttggaagggatcgtttatcgttggggcgaggacgttaaggttaaagcggagcggatgttgaacgcggttttggcggttagtaaggacgtaatggcgaaggtaatgaaggatagcgtcgcgtaggcggtcgaagcgattcgtagggaaatcgacgacggttttggtcgttagttcgcggttaaggtcgcggacgcgcggcgcgtggcgatgatgaatatgatcgtcggcggtatggtgttgttcgcggtcgttttggtggtgtgggtttcgttatgaatcgtagaggcgtagatgaaaaagttcggcgttgtcgggttttgtttttgcgttagttgggtttgtttgataggtttaagttttgattgcgttcgcgttcgcgtttttgggtttgtttttttttttgtttttgtttgcgtattagggtttggtgtcgtcgggttgttttacgtatcgaattttagtcgtcggttagttcgggatgtttcgcgcgtattttgcgcgtcgttagtttttcgattttgggcgcgtgaat

SEQ ID NO: 1368 - DNA, 1891 bp, Artificial Sequence
  chemically treated genomic DNA (Homo sapiens) CpG-island No: 1368
attcacgcgcccaaaatcgaaaaactaacgacgcgcaaaatacgcgcgaaacatcccgaactaaccgacgactaaaattcgatacgtaaaacaacccgacgacaccaaaccctaatacgcaaacaaaaacaaaaaaaaaaacaaacccaaaaacgcgaacgcgaacgcaatcaaaacttaaacctatcaaacaaacccaactaacgcaaaaacaaaacccgacaacgccgaactttttcatctacgcctctacgattcataacgaaacccacaccaccaaaacgaccgcgaacaacaccataccgccgacgatcatattcatcatcgccacgcgccgcgcgtccgcgaccttaaccgcgaactaacgaccaaaaccgtcgtcgatttccctacgaatcgcttcgaccgcctacgcgacgctatccttcattaccttcgccattacgtccttactaaccgccaaaaccgcgttcaacatccgctccgctttaaccttaacgtcctcgccccaacgataaacgatcccttccaactcttccttaaacgcgacaaaaatttcctcttacttaaccgcactatcgaccataaaccgaacgttaataatatacaaaatcaacaccgaatcgtcgcgaccgacgacgataccgtacttaaccgcaatctcccgaatcaactcttcaatctaatcgctcataacacgaccgccgcgtcgaactattcaaacaaaccgcgccgcacgatcttaaaacgttaccgcgtcataatcgtaaacgattcatcgaccaacgcctaatcgaacgtcaaccgctcttacaacatatcgctaaaatcgcgaccgtaaatttcttccttaaaaaccgaaatctaaataataaacgacacgcgaaccttattaaccgtatacgccttcatctactcaaaactcttaccctcatactcgataaacccccaatacgaattcaaccaaaccacgaaaaacgcttcgaccgaaaactaactaacgaactaaacgaaaccgctcaccgtatccaaaaaaacctaaccgccgataacgacgatataaataaccaactcataccccatttcttacaacaaaaccgacacctaattactaataaaataatacgacaaaaacacgaacgaactaacaccgttatcgatcaccacgtcatccttaatcgacgcaatcaactcgaccaaaatatcgaaattacgcgaattaatttcgtcgccgaccataatattcaaccgacgaacgttcaaaaccttataaccctcgaacgtcgcgttcaccgaatcgatatcgatacacaaaaatatctaccccttatccatcttatactacgcaataatcgcgacgataaccgacttaccgaccccgcccttaccctacaaaaccatataaattttcgccattacaataaatcctttttatccgatattaaattaaaaataaaaccgatcgaaaccgcaacgaaaaccgacttttcaaccttacccccctacttcgaccgccgtaactccgacgtcttaaataccgacgcgaattccgcaaccttaacctacgatacgaacacatcgacgaacttaaccttaatataccgcctaacgtacgaacgaaacgtctcgtaaaaaaacttaaccttccccgtttcccgcatatactcccaaataataacgaacgcataaccgaacgctaacgccgcctcgacatccgccctcaccgccaaaaacgcaaccgcaacctcatcacgccgacgcttcttaaccgcgcgaaattcaacccactcgaccaactcgtcgatataactctttaacatcgtctctcgcctatcccctcaattcaataatttcctacatttacctatttccaatcgataaatattccaca

SEQ ID NO: 1369 - DNA, 1581 bp, Artificial Sequence
  chemically treated genomic DNA (Homo sapiens) CpG-island No: 1369
aaaggcggcggcggtcggtatgagtttgtcggtttatttgttggtcgtcggttagggttataaaattacgggcgtcgtggattatgagtacgttcgcgagttggttcgtattaatggcgatttgggtcgtttgggcggtttgttgaaattttggtttatcgacgattcgcgtacggcgcggttcggtgatgttacgattttcgttttgttggcgaagatcgaagagaagtaggacgagtttggtaaggttatgatgggcgtggttcgttcgagggtagagttatgatttttttagtcgttaaaacggtcggggggtgcgcgtgattgttaagtacgtttttatgcgttttattaagaagagcgatttcgcggagttggtgaagtatattatcgacgagtaaggtaagatcgagcgtttttttttaatcgttgtcgttagacggttagggaacgtcgataggtttcgtttcgcgtagttcggagtaggacgtcgtacggcgtttatatggattatttatttattttttaggttcgcgagggtttggttgatgcgggcggatattatttcgcgttgttggtcggtgttgtttgcgttgttatcgtttttgtatagttaggtagttataaagttgtcgtttttgtttacgattacgtcgttatcgacgatagcggcgtagttgagtagatcggttaggtcggcgtttttggaacgatgtttttttagttttagttcggtatcgatcgcgcggatgcgggtaaagaggatgaataatagaagcgcgtcgaggttcgcgattgtaatcgtaattgtttggattatcggtattgttttttttggttattggtgttttcgcggaacggggtcgagcgggtcgggtaatacggtttgtatcggcggtgacgtaggtatacgaatcgtattttcggatcggttttcgttatgattcggaacgtatagagcgtttcgaattataggattagatcgattacggtggttcgtagtttttgggcgttgaaaattagcgtaaacgttattaggttcgagaatattattagtttacgattattatttatgaataggttttttcggttgtttgcgcgacggatggggatcgtgcgtagagttatgattaggcgagtcgtttagtcgttatcgtacgtacggtattcgtcgtcgcgatttgtatttggtgtagcgtttcgttgtcgagggtcgcgatttcggtattacgatcgaagaaggtgtttattacgttttgcgcgtcgattagtagcgttattattagaattaggaagattagggttcggaagaaggcgttgagttcgtcgtcgaagattagtacgtcgtcggcgacgacgatgtcgatgatggatagcgcgaaggttatcgggtcggttacggagttgcgtaggttcgttagttagtttttatatggtaagttgtcgtcggtgtttttcgaggttatcgtcggatgcgcggataacgcgagagcgagaacgaagaatacggtaaggtagaataaaatgtcgcgatttatggttagacggaacggaatagtcgttgttattggaaatattttt

SEQ ID NO: 1370 - DNA, 1581 bp, Artificial Sequence
  chemically treated genomic DNA (Homo sapiens) CpG-island No: 1370
aaaaatatttccaataacaacgactattccgttccgtctaaccataaatcgcgacattttattctaccttaccgtattcttcgttctcgctctcgcgttatccgcgcatccgacgataacctcgaaaaacaccgacgacaacttaccatataaaaactaactaacgaacctacgcaactccgtaaccgacccgataaccttcgcgctatccatcatcgacatcgtcgtcgccgacgacgtactaatcttcgacgacgaactcaacgccttcttccgaaccctaatcttcctaattctaataataacgctactaatcgacgcgcaaaacgtaataaacaccttcttcgatcgtaataccgaaatcgcgaccctcgacaacgaaacgctacaccaaatacaaatcgcgacgacgaataccgtacgtacgataacgactaaacgactcgcctaatcataactctacgcacgatccccatccgtcgcgcaaacaaccgaaaaaacctattcataaataataatcgtaaactaataatattctcgaacctaataacgtttacgctaattttcaacgcccaaaaactacgaaccaccgtaatcgatctaatcctataattcgaaacgctctatacgttccgaatcataacgaaaaccgatccgaaaatacgattcgtatacctacgtcaccgccgatacaaaccgtattacccgacccgctcgaccccgttccgcgaaaacaccaataaccaaaaaaaacaataccgataatccaaacaattacgattacaatcgcgaacctcgacgcgcttctattattcatcctctttacccgcatccgcgcgatcgataccgaactaaaactaaaaaaacatcgttccaaaaacgccgacctaaccgatctactcaactacgccgctatcgtcgataacgacgtaatcgtaaacaaaaacgacaactttataactacctaactatacaaaaacgataacaacgcaaacaacaccgaccaacaacgcgaaataatatccgcccgcatcaaccaaaccctcgcgaacctaaaaaataaataaataatccatataaacgccgtacgacgtcctactccgaactacgcgaaacgaaacctatcgacgttccctaaccgtctaacgacaacgattaaaaaaaaacgctcgatcttaccttactcgtcgataatatacttcaccaactccgcgaaatcgctcttcttaataaaacgcataaaaacgtacttaacaatcacgcgcaccccccgaccgttttaacgactaaaaaaatcataactctaccctcgaacgaaccacgcccatcataaccttaccaaactcgtcctacttctcttcgatcttcgccaacaaaacgaaaatcgtaacatcaccgaaccgcgccgtacgcgaatcgtcgataaaccaaaatttcaacaaaccgcccaaacgacccaaatcgccattaatacgaaccaactcgcgaacgtactcataatccacgacgcccgtaattttataaccctaaccgacgaccaacaaataaaccgacaaactcataccgaccgccgccgccttt

SEQ ID NO: 1371 - DNA, 1581 bp, Artificial Sequence
  chemically treated genomic DNA (Homo sapiens) CpG-island No: 1371
aggagtatttttaatgataacggttgtttcgtttcgtttgattatgaatcgcggtattttgttttattttgtcgtgtttttcgttttcgttttcgcgttattcgcgtattcggcgatggtttcggaaggtatcggcggtagtttgttatatgagagttggttgacgaatttgcgtaatttcgtaatcggttcggtggttttcgcgttgtttattatcggtatcgtcgtcgtcggcggcgtgttgattttcggcggcgaatttaacgttttttttcgaattttgatttttttggttttggtgatggcgttgttggtcggcgcgtagaacgtgatgagtatttttttcggtcgtggtgtcgaaatcgcggttttcggtaacggggcgttgtattaggtgtaagtcgcggcggcggatgtcgtgcgtgcggtagcggttggacggttcgtttaattatggttttgcgtacgatttttattcgtcgcgtaggtaatcgagaaaatttgtttatgggtggtgatcgtgaattggtgatgttttcgggtttgatggcgtttgcgttgatttttagcgtttaagagttgcgggttatcgtggtcggtttgattttgtggttcggggcgttttatgcgtttcgaattatggcgaaggtcgattcgaagatgcggttcgtgtatttgcgttatcgtcggtataagtcgtattattcggttcgttcgatttcgtttcgcgagaatattaatagttaagggaagtaatatcgatgatttaagtaattgcgattgtaatcgcgggtttcggcgcgtttttgttgtttattttttttgttcgtattcgcgcggtcgatgtcgaattgaaattgaaaaagtatcgttttaaggacgtcggtttggtcgatttgtttaattacgtcgttgtcgtcgatgacggcgtaatcgtgggtaagaacggtagttttatggttgtttggttgtataagggcgatgataacgtaagtagtatcgattagtagcgcgaagtagtgttcgttcgtattaattaggttttcgcgggtttgggaagtgggtggatgatttatgtggacgtcgtgcggcgttttgtttcgaattacgcggagcggggtttgtcggcgttttttgatcgtttgacggtagcgattgaagaagagcgttcggttttgttttgttcgtcggtgatgtattttattagtttcgcgaagtcgttttttttgatggagcgtatggggacgtgtttggtaattacgcgtatttttcggtcgttttagcggttaaaaaagttatggttttgttttcgggcggattacgtttattatgattttgttaagttcgttttgttttttttcgattttcgttagtagggcgaggatcgtggtattatcgaatcgcgtcgtgcgcgggtcgtcggtgagttagagttttagtaggtcgtttaggcggtttaggtcgttattgatgcgggttagttcgcggacgtgtttatagtttacgacgttcgtgattttgtagttttggtcgacggttagtaggtaggtcgataggtttatgtcggtcgtcgtcgttttt

SEQ ID NO: 1372 - DNA, 1581 bp, Artificial Sequence
  chemically treated genomic DNA (Homo sapiens) CpG-island No: 1372
aaaaacgacgacgaccgacataaacctatcgacctacctactaaccgtcgaccaaaactacaaaatcacgaacgtcgtaaactataaacacgtccgcgaactaacccgcatcaataacgacctaaaccgcctaaacgacctactaaaactctaactcaccgacgacccgcgcacgacgcgattcgataataccacgatcctcgccctactaacgaaaatcgaaaaaaaacaaaacgaacttaacaaaatcataataaacgtaatccgcccgaaaacaaaaccataacttttttaaccgctaaaacgaccgaaaaatacgcgtaattaccaaacacgtccccatacgctccatcaaaaaaaacgacttcgcgaaactaataaaatacatcaccgacgaacaaaacaaaaccgaacgctcttcttcaatcgctaccgtcaaacgatcaaaaaacgccgacaaaccccgctccgcgtaattcgaaacaaaacgccgcacgacgtccacataaatcatccacccacttcccaaacccgcgaaaacctaattaatacgaacgaacactacttcgcgctactaatcgatactacttacgttatcatcgcccttatacaaccaaacaaccataaaactaccgttcttacccacgattacgccgtcatcgacgacaacgacgtaattaaacaaatcgaccaaaccgacgtccttaaaacgatactttttcaatttcaattcgacatcgaccgcgcgaatacgaacaaaaaaaataaacaacaaaaacgcgccgaaacccgcgattacaatcgcaattacttaaatcatcgatattacttcccttaactattaatattctcgcgaaacgaaatcgaacgaaccgaataatacgacttataccgacgataacgcaaatacacgaaccgcatcttcgaatcgaccttcgccataattcgaaacgcataaaacgccccgaaccacaaaatcaaaccgaccacgataacccgcaactcttaaacgctaaaaatcaacgcaaacgccatcaaacccgaaaacatcaccaattcacgatcaccacccataaacaaattttctcgattacctacgcgacgaataaaaatcgtacgcaaaaccataattaaacgaaccgtccaaccgctaccgcacgcacgacatccgccgccgcgacttacacctaatacaacgccccgttaccgaaaaccgcgatttcgacaccacgaccgaaaaaaatactcatcacgttctacgcgccgaccaacaacgccatcaccaaaaccaaaaaaatcaaaattcgaaaaaaaacgttaaattcgccgccgaaaatcaacacgccgccgacgacgacgataccgataataaacaacgcgaaaaccaccgaaccgattacgaaattacgcaaattcgtcaaccaactctcatataacaaactaccgccgataccttccgaaaccatcgccgaatacgcgaataacgcgaaaacgaaaacgaaaaacacgacaaaataaaacaaaataccgcgattcataatcaaacgaaacgaaacaaccgttatcattaaaaatactcct

SEQ ID NO: 1373 - DNA, 718 bp, Artificial Sequence
  chemically treated genomic DNA (Homo sapiens) CpG-island No: 1373
gtattttatcgattaggatgcggtcggggcgtatacgtagcgttgttttgagtagtagcgttatcgagacgtcgatgttggtgtggtattggacggcgttttttgcggcgtattggatttcgtcggtgttttcgatgatgacgacgcgtttagacgggttgaaggcgattattttattgatgatcgcgttgacgagcgtggttttgttcgagttagtatcgttaatgacgaggatgtttcgatgcgtcgcgacggcgtttttaatgatttcgtattgttcgcgggttatgatgttcgtttcgacgtattgttttagcgtgaagatggcgatcgcgcgtttgcggatcgtaaaggttggcgcggttacgatcggcggtaattggtcggtaaagcggttgttatttaaggggaattcgttttttaggatgggcgaatgtcgcgtgatttttttgtcgtggaattcggttatcgtttttataatcgtttgcgattggttgggtcgtatgtcgtagatgtatcgtatcggttcgttaaggcgttcgtgttatattttgtcgttcgcgttgagtatgattttaacggttttcgggtcgttgagcgcggttaataggttcgtatttatgtcgcgttttagtttgcgtttggttcgttttttgatggtttgaaatttttttttttcgtttattttttagtaatttttacgtaataaattattagt

SEQ ID NO: 1374 - DNA, 718 bp, Artificial Sequence
  chemically treated genomic DNA (Homo sapiens) CpG-island No: 1374
actaataatttattacgtaaaaattactaaaaaataaacgaaaaaaaaaaatttcaaaccatcaaaaaacgaaccaaacgcaaactaaaacgcgacataaatacgaacctattaaccgcgctcaacgacccgaaaaccgttaaaatcatactcaacgcgaacgacaaaatataacacgaacgccttaacgaaccgatacgatacatctacgacatacgacccaaccaatcgcaaacgattataaaaacgataaccgaattccacgacaaaaaaatcacgcgacattcgcccatcctaaaaaacgaattccccttaaataacaaccgctttaccgaccaattaccgccgatcgtaaccgcgccaacctttacgatccgcaaacgcgcgatcgccatcttcacgctaaaacaatacgtcgaaacgaacatcataacccgcgaacaatacgaaatcattaaaaacgccgtcgcgacgcatcgaaacatcctcgtcattaacgatactaactcgaacaaaaccacgctcgtcaacgcgatcatcaataaaataatcgccttcaacccgtctaaacgcgtcgtcatcatcgaaaacaccgacgaaatccaatacgccgcaaaaaacgccgtccaataccacaccaacatcgacgtctcgataacgctactactcaaaacaacgctacgtatacgccccgaccgcatcctaatcgataaaatac

SEQ ID NO: 1375 - DNA, 718 bp, Artificial Sequence
  chemically treated genomic DNA (Homo sapiens) CpG-island No: 1375
gttaatgatttgttgcgtaggggttattgaaaagtgagcgggaaagaagagttttagattattaaggagcgggttaagcgtaagttggaacgcgatatgggtgcggatttgttggtcgcgtttaacgattcgaaaatcgttgaagttatgtttaacgcggacggtaaggtgtggtacgaacgttttggcgagtcgatgcggtatatttgcgatatgcggtttagttagtcgtaggcgattatagaaacggtggtcggattttacggtaaagaggttacgcggtattcgtttattttggaaggcgagttttttttggatggtagtcgttttgtcggttaattgtcgtcggtcgtggtcgcgttaatttttgcgattcgtaagcgcgcggtcgttatttttacgttggaatagtacgtcgaggcgggtattatgattcgcgagtaatacgaggttattaaaagcgtcgtcgcggcgtatcgaaatattttcgttattggcggtattggttcgggtaagattacgttcgttaacgcgattattaatgaaatggtcgtttttaattcgtttgagcgcgtcgttattatcgaggatatcggcgaaatttagtgcgtcgtagagaacgtcgtttaatattatattagtatcgacgtttcgatgacgttgttgtttaagataacgttgcgtatgcgtttcgatcgtattttggtcggtgaggtat

SEQ ID NO: 1376 - DNA, 718 bp, Artificial Sequence
  chemically treated genomic DNA (Homo sapiens) CpG-island No: 1376
atacctcaccgaccaaaatacgatcgaaacgcatacgcaacgttatcttaaacaacaacgtcatcgaaacgtcgatactaatataatattaaacgacgttctctacgacgcactaaatttcgccgatatcctcgataataacgacgcgctcaaacgaattaaaaacgaccatttcattaataatcgcgttaacgaacgtaatcttacccgaaccaataccgccaataacgaaaatatttcgatacgccgcgacgacgcttttaataacctcgtattactcgcgaatcataatacccgcctcgacgtactattccaacgtaaaaataacgaccgcgcgcttacgaatcgcaaaaattaacgcgaccacgaccgacgacaattaaccgacaaaacgactaccatccaaaaaaaactcgccttccaaaataaacgaataccgcgtaacctctttaccgtaaaatccgaccaccgtttctataatcgcctacgactaactaaaccgcatatcgcaaatataccgcatcgactcgccaaaacgttcgtaccacaccttaccgtccgcgttaaacataacttcaacgattttcgaatcgttaaacgcgaccaacaaatccgcacccatatcgcgttccaacttacgcttaacccgctccttaataatctaaaactcttctttcccgctcacttttcaataacccctacgcaacaaatcattaac

SEQ ID NO: 1377 - DNA, 1446 bp, Artificial Sequence
  chemically treated genomic DNA (Homo sapiens) CpG-island No: 1377
gcgataagtaggagcgtatcgatttttttcgtattaagtgttttggtttttaggtcgaggtttacggtaagtatttgggtaaggggtcgttggtattcgtgtagggtaagattcggaatattaagtacgagaaggacggttagacggtttacgggatcgattttattgtcgataaggtggattatttggatattaaggtattaggcgggttaaattaggaataagggtatattgtttcggcgtgagtcggggtaatttcgtaaggagggtgaatgaatcggacgtttgatcggaaggtatataggtaagaattgatcgacgcggggtttttcgtcgaggatgtcgaaattatcgtaagtcgtatcgttatgcgtgcgtttcgcgaaattttttagttcgtcggttcgatggtttagtaagttacggttaagatcgagcgcgatagcgtgtaattggttttttttgttttgttcgcgttatcggtcgtcgtggagcgttcgcgtcgtttcgaataggaggcggtaggtttggcgaagtcgatgattatcgatacgcgaggaattatgacgattaagaagcgaaaaatcgtcggcgaggatttggtaaaataggttagcgaggttaagtaggtcgcgttgttgaaatatacgaagtagtagattaaggaaatgtagttttttttgttcgatattgcgtcgtggtcggatacgatgcgagcgatgttaaacgatacggttcgttttgttttgtttattacgcgtaataagaaaatttcgcgcgaggcgttgtaaaataaggttattttttacgttaataaggacgtgaagattatttatatcggcgtcgagttgcgggtcgacgatgacgaattggtgtggtagtaggtgttggagtacgcgaagcgtatttttatcggcgagtcgattatttttacgttttacgagttttgttaggatttgggttggtcgattaatggtcggtattatacgaaggtcgaggaatgtttgtcgcgtttataggcgacggcgatgggttttacgttcgatcgcgttgggtatttggaatcggtgtcgttgttgtatcgttttcgcgttttggatcgtggtaagaaaacgtttcgttgttaggttttgatcgacgaggaaatcgtcgtgttgtttgttggcgattattatacgaaatttatatgggagaagtatcgtaagttgtcgtcgacggttcgacggatgttcgattattttagttcgtatcgggagtcgtattcgtttaagttggaaatttttcgttttatgtgcggatcggattttattcgcgtgaagaagtggcgcgagtaggtcggcgaagtttgcgaagagttgcgaggtagcggtttggtggaatacgtttgggttaatgatgatttggtgtattgtaaacgttagggttttgtggggttagtttcggttg

SEQ ID NO: 1378 - DNA, 1446 bp, Artificial Sequence
  chemically treated genomic DNA (Homo sapiens) CpG-island No: 1378
caaccgaaactaaccccacaaaaccctaacgtttacaatacaccaaatcatcattaacccaaacgtattccaccaaaccgctacctcgcaactcttcgcaaacttcgccgacctactcgcgccacttcttcacgcgaataaaatccgatccgcacataaaacgaaaaatttccaacttaaacgaatacgactcccgatacgaactaaaataatcgaacatccgtcgaaccgtcgacgacaacttacgatacttctcccatataaatttcgtataataatcgccaacaaacaacacgacgatttcctcgtcgatcaaaacctaacaacgaaacgttttcttaccacgatccaaaacgcgaaaacgatacaacaacgacaccgattccaaatacccaacgcgatcgaacgtaaaacccatcgccgtcgcctataaacgcgacaaacattcctcgaccttcgtataataccgaccattaatcgaccaacccaaatcctaacaaaactcgtaaaacgtaaaaataatcgactcgccgataaaaatacgcttcgcgtactccaacacctactaccacaccaattcgtcatcgtcgacccgcaactcgacgccgatataaataatcttcacgtccttattaacgtaaaaaataaccttattttacaacgcctcgcgcgaaattttcttattacgcgtaataaacaaaacaaaacgaaccgtatcgtttaacatcgctcgcatcgtatccgaccacgacgcaatatcgaacaaaaaaaactacatttccttaatctactacttcgtatatttcaacaacgcgacctacttaacctcgctaacctattttaccaaatcctcgccgacgatttttcgcttcttaatcgtcataattcctcgcgtatcgataatcatcgacttcgccaaacctaccgcctcctattcgaaacgacgcgaacgctccacgacgaccgataacgcgaacaaaacaaaaaaaaccaattacacgctatcgcgctcgatcttaaccgtaacttactaaaccatcgaaccgacgaactaaaaaatttcgcgaaacgcacgcataacgatacgacttacgataatttcgacatcctcgacgaaaaaccccgcgtcgatcaattcttacctatataccttccgatcaaacgtccgattcattcaccctccttacgaaattaccccgactcacgccgaaacaatatacccttattcctaatttaacccgcctaataccttaatatccaaataatccaccttatcgacaataaaatcgatcccgtaaaccgtctaaccgtccttctcgtacttaatattccgaatcttaccctacacgaataccaacgaccccttacccaaatacttaccgtaaacctcgacctaaaaaccaaaacacttaatacgaaaaaaatcgatacgctcctacttatcgc

SEQ ID NO: 1379 - DNA, 1446 bp, Artificial Sequence
  chemically treated genomic DNA (Homo sapiens) CpG-island No: 1379
tagtcggaattgattttataaggttttagcgtttgtaatgtattaggttattattgatttaggcgtgttttattaggtcgttgtttcgtaatttttcgtaggtttcgtcgatttgttcgcgttatttttttacgcgggtggaattcgattcgtatatgaggcggaaggtttttagtttgagcgggtacggttttcggtgcgagttgaaatagtcgaatattcgtcgggtcgtcggcgatagtttgcggtattttttttatatgaatttcgtgtagtggtcgttagtaaatagtacgacgattttttcgtcgattaggatttggtaacgggacgtttttttgttacggtttaggacgcggaagcggtgtagtagcgatatcgattttaggtgtttaacgcggtcggacgtgaagtttatcgtcgtcgtttgtaggcgcgataggtatttttcggttttcgtgtaatatcggttattgatcgattagtttaggttttggtaaagttcgtagaacgtgaaggtgatcggttcgtcgataggggtgcgtttcgcgtattttaatatttgttgttatattagttcgttatcgtcggttcgtagttcgacgtcggtgtaggtgatttttacgtttttgttgacgtggaaaatgattttgttttgtagcgtttcgcgcgggatttttttgttgcgcgtggtgaatagggtagagcgggtcgtgtcgtttggtatcgttcgtatcgtgttcggttacggcgtaatatcgaataaggaaagttgtatttttttgatttgttgtttcgtgtgttttagtaacgcggtttgtttggtttcgttgatttgttttgttaggttttcgtcggcggtttttcgttttttggtcgttatagtttttcgcgtgtcgatggttatcgatttcgttaaatttgtcgttttttgttcgagacgacgcgaacgttttacggcggtcgatggcgcgggtagggtagggggagttagttgtacgttgtcgcgttcgattttggtcgtagtttgttggattatcgagtcgacggattggaaggtttcgcggggcgtacgtatgacggtgcggtttgcgatggtttcggtattttcggcggaaaatttcgcgtcgattagtttttgtttgtatgtttttcggttaaacgttcgatttatttattttttttgcgggattgtttcgatttacgtcggggtaatgtgtttttatttttgatttgattcgtttggtgttttggtgtttagataatttattttatcggtaatgaagtcggtttcgtagatcgtttggtcgtttttttcgtatttggtatttcgaattttgttttgtacgaatattagcgattttttgtttaaatatttgtcgtgggtttcggtttgagagttaaaatatttgatgcggaagaagtcggtgcgtttttgtttgtcgt

SEQ ID NO: 1380 - DNA, 1446 bp, Artificial Sequence
  chemically treated genomic DNA (Homo sapiens) CpG-island No: 1380
acgacaaacaaaaacgcaccgacttcttccgcatcaaatattttaactctcaaaccgaaacccacgacaaatatttaaacaaaaaatcgctaatattcgtacaaaacaaaattcgaaataccaaatacgaaaaaaacgaccaaacgatctacgaaaccgacttcattaccgataaaataaattatctaaacaccaaaacaccaaacgaatcaaatcaaaaataaaaacacattaccccgacgtaaatcgaaacaatcccgcaaaaaaaataaataaatcgaacgtttaaccgaaaaacatacaaacaaaaactaatcgacgcgaaattttccgccgaaaataccgaaaccatcgcaaaccgcaccgtcatacgtacgccccgcgaaaccttccaatccgtcgactcgataatccaacaaactacgaccaaaatcgaacgcgacaacgtacaactaactccccctaccctacccgcgccatcgaccgccgtaaaacgttcgcgtcgtctcgaacaaaaaacgacaaatttaacgaaatcgataaccatcgacacgcgaaaaactataacgaccaaaaaacgaaaaaccgccgacgaaaacctaacaaaacaaatcaacgaaaccaaacaaaccgcgttactaaaacacacgaaacaacaaatcaaaaaaatacaactttccttattcgatattacgccgtaaccgaacacgatacgaacgataccaaacgacacgacccgctctaccctattcaccacgcgcaacaaaaaaatcccgcgcgaaacgctacaaaacaaaatcattttccacgtcaacaaaaacgtaaaaatcacctacaccgacgtcgaactacgaaccgacgataacgaactaatataacaacaaatattaaaatacgcgaaacgcacccctatcgacgaaccgatcaccttcacgttctacgaactttaccaaaacctaaactaatcgatcaataaccgatattacacgaaaaccgaaaaatacctatcgcgcctacaaacgacgacgataaacttcacgtccgaccgcgttaaacacctaaaatcgatatcgctactacaccgcttccgcgtcctaaaccgtaacaaaaaaacgtcccgttaccaaatcctaatcgacgaaaaaatcgtcgtactatttactaacgaccactacacgaaattcatataaaaaaaataccgcaaactatcgccgacgacccgacgaatattcgactatttcaactcgcaccgaaaaccgtacccgctcaaactaaaaaccttccgcctcatatacgaatcgaattccacccgcgtaaaaaaataacgcgaacaaatcgacgaaacctacgaaaaattacgaaacaacgacctaataaaacacgcctaaatcaataataacctaatacattacaaacgctaaaaccttataaaatcaattccgacta

SEQ ID NO: 1381 - DNA, 644 bp, Artificial Sequence
  chemically treated genomic DNA (Homo sapiens) CpG-island No: 1381
gtcgggcggggtcgcggcgacggtaggcgttgtgtagtcgttgatggtcgtgtttatttttgtcgttttgttaggtagttcgatacgattgatggcggttttgggggttatttgcggaattgcgggcgtggcgttgttggtgttgatattaaacgtagcgttagattttgtcggcgtcgtagcgggtttggcgggggcggtttttatggcgttcggaatcgtgttgattcgtaagtggtaatttttcgtgtttttgtttatttttatcgtttggtaattggcggtcggaggatttttgttcgttttagtagttttagtgtttgattcgttaatttcgatgtttataggaattaatgttttcggtttggcgtggttcggtttgatcggagcgggtttaatttattttttttggtttcgggggatttcgcgattcgaatttatagttgtttttttattgggtttttttagttcggggatcgtcgtgttgttaggatggttgtttttggattagacgttgagtgcgttttaaattatcggcgttttgttcgtgatcgggagtatttggttgggttaacgttttaatcgtatttttagggcgcgtatagtttgtcggaagtcgttttgattcgtatggtataggttta

SEQ ID NO: 1382 - DNA, 644 bp, Artificial Sequence
  chemically treated genomic DNA (Homo sapiens) CpG-island No: 1382
taaacctataccatacgaatcaaaacgacttccgacaaactatacgcgccctaaaaatacgattaaaacgttaacccaaccaaatactcccgatcacgaacaaaacgccgataatttaaaacgcactcaacgtctaatccaaaaacaaccatcctaacaacacgacgatccccgaactaaaaaaacccaataaaaaaacaactataaattcgaatcgcgaaatcccccgaaaccaaaaaaaataaattaaacccgctccgatcaaaccgaaccacgccaaaccgaaaacattaattcctataaacatcgaaattaacgaatcaaacactaaaactactaaaacgaacaaaaatcctccgaccgccaattaccaaacgataaaaataaacaaaaacacgaaaaattaccacttacgaatcaacacgattccgaacgccataaaaaccgcccccgccaaacccgctacgacgccgacaaaatctaacgctacgtttaatatcaacaccaacaacgccacgcccgcaattccgcaaataacccccaaaaccgccatcaatcgtatcgaactacctaacaaaacgacaaaaataaacacgaccatcaacgactacacaacgcctaccgtcgccgcgaccccgcccgac

SEQ ID NO: 1383 - DNA, 644 bp, Artificial Sequence
  chemically treated genomic DNA (Homo sapiens) CpG-island No: 1383
taggtttatgttatgcgggttaaggcgattttcggtaagttatacgcgttttaggagtgcggttggaacgttggtttagttagatattttcgattacgagtaggacgtcgatgatttgaagcgtatttagcgtttgatttaagaataattattttagtaatacggcggttttcgggttgagaaagtttagtaaggaaataattgtaggttcgagtcgcgagatttttcggaattaaaggaagtaggttaaattcgtttcgattaggtcgagttacgttaggtcgagaatattggtttttgtaggtatcgggattggcggattaaatattaaagttattggaacgagtagaagtttttcggtcgttagttgttaggcggtaaaggtgagtagaggtacgggaggttgttatttgcgggttagtacggtttcgaacgttatggaaatcgttttcgttaggttcgttgcgacgtcgataggatttagcgttgcgtttggtgttaatattaatagcgttacgttcgtagtttcgtaaatagtttttaggatcgttattaatcgtatcgggttatttagtagagcggtagagatgaatacgattattagcggttgtatagcgtttatcgtcgtcgcgatttcgttcggt

SEQ ID NO: 1384 - DNA, 644 bp, Artificial Sequence
  chemically treated genomic DNA (Homo sapiens) CpG-island No: 1384
accgaacgaaatcgcgacgacgataaacgctatacaaccgctaataatcgtattcatctctaccgctctactaaataacccgatacgattaataacgatcctaaaaactatttacgaaactacgaacgtaacgctattaatattaacaccaaacgcaacgctaaatcctatcgacgtcgcaacgaacctaacgaaaacgatttccataacgttcgaaaccgtactaacccgcaaataacaacctcccgtacctctactcacctttaccgcctaacaactaacgaccgaaaaacttctactcgttccaataactttaatatttaatccgccaatcccgatacctacaaaaaccaatattctcgacctaacgtaactcgacctaatcgaaacgaatttaacctacttcctttaattccgaaaaatctcgcgactcgaacctacaattatttccttactaaactttctcaacccgaaaaccgccgtattactaaaataattattcttaaatcaaacgctaaatacgcttcaaatcatcgacgtcctactcgtaatcgaaaatatctaactaaaccaacgttccaaccgcactcctaaaacgcgtataacttaccgaaaatcgccttaacccgcataacataaaccta

SEQ ID NO: 1385 - DNA, 1448 bp, Artificial Sequence
  chemically treated genomic DNA (Homo sapiens) CpG-island No: 1385
tttttttttatatatatatttacgcgtttttattcgtttgatgtcgttttttttttatatatatttacgtatttttattcgtttgatttcgttttttttttttttatatatatttacgcgtttttattcgtttgatttcgttttttttttatatatatatatttttattcgtttgatttcgttttttttttttatatacgcgtttttattcgtttgatttcgttttttttttttatatatatatatttttattcgtttgatttcgttttttttttatatatatttacgtatttttattcgtttgatttcgttttttttttttatatatatatttacgcgtttttattcgtttgatgtcgttttttttttatatatatttacgtatttttattcgtttgatttcgttttttttttttatatatatatttacgcgtttttattcgtttgatgtcgttttttttttatatatatttacgtatttttattcgtttgatttcgttttttttttttttatatatatttacgcgtttttattcgtttgatttcgttttttttttatatatatatatttttattcgtttgatttcgttttttttttttatatatacgcgtttttattcgtttgatttcgttttttttttatatatatatatttttattcgtttgatttcgttttttttttatatatatttacgtatttttattcgtttgatttcgttttttttttttatatatatattcgcgtttttattcgtttgatgcggttttttttttatatatatatttacgcgtttttatttgtttgatttcgttttttttttttatatatagatttacgcgtttttattcgtttgattttattttttttttttatatatatttatgcgttgttattcgtttgatttcgttttttttttatatatatttacgtttttattcgtttgatttcgttttttttttatatatattcgcgtttttattcgtttgatttcgttttttttttatatatatatatttttattcgtttgatttcgttttttttttatatatatttacgtatttttattcgtttgatttcgttttttttttttatatatatattcgcgtttttattcgtttgatgcggttttttttttatatatatatttacgcgtttttatttgtttgatttcgttttttttttttatatatagatttacgcgtttttattcgtttgattttattttttttttttatatatatttatgcgttgttattcgtttgatttcgttttttttttatatatatttacgtttttattcgtttgatttcgttttttttttttttatatatatttacgtttttattcgcgtgatttcgttttttttttatatagatttatgtatttttattcgtttgattttattttttttttttatatatatttatacgttgttattcgtttgatt

SEQ ID NO: 1386 - DNA, 1448 bp, Artificial Sequence
  chemically treated genomic DNA (Homo sapiens) CpG-island No: 1386
aatcaaacgaataacaacgtataaatatatataaaaaaaaaaaataaaatcaaacgaataaaaatacataaatctatataaaaaaaaaacgaaatcacgcgaataaaaacgtaaatatatataaaaaaaaaaaaaacgaaatcaaacgaataaaaacgtaaatatatataaaaaaaaaacgaaatcaaacgaataacaacgcataaatatatataaaaaaaaaaaataaaatcaaacgaataaaaacgcgtaaatctatatataaaaaaaaaaaacgaaatcaaacaaataaaaacgcgtaaatatatatataaaaaaaaaaccgcatcaaacgaataaaaacgcgaatatatatataaaaaaaaaaaacgaaatcaaacgaataaaaatacgtaaatatatataaaaaaaaaacgaaatcaaacgaataaaaatatatatatataaaaaaaaaacgaaatcaaacgaataaaaacgcgaatatatataaaaaaaaaacgaaatcaaacgaataaaaacgtaaatatatataaaaaaaaaacgaaatcaaacgaataacaacgcataaatatatataaaaaaaaaaaataaaatcaaacgaataaaaacgcgtaaatctatatataaaaaaaaaaaacgaaatcaaacaaataaaaacgcgtaaatatatatataaaaaaaaaaccgcatcaaacgaataaaaacgcgaatatatatataaaaaaaaaaaacgaaatcaaacgaataaaaatacgtaaatatatataaaaaaaaaacgaaatcaaacgaataaaaatatatatatataaaaaaaaaacgaaatcaaacgaataaaaacgcgtatatataaaaaaaaaaaacgaaatcaaacgaataaaaatatatatatataaaaaaaaaacgaaatcaaacgaataaaaacgcgtaaatatatataaaaaaaaaaaaaacgaaatcaaacgaataaaaatacgtaaatatatataaaaaaaaaacgacatcaaacgaataaaaacgcgtaaatatatatataaaaaaaaaaaacgaaatcaaacgaataaaaatacgtaaatatatataaaaaaaaaacgacatcaaacgaataaaaacgcgtaaatatatatataaaaaaaaaaaacgaaatcaaacgaataaaaatacgtaaatatatataaaaaaaaaacgaaatcaaacgaataaaaatatatatatataaaaaaaaaaaacgaaatcaaacgaataaaaacgcgtatataaaaaaaaaaaacgaaatcaaacgaataaaaatatatatatataaaaaaaaaacgaaatcaaacgaataaaaacgcgtaaatatatataaaaaaaaaaaaaacgaaatcaaacgaataaaaatacgtaaatatatataaaaaaaaaacgacatcaaacgaataaaaacgcgtaaatatatatataaaaaaaaa

SEQ ID NO: 1387 - DNA, 1448 bp, Artificial Sequence
  chemically treated genomic DNA (Homo sapiens) CpG-island No: 1387
aattaagcgaatgatagcgtgtgagtgtgtgtggagagagagaatggaattaggcgaatgagagtgtatgagtttgtgtggagagagaacggaattacgcgaatgagaacgtgagtgtgtgtggagggagagagaacggaattaagcgaatgagagcgtgagtgtgtgtggagagagaacggaattaagcgaatgatagcgtatgagtgtgtgtggagggagagaatggaattaagcgaatgagagcgcgtgagtttgtgtgtggagggagagaacggaattaggtaaatgagagcgcgtgagtgtgtgtgtggagagagaatcgtattaagcgaatgagagcgcgagtgtgtgtgtggagggagagaacggaattaggcgaataagagtgcgtgagtgtgtgtggagagagaacggaattaggcgaatgagagtgtgtgtgtgtggagagagaacggaattaagcgaatgagagcgcgagtgtgtgtggagagagaacggaattaagcgaatgagagcgtgagtgtgtgtggagagagaacggaattaagcgaatgatagcgtatgagtgtgtgtggagggagagaatggaattaagcgaatgagagcgcgtgagtttgtgtgtggagggagagaacggaattaggtaaatgagagcgcgtgagtgtgtgtgtggagagagaatcgtattaagcgaatgagagcgcgagtgtgtgtgtggagggagagaacggaattaggcgaataagagtgcgtgagtgtgtgtggagagagaacggaattaggcgaatgagagtgtgtgtgtgtggagagagaacggaattaggcgaatgagagcgcgtgtgtgtggagagagagaacggaattaggcgaatgagagtgtgtgtgtgtggagagagaacggaattaggcgaatgagagcgcgtgagtgtgtgtggagagaaggagaacggaattaggcgaatgagagtgcgtgagtgtgtgtggagagagaacggtattaagcgaatgagagcgcgtgagtgtgtgtgtggagggagagaacggaattaggcgaatgagagtgcgtgagtgtgtgtggagagagaacggtattaagcgaatgagagcgcgtgagtgtgtgtgtggagggagagaacggaattaggcgaataagagtgcgtgagtgtgtgtggagagagaacggaattaggcgaatgagagtgtgtgtgtgtggagagagagaacggaattaggcgaatgagagcgcgtgtgtggagagagagaacggaattaggcgaatgagagtgtgtgtgtgtggagagagaacggaattaggcgaatgagagcgcgtgagtgtgtgtggagagaaggagaacggaattaggcgaatgagagtgcgtgagtgtgtgtggagagagaacggtattaagcgaatgagagcgcgtgagtgtgtgtgtggagggaga

SEQ ID NO: 1388 - DNA, 1448 bp, Artificial Sequence
  chemically treated genomic DNA (Homo sapiens) CpG-island No: 1388
tctccctccacacacacactcacgcgctctcattcgcttaataccgttctctctccacacacactcacgcactctcattcgcctaattccgttctccttctctccacacacactcacgcgctctcattcgcctaattccgttctctctccacacacacacactctcattcgcctaattccgttctctctctccacacacgcgctctcattcgcctaattccgttctctctctccacacacacacactctcattcgcctaattccgttctctctccacacacactcacgcactcttattcgcctaattccgttctctccctccacacacacactcacgcgctctcattcgcttaataccgttctctctccacacacactcacgcactctcattcgcctaattccgttctctccctccacacacacactcacgcgctctcattcgcttaataccgttctctctccacacacactcacgcactctcattcgcctaattccgttctccttctctccacacacactcacgcgctctcattcgcctaattccgttctctctccacacacacacactctcattcgcctaattccgttctctctctccacacacacgcgctctcattcgcctaattccgttctctctccacacacacacactctcattcgcctaattccgttctctctccacacacactcacgcactcttattcgcctaattccgttctctccctccacacacacactcgcgctctcattcgcttaatacgattctctctccacacacacactcacgcgctctcatttacctaattccgttctctccctccacacacaaactcacgcgctctcattcgcttaattccattctctccctccacacacactcatacgctatcattcgcttaattccgttctctctccacacacactcacgctctcattcgcttaattccgttctctctccacacacactcgcgctctcattcgcttaattccgttctctctccacacacacacactctcattcgcctaattccgttctctctccacacacactcacgcactcttattcgcctaattccgttctctccctccacacacacactcgcgctctcattcgcttaatacgattctctctccacacacacactcacgcgctctcatttacctaattccgttctctccctccacacacaaactcacgcgctctcattcgcttaattccattctctccctccacacacactcatacgctatcattcgcttaattccgttctctctccacacacactcacgctctcattcgcttaattccgttctctctccctccacacacactcacgttctcattcgcgtaattccgttctctctccacacaaactcatacactctcattcgcctaattccattctctctctccacacacactcacacgctatcattcgcttaatt

SEQ ID NO: 1389 - DNA, 580 bp, Artificial Sequence
  chemically treated genomic DNA (Homo sapiens) CpG-island No: 1389
ttttttttatatatatttacgtttttattcgtttgatttcgttttttttttttatatatatttacgcgtttttattcgtttgatttcgttttttttttttatatatattcgtgtttttattcgtttgattttattttttttttttatatatatttacgcgttgttattcgtttgattttattttttttttttatatatatttacgcgtttttattcgtttgattttgttttttttttttatatatatttacgcgttgttattcgtttgatttcgttttttttttatatatatttacgtttttattcgtttgatttcgttttttttttttttatatatatttacgcgtttttattcgtttgatttcgttttttttttttatatatattcgcgtttttattcgtttgattttattttttttttttatatatattcgcgtttttattcgtttgattttattttttttttttatatatatttacgcgttgttattcgtttgatttcgttttttttttttatatatattcgtgtttttattcgtttgatttcgttttttttttttatatatattcgtgtttttat

SEQ ID NO: 1390 - DNA, 580 bp, Artificial Sequence
  chemically treated genomic DNA (Homo sapiens) CpG-island No: 1390
ataaaaacacgaatatatataaaaaaaaaaaacgaaatcaaacgaataaaaacacgaatatatataaaaaaaaaaaacgaaatcaaacgaataacaacgcgtaaatatatataaaaaaaaaaaataaaatcaaacgaataaaaacgcgaatatatataaaaaaaaaaaataaaatcaaacgaataaaaacgcgaatatatataaaaaaaaaaaacgaaatcaaacgaataaaaacgcgtaaatatatataaaaaaaaaaaaaacgaaatcaaacgaataaaaacgtaaatatatataaaaaaaaaacgaaatcaaacgaataacaacgcgtaaatatatataaaaaaaaaaaacaaaatcaaacgaataaaaacgcgtaaatatatataaaaaaaaaaaataaaatcaaacgaataacaacgcgtaaatatatataaaaaaaaaaaataaaatcaaacgaataaaaacacgaatatatataaaaaaaaaaaacgaaatcaaacgaataaaaacgcgtaaatatatataaaaaaaaaaaacgaaatcaaacgaataaaaacgtaaatatatataaaaaaaa

SEQ ID NO: 1391 - DNA, 580 bp, Artificial Sequence
  chemically treated genomic DNA (Homo sapiens) CpG-island No: 1391
atgagaatacgagtgtgtgtggagagagagaacggaattaggcgaatgagaatacgagtgtgtgtggagagagagaacggaattaagcgaatgatagcgcgtgagtgtgtgtggagggagagaatggaattaagcgaatgagaacgcgagtgtgtgtggagggagagaatggaattaagcgaatgagaacgcgagtgtgtgtggagggagagaacggaattaagcgaatgagagcgcgtgagtgtgtgtggagagagagagaacggaattaagcgaatgagagcgtgagtgtgtgtggagagagaacggaattaagcgaatgatagcgcgtgagtgtgtgtggagagagagaatagaattaagcgaatgagagcgcgtgagtgtgtgtggagagagagaatggaattaagcgaatgatagcgcgtgagtgtgtgtggagggagagaatggaattaagcgaatgagaatacgagtgtgtgtggagggagagaacggaattaagcgaatgagagcgcgtgagtgtgtgtggagagagagaacggaattaagcgaatgagagcgtgagtgtgtgtggagagag

SEQ ID NO: 1392 - DNA, 580 bp, Artificial Sequence
  chemically treated genomic DNA (Homo sapiens) CpG-island No: 1392
ctctctccacacacactcacgctctcattcgcttaattccgttctctctctccacacacactcacgcgctctcattcgcttaattccgttctctccctccacacacactcgtattctcattcgcttaattccattctctccctccacacacactcacgcgctatcattcgcttaattccattctctctctccacacacactcacgcgctctcattcgcttaattctattctctctctccacacacactcacgcgctatcattcgcttaattccgttctctctccacacacactcacgctctcattcgcttaattccgttctctctctctccacacacactcacgcgctctcattcgcttaattccgttctctccctccacacacactcgcgttctcattcgcttaattccattctctccctccacacacactcgcgttctcattcgcttaattccattctctccctccacacacactcacgcgctatcattcgcttaattccgttctctctctccacacacactcgtattctcattcgcctaattccgttctctctctccacacacactcgtattctcat

SEQ ID NO: 1393 - DNA, 903 bp, Artificial Sequence
  chemically treated genomic DNA (Homo sapiens) CpG-island No: 1393
ggagatcgttaagtacgatcgcgagatggtgtagtaggtcgagttgggttagcgcgtgggttttttttcgtcgtcgtcgtcgtcgtcgtaggttatttcggttatcgttacgttgtagtaggcggcggttatgagtttttgttcgtaggtggcgcggtcgttcgtggggtcgttggcgttcggttcgtcgcgtttcgtgcgtcgttcgttttcggggttcgtatttgtcgtcgttttattcgggttttcgtttttcgttagtttttcgggcgcgttcgttagttttcgggtatcgcggatttcgttttacggcggtttgttcgtcgttttttttgttgggttcgttttgttcgcgcgtcgtttgagtcgcgcgtcgcgtttattgttcgtttcgtagttttcgttgttttacggcgttttcggtttcgcggtttttatacgttcggttagtagttttatatcgcgtttggggtttacgttcgttgttcgggtcgtcgcgtttagttcggatcgtagggattcggttttattcggcgtcgtcggcggtttggatttttaggatttcgcgcgttcgcgtttttcgtttaatttgtgattttcgtcgatcgtttcgcgggtttaggcgggtcgggggcggggtcgttatttagattaaagttatgttattgcgttgtttcggtcgttagttcgtttagaagttatagacgagacgtaggtagtcgtagttggacggacgggtagggtcggcggggtagtttttttcgcgttttcggtcgtttttttttatcgtttcgcgtttatttttatcgtttttgttttcggcggcggtttcgcgtgcgagggggttttttttatttcggtgttttagtttttttagttgtaagatagggacggggcggttta

SEQ ID NO: 1394 - DNA, 903 bp, Artificial Sequence
  chemically treated genomic DNA (Homo sapiens) CpG-island No: 1394
taaaccgccccgtccctatcttacaactaaaaaaactaaaacaccgaaataaaaaaaaccccctcgcacgcgaaaccgccgccgaaaacaaaaacgataaaaataaacgcgaaacgataaaaaaaaacgaccgaaaacgcgaaaaaaactaccccgccgaccctacccgtccgtccaactacgactacctacgtctcgtctataacttctaaacgaactaacgaccgaaacaacgcaataacataactttaatctaaataacgaccccgcccccgacccgcctaaacccgcgaaacgatcgacgaaaatcacaaattaaacgaaaaacgcgaacgcgcgaaatcctaaaaatccaaaccgccgacgacgccgaataaaaccgaatccctacgatccgaactaaacgcgacgacccgaacaacgaacgtaaaccccaaacgcgatataaaactactaaccgaacgtataaaaaccgcgaaaccgaaaacgccgtaaaacaacgaaaactacgaaacgaacaataaacgcgacgcgcgactcaaacgacgcgcgaacaaaacgaacccaacaaaaaaaacgacgaacaaaccgccgtaaaacgaaatccgcgatacccgaaaactaacgaacgcgcccgaaaaactaacgaaaaacgaaaacccgaataaaacgacgacaaatacgaaccccgaaaacgaacgacgcacgaaacgcgacgaaccgaacgccaacgaccccacgaacgaccgcgccacctacgaacaaaaactcataaccgccgcctactacaacgtaacgataaccgaaataacctacgacgacgacgacgacgacgaaaaaaaacccacgcgctaacccaactcgacctactacaccatctcgcgatcgtacttaacgatctcc

SEQ ID NO: 1395 - DNA, 903 bp, Artificial Sequence
  chemically treated genomic DNA (Homo sapiens) CpG-island No: 1395
tgggtcgtttcgtttttgttttatagttgggggaattgaggtatcgaggtgaagggagttttttcgtacgcgaggtcgtcgtcgggggtaggggcgatgggggtgggcgcggggcgatgaggggggacggtcgggggcgcggagggggttgtttcgtcggttttgttcgttcgtttaattacggttatttacgtttcgtttatggtttttgggcggattggcggtcggggtagcgtaatggtatggttttggtttggatgacggtttcgttttcggttcgtttgggttcgcggggcggtcggcgagggttataagttggacgagaggcgcgagcgcgcggagttttgggggtttaggtcgtcggcggcgtcgggtgaggtcgagtttttgcggttcgggttgggcgcggcggttcgggtagcgggcgtgggttttaagcgcggtgtggagttgttggtcgggcgtgtggaggtcgcggggtcgggggcgtcgtgaggtagcgagggttgcgaggcggatagtgggcgcgacgcgcggtttaggcggcgcgcgggtagggcgggtttagtaaggggggcggcgggtaggtcgtcgtagggcgaggttcgcggtgttcgggggttggcgggcgcgttcggggggttggcggggggcgggggttcgggtgaggcggcggtaggtgcgggtttcgggggcgggcggcgtacgaggcgcggcgagtcgagcgttagcggttttacgagcggtcgcgttatttgcgggtagaagtttatggtcgtcgtttgttgtagcgtggcgatggtcgaggtgatttgcggcggcggcggcggcggcgggaagaggtttacgcgttgatttagttcggtttgttgtattatttcgcggtcgtatttgacgattttt

SEQ ID NO: 1396 - DNA, 903 bp, Artificial Sequence
  chemically treated genomic DNA (Homo sapiens) CpG-island No: 1396
aaaaatcgtcaaatacgaccgcgaaataatacaacaaaccgaactaaatcaacgcgtaaacctcttcccgccgccgccgccgccgccgcaaatcacctcgaccatcgccacgctacaacaaacgacgaccataaacttctacccgcaaataacgcgaccgctcgtaaaaccgctaacgctcgactcgccgcgcctcgtacgccgcccgcccccgaaacccgcacctaccgccgcctcacccgaacccccgccccccgccaaccccccgaacgcgcccgccaacccccgaacaccgcgaacctcgccctacgacgacctacccgccgccccccttactaaacccgccctacccgcgcgccgcctaaaccgcgcgtcgcgcccactatccgcctcgcaaccctcgctacctcacgacgcccccgaccccgcgacctccacacgcccgaccaacaactccacaccgcgcttaaaacccacgcccgctacccgaaccgccgcgcccaacccgaaccgcaaaaactcgacctcacccgacgccgccgacgacctaaacccccaaaactccgcgcgctcgcgcctctcgtccaacttataaccctcgccgaccgccccgcgaacccaaacgaaccgaaaacgaaaccgtcatccaaaccaaaaccataccattacgctaccccgaccgccaatccgcccaaaaaccataaacgaaacgtaaataaccgtaattaaacgaacgaacaaaaccgacgaaacaaccccctccgcgcccccgaccgtcccccctcatcgccccgcgcccacccccatcgcccctacccccgacgacgacctcgcgtacgaaaaaactcccttcacctcgatacctcaattcccccaactataaaacaaaaacgaaacgaccca

SEQ ID NO: 1397 - DNA, 969 bp, Artificial Sequence
  chemically treated genomic DNA (Homo sapiens) CpG-island No: 1397
aggagacgtatattcgtgatagtgaatacgggacgtatgtgggcgagagacggggcggtggttggatgagttttttatagttacggatggaggatgggagttgcgggtggatcgggttgaaataagcgtgttcggagttgtcgggggaggagggtggatagaggatttgggggcgtcgggggaggaagtagttcggcggatgtaggggaggggggaacgtggggaacgcgggggttttggggtaggggagaagggagaagtaggacgggtagggggcgcgggggaggagagcgggcgggggacgtgggggcgttaggggagggggaggggaggaggaagacgggtagggggcgttaggggagggggaggggaggaggaagacgggtagggggcgcgggggcgtcgggggagggcgcgggggcgtcgggggagggcgcgggggtgtcgggagggcggggaatgcgggggtttcgtttttatcgttaagggttggttcgcggagtttaggatgttatttattatttttttcgtaaaggttaggcgttttcgtagcggttttcgtttttttaatttcgtgagattgattaggtggattttgagttaatttaggtcgtgcgggtcgagcgggcggttttgggcgaattttagtagggttcgcgttacgtcgttgtttaggtggttgaagtgcggcgggtaggggtaggtgcggtcgcggaagtttatgttgtgcggtagttagaagacgcggtttcgtaggtgttgcgttagcgagaggcggtatagcgttttcgttcgtaggttgtgtatttttcgggttattttttggtagtgcgttagtttacggcgtagttcggttttgcgggcgggcgcggcgttgtgcggtaggtgggtttcgggcggttggggcgtttcggagggcggggtcggtacgtttagttgggggtagtttttggtttggaagagttgtag

SEQ ID NO: 1398 - DNA, 969 bp, Artificial Sequence
  chemically treated genomic DNA (Homo sapiens) CpG-island No: 1398
ctacaactcttccaaaccaaaaactacccccaactaaacgtaccgaccccgccctccgaaacgccccaaccgcccgaaacccacctaccgcacaacgccgcgcccgcccgcaaaaccgaactacgccgtaaactaacgcactaccaaaaaataacccgaaaaatacacaacctacgaacgaaaacgctataccgcctctcgctaacgcaacacctacgaaaccgcgtcttctaactaccgcacaacataaacttccgcgaccgcacctacccctacccgccgcacttcaaccacctaaacaacgacgtaacgcgaaccctactaaaattcgcccaaaaccgcccgctcgacccgcacgacctaaattaactcaaaatccacctaatcaatctcacgaaattaaaaaaacgaaaaccgctacgaaaacgcctaacctttacgaaaaaaataataaataacatcctaaactccgcgaaccaacccttaacgataaaaacgaaacccccgcattccccgccctcccgacacccccgcgccctcccccgacgcccccgcgccctcccccgacgcccccgcgccccctacccgtcttcctcctcccctccccctcccctaacgccccctacccgtcttcctcctcccctccccctcccctaacgcccccacgtcccccgcccgctctcctcccccgcgccccctacccgtcctacttctcccttctcccctaccccaaaacccccgcgttccccacgttcccccctcccctacatccgccgaactacttcctcccccgacgcccccaaatcctctatccaccctcctcccccgacaactccgaacacgcttatttcaacccgatccacccgcaactcccatcctccatccgtaactataaaaaactcatccaaccaccgccccgtctctcgcccacatacgtcccgtattcactatcacgaatatacgtctcct

SEQ ID NO: 1399 - DNA, 969 bp, Artificial Sequence
  chemically treated genomic DNA (Homo sapiens) CpG-island No: 1399
ttgtagtttttttaggttaagggttgtttttagttaggcgtgtcggtttcgtttttcgaggcgttttagtcgttcgaggtttatttgtcgtatagcgtcgcgttcgttcgtaaggtcgagttgcgtcgtgagttggcgtattgttagaaggtggttcgggagatgtatagtttgcgggcggaggcgttgtatcgtttttcgttggcgtagtatttgcgggatcgcgttttttggttgtcgtataatatggattttcgcggtcgtatttatttttgttcgtcgtattttaattatttgggtagcgacgtggcgcgggttttgttggagttcgtttagggtcgttcgttcggttcgtacggtttggattggtttaagatttatttggttaattttacggggttgaagaagcgggagtcgttgcggaagcgtttggtttttgcggaggaggtgatggatgatattttggatttcgcggattaatttttgacggtaggggcggggttttcgtatttttcgttttttcggtattttcgcgttttttttcggcgttttcgcgttttttttcggcgttttcgcgttttttgttcgttttttttttttttttttttttttttggcgttttttgttcgttttttttttttttttttttttttttggcgtttttacgtttttcgttcgtttttttttttcgcgttttttgttcgttttgtttttttttttttttttgttttagggttttcgcgttttttacgttttttttttttttgtattcgtcgagttgttttttttttcggcgtttttaggttttttgtttatttttttttttcggtagtttcggatacgtttgttttagttcggtttattcgtagtttttattttttattcgtggttatggagaatttatttagttatcgtttcgtttttcgtttatatgcgtttcgtgtttattattacgggtgtgcgtttttt

SEQ ID NO: 1400 - DNA, 969 bp, Artificial Sequence
  chemically treated genomic DNA (Homo sapiens) CpG-island No: 1400
aaaaaacgcacacccgtaataataaacacgaaacgcatataaacgaaaaacgaaacgataactaaataaattctccataaccacgaataaaaaataaaaactacgaataaaccgaactaaaacaaacgtatccgaaactaccgaaaaaaaaaaataaacaaaaaacctaaaaacgccgaaaaaaaaaacaactcgacgaatacaaaaaaaaaaaaaacgtaaaaaacgcgaaaaccctaaaacaaaaaaaaaaaaaaaaacaaaacgaacaaaaaacgcgaaaaaaaaaaacgaacgaaaaacgtaaaaacgccaaaaaaaaaaaaaaaaaaaaaaaaaacgaacaaaaaacgccaaaaaaaaaaaaaaaaaaaaaaaaaacgaacaaaaaacgcgaaaacgccgaaaaaaaacgcgaaaacgccgaaaaaaaacgcgaaaataccgaaaaaacgaaaaatacgaaaaccccgcccctaccgtcaaaaattaatccgcgaaatccaaaatatcatccatcacctcctccgcaaaaaccaaacgcttccgcaacgactcccgcttcttcaaccccgtaaaattaaccaaataaatcttaaaccaatccaaaccgtacgaaccgaacgaacgaccctaaacgaactccaacaaaacccgcgccacgtcgctacccaaataattaaaatacgacgaacaaaaataaatacgaccgcgaaaatccatattatacgacaaccaaaaaacgcgatcccgcaaatactacgccaacgaaaaacgatacaacgcctccgcccgcaaactatacatctcccgaaccaccttctaacaatacgccaactcacgacgcaactcgaccttacgaacgaacgcgacgctatacgacaaataaacctcgaacgactaaaacgcctcgaaaaacgaaaccgacacgcctaactaaaaacaacccttaacctaaaaaaactacaa

SEQ ID NO: 1401 - DNA, 800 bp, Artificial Sequence
  chemically treated genomic DNA (Homo sapiens) CpG-island No: 1401
ttttgattgtcgtcgtttttttgtttttgttttttttcgggtttttgtttttttttaggtttttgcggttcgcgttttatattttcgttttcgtaattcgaggttttagttcgttcggggattcggttgatttacggatacgtttcgcgagataaataataaacgcgcggaggtcgagcgcggagtttcgtacggtcgcgtttttgtgtatttggttttcgttttcgagacgttttattggtcggcgttttagtttggtttcgtttaagtggatttcgttttcgtttcgaggtattttattggtcggcgttttcgttttagcgaattcggtttcgttttcgaggcgttttattggtttcgtcgcgcgaaggtagagtcgcggacgttcgggagcgacgagcgcgtagcgaatcgggtgtcgggttatgcgtcgtcgtttgtggttgggtttggtttggttgttgttggcgcgggcgtcggacgtcgcgggaatttcgagcgcgtcgcggggatcgcgtagttattcgtatttggagggcgacgtgcgttggcggcgtttttttttttttatttatttttttttgcgcgtggatttcggcggtcgcgtgtagggtattcgttggcgttacggttaggatagtgagtgcggggcggcgggggtttggggtggggaggcggcgggtgacggtaacgcggtcgtcgtttttacggtgatttgcgttcgcgggggagtttcggaggtttttttgtgtagtttcggttttagttttcgtggtttgtgagatgggtgtagtttgttt

SEQ ID NO: 1402 - DNA, 800 bp, Artificial Sequence
  chemically treated genomic DNA (Homo sapiens) CpG-island No: 1402
aaacaaactacacccatctcacaaaccacgaaaactaaaaccgaaactacacaaaaaaacctccgaaactcccccgcgaacgcaaatcaccgtaaaaacgacgaccgcgttaccgtcacccgccgcctccccaccccaaacccccgccgccccgcactcactatcctaaccgtaacgccaacgaataccctacacgcgaccgccgaaatccacgcgcaaaaaaaaataaataaaaaaaaaaaaacgccgccaacgcacgtcgccctccaaatacgaataactacgcgatccccgcgacgcgctcgaaattcccgcgacgtccgacgcccgcgccaacaacaaccaaaccaaacccaaccacaaacgacgacgcataacccgacacccgattcgctacgcgctcgtcgctcccgaacgtccgcgactctaccttcgcgcgacgaaaccaataaaacgcctcgaaaacgaaaccgaattcgctaaaacgaaaacgccgaccaataaaatacctcgaaacgaaaacgaaatccacttaaacgaaaccaaactaaaacgccgaccaataaaacgtctcgaaaacgaaaaccaaatacacaaaaacgcgaccgtacgaaactccgcgctcgacctccgcgcgtttattatttatctcgcgaaacgtatccgtaaatcaaccgaatccccgaacgaactaaaacctcgaattacgaaaacgaaaatataaaacgcgaaccgcaaaaacctaaaaaaaaacaaaaacccgaaaaaaaacaaaaacaaaaaaacgacgacaatcaaaa

SEQ ID NO: 1403 - DNA, 800 bp, Artificial Sequence
  chemically treated genomic DNA (Homo sapiens) CpG-island No: 1403
aggtaggttgtatttattttatagattacggaaattgaggtcgaggttgtatagaggagttttcgggattttttcgcgggcgtaggttatcgtgaagacggcggtcgcgttgtcgttattcgtcgtttttttattttaggttttcgtcgtttcgtatttattgttttggtcgtggcgttagcgggtgttttgtacgcggtcgtcgggatttacgcgtaggaagaagtgagtggaggagaagaggcgtcgttagcgtacgtcgttttttaggtgcgggtagttgcgcggttttcgcgacgcgttcggggttttcgcggcgttcggcgttcgcgttagtagtagttaggttaggtttagttataggcggcggcgtatgattcggtattcggttcgttgcgcgttcgtcgttttcgggcgttcgcggttttgttttcgcgcggcggggttaatggggcgtttcgggggcggggtcgggttcgttggggcggggacgtcggttaatggggtgtttcggggcgggggcggggtttatttgggcgggattaggttagggcgtcggttaatgggacgtttcgggggcgggggttaggtgtataggggcgcggtcgtgcgggatttcgcgttcggttttcgcgcgtttgttgtttgtttcgcggggcgtgttcgtgagttagtcgagttttcgggcgggttaggatttcgggttgcgggggcgggagtgtgagacgcgggtcgtagagatttggagggagatagagattcggagggagatagagatagaaagacggcggtagttaaga

SEQ ID NO: 1404 - DNA, 800 bp, Artificial Sequence
  chemically treated genomic DNA (Homo sapiens) CpG-island No: 1404
tcttaactaccgccgtctttctatctctatctccctccgaatctctatctccctccaaatctctacgacccgcgtctcacactcccgcccccgcaacccgaaatcctaacccgcccgaaaactcgactaactcacgaacacgccccgcgaaacaaacaacaaacgcgcgaaaaccgaacgcgaaatcccgcacgaccgcgcccctatacacctaacccccgcccccgaaacgtcccattaaccgacgccctaacctaatcccgcccaaataaaccccgcccccgccccgaaacaccccattaaccgacgtccccgccccaacgaacccgaccccgcccccgaaacgccccattaaccccgccgcgcgaaaacaaaaccgcgaacgcccgaaaacgacgaacgcgcaacgaaccgaataccgaatcatacgccgccgcctataactaaacctaacctaactactactaacgcgaacgccgaacgccgcgaaaaccccgaacgcgtcgcgaaaaccgcgcaactacccgcacctaaaaaacgacgtacgctaacgacgcctcttctcctccactcacttcttcctacgcgtaaatcccgacgaccgcgtacaaaacacccgctaacgccacgaccaaaacaataaatacgaaacgacgaaaacctaaaataaaaaaacgacgaataacgacaacgcgaccgccgtcttcacgataacctacgcccgcgaaaaaatcccgaaaactcctctatacaacctcgacctcaatttccgtaatctataaaataaatacaacctacct

SEQ ID NO: 1405 - DNA, 828 bp, Artificial Sequence
  chemically treated genomic DNA (Homo sapiens) CpG-island No: 1405
gaggcgttatcggtaagttcgagagaatgagcgtttttttagttaggatagtttttgggtattttaatttcgtatttttttatttcgtttcgtagttcgggtgtgaatgtaagggattggggcggcggggcgggggcgggggcgggggcgagggggtagcgcggagttgagatttcgttcggttattagggtttttttgggagaacgtgagaaatgatgttttcggttttagaatgatggattagtttgggatagtgggcggggggcggggggcgtcggggaattagggtcgatgtagttgtgtagacgtcgggttagttatttaaatttcgtttttttcgttcgggacgttttcgcgatttttcgtttaaagtcgttcgcggagtataaagcgagcgcggttatcgatttagttatcgcgttcgcgcgttttcggtagggcgcgaggggaagcgtcggcggtagggagttttagagttagtttttaagtagtttagtatatagcgcggagggtagtcgtcggcgggttggcgggatagcgggtaggaaaggcgatagacgcgtggttatttatcgtcggcgttgggttcggtgttttacgttcgtttggggatagtcggggacgtacggcgggggtttatcggggtagggaattttttcgcggagagtcggagggttgtattggttttagttggagacgttttttttttttttttttttttcgtcgtcgtcgtcgtcgttttttgggaaaaagaaaaaaaaaaaaaaaagttttgggtagtagttgttggaaagtttttgttaagttattttttagcgtcgttgttt

SEQ ID NO: 1406 - DNA, 828 bp, Artificial Sequence
  chemically treated genomic DNA (Homo sapiens) CpG-island No: 1406
aaacaacgacgctaaaaaataacttaacaaaaactttccaacaactactacccaaaacttttttttttttttttctttttcccaaaaaacgacgacgacgacgacgaaaaaaaaaaaaaaaaaaaaaacgtctccaactaaaaccaatacaaccctccgactctccgcgaaaaaattccctaccccgataaacccccgccgtacgtccccgactatccccaaacgaacgtaaaacaccgaacccaacgccgacgataaataaccacgcgtctatcgcctttcctacccgctatcccgccaacccgccgacgactaccctccgcgctatatactaaactacttaaaaactaactctaaaactccctaccgccgacgcttcccctcgcgccctaccgaaaacgcgcgaacgcgataactaaatcgataaccgcgctcgctttatactccgcgaacgactttaaacgaaaaatcgcgaaaacgtcccgaacgaaaaaaacgaaatttaaataactaacccgacgtctacacaactacatcgaccctaattccccgacgccccccgccccccgcccactatcccaaactaatccatcattctaaaaccgaaaacatcatttctcacgttctcccaaaaaaaccctaataaccgaacgaaatctcaactccgcgctaccccctcgcccccgcccccgcccccgccccgccgccccaatcccttacattcacacccgaactacgaaacgaaataaaaaaatacgaaattaaaatacccaaaaactatcctaactaaaaaaacgctcattctctcgaacttaccgataacgcctc

SEQ ID NO: 1407 - DNA, 828 bp, Artificial Sequence
  chemically treated genomic DNA (Homo sapiens) CpG-island No: 1407
ggatagcggcgttgggaggtggtttagtagagattttttagtaattgttgtttaggattttttttttttttttttttttttttaggaggcggcgacggcggcggcggggggagaggaagagaaagaagcgtttttagttgaagttaatgtagtttttcggtttttcgcgaagaagttttttgtttcgatgagttttcgtcgtgcgttttcgattatttttaggcgggcgtggggtatcgggtttagcgtcgacggtaagtggttacgcgtttgtcgttttttttgttcgttgtttcgttagttcgtcggcggttgtttttcgcgttgtgtgttaaattatttaagggttggttttggggttttttgtcgtcggcgttttttttcgcgttttgtcgggggcgcgcggacgcgatggttgggtcggtggtcgcgttcgttttgtgtttcgcgggcggttttgagcgaggggtcgcgggagcgtttcgggcgggggaagcggggtttgaatgattaattcggcgtttgtatagttgtatcggttttaatttttcggcgtttttcgtttttcgtttattgttttaggttaatttattattttggggtcgaaaatattattttttacgtttttttagagaaattttagtagtcgggcggaattttaatttcgcgttgttttttcgttttcgttttcgttttcgtttcgtcgttttagttttttgtatttatattcgagttgcgggacggggtagaggggtgcggagttggagtgtttaggaattgttttaattagaagggcgtttattttttcgggtttgtcggtggcgtttt

SEQ ID NO: 1408 - DNA, 828 bp, Artificial Sequence
  chemically treated genomic DNA (Homo sapiens) CpG-island No: 1408
aaaacgccaccgacaaacccgaaaaaataaacgcccttctaattaaaacaattcctaaacactccaactccgcacccctctaccccgtcccgcaactcgaatataaatacaaaaaactaaaacgacgaaacgaaaacgaaaacgaaaacgaaaaaacaacgcgaaattaaaattccgcccgactactaaaatttctctaaaaaaacgtaaaaaataatattttcgaccccaaaataataaattaacctaaaacaataaacgaaaaacgaaaaacgccgaaaaattaaaaccgatacaactatacaaacgccgaattaatcattcaaaccccgcttcccccgcccgaaacgctcccgcgacccctcgctcaaaaccgcccgcgaaacacaaaacgaacgcgaccaccgacccaaccatcgcgtccgcgcgcccccgacaaaacgcgaaaaaaaacgccgacgacaaaaaaccccaaaaccaacccttaaataatttaacacacaacgcgaaaaacaaccgccgacgaactaacgaaacaacgaacaaaaaaaacgacaaacgcgtaaccacttaccgtcgacgctaaacccgataccccacgcccgcctaaaaataatcgaaaacgcacgacgaaaactcatcgaaacaaaaaacttcttcgcgaaaaaccgaaaaactacattaacttcaactaaaaacgcttctttctcttcctctccccccgccgccgccgtcgccgcctcctaaaaaaaaaaaaaaaaaaaaaaaaaatcctaaacaacaattactaaaaaatctctactaaaccacctcccaacgccgctatcc

SEQ ID NO: 1409 - DNA, 1232 bp, Artificial Sequence
  chemically treated genomic DNA (Homo sapiens) CpG-island No: 1409
ggtatttttttgtttttattcgttttttatattttcggacgtttagcgtcgtttagggatttttttttttcggcgcgttagggcggggtttgggtcgaggtcgtttttgtaaagggcgttcgttcgttaggattttagtttagtgtagtcgcggttcgcgcgtttcggggaaaggttgggcggggtatttatttttacgcgtttttcgcgaaggcggatgcggtcggttaggcgttcgcgcgtatttacgttaggatattggttttgtacgaaaagcgtttcgagcgtttgtagttgtttttcgttgaagatggtgcggtggcgtttcgtgcgtcgttgcgaattcgggtcgatcgcgttcgggagcgtttcggaattttcggttggcgtatttagagataagggtatcgtcggttttagttttagcggttacgttagacgagcgtttgcggagcgagggcgcggtgaggcgcggggttggggttaagttcggtatttattgcgtcgcgtttcggtttcgtcgggtttcgcgttcgtttcgcgtttatttatttagtacggcggtcgtttttgggggttcgtagggcgtcgcgcgggggtcgtagtagtagtagtaggcgtagggcgtagtttcgggcgtttcgggtttttttggtttcgcggggttttggcgatcggcgggttgcggtgggtaggcggttcgggtcgggagtttcgttcgggtaggttggagaggatgtgttcgatggagaaggggtagggtcgttcggtatttcggcggttcgtcgcgtttttagtcgttgtcgttatgttcggttcggtcggggcgtcgtcgtcgcgggaatatatacgtcggggagggagcgcgtagtaattttcgggtcgggcgtttagtttacgcgggttaatttcgtagcgtcggtcgcgaacgcgttaattttcgattgcggcggttttgttttcgcgcgcgggggtcgggggcgttgtagagagggttttttgtgttttttatttcgtttcgcgtttttttgttttattcgcgttcgtcgtttaagttggtagggcgatttgcggggaaggggcggagggtcgtttcgtcgtcgttcgcggggtttggtagtcgttcggagggcgtttcgattttggtagttttttagagcgcggcggtgtttttcggtttagtttttggtggttttttttcgttcggttgggtttaatttttcgtttttttt

SEQ ID NO: 1410 - DNA, 1232 bp, Artificial Sequence
  chemically treated genomic DNA (Homo sapiens) CpG-island No: 1410
aaaaaaaacgaaaaattaaacccaaccgaacgaaaaaaaaccaccaaaaactaaaccgaaaaacaccgccgcgctctaaaaaactaccaaaatcgaaacgccctccgaacgactaccaaaccccgcgaacgacgacgaaacgaccctccgccccttccccgcaaatcgccctaccaacttaaacgacgaacgcgaataaaacaaaaaaacgcgaaacgaaataaaaaacacaaaaaaccctctctacaacgcccccgacccccgcgcgcgaaaacaaaaccgccgcaatcgaaaattaacgcgttcgcgaccgacgctacgaaattaacccgcgtaaactaaacgcccgacccgaaaattactacgcgctccctccccgacgtatatattcccgcgacgacgacgccccgaccgaaccgaacataacgacaacgactaaaaacgcgacgaaccgccgaaataccgaacgaccctaccccttctccatcgaacacatcctctccaacctacccgaacgaaactcccgacccgaaccgcctacccaccgcaacccgccgatcgccaaaaccccgcgaaaccaaaaaaacccgaaacgcccgaaactacgccctacgcctactactactactacgacccccgcgcgacgccctacgaacccccaaaaacgaccgccgtactaaataaataaacgcgaaacgaacgcgaaacccgacgaaaccgaaacgcgacgcaataaataccgaacttaaccccaaccccgcgcctcaccgcgccctcgctccgcaaacgctcgtctaacgtaaccgctaaaactaaaaccgacgatacccttatctctaaatacgccaaccgaaaattccgaaacgctcccgaacgcgatcgacccgaattcgcaacgacgcacgaaacgccaccgcaccatcttcaacgaaaaacaactacaaacgctcgaaacgcttttcgtacaaaaccaatatcctaacgtaaatacgcgcgaacgcctaaccgaccgcatccgccttcgcgaaaaacgcgtaaaaataaataccccgcccaacctttccccgaaacgcgcgaaccgcgactacactaaactaaaatcctaacgaacgaacgccctttacaaaaacgacctcgacccaaaccccgccctaacgcgccgaaaaaaaaaaatccctaaacgacgctaaacgtccgaaaatataaaaaacgaataaaaacaaaaaaatacc

SEQ ID NO: 1411 - DNA, 1232 bp, Artificial Sequence
  chemically treated genomic DNA (Homo sapiens) CpG-island No: 1411
agaggggacgaggaattaggtttagtcgaacgagggggagttattagaggttgggtcgggaggtatcgtcgcgttttggggagttgttagggtcggggcgtttttcgagcggttgttaggtttcgcgggcggcggcgaggcggtttttcgtttttttttcgtaggtcgttttgttagtttgagcggcgggcgcgggtggggtaggaggacgcggggcggggtggggggtatagggggttttttttgtagcgttttcggttttcgcgcgcggaggtagggtcgtcgtagtcgaggattagcgcgttcgcggtcggcgttgcgggattaattcgcgtggattggacgttcggttcggggattattgcgcgtttttttttcgacgtatatattttcgcggcggcggcgtttcggtcgggtcgggtatggcggtagcggttgggggcgcggcgagtcgtcggggtgtcgggcggttttgttttttttttatcgagtatattttttttagtttgttcgagcggagttttcggttcgggtcgtttgtttatcgtagttcgtcggtcgttagagtttcgcgaagttagaggagttcggggcgttcgaggttgcgttttgcgtttgttgttgttgttgcggttttcgcgcggcgttttgcgggtttttagaggcggtcgtcgtgttgggtgagtgggcgcggagcgggcgcggggttcggcggagtcggggcgcggcgtagtgggtgtcgagtttggttttagtttcgcgttttatcgcgttttcgtttcgtaggcgttcgtttggcgtggtcgttgaggttgggatcggcggtgtttttgtttttgggtgcgttagtcggaggtttcggggcgttttcgggcgcggtcggttcgggttcgtagcggcgtacgaggcgttatcgtattatttttagcgaagagtagttgtaggcgttcgaggcgtttttcgtgtagaattagtattttgacgtgagtacgcgcgagcgtttggtcggtcgtattcgttttcgcgaggagcgcgtggaggtgagtgtttcgtttagttttttttcggagcgcgcgggtcgcggttatattggattggggttttggcgggcgggcgttttttgtaaagacggtttcggtttaagtttcgttttggcgcgtcggagggaggaggtttttggacggcgttgggcgttcgggggtatgaggagcgggtgagagtagggaggtgtt

SEQ ID NO: 1412 - DNA, 1232 bp, Artificial Sequence
  chemically treated genomic DNA (Homo sapiens) CpG-island No: 1412
aacacctccctactctcacccgctcctcatacccccgaacgcccaacgccgtccaaaaacctcctccctccgacgcgccaaaacgaaacttaaaccgaaaccgtctttacaaaaaacgcccgcccgccaaaaccccaatccaatataaccgcgacccgcgcgctccgaaaaaaaactaaacgaaacactcacctccacgcgctcctcgcgaaaacgaatacgaccgaccaaacgctcgcgcgtactcacgtcaaaatactaattctacacgaaaaacgcctcgaacgcctacaactactcttcgctaaaaataatacgataacgcctcgtacgccgctacgaacccgaaccgaccgcgcccgaaaacgccccgaaacctccgactaacgcacccaaaaacaaaaacaccgccgatcccaacctcaacgaccacgccaaacgaacgcctacgaaacgaaaacgcgataaaacgcgaaactaaaaccaaactcgacacccactacgccgcgccccgactccgccgaaccccgcgcccgctccgcgcccactcacccaacacgacgaccgcctctaaaaacccgcaaaacgccgcgcgaaaaccgcaacaacaacaacaaacgcaaaacgcaacctcgaacgccccgaactcctctaacttcgcgaaactctaacgaccgacgaactacgataaacaaacgacccgaaccgaaaactccgctcgaacaaactaaaaaaaatatactcgataaaaaaaaaacaaaaccgcccgacaccccgacgactcgccgcgcccccaaccgctaccgccatacccgacccgaccgaaacgccgccgccgcgaaaatatatacgtcgaaaaaaaaacgcgcaataatccccgaaccgaacgtccaatccacgcgaattaatcccgcaacgccgaccgcgaacgcgctaatcctcgactacgacgaccctacctccgcgcgcgaaaaccgaaaacgctacaaaaaaaaccccctataccccccaccccgccccgcgtcctcctaccccacccgcgcccgccgctcaaactaacaaaacgacctacgaaaaaaaaacgaaaaaccgcctcgccgccgcccgcgaaacctaacaaccgctcgaaaaacgccccgaccctaacaactccccaaaacgcgacgatacctcccgacccaacctctaataactccccctcgttcgactaaacctaattcctcgtcccctct

SEQ ID NO: 1413 - DNA, 1532 bp, Artificial Sequence
  chemically treated genomic DNA (Homo sapiens) CpG-island No: 1413
gtttgtcggttgtttcgggagtatcgggttagcggggtcgttcgttttcgtattttttgcgtgttcggggttttcgttaggattttttttattttgatggtttttatggggtatacgattattacggtttcggttacgttagcgtttaggtcgtatagtagtttacgcgtgttgtttagtcgtttttgggtatttcgtatgtggttgttgaggaattcgaatattttaaatttggaggcgggaggcgggtgagaggggttgtcgcggtcgagtttttttttcgtagtagttatcggtcgggttttatttgacggtcgttttggggatggaatcgtagagtagggagttaaggtcgcggtataggtttaggacgttatggttgcgaatcgtttgtcgtacgtagttttttgggggagggggcggttaggattttacggttttcggtgtcgtcgttttgggtattcgtttttcgcggcgtcgcggtttttttttttttatcgatgtttcggtatcgcggcgggtgcgagcgttcgtttagttgtagttgcgtttttacgtattcggtggggaaggtgatgtagatttcgatgttattcgttaggtcgtttgtagggatcgggaattcgtttttgagattttcgttcggtcgttggcgttcgggtttttttttcgtttcggatttcggtcggcgcggtcgtcgcgttagtgtcgcggggaatataggttggggttttacgtttttatgtttttatttcgttgtttcggcgaggcgtagggggtgatagacgggaggcgggcgagttttagcgcgtcgggtggggattaggatcgcgtttttacgattttttagtttacggtttaattcggaagtggggcggggttttagcgtttcgggtttatttagaagcgcggcgggagaggggttcgcgtttcggaggggtttatttgttaggatcgtttttttcgggtgcgttagtttggttttttcggacgcgggcgcggcggtcgttagagcgcgcggggcgcggggcgcgggtatggcgggcgggaggcggggcgttttgtggcggtttcgggttcgagattttagaatttcgcgttcggttcgcggtggcggcggcggtcggttatggttttaggggcggggcggtcgcgttagttttaggtttcgtttcgcgtggttcgagttaggtttcgtttttagttcgtttcgtgcgggtcgggaaattgaggtttgggcggggcgcgtcgaggtaggcgtaggggcggggttaaagcgtagttaatggtcgaggtcgagtttttgggcgatcgcgagcggcgggacgggggcggggttgcgggaggcggagtcgtggtttagtttcgagtagtgggttaaggtgtattgtgtgtcgcgtcgcgggatagcgggtttcgggtttgcgcgattgtcgagagcggcgggatttttagggatttcggaggttaggggtatatttttttcgaaaatacgtggggttagtttagttttagaggaattttaacgtttt

SEQ ID NO: 1414 - DNA, 1532 bp, Artificial Sequence
  chemically treated genomic DNA (Homo sapiens) CpG-island No: 1414
aaaacgttaaaattcctctaaaactaaactaaccccacgtattttcgaaaaaaatatacccctaacctccgaaatccctaaaaatcccgccgctctcgacaatcgcgcaaacccgaaacccgctatcccgcgacgcgacacacaatacaccttaacccactactcgaaactaaaccacgactccgcctcccgcaaccccgcccccgtcccgccgctcgcgatcgcccaaaaactcgacctcgaccattaactacgctttaaccccgcccctacgcctacctcgacgcgccccgcccaaacctcaatttcccgacccgcacgaaacgaactaaaaacgaaacctaactcgaaccacgcgaaacgaaacctaaaactaacgcgaccgccccgcccctaaaaccataaccgaccgccgccgccaccgcgaaccgaacgcgaaattctaaaatctcgaacccgaaaccgccacaaaacgccccgcctcccgcccgccatacccgcgccccgcgccccgcgcgctctaacgaccgccgcgcccgcgtccgaaaaaaccaaactaacgcacccgaaaaaaacgatcctaacaaataaacccctccgaaacgcgaacccctctcccgccgcgcttctaaataaacccgaaacgctaaaaccccgccccacttccgaattaaaccgtaaactaaaaaatcgtaaaaacgcgatcctaatccccacccgacgcgctaaaactcgcccgcctcccgtctatcaccccctacgcctcgccgaaacaacgaaataaaaacataaaaacgtaaaaccccaacctatattccccgcgacactaacgcgacgaccgcgccgaccgaaatccgaaacgaaaaaaaaacccgaacgccaacgaccgaacgaaaatctcaaaaacgaattcccgatccctacaaacgacctaacgaataacatcgaaatctacatcaccttccccaccgaatacgtaaaaacgcaactacaactaaacgaacgctcgcacccgccgcgataccgaaacatcgataaaaaaaaaaaaaccgcgacgccgcgaaaaacgaatacccaaaacgacgacaccgaaaaccgtaaaatcctaaccgccccctcccccaaaaaactacgtacgacaaacgattcgcaaccataacgtcctaaacctataccgcgaccttaactccctactctacgattccatccccaaaacgaccgtcaaataaaacccgaccgataactactacgaaaaaaaaactcgaccgcgacaacccctctcacccgcctcccgcctccaaatttaaaatattcgaattcctcaacaaccacatacgaaatacccaaaaacgactaaacaacacgcgtaaactactatacgacctaaacgctaacgtaaccgaaaccgtaataatcgtataccccataaaaaccatcaaaataaaaaaaatcctaacgaaaaccccgaacacgcaaaaaatacgaaaacgaacgaccccgctaacccgatactcccgaaacaaccgacaaac

SEQ ID NO: 1415 - DNA, 1532 bp, Artificial Sequence
  chemically treated genomic DNA (Homo sapiens) CpG-island No: 1415
gaaacgttagagtttttttgggattgggttagttttacgtgttttcggggagggtgtgtttttggttttcgggatttttggggatttcgtcgttttcgatagtcgcgtagattcgaggttcgttatttcgcggcgcggtatatagtgtattttgatttattgttcggagttgggttacggtttcgtttttcgtagtttcgttttcgtttcgtcgttcgcggtcgtttagggattcggtttcggttattggttgcgttttggtttcgtttttacgtttgtttcggcgcgtttcgtttaggttttagtttttcggttcgtacggggcgggttgggggcggggtttggttcggattacgcggggcgggatttggagttgacgcggtcgtttcgtttttgggattataatcggtcgtcgtcgttatcgcggatcgagcgcggagttttggagtttcggattcgaagtcgttatagggcgtttcgtttttcgttcgttatgttcgcgtttcgcgtttcgcgcgttttggcggtcgtcgcgttcgcgttcgggaaggttaagttgacgtattcggggaaggcgattttggtaggtgggttttttcgggacgcggatttttttttcgtcgcgtttttgggtgggttcgggacgttgaggtttcgttttattttcgggttgggtcgtgggttggggagtcgtggaggcgcggttttggtttttattcggcgcgttgggattcgttcgtttttcgtttgttattttttgcgtttcgtcgggataacggggtgagggtatgggggcgtggggttttagtttatgtttttcgcggtattggcgcggcggtcgcgtcgatcgaagttcgggacgggggaggggttcgagcgttagcggtcgggcgggagttttaggagcgggttttcggtttttgtaggcggtttggcgggtggtatcgagatttgtattattttttttatcgagtacgtgaagacgtagttgtagttggacgagcgttcgtattcgtcgcggtatcggggtatcggtgaggagggggaggtcgcggcgtcgcggggggcgggtatttagggcggcggtatcgagggtcgtggggttttgatcgtttttttttttaggggattgcgtgcggtagacggttcgtagttatggcgttttgggtttgtatcgcggttttagttttttgttttacggttttatttttaaggcggtcgttaggtgaggttcggtcggtggttgttgcgggaggggggttcggtcgcggtagttttttttattcgtttttcgtttttaggtttggaatgttcgagttttttagtaattatatgcgggatgtttagggacggttggatagtacgcgtgggttgttgtgcggtttgggcgttggcgtggtcgaggtcgtggtggtcgtgtgttttatggagattattaaggtggggaaggttttggcgaggatttcggatacgtagggagtacggagacgggcggtttcgttggttcggtgttttcggggtaatcggtaagt

SEQ ID NO: 1416 - DNA, 1532 bp, Artificial Sequence
  chemically treated genomic DNA (Homo sapiens) CpG-island No: 1416
acttaccgattaccccgaaaacaccgaaccaacgaaaccgcccgtctccgtactccctacgtatccgaaatcctcgccaaaaccttccccaccttaataatctccataaaacacacgaccaccacgacctcgaccacgccaacgcccaaaccgcacaacaacccacgcgtactatccaaccgtccctaaacatcccgcatataattactaaaaaactcgaacattccaaacctaaaaacgaaaaacgaataaaaaaaactaccgcgaccgaacccccctcccgcaacaaccaccgaccgaacctcacctaacgaccgccttaaaaataaaaccgtaaaacaaaaaactaaaaccgcgatacaaacccaaaacgccataactacgaaccgtctaccgcacgcaatcccctaaaaaaaaaaacgatcaaaaccccacgaccctcgataccgccgccctaaatacccgccccccgcgacgccgcgacctccccctcctcaccgataccccgataccgcgacgaatacgaacgctcgtccaactacaactacgtcttcacgtactcgataaaaaaaataatacaaatctcgataccacccgccaaaccgcctacaaaaaccgaaaacccgctcctaaaactcccgcccgaccgctaacgctcgaacccctcccccgtcccgaacttcgatcgacgcgaccgccgcgccaataccgcgaaaaacataaactaaaaccccacgcccccataccctcaccccgttatcccgacgaaacgcaaaaaataacaaacgaaaaacgaacgaatcccaacgcgccgaataaaaaccaaaaccgcgcctccacgactccccaacccacgacccaacccgaaaataaaacgaaacctcaacgtcccgaacccacccaaaaacgcgacgaaaaaaaaatccgcgtcccgaaaaaacccacctaccaaaatcgccttccccgaatacgtcaacttaaccttcccgaacgcgaacgcgacgaccgccaaaacgcgcgaaacgcgaaacgcgaacataacgaacgaaaaacgaaacgccctataacgacttcgaatccgaaactccaaaactccgcgctcgatccgcgataacgacgacgaccgattataatcccaaaaacgaaacgaccgcgtcaactccaaatcccgccccgcgtaatccgaaccaaaccccgcccccaacccgccccgtacgaaccgaaaaactaaaacctaaacgaaacgcgccgaaacaaacgtaaaaacgaaaccaaaacgcaaccaataaccgaaaccgaatccctaaacgaccgcgaacgacgaaacgaaaacgaaactacgaaaaacgaaaccgtaacccaactccgaacaataaatcaaaatacactatataccgcgccgcgaaataacgaacctcgaatctacgcgactatcgaaaacgacgaaatccccaaaaatcccgaaaaccaaaaacacaccctccccgaaaacacgtaaaactaacccaatcccaaaaaaactctaacgtttc

SEQ ID NO: 1417 - DNA, 743 bp, Artificial Sequence
  chemically treated genomic DNA (Homo sapiens) CpG-island No: 1417
agcgtcgcgggcgcgcggaggggatattgtcgtggggtaattgggcggagggcgataggtagtgtgtcgtgatagataattcgggcggcgcggtaggtttgtgtagtcggtagtggcgggtcgtcggtatttttaggtggcgttcgggcgggtatcgggttttagaggtatttaggaatgtttaggagttcgggttcgcgtggggtttgtcgtcgttaatcgttgttttcgagtaaatattttattcgtttcgcggggaagcgtcgttcgcggggagcgttttggagtagttgacggcgttcgtttcgtagtcgcgtattcgtttcgcgtcgtttagcgtttcggggtatttgcgagtttttttatggtcgcggttttcggttgtcggtagattatcgtttagacgaggaagatggagaagtcggttacggagttgatgtcggagtaggcggcgcggaggtcgagttgtagtttggacggggttatggggttgcggcgtcgggcgggtcgagggcgagcgcggtcgagagttataggtgtagggttcgaagtcgttagtcggagtcgcgggagtcgttagagtagtcggcgtttcgcgtttcgttttcggttcgtttttagcgtcgttcgtatagcgtttttttcggtcggaggtcgttcgcgttcggaatcgtagacgttatcgtcgttttgcgaagttgtcgtgtcgtttgggggaatgttgttaaaaaggcggatttttg

SEQ ID NO: 1418 - DNA, 743 bp, Artificial Sequence
  chemically treated genomic DNA (Homo sapiens) CpG-island No: 1418
caaaaatccgcctttttaacaacattcccccaaacgacacgacaacttcgcaaaacgacgataacgtctacgattccgaacgcgaacgacctccgaccgaaaaaaacgctatacgaacgacgctaaaaacgaaccgaaaacgaaacgcgaaacgccgactactctaacgactcccgcgactccgactaacgacttcgaaccctacacctataactctcgaccgcgctcgccctcgacccgcccgacgccgcaaccccataaccccgtccaaactacaactcgacctccgcgccgcctactccgacatcaactccgtaaccgacttctccatcttcctcgtctaaacgataatctaccgacaaccgaaaaccgcgaccataaaaaaactcgcaaataccccgaaacgctaaacgacgcgaaacgaatacgcgactacgaaacgaacgccgtcaactactccaaaacgctccccgcgaacgacgcttccccgcgaaacgaataaaatatttactcgaaaacaacgattaacgacgacaaaccccacgcgaacccgaactcctaaacattcctaaatacctctaaaacccgatacccgcccgaacgccacctaaaaataccgacgacccgccactaccgactacacaaacctaccgcgccgcccgaattatctatcacgacacactacctatcgccctccgcccaattaccccacgacaatatcccctccgcgcgcccgcgacgct

SEQ ID NO: 1419 - DNA, 743 bp, Artificial Sequence
  chemically treated genomic DNA (Homo sapiens) CpG-island No: 1419
taggaattcgtttttttagtagtatttttttaaacgatacggtagtttcgtaaagcggcggtggcgtttgcggtttcgggcgcgggcggttttcggtcggggagggcgttgtgcgggcggcgttgggggcgggtcgggggcggagcgcggggcgtcggttgttttggcggttttcgcggtttcggttggcggtttcgggttttgtatttgtgattttcggtcgcgttcgttttcggttcgttcggcgtcgtagttttatggtttcgtttaggttgtagttcggttttcgcgtcgtttatttcggtattagtttcgtggtcggtttttttatttttttcgtttggacggtggtttatcgatagtcggggatcgcggttatgggagggttcgtaggtatttcgggacgttgggcggcgcggggcgggtgcgcggttgcggggcgggcgtcgttagttgttttaggacgtttttcgcgagcggcgttttttcgcggagcgggtggagtgtttattcgaaaatagcggttggcggcggtaggttttacgcgggttcgggtttttgggtatttttgggtgtttttgagattcgatgttcgttcgggcgttatttgggggtgtcgacggttcgttattgtcggttgtatagatttgtcgcgtcgttcgggttatttgttacggtatattgtttgtcgtttttcgtttagttgttttacgatagtgtttttttcgcgcgttcgcggcgtt

SEQ ID NO: 1420 - DNA, 743 bp, Artificial Sequence
  chemically treated genomic DNA (Homo sapiens) CpG-island No: 1420
aacgccgcgaacgcgcgaaaaaaacactatcgtaaaacaactaaacgaaaaacgacaaacaatataccgtaacaaataacccgaacgacgcgacaaatctatacaaccgacaataacgaaccgtcgacacccccaaataacgcccgaacgaacatcgaatctcaaaaacacccaaaaatacccaaaaacccgaacccgcgtaaaacctaccgccgccaaccgctattttcgaataaacactccacccgctccgcgaaaaaacgccgctcgcgaaaaacgtcctaaaacaactaacgacgcccgccccgcaaccgcgcacccgccccgcgccgcccaacgtcccgaaatacctacgaaccctcccataaccgcgatccccgactatcgataaaccaccgtccaaacgaaaaaaataaaaaaaccgaccacgaaactaataccgaaataaacgacgcgaaaaccgaactacaacctaaacgaaaccataaaactacgacgccgaacgaaccgaaaacgaacgcgaccgaaaatcacaaatacaaaacccgaaaccgccaaccgaaaccgcgaaaaccgccaaaacaaccgacgccccgcgctccgcccccgacccgcccccaacgccgcccgcacaacgccctccccgaccgaaaaccgcccgcgcccgaaaccgcaaacgccaccgccgctttacgaaactaccgtatcgtttaaaaaaatactactaaaaaaacgaattccta

SEQ ID NO: 1421 - DNA, 1032 bp, Artificial Sequence
  chemically treated genomic DNA (Homo sapiens) CpG-island No: 1421
tcgtggcgtagtttttggtcgtcgtcgttttcgggaagggtttagaggtaatattttggatagtagagttgtacgaagttcgaggcgtcgcgagtttaggtaagttttagtaggcgttcgtagagagtgttaggcggttcgcgagttaggtttcgttcgtttttgttttaggcgcggtttttgtaggagggcgtcgcgggtgaaaggaggtttcggggcgatttcggtttcgttcgtcgtttagtttttatatcgtttttatcgcgcggcgtatttggtcgtagcggttcggtgatagtgagtacgagtaggaagagtagtaggaaggcgtcgttgtttgttttgggtattatttatttttcgtttatcgttttcggggcggttggaaggtcggattaggtcggattgagggttaggggatcgtgttaagcggagggttaggcggagttgaatttgggcgaggcgcggagaggcggcgggaaagagtttcggttgggtcgcgggttggcgtatattttcggttgtaattttaggtatcgattttagttgcgcgtaagatggcggtcgttttgttcggtttcgcgtcgcgtcgtttcgtttcgtttttcgttcgcgacgtaggcgcgggttaatgatcgttaagatggggggcggggttagagttaaagtttttcgaagagggtgaggtttaaggtcgcgacggcggagggcggggatttaagggcggggattgaggggcgggttttaagggaagggcgggattatacggagtgaggcgtgttattggttaagtagagaggtagggtcggggtcggggtttgagcggcggggttatcgaagggagtagggtttttggacgtcggttagggacggcgggcgcgggacggtaaggatggatatcgaaaggcgcggggtatggggcggggcgtcgaggggtcgcgcgggtggggagcggagagaacgaagtgggaatttggttgggattttaagggtttttatatttgtaagtttaggtttcgtgagtagtttaaa

SEQ ID NO: 1422 - DNA, 1032 bp, Artificial Sequence
  chemically treated genomic DNA (Homo sapiens) CpG-island No: 1422
tttaaactactcacgaaacctaaacttacaaatataaaaacccttaaaatcccaaccaaattcccacttcgttctctccgctccccacccgcgcgacccctcgacgccccgccccataccccgcgcctttcgatatccatccttaccgtcccgcgcccgccgtccctaaccgacgtccaaaaaccctactcccttcgataaccccgccgctcaaaccccgaccccgaccctacctctctacttaaccaataacacgcctcactccgtataatcccgcccttcccttaaaacccgcccctcaatccccgcccttaaatccccgccctccgccgtcgcgaccttaaacctcaccctcttcgaaaaactttaactctaaccccgccccccatcttaacgatcattaacccgcgcctacgtcgcgaacgaaaaacgaaacgaaacgacgcgacgcgaaaccgaacaaaacgaccgccatcttacgcgcaactaaaatcgatacctaaaattacaaccgaaaatatacgccaacccgcgacccaaccgaaactctttcccgccgcctctccgcgcctcgcccaaattcaactccgcctaaccctccgcttaacacgatcccctaaccctcaatccgacctaatccgaccttccaaccgccccgaaaacgataaacgaaaaataaataatacccaaaacaaacaacgacgccttcctactactcttcctactcgtactcactatcaccgaaccgctacgaccaaatacgccgcgcgataaaaacgatataaaaactaaacgacgaacgaaaccgaaatcgccccgaaacctcctttcacccgcgacgccctcctacaaaaaccgcgcctaaaacaaaaacgaacgaaacctaactcgcgaaccgcctaacactctctacgaacgcctactaaaacttacctaaactcgcgacgcctcgaacttcgtacaactctactatccaaaatattacctctaaacccttcccgaaaacgacgacgaccaaaaactacgccacga

SEQ ID NO: 1423 - DNA, 1032 bp, Artificial Sequence
  chemically treated genomic DNA (Homo sapiens) CpG-island No: 1423
tttgggttgtttacgggatttgagtttgtaggtgtgaagatttttggagttttagttaggtttttatttcgtttttttcgttttttattcgcgcgatttttcggcgtttcgttttatgtttcgcgtttttcgatgtttatttttgtcgtttcgcgttcgtcgtttttaatcggcgtttagagattttatttttttcggtggtttcgtcgtttaggtttcggtttcggttttgtttttttgtttaattaatggtacgttttatttcgtatggtttcgttttttttttagagttcgttttttagttttcgtttttaggttttcgtttttcgtcgtcgcgattttaggttttatttttttcggagggttttggttttggtttcgttttttattttgacggttattggttcgcgtttgcgtcgcgggcgggaggcggggcggggcggcgcggcgcggagtcgagtaggacggtcgttattttgcgcgtagttggagtcggtgtttgaggttgtagtcgagagtgtgcgttagttcgcggtttagtcgaagttttttttcgtcgttttttcgcgtttcgtttaggtttagtttcgtttgatttttcgtttggtacggttttttgatttttagttcggtttggttcggttttttagtcgtttcggggacgatgaacggaggataaatggtgtttaaggtagatagcggcgtttttttgttgttttttttgttcgtgtttattgttatcgagtcgttgcggttaggtgcgtcgcgcgatgggggcggtgtgggggttgggcggcgagcggggtcggggtcgtttcgggatttttttttattcgcggcgtttttttgtaggggtcgcgtttggggtaggggcgggcggggtttggttcgcgggtcgtttggtattttttgcggacgtttgttggagtttatttgggttcgcggcgtttcggatttcgtgtagttttgttgtttaggatgttgtttttgggtttttttcgggagcggcggcggttaggagttacgttacgg

SEQ ID NO: 1424 - DNA, 1032 bp, Artificial Sequence
  chemically treated genomic DNA (Homo sapiens) CpG-island No: 1424
ccgtaacgtaactcctaaccgccgccgctcccgaaaaaaacccaaaaacaacatcctaaacaacaaaactacacgaaatccgaaacgccgcgaacccaaataaactccaacaaacgtccgcaaaaaataccaaacgacccgcgaaccaaaccccgcccgcccctaccccaaacgcgacccctacaaaaaaacgccgcgaataaaaaaaaatcccgaaacgaccccgaccccgctcgccgcccaacccccacaccgcccccatcgcgcgacgcacctaaccgcaacgactcgataacaataaacacgaacaaaaaaaacaacaaaaaaacgccgctatctaccttaaacaccatttatcctccgttcatcgtccccgaaacgactaaaaaaccgaaccaaaccgaactaaaaatcaaaaaaccgtaccaaacgaaaaatcaaacgaaactaaacctaaacgaaacgcgaaaaaacgacgaaaaaaaacttcgactaaaccgcgaactaacgcacactctcgactacaacctcaaacaccgactccaactacgcgcaaaataacgaccgtcctactcgactccgcgccgcgccgccccgccccgcctcccgcccgcgacgcaaacgcgaaccaataaccgtcaaaataaaaaacgaaaccaaaaccaaaaccctccgaaaaaaataaaacctaaaatcgcgacgacgaaaaacgaaaacctaaaaacgaaaactaaaaaacgaactctaaaaaaaaaacgaaaccatacgaaataaaacgtaccattaattaaacaaaaaaacaaaaccgaaaccgaaacctaaacgacgaaaccaccgaaaaaaataaaatctctaaacgccgattaaaaacgacgaacgcgaaacgacaaaaataaacatcgaaaaacgcgaaacataaaacgaaacgccgaaaaatcgcgcgaataaaaaacgaaaaaaacgaaataaaaacctaactaaaactccaaaaatcttcacacctacaaactcaaatcccgtaaacaacccaaa

SEQ ID NO: 1425 - DNA, 1141 bp, Artificial Sequence
  chemically treated genomic DNA (Homo sapiens) CpG-island No: 1425
ttcgtcgattcggttttaaaaaggcggttgtgagtttttttgagttcggcgggtttttttcgatttcgggtttcgtttcggtggtagagtttttgaggtttttatatggcgtaaagtttacgtttatcgggttcggttggggtttcgggttcgcggggtttgtttttttcggggattaaaggttttcggcgggtggtaggtcggacggtagattggcgttttaaagtttcggggcgtcgtttcggcggagtgggtcggaagatttggttaggtttagacgttcgttttaagggagttaatcgggcgggtcggggtttgtatgatatagtacgattcggtttaggtttcgattcggatttaacgtaagtttcgtttagggggcgcgcgggtgcgtagttggttttagtcgggtttgtcgggtttacggttttttattcgttttttagtttttttttttttttttttggtttttatttttttgacgcgtttacggttaggtttcgtcgggtttattttgcgcggttggtttcggtgcgcgtcgtcgtagtaagcgaacggcgcgcgtatatttattcggttttagaagttatggcgcgcgtttttttcggtcggcggttgtggcggttcgcgggtaacggttacgagcggtggtaagcgatcgattgggtcggggttcggtttttttaggcggtgggcgagtagcggcgataaattcgtaagcggtttttttttcgtttttttttatcggtagcgaggcgtcgggcgaataacgttggtttttgattcgcgaggtggtagtggtagtggtagcggtagcggtagcgacgatttaaacgacggtcgtagacgtttcgttgagattgagtcgagaagagtcgaattatcggaagggaagttgtttttattttagttaattagcgtttgttttgcggattttcgttcgttttttcgcgtttttttttagtaattcgtagattatagttaattaggaaattcgtttgcggtttggttttcgttttagtgatgcgatacgtttagtaacgttacgttaattggtcgtaacgttacgttttttcgacggattggaatttttagttaattaacgaaaggaatagggcgagatcgattagtgaaaggagat

SEQ ID NO: 1426 - DNA, 1141 bp, Artificial Sequence
  chemically treated genomic DNA (Homo sapiens) CpG-island No: 1426
atctcctttcactaatcgatctcgccctattcctttcgttaattaactaaaaattccaatccgtcgaaaaaacgtaacgttacgaccaattaacgtaacgttactaaacgtatcgcatcactaaaacgaaaaccaaaccgcaaacgaatttcctaattaactataatctacgaattactaaaaaaaaacgcgaaaaaacgaacgaaaatccgcaaaacaaacgctaattaactaaaataaaaacaacttcccttccgataattcgactcttctcgactcaatctcaacgaaacgtctacgaccgtcgtttaaatcgtcgctaccgctaccgctaccactaccactaccacctcgcgaatcaaaaaccaacgttattcgcccgacgcctcgctaccgataaaaaaaaacgaaaaaaaaaccgcttacgaatttatcgccgctactcgcccaccgcctaaaaaaaccgaaccccgacccaatcgatcgcttaccaccgctcgtaaccgttacccgcgaaccgccacaaccgccgaccgaaaaaaacgcgcgccataacttctaaaaccgaataaatatacgcgcgccgttcgcttactacgacgacgcgcaccgaaaccaaccgcgcaaaataaacccgacgaaacctaaccgtaaacgcgtcaaaaaaataaaaaccaaaaaaaaaaaaaaaaaaactaaaaaacgaataaaaaaccgtaaacccgacaaacccgactaaaaccaactacgcacccgcgcgccccctaaacgaaacttacgttaaatccgaatcgaaacctaaaccgaatcgtactatatcatacaaaccccgacccgcccgattaactcccttaaaacgaacgtctaaacctaaccaaatcttccgacccactccgccgaaacgacgccccgaaactttaaaacgccaatctaccgtccgacctaccacccgccgaaaacctttaatccccgaaaaaaacaaaccccgcgaacccgaaaccccaaccgaacccgataaacgtaaactttacgccatataaaaacctcaaaaactctaccaccgaaacgaaacccgaaatcgaaaaaaacccgccgaactcaaaaaaactcacaaccgcctttttaaaaccgaatcgacgaa

SEQ ID NO: 1427 - DNA, 1141 bp, Artificial Sequence
  chemically treated genomic DNA (Homo sapiens) CpG-island No: 1427
gtttttttttattaatcgatttcgttttatttttttcgttgattggttgagaattttaattcgtcgaggaagcgtagcgttgcggttaattgacgtggcgttattaggcgtgtcgtattattgaggcgggagttaggtcgtaagcgaattttttgattggttgtgatttgcgggttgttggggagaggcgcggagaggcgggcgagagttcgtagggtaggcgttgattggttgaggtgggagtagtttttttttcgatgattcggtttttttcggtttagttttagcgaagcgtttgcgatcgtcgtttgagtcgtcgttgtcgttgtcgttgttattgttattgttatttcgcggattaggagttagcgttgttcgttcgacgtttcgttgtcggtgggaggaagcgagagggaagtcgtttgcgggtttgtcgtcgttgttcgtttatcgtttggaagagtcgagtttcggtttagtcggtcgtttgttatcgttcgtagtcgttattcgcgggtcgttatagtcgtcggtcgggagaggcgcgcgttatggtttttggagtcgagtgagtgtgcgcgcgtcgttcgtttgttgcggcggcgcgtatcgggattagtcgcgtagggtaggttcggcggggtttggtcgtgggcgcgttagagaggtggagattaggaaagagggaagggaagttagggggcgagtgaggggtcgtggattcggtaggttcggttggggttagttgcgtattcgcgcgttttttaggcggggtttgcgttgggttcgggtcggagtttgggtcggatcgtgttgtgttatgtaggtttcggttcgttcgattggtttttttagaacggacgtttgggtttggttaggtttttcggtttatttcgtcggggcggcgtttcggggttttggggcgttagtttgtcgttcggtttattattcgtcgaaagtttttggttttcggagagagtaggtttcgcgagttcgaggttttagtcgggttcggtgggcgtggattttgcgttatgtgaaggttttaggagttttgttatcgaggcggagttcggggtcggggaaggttcgtcgagtttagggaagtttatagtcgtttttttggagtcgggtcggcggg

SEQ ID NO: 1428 - DNA, 1141 bp, Artificial Sequence
  chemically treated genomic DNA (Homo sapiens) CpG-island No: 1428
cccgccgacccgactccaaaaaaacgactataaacttccctaaactcgacgaaccttccccgaccccgaactccgcctcgataacaaaactcctaaaaccttcacataacgcaaaatccacgcccaccgaacccgactaaaacctcgaactcgcgaaacctactctctccgaaaaccaaaaactttcgacgaataataaaccgaacgacaaactaacgccccaaaaccccgaaacgccgccccgacgaaataaaccgaaaaacctaaccaaacccaaacgtccgttctaaaaaaaccaatcgaacgaaccgaaacctacataacacaacacgatccgacccaaactccgacccgaacccaacgcaaaccccgcctaaaaaacgcgcgaatacgcaactaaccccaaccgaacctaccgaatccacgacccctcactcgccccctaacttcccttccctctttcctaatctccacctctctaacgcgcccacgaccaaaccccgccgaacctaccctacgcgactaatcccgatacgcgccgccgcaacaaacgaacgacgcgcgcacactcactcgactccaaaaaccataacgcgcgcctctcccgaccgacgactataacgacccgcgaataacgactacgaacgataacaaacgaccgactaaaccgaaactcgactcttccaaacgataaacgaacaacgacgacaaacccgcaaacgacttccctctcgcttcctcccaccgacaacgaaacgtcgaacgaacaacgctaactcctaatccgcgaaataacaataacaataacaacgacaacgacaacgacgactcaaacgacgatcgcaaacgcttcgctaaaactaaaccgaaaaaaaccgaatcatcgaaaaaaaaactactcccacctcaaccaatcaacgcctaccctacgaactctcgcccgcctctccgcgcctctccccaacaacccgcaaatcacaaccaatcaaaaaattcgcttacgacctaactcccgcctcaataatacgacacgcctaataacgccacgtcaattaaccgcaacgctacgcttcctcgacgaattaaaattctcaaccaatcaacgaaaaaaataaaacgaaatcgattaataaaaaaaaac

SEQ ID NO: 1429 - DNA, 571 bp, Artificial Sequence
  chemically treated genomic DNA (Homo sapiens) CpG-island No: 1429
cgcggttcgtcgggtttttaatttcgtttttggttggtcgggtttgcgaagttttgggttgcggttggtttttttgaagagttagttttcgcgggaaattcggggaggaaacgagttagtaattttaaataggtttaggcgggttagaagtcggggtcgtgtttgattggggtagtcgtacggtcggcggtgcggttcgttcggttttcgcggaggttatagtttcgagaaagggtgggcgggagcgagtttcggttttatagttcgtggttcggttttttttcgttgttatatttttaggtttttttgggttttcgtttttatcgagggtcgattgcgaggtgtatgttgggagtcgtagtatcgtatcggggcggaatagtttcgtttcggcggatggtgtttttagaaagcggtaattggagacgagggcgtttcgtaatcgtttattttttttttgtttattgtcgagtattaatacgtttattaaggtcggttttttatcgcgtgtagtttgttggtagtgtcgttttgtatttgtattgtttaaaagtatttgtttaattatttt

SEQ ID NO: 1430 - DNA, 571 bp, Artificial Sequence
  chemically treated genomic DNA (Homo sapiens) CpG-island No: 1430
aaaataattaaacaaatacttttaaacaatacaaatacaaaacgacactaccaacaaactacacgcgataaaaaaccgaccttaataaacgtattaatactcgacaataaacaaaaaaaaaataaacgattacgaaacgccctcgtctccaattaccgctttctaaaaacaccatccgccgaaacgaaactattccgccccgatacgatactacgactcccaacatacacctcgcaatcgaccctcgataaaaacgaaaacccaaaaaaacctaaaaatataacaacgaaaaaaaaccgaaccacgaactataaaaccgaaactcgctcccgcccaccctttctcgaaactataacctccgcgaaaaccgaacgaaccgcaccgccgaccgtacgactaccccaatcaaacacgaccccgacttctaacccgcctaaacctatttaaaattactaactcgtttcctccccgaatttcccgcgaaaactaactcttcaaaaaaaccaaccgcaacccaaaacttcgcaaacccgaccaaccaaaaacgaaattaaaaacccgacgaaccgcg

SEQ ID NO: 1431 - DNA, 571 bp, Artificial Sequence
  chemically treated genomic DNA (Homo sapiens) CpG-island No: 1431
gaaatgattgggtaggtatttttgagtagtgtaagtatagagcggtattgttagtagattatacgcggtagaaagtcgattttggtgagcgtgttggtgttcgatagtgagtagagaaaggatggacgattacggagcgttttcgtttttagttatcgttttttggaaatattattcgtcggggcggagttgtttcgtttcggtgcggtattacgatttttagtatgtatttcgtagtcggttttcggtggaagcgggaatttaggaggatttgggggtgtggtagcgaggaagggtcgagttacggattgtggggtcgaaattcgttttcgtttattttttttcgaggttgtggttttcgcgagagtcgagcgggtcgtatcgtcggtcgtgcgattgttttagttagatacgatttcggtttttagttcgtttaagtttgtttggggttgttgattcgtttttttttcgagtttttcgcgggaattaattttttaagaggattaatcgtagtttagagtttcgtagattcggttaattagaggcgaggttgagagttcggcgggtcgcg

SEQ ID NO: 1432 - DNA, 571 bp, Artificial Sequence
  chemically treated genomic DNA (Homo sapiens) CpG-island No: 1432
cgcgacccgccgaactctcaacctcgcctctaattaaccgaatctacgaaactctaaactacgattaatcctcttaaaaaattaattcccgcgaaaaactcgaaaaaaaaacgaatcaacaaccccaaacaaacttaaacgaactaaaaaccgaaatcgtatctaactaaaacaatcgcacgaccgacgatacgacccgctcgactctcgcgaaaaccacaacctcgaaaaaaaataaacgaaaacgaatttcgaccccacaatccgtaactcgacccttcctcgctaccacacccccaaatcctcctaaattcccgcttccaccgaaaaccgactacgaaatacatactaaaaatcgtaataccgcaccgaaacgaaacaactccgccccgacgaataatatttccaaaaaacgataactaaaaacgaaaacgctccgtaatcgtccatcctttctctactcactatcgaacaccaacacgctcaccaaaatcgactttctaccgcgtataatctactaacaataccgctctatacttacactactcaaaaatacctacccaatcatttc

SEQ ID NO: 1433 - DNA, 529 bp, Artificial Sequence
  chemically treated genomic DNA (Homo sapiens) CpG-island No: 1433
tcgcgtatcgtcgtgcgttcggatgtgttttcgttcgttattttcggcggtacgttttatatcgatagcgatcgttcggttagtagtaaggtttattagttgtttgagtcgggagttcgttattttcgcgagtttacggagatggaggtaggttgtagttatacgtgcgtggtcgtgttggataattttgtgtacgtggtcggggggtagtatttgtagtatcgtagcggcgagggcgtagtggacgtttgttatcgttacgatttttatttgaatcgttggttgcgtttgtaggttatgtaggaaagtcgtatttagttttagttgaacgtgttgtgcggtatggtgtacgttacgggcggtcgtaatcgagtcggtagtttggttttcgtggagcggtattgttttcggcgtaatgagtggggttacgtttgttcgttgaagcgtcgtatttggggttatgttggggtcgttttagggggtcgtttttatatttcgggtggttacgggattttagtggaggataaga

SEQ ID NO: 1434 - DNA, 529 bp, Artificial Sequence
  chemically treated genomic DNA (Homo sapiens) CpG-island No: 1434
tcttatcctccactaaaatcccgtaaccacccgaaatataaaaacgaccccctaaaacgaccccaacataaccccaaatacgacgcttcaacgaacaaacgtaaccccactcattacgccgaaaacaataccgctccacgaaaaccaaactaccgactcgattacgaccgcccgtaacgtacaccataccgcacaacacgttcaactaaaactaaatacgactttcctacataacctacaaacgcaaccaacgattcaaataaaaatcgtaacgataacaaacgtccactacgccctcgccgctacgatactacaaatactaccccccgaccacgtacacaaaattatccaacacgaccacgcacgtataactacaacctacctccatctccgtaaactcgcgaaaataacgaactcccgactcaaacaactaataaaccttactactaaccgaacgatcgctatcgatataaaacgtaccgccgaaaataacgaacgaaaacacatccgaacgcacgacgatacgcga

SEQ ID NO: 1435 - DNA, 529 bp, Artificial Sequence
  chemically treated genomic DNA (Homo sapiens) CpG-island No: 1435
ttttgttttttattgagatttcgtagttattcgagatgtagaggcggttttttgaggcggttttagtatggttttaggtacggcgttttagcgagtaggcgtagttttatttattgcgtcgggggtagtatcgttttacggaggttaggttgtcggttcggttgcggtcgttcgtggcgtatattatgtcgtatagtacgtttagttggaattggatgcggtttttttgtatggtttgtaggcgtagttagcgatttaggtgggggtcgtagcggtagtaggcgtttattgcgttttcgtcgttgcggtattgtaggtgttgtttttcggttacgtatataaaattgtttagtacggttacgtacgtgtggttgtagtttatttttattttcgtgagttcgcggaagtggcgggttttcggtttaggtagttggtagattttgttgttgatcgagcggtcgttgtcggtgtagggcgtgtcgtcgaaggtgacgagcgagggtatattcgagcgtacggcggtgcgcgg

SEQ ID NO: 1436 - DNA, 529 bp, Artificial Sequence
  chemically treated genomic DNA (Homo sapiens) CpG-island No: 1436
ccgcgcaccgccgtacgctcgaatataccctcgctcgtcaccttcgacgacacgccctacaccgacaacgaccgctcgatcaacaacaaaatctaccaactacctaaaccgaaaacccgccacttccgcgaactcacgaaaataaaaataaactacaaccacacgtacgtaaccgtactaaacaattttatatacgtaaccgaaaaacaacacctacaataccgcaacgacgaaaacgcaataaacgcctactaccgctacgacccccacctaaatcgctaactacgcctacaaaccatacaaaaaaaccgcatccaattccaactaaacgtactatacgacataatatacgccacgaacgaccgcaaccgaaccgacaacctaacctccgtaaaacgatactacccccgacgcaataaataaaactacgcctactcgctaaaacgccgtacctaaaaccatactaaaaccgcctcaaaaaaccgcctctacatctcgaataactacgaaatctcaataaaaaacaaaa

SEQ ID NO: 1437 - DNA, 609 bp, Artificial Sequence
  chemically treated genomic DNA (Homo sapiens) CpG-island No: 1437
attgcgtcggcgttgaaatttttattcgcgttttatcgtttttttcgcgggtttcgagcgcgcgtttgggcgcgcgtatgcgttttcgttttcgcgtcgcgcgtcgtttttgtgcgtttgcgtcgcgtttacgatcgtcggcgcgtttgcgtattgttcgtcgttcgtgggtttagtcggcgtttgcgcggtggtacgggcgagtgggggggcgaggaggtggaggaggaggaggaggaggaggaggtggcggcgagaagatggcgatttcgaataattcgcggaaatttagcgagaagatcgcgttgtataattagaagtaggcggaggagacggcggttttcgaggaggttatgaaggatttgagtttgacgcgggtcgcgcgggtaagggggttgttcgcgtcgattttttagggtcggcggagggagggagggggcgcgtgttcggcgcgtgtacggggcggggtgggggggggcgcggcgggggcggggcgcgcgcggcgggggcggggtttggtacggttcgagggggataggtgtttttacgtttcgggcgtcgtgggcgggataggtgattttataaaatttatatttgatggggtatagg

SEQ ID NO: 1438 - DNA, 609 bp, Artificial Sequence
  chemically treated genomic DNA (Homo sapiens) CpG-island No: 1438
cctataccccatcaaatataaattttataaaatcacctatcccgcccacgacgcccgaaacgtaaaaacacctatccccctcgaaccgtaccaaaccccgcccccgccgcgcgcgccccgcccccgccgcgcccccccccaccccgccccgtacacgcgccgaacacgcgccccctccctccctccgccgaccctaaaaaatcgacgcgaacaacccccttacccgcgcgacccgcgtcaaactcaaatccttcataacctcctcgaaaaccgccgtctcctccgcctacttctaattatacaacgcgatcttctcgctaaatttccgcgaattattcgaaatcgccatcttctcgccgccacctcctcctcctcctcctcctcctccacctcctcgcccccccactcgcccgtaccaccgcgcaaacgccgactaaacccacgaacgacgaacaatacgcaaacgcgccgacgatcgtaaacgcgacgcaaacgcacaaaaacgacgcgcgacgcgaaaacgaaaacgcatacgcgcgcccaaacgcgcgctcgaaacccgcgaaaaaaacgataaaacgcgaataaaaatttcaacgccgacgcaat

SEQ ID NO: 1439 - DNA, 609 bp, Artificial Sequence
  chemically treated genomic DNA (Homo sapiens) CpG-island No: 1439
tttgtattttattaggtatggattttgtggggttatttgtttcgtttacgacgttcggggcgtggggatatttgtttttttcgggtcgtgttaagtttcgttttcgtcgcgcgcgtttcgttttcgtcgcgtttttttttatttcgtttcgtgtacgcgtcggatacgcgtttttttttttttttcgtcggttttgaagggtcggcgcgggtagtttttttattcgcgcggttcgcgttaggtttaggttttttatgattttttcgaaggtcgtcgtttttttcgtttgtttttgattgtgtagcgcgattttttcgttgaattttcgcggattgttcgaagtcgttattttttcgtcgttattttttttttttttttttttttttttattttttcgtttttttattcgttcgtgttatcgcgtaagcgtcggttgggtttacgggcggcgagtagtgcgtaggcgcgtcggcggtcgtgagcgcggcgtaggcgtataggagcggcgcgcggcgcgggggcgaaggcgtatgcgcgcgtttaggcgcgcgttcggggttcgcgggaagggcggtggagcgcgagtggaaattttaacgtcgacgtagt

SEQ ID NO: 1440 - DNA, 609 bp, Artificial Sequence
  chemically treated genomic DNA (Homo sapiens) CpG-island No: 1440
actacgtcgacgttaaaatttccactcgcgctccaccgcccttcccgcgaaccccgaacgcgcgcctaaacgcgcgcatacgccttcgcccccgcgccgcgcgccgctcctatacgcctacgccgcgctcacgaccgccgacgcgcctacgcactactcgccgcccgtaaacccaaccgacgcttacgcgataacacgaacgaataaaaaaacgaaaaaataaaaaaaaaaaaaaaaaaaaaaaaaataacgacgaaaaaataacgacttcgaacaatccgcgaaaattcaacgaaaaaatcgcgctacacaatcaaaaacaaacgaaaaaaacgacgaccttcgaaaaaatcataaaaaacctaaacctaacgcgaaccgcgcgaataaaaaaactacccgcgccgacccttcaaaaccgacgaaaaaaaaaaaaaaacgcgtatccgacgcgtacacgaaacgaaataaaaaaaaacgcgacgaaaacgaaacgcgcgcgacgaaaacgaaacttaacacgacccgaaaaaaacaaatatccccacgccccgaacgtcgtaaacgaaacaaataaccccacaaaatccatacctaataaaatacaaa

SEQ ID NO: 1441 - DNA, 629 bp, Artificial Sequence
  chemically treated genomic DNA (Homo sapiens) CpG-island No: 1441
cgggcgacgcggtcgagggtcgggcggttaagaggtgcgagaaggtcgaggagaaggttaaggagattgcgaagatggtagagatgttggtggagttggttcggcggatagagaagagcgagtcgtcgtgagcgcggtcggcggtaagtcgggtattcgcgttaggtcgaggagcggttttagtttggtcgtttttcgagagcgatgattttatcgagatgtatcggaatcgggggtggggcgggagaataaaggcgtgttcgggttagggtcgatttgggtttcgttttcgtgttttgttttttgacggtggcggcgtgggataattagagtggtcgggtttgggcgtgatgcgtgtttagtggaagggttataaattttagagtcgttaaggaaatagaaacggataaggtttcgggtcgtttagtaagcgggggtggaaatagaggattttcggggaagacgttggataagttaacgttgttagagattggagtgagttaggtggtggttagaagaggtggcgttttgtatagtggcgttcgtgagggtttgggggtcgttgtgtttgggattaatttttcgatgatgaatttttttttattgtgttttaggtttttagttaatgg

SEQ ID NO: 1442 - DNA, 629 bp, Artificial Sequence
  chemically treated genomic DNA (Homo sapiens) CpG-island No: 1442
ccattaactaaaaacctaaaacacaataaaaaaaaattcatcatcgaaaaattaatcccaaacacaacgacccccaaaccctcacgaacgccactatacaaaacgccacctcttctaaccaccacctaactcactccaatctctaacaacgttaacttatccaacgtcttccccgaaaatcctctatttccacccccgcttactaaacgacccgaaaccttatccgtttctatttccttaacgactctaaaatttataacccttccactaaacacgcatcacgcccaaacccgaccactctaattatcccacgccgccaccgtcaaaaaacaaaacacgaaaacgaaacccaaatcgaccctaacccgaacacgcctttattctcccgccccacccccgattccgatacatctcgataaaatcatcgctctcgaaaaacgaccaaactaaaaccgctcctcgacctaacgcgaatacccgacttaccgccgaccgcgctcacgacgactcgctcttctctatccgccgaaccaactccaccaacatctctaccatcttcgcaatctccttaaccttctcctcgaccttctcgcacctcttaaccgcccgaccctcgaccgcgtcgcccg

SEQ ID NO: 1443 - DNA, 629 bp, Artificial Sequence
  chemically treated genomic DNA (Homo sapiens) CpG-island No: 1443
ttattggttggaaatttaaagtataatgggaagaaatttattatcgagaggttaattttaggtataacgatttttaaatttttacgaacgttattgtgtaggacgttattttttttggttattatttgatttattttagtttttagtaacgttgatttgtttaacgtttttttcgaaaattttttatttttattttcgtttgttggacggttcgggattttgttcgtttttgtttttttggcgattttgagatttatgatttttttattgaatacgtattacgtttaaattcggttattttgattattttacgtcgttatcgttaaaaaataaaatacgaagacggggtttagatcggttttgattcgagtacgtttttattttttcgttttattttcgatttcggtgtatttcgatgaaattatcgttttcgaagagcggttaagttggggtcgtttttcggtttggcgcgggtgttcgatttatcgtcgatcgcgtttacgacgattcgtttttttttattcgtcggattagttttattagtatttttgttattttcgtaatttttttggtttttttttcggttttttcgtattttttggtcgttcggttttcggtcgcgtcgttcg

SEQ ID NO: 1444 - DNA, 629 bp, Artificial Sequence
  chemically treated genomic DNA (Homo sapiens) CpG-island No: 1444
cgaacgacgcgaccgaaaaccgaacgaccaaaaaatacgaaaaaaccgaaaaaaaaaccaaaaaaattacgaaaataacaaaaatactaataaaactaatccgacgaataaaaaaaaacgaatcgtcgtaaacgcgatcgacgataaatcgaacacccgcgccaaaccgaaaaacgaccccaacttaaccgctcttcgaaaacgataatttcatcgaaatacaccgaaatcgaaaataaaacgaaaaaataaaaacgtactcgaatcaaaaccgatctaaaccccgtcttcgtattttattttttaacgataacgacgtaaaataatcaaaataaccgaatttaaacgtaatacgtattcaataaaaaaatcataaatctcaaaatcgccaaaaaaacaaaaacgaacaaaatcccgaaccgtccaacaaacgaaaataaaaataaaaaattttcgaaaaaaacgttaaacaaatcaacgttactaaaaactaaaataaatcaaataataaccaaaaaaaataacgtcctacacaataacgttcgtaaaaatttaaaaatcgttatacctaaaattaacctctcgataataaatttcttcccattatactttaaatttccaaccaataa

SEQ ID NO: 1445 - DNA, 752 bp, Artificial Sequence
  chemically treated genomic DNA (Homo sapiens) CpG-island No: 1445
gtttttttcgtattttttattttttttgtatttttcgtttttttcgtattttttattttttttttatttttcgtttttttcgtatttttcgttttttttacgtttttcgtttttttcgtatttttcgttttttttttattttttattttttttgtattttttttttttttcgtattttttattttttttttatttttcgtttttttcgtattttttatttttttcgtatttttcgtttttttcgtatttttcgttttttttttatttttcgtcgtttttttatttttcgtttttttcgtatttttcgtttttttcgtatttttcgtttttttcgtatttttcgttttttttgtatttttcgtcgtttttttatttttcgtttttttcgtatttttcgtttttttcgtatttttcgtttttttcgtatttttcgttttttttttatttttcgtttttttcgtatttttcgttttttttttatttttcgtttttttcgtatttttcgttttttttgtatttttcgttttttttttatttttcgtttttttcgtatttttcgttttttttatgttcgttattttttttgtattttttattttttttgtatttttcgttttttttgcgttcgtcgtttttttcgtttttttttttttttttgtattttttattttttttatgtttttcgtttttttcgtattttcgtttttgttgttttttttgtgtttttttttttcgggtgtgttcgtggtttg

SEQ ID NO: 1446 - DNA, 752 bp, Artificial Sequence
  chemically treated genomic DNA (Homo sapiens) CpG-island No: 1446
caaaccacgaacacacccgaaaaaaaaaaacacaaaaaaaacaacaaaaacgaaaatacgaaaaaaacgaaaaacataaaaaaaataaaaaatacaaaaaaaaaaaaaaaaacgaaaaaaacgacgaacgcaaaaaaaacgaaaaatacaaaaaaaataaaaaatacaaaaaaaataacgaacataaaaaaaacgaaaaatacgaaaaaaacgaaaaataaaaaaaaaacgaaaaatacaaaaaaaacgaaaaatacgaaaaaaacgaaaaataaaaaaaaaacgaaaaatacgaaaaaaacgaaaaataaaaaaaaaacgaaaaatacgaaaaaaacgaaaaatacgaaaaaaacgaaaaatacgaaaaaaacgaaaaataaaaaaacgacgaaaaatacaaaaaaaacgaaaaatacgaaaaaaacgaaaaatacgaaaaaaacgaaaaatacgaaaaaaacgaaaaataaaaaaacgacgaaaaataaaaaaaaaacgaaaaatacgaaaaaaacgaaaaatacgaaaaaaataaaaaatacgaaaaaaacgaaaaataaaaaaaaaataaaaaatacgaaaaaaaaaaaaaatacaaaaaaaataaaaaataaaaaaaaaacgaaaaatacgaaaaaaacgaaaaacgtaaaaaaaacgaaaaatacgaaaaaaacgaaaaataaaaaaaaaataaaaaatacgaaaaaaacgaaaaatacaaaaaaaataaaaaatacgaaaaaaac

SEQ ID NO: 1447 - DNA, 752 bp, Artificial Sequence
  chemically treated genomic DNA (Homo sapiens) CpG-island No: 1447
taagttacgagtatattcgaggaagaagagtatagggaagatagtaggagcgagggtgcggggaggacgagaggtatggggaggatgaggaatgtagggagaaggaggggagcggggaggacgacgggcgtagggaggacgaggaatgtagggagaatgaggaatatagggaggatgacgggtatggggaggacgaggaatgcggggaggacgaggaatgaggggaggacgaggaatgtagggaggacgaggaatgcggggaggacgaggaatgaggggaggacgaggaatgcggggaggacgaggaatgaggggaggacgaggaatgcggggaggacgaggaatgcggggaggacgaggaatgcggggaggacgaggaatgaggggacgacgaggaatgtagggaggacgaggaatgcggggaggacgaggaatgcggggaggacgaggaatgcggggaggacgaggaatgaggggacgacgaggaatgaggggaggacgaggaatgcggggaggacgaggaatgcggggaggatgaggaatacggggaggacgaggaatgaggggaggatgaagaatgcggggaggaagaggaatatagggaagatgaggaatgaggggaggacgaggaatgcggggaggacgagaggcgtggggaggacgaggaatgcggggaggacgaggaatgaggggaggatgaagaatgcggggaggacgaggaatatagggaagatgaggaatgcggggaggat

SEQ ID NO: 1448 - DNA, 752 bp, Artificial Sequence
  chemically treated genomic DNA (Homo sapiens) CpG-island No: 1448
atcctccccgcattcctcatcttccctatattcctcgtcctccccgcattcttcatcctcccctcattcctcgtcctccccgcattcctcgtcctccccacgcctctcgtcctccccgcattcctcgtcctcccctcattcctcatcttccctatattcctcttcctccccgcattcttcatcctcccctcattcctcgtcctccccgtattcctcatcctccccgcattcctcgtcctccccgcattcctcgtcctcccctcattcctcgtcgtcccctcattcctcgtcctccccgcattcctcgtcctccccgcattcctcgtcctccccgcattcctcgtcctccctacattcctcgtcgtcccctcattcctcgtcctccccgcattcctcgtcctccccgcattcctcgtcctccccgcattcctcgtcctcccctcattcctcgtcctccccgcattcctcgtcctcccctcattcctcgtcctccccgcattcctcgtcctccctacattcctcgtcctcccctcattcctcgtcctccccgcattcctcgtcctccccatacccgtcatcctccctatattcctcattctccctacattcctcgtcctccctacgcccgtcgtcctccccgctcccctccttctccctacattcctcatcctccccatacctctcgtcctccccgcaccctcgctcctactatcttccctatactcttcttcctcgaatatactcgtaactta

SEQ ID NO: 1449 - DNA, 524 bp, Artificial Sequence
  chemically treated genomic DNA (Homo sapiens) CpG-island No: 1449
agggttttcgcggatcggggtaggcggcggcggcggcggcggtattaaggttggatcggagaaaggaaggggagggggaggggaggcggcgagggggagggggaggggggcgggcgcggagtcgtagcgcgcgtcgggggcgggggaggcgcggtttcgtcggtagagatcggcgcgttcgagttttcggggatcgggaaatttcggaattagttggcgggggcgcgaggggagatcgggaggcgggttttcgggttagatttcgcggttttcgggttcgtacggcgaggatgtgatttgaataataaaaggtggtttttttttagagttttcggtggcggggatcgtcgatttcggagcgagaggtcgtcggttcgttaggaagcgtgtgtgtgtgtgtgtgtgtgtgtgtgtgtgcgttcgcgtgtgtgtgtaggcgtgcgtgtgtatgtatgcgtgtgttttggtggtgggattagtgggatttaggaagtgagtaggggaggtggtgaaaaaggagggat

SEQ ID NO: 1450 - DNA, 524 bp, Artificial Sequence
  chemically treated genomic DNA (Homo sapiens) CpG-island No: 1450
atccctcctttttcaccacctcccctactcacttcctaaatcccactaatcccaccaccaaaacacacgcatacatacacacgcacgcctacacacacacgcgaacgcacacacacacacacacacacacacacacacgcttcctaacgaaccgacgacctctcgctccgaaatcgacgatccccgccaccgaaaactctaaaaaaaaaccaccttttattattcaaatcacatcctcgccgtacgaacccgaaaaccgcgaaatctaacccgaaaacccgcctcccgatctcccctcgcgcccccgccaactaattccgaaatttcccgatccccgaaaactcgaacgcgccgatctctaccgacgaaaccgcgcctcccccgcccccgacgcgcgctacgactccgcgcccgcccccctccccctccccctcgccgcctcccctccccctccccttcctttctccgatccaaccttaataccgccgccgccgccgccgcctaccccgatccgcgaaaaccct

SEQ ID NO: 1451 - DNA, 524 bp, Artificial Sequence
  chemically treated genomic DNA (Homo sapiens) CpG-island No: 1451
gtttttttttttttattattttttttgtttattttttgagttttattgattttattattaaaatatacgtatgtatgtatacgtacgtttgtatatatacgcgggcgtatatatatatatatatatatatatatatacgttttttggcgggtcggcggtttttcgtttcgggatcggcgattttcgttatcgggaattttggggagaagttattttttgttatttaaattatattttcgtcgtgcgagttcgggggtcgcgggatttggttcgggaattcgtttttcggttttttttcgcgttttcgttagttgatttcgggatttttcggttttcgggggttcgggcgcgtcggtttttgtcggcggggtcgcgtttttttcgttttcggcgcgcgttgcggtttcgcgttcgtttttttttttttttttttcgtcgttttttttttttttttttttttttttttcggtttagttttggtgtcgtcgtcgtcgtcgtcgtttgtttcggttcgcgggggtttt

SEQ ID NO: 1452 - DNA, 524 bp, Artificial Sequence
  chemically treated genomic DNA (Homo sapiens) CpG-island No: 1452
aaaacccccgcgaaccgaaacaaacgacgacgacgacgacgacaccaaaactaaaccgaaaaaaaaaaaaaaaaaaaaaaaaaaaacgacgaaaaaaaaaaaaaaaaaaacgaacgcgaaaccgcaacgcgcgccgaaaacgaaaaaaacgcgaccccgccgacaaaaaccgacgcgcccgaacccccgaaaaccgaaaaatcccgaaatcaactaacgaaaacgcgaaaaaaaaccgaaaaacgaattcccgaaccaaatcccgcgacccccgaactcgcacgacgaaaatataatttaaataacaaaaaataacttctccccaaaattcccgataacgaaaatcgccgatcccgaaacgaaaaaccgccgacccgccaaaaaacgtatatatatatatatatatatatatatatacgcccgcgtatatatacaaacgtacgtatacatacatacgtatattttaataataaaatcaataaaactcaaaaaataaacaaaaaaaataataaaaaaaaaaaaac

SEQ ID NO: 1453 - DNA, 720 bp, Artificial Sequence
  chemically treated genomic DNA (Homo sapiens) CpG-island No: 1453
tttttacggcgtcgttcgtttcgttttattcgcggggattcggcgttaacgggacggttttcgtttgttattggttgtgagttttgttagttttttagagatttcgtttttcgtcgaacggttttttcgttcgttttcgtttttttaggagttttttcgttggttcggtttcgattagtttttcggggtttcgaggcgcgtggtgattggtttggagttttgttagttatcgtggtttcgtcgttttaggtagggtcggggcggggtgcggacggggcgaggtttggatggggcgtggtttgggcgggttgttttgatatgttttcgttcgtttcgttttcgttcgcgtatcgttttttttttttttcggtcgtagttttcgcgcgtttcgagcgtgttgtttttcgttaagcgtcgtttattattttgttcgtttttgtagggggttatttcgcgacggttcgtggagatgggcggggatgacgcgggtcgggtagtggggtttttttcgggggaattttagttcgtttgcgaatagttcgttagtttttttcgggtttgggattcgggagcgtcggattgattagttttgcggtcgtagttcgggaaagcgtagtttcgcgggcggggcgtagcgtgggcgtttggtcggattcggtttaatgggtggtcgtttttatttagtttttaggttttttcgttttgtatttttttattttg

SEQ ID NO: 1454 - DNA, 720 bp, Artificial Sequence
  chemically treated genomic DNA (Homo sapiens) CpG-island No: 1454
caaaataaaaaaatacaaaacgaaaaaacctaaaaactaaataaaaacgaccacccattaaaccgaatccgaccaaacgcccacgctacgccccgcccgcgaaactacgctttcccgaactacgaccgcaaaactaatcaatccgacgctcccgaatcccaaacccgaaaaaaactaacgaactattcgcaaacgaactaaaattcccccgaaaaaaaccccactacccgacccgcgtcatccccgcccatctccacgaaccgtcgcgaaataaccccctacaaaaacgaacaaaataataaacgacgcttaacgaaaaacaacacgctcgaaacgcgcgaaaactacgaccgaaaaaaaaaaaaaacgatacgcgaacgaaaacgaaacgaacgaaaacatatcaaaacaacccgcccaaaccacgccccatccaaacctcgccccgtccgcaccccgccccgaccctacctaaaacgacgaaaccacgataactaacaaaactccaaaccaatcaccacgcgcctcgaaaccccgaaaaactaatcgaaaccgaaccaacgaaaaaactcctaaaaaaacgaaaacgaacgaaaaaaccgttcgacgaaaaacgaaatctctaaaaaactaacaaaactcacaaccaataacaaacgaaaaccgtcccgttaacgccgaatccccgcgaataaaacgaaacgaacgacgccgtaaaaa

SEQ ID NO: 1455 - DNA, 720 bp, Artificial Sequence
  chemically treated genomic DNA (Homo sapiens) CpG-island No: 1455
tagaatggagaagtgtaggacggggaagtttgggagttgggtgggggcggttatttattgagtcggattcggttaggcgtttacgttgcgtttcgttcgcggggttgcgttttttcgggttgcggtcgtagggttggttagttcggcgttttcgggttttaggttcggaaggagttaacgggttattcgtaggcgggttgggattttttcgggggaggttttattgttcggttcgcgttattttcgtttatttttacgggtcgtcgcgggatagttttttgtaggagcgggtagggtagtgggcggcgtttggcggagggtagtacgttcggggcgcgcggggattgcggtcgaggggaggagagggcggtgcgcgggcgggggcggggcgagcgagggtatattagggtagttcgtttaggttacgttttatttaggtttcgtttcgttcgtatttcgtttcggttttgtttagaacggcgggattacggtgattgataggattttagattagttattacgcgtttcgaggtttcgagaggttagtcggggtcgagttagcggaggggtttttgaaggggcgggggcgggcggggaagtcgttcggcgaggggcggggtttttggaagattggtagaatttatagttaatggtaggcgggagtcgtttcgttagcgtcggattttcgcgggtagggcggggcgggcggcgtcgtgggga

SEQ ID NO: 1456 - DNA, 720 bp, Artificial Sequence
  chemically treated genomic DNA (Homo sapiens) CpG-island No: 1456
tccccacgacgccgcccgccccgccctacccgcgaaaatccgacgctaacgaaacgactcccgcctaccattaactataaattctaccaatcttccaaaaaccccgcccctcgccgaacgacttccccgcccgcccccgccccttcaaaaacccctccgctaactcgaccccgactaacctctcgaaacctcgaaacgcgtaataactaatctaaaatcctatcaatcaccgtaatcccgccgttctaaacaaaaccgaaacgaaatacgaacgaaacgaaacctaaataaaacgtaacctaaacgaactaccctaatataccctcgctcgccccgcccccgcccgcgcaccgccctctcctcccctcgaccgcaatccccgcgcgccccgaacgtactaccctccgccaaacgccgcccactaccctacccgctcctacaaaaaactatcccgcgacgacccgtaaaaataaacgaaaataacgcgaaccgaacaataaaacctcccccgaaaaaatcccaacccgcctacgaataacccgttaactccttccgaacctaaaacccgaaaacgccgaactaaccaaccctacgaccgcaacccgaaaaaacgcaaccccgcgaacgaaacgcaacgtaaacgcctaaccgaatccgactcaataaataaccgcccccacccaactcccaaacttccccgtcctacacttctccattcta

SEQ ID NO: 1457 - DNA, 1090 bp, Artificial Sequence
  chemically treated genomic DNA (Homo sapiens) CpG-island No: 1457
cgtttatttcgagttgttcgtggagtacgggatttggagcggcggcggatagtaagtggtgagcgatttcgagaacgtttgcgtggtaatagtggcgttcgagatttagagcggcgtcgaatagttggaggtgttcgggatttagagcggcggcgtgttattggtgaggttcgagagcgggatttttttcgagttattggagatgtgcgagatcgagatttttttcgggtgatcggagatgttttggattttgattttttgcgagtgataggcgaagttttgtttcgagatcgttttttggttattggtggagttttggatttggattttttgcgagttattggtggagttttagaacgggagcggcggcgtgttgttggcgttttagattttgaacgacggcgggttattggtggcgttttggatttggatcgttttttgtttattggggatgtttttgatcgggattttcgtcgagttattgaagttttggattttgatcgttttcggttgattggtgaagttcgagatttggatttacgtcggtttattaggggggttttggatttggatcgtcggtgagtggttggagaggttcgagatttagagcgtttttacggggttggtgatgtgcgtgagcgagaacgttttcgattggttgggggtgttcgagagcggttttttcggcgtcgagaggaggttcgggaatttttttgtcgggtaggtgattttgagtgataattagagtttttttttcgtcgtcgagtaattcgcgattttgatcggtttcgttgttttcgtcgagaggttgattgagaagatttagatttatttcgacgtcgggttgtttttgttttttttttttttgagcgggaacgggatttttggagtttacgaggttttggcgaaggagagcggtttttttttgaggttgttttagtgcgtggagatgaagttgagcgtcgtcggcgtgaagatttcgatttttcggttggtttcggggaagatattgagggattttttcggtgttttgggggagttttagagcgagtttttggtgaggatgaggtagagcggtttttacgggata

SEQ ID NO: 1458 - DNA, 1090 bp, Artificial Sequence
  chemically treated genomic DNA (Homo sapiens) CpG-island No: 1458
tatcccgtaaaaaccgctctacctcatcctcaccaaaaactcgctctaaaactcccccaaaacaccgaaaaaatccctcaatatcttccccgaaaccaaccgaaaaatcgaaatcttcacgccgacgacgctcaacttcatctccacgcactaaaacaacctcaaaaaaaaaccgctctccttcgccaaaacctcgtaaactccaaaaatcccgttcccgctcaaaaaaaaaaaaaacaaaaacaacccgacgtcgaaataaatctaaatcttctcaatcaacctctcgacgaaaacaacgaaaccgatcaaaatcgcgaattactcgacgacgaaaaaaaaactctaattatcactcaaaatcacctacccgacaaaaaaattcccgaacctcctctcgacgccgaaaaaaccgctctcgaacacccccaaccaatcgaaaacgttctcgctcacgcacatcaccaaccccgtaaaaacgctctaaatctcgaacctctccaaccactcaccgacgatccaaatccaaaacccccctaataaaccgacgtaaatccaaatctcgaacttcaccaatcaaccgaaaacgatcaaaatccaaaacttcaataactcgacgaaaatcccgatcaaaaacatccccaataaacaaaaaacgatccaaatccaaaacgccaccaataacccgccgtcgttcaaaatctaaaacgccaacaacacgccgccgctcccgttctaaaactccaccaataactcgcaaaaaatccaaatccaaaactccaccaataaccaaaaaacgatctcgaaacaaaacttcgcctatcactcgcaaaaaatcaaaatccaaaacatctccgatcacccgaaaaaaatctcgatctcgcacatctccaataactcgaaaaaaatcccgctctcgaacctcaccaataacacgccgccgctctaaatcccgaacacctccaactattcgacgccgctctaaatctcgaacgccactattaccacgcaaacgttctcgaaatcgctcaccacttactatccgccgccgctccaaatcccgtactccacgaacaactcgaaataaacg

SEQ ID NO: 1459 - DNA, 1090 bp, Artificial Sequence
  chemically treated genomic DNA (Homo sapiens) CpG-island No: 1459
tgtttcgtagaagtcgttttgttttatttttattagaaattcgttttagaatttttttaaggtatcggagaagttttttagtgtttttttcggagttagtcgaaaaatcgaggtttttacgtcgacggcgtttagttttatttttacgtattaagataattttaaggagaggtcgttttttttcgttaaagtttcgtggattttagaggtttcgttttcgtttaaggagagagaaaataagaataattcgacgtcgagataggtttggatttttttagttaatttttcggcgaagatagcggagtcggttaaggtcgcgggttattcggcggcggaggggaggttttggttattatttaaggttatttgttcggtaggaaagttttcggattttttttcgacgtcgaagaggtcgttttcggatatttttaattagtcggaagcgttttcgtttacgtatattattagtttcgtggaaacgttttagatttcgagtttttttagttatttatcggcgatttaggtttagaatttttttgataagtcgacgtaggtttagatttcgaattttattagttagtcggagacggttaaggtttaggattttagtgattcgacgaagatttcggttaagagtatttttagtgagtagaaggcgatttagatttagaacgttattagtaattcgtcgtcgtttaaggtttagaacgttaataatacgtcgtcgttttcgttttagaattttattagtgattcgtagaaggtttagatttaggattttattagtaattaggaggcgatttcgaagtagaatttcgtttattattcgtagaagattaagatttagaatattttcggttattcgaaggagatttcgatttcgtatatttttagtaattcgaagaaggtttcgttttcgaattttattagtgatacgtcgtcgttttaggtttcggatatttttagttattcggcgtcgttttagatttcgaacgttattgttattacgtaaacgttttcgaagtcgtttattatttgttattcgtcgtcgttttagatttcgtattttacgaatagttcggggtaaacg

SEQ ID NO: 1460 - DNA, 1090 bp, Artificial Sequence
  chemically treated genomic DNA (Homo sapiens) CpG-island No: 1460
cgtttaccccgaactattcgtaaaatacgaaatctaaaacgacgacgaataacaaataataaacgacttcgaaaacgtttacgtaataacaataacgttcgaaatctaaaacgacgccgaataactaaaaatatccgaaacctaaaacgacgacgtatcactaataaaattcgaaaacgaaaccttcttcgaattactaaaaatatacgaaatcgaaatctccttcgaataaccgaaaatattctaaatcttaatcttctacgaataataaacgaaattctacttcgaaatcgcctcctaattactaataaaatcctaaatctaaaccttctacgaatcactaataaaattctaaaacgaaaacgacgacgtattattaacgttctaaaccttaaacgacgacgaattactaataacgttctaaatctaaatcgccttctactcactaaaaatactcttaaccgaaatcttcgtcgaatcactaaaatcctaaaccttaaccgtctccgactaactaataaaattcgaaatctaaacctacgtcgacttatcaaaaaaattctaaacctaaatcgccgataaataactaaaaaaactcgaaatctaaaacgtttccacgaaactaataatatacgtaaacgaaaacgcttccgactaattaaaaatatccgaaaacgacctcttcgacgtcgaaaaaaaatccgaaaactttcctaccgaacaaataaccttaaataataaccaaaacctcccctccgccgccgaataacccgcgaccttaaccgactccgctatcttcgccgaaaaattaactaaaaaaatccaaacctatctcgacgtcgaattattcttattttctctctccttaaacgaaaacgaaacctctaaaatccacgaaactttaacgaaaaaaaacgacctctccttaaaattatcttaatacgtaaaaataaaactaaacgccgtcgacgtaaaaacctcgatttttcgactaactccgaaaaaaacactaaaaaacttctccgataccttaaaaaaattctaaaacgaatttctaataaaaataaaacaaaacgacttctacgaaaca

SEQ ID NO: 1461 - DNA, 1086 bp, Artificial Sequence
  chemically treated genomic DNA (Homo sapiens) CpG-island No: 1461
ggttatttcggcggtatatgttggggggaggagtgaagtcgaggcgcgcgttttttttttttattaagggcgttcgcgaattcgagtataggcggttgcgaacgtcgttgttatgggggaggggcgggggggggggtgaagttcgcgcgcgataggaacggcgggaagggggaagggaggcgagggcgttcgcgttagcgaagggcgtcgagcgcgcgtgcgcgcggaggagttcggcggtttgggtagtttttcgcgcgttttggtttcgcgtcggggtcgtcgttttttttttattcggttcgttggtttttttatttttttattcgtcgttttcgttcgtcgttttcgagggggagaggttttgtcgtcgtcgttgttcgagttttcgagtttttcgggtttggggtcgtcgtttcgtttcgtcggttcgttcgttttagtcgacgtcgacgttttttcgtttttttaggggtcgtaacgggtttcgattgcgttattcgtatttcgtttgggtcgcgttgtacgttagtacgattaattgcgtgcgttagtacgtaaacgcgcgtcgcggggtttgtcgggaattggagtgcgtttcgcggttttttgcgtaggcgtcgaagttatatcgcgaagtatcgtttttttaggtataaggaaggttttatttcgttgtcgaaagattaagcgtttcgttggttagtgtaacgaagaacggaggaagcgacgtaagatatcgcgtattcgtaggtttttcgttgcggggaggagtatagggtttagcggtagtaaagcgacgttcgagcgcgtttcgtttttcgttgtcgatgtagagtattttgggagttgtggttcgggcgtgtcgcggagttcggatgtaatttcggttcggggcgtggcggttattttgtttttttatgttgggagacgatattttagtcgcggtggtgttgtcgttttcgtgtgattttgggtttttcgagcgagttcgtagttgtatagtagttcgttttttcgtattcgagagaagtcgttttagattttagttagcgggtattttcggaggtttcgagtttggttgta

SEQ ID NO: 1462 - DNA, 1086 bp, Artificial Sequence
  chemically treated genomic DNA (Homo sapiens) CpG-island No: 1462
tacaaccaaactcgaaacctccgaaaatacccgctaactaaaatctaaaacgacttctctcgaatacgaaaaaacgaactactatacaactacgaactcgctcgaaaaacccaaaatcacacgaaaacgacaacaccaccgcgactaaaatatcgtctcccaacataaaaaaacaaaataaccgccacgccccgaaccgaaattacatccgaactccgcgacacgcccgaaccacaactcccaaaatactctacatcgacaacgaaaaacgaaacgcgctcgaacgtcgctttactaccgctaaaccctatactcctccccgcaacgaaaaacctacgaatacgcgatatcttacgtcgcttcctccgttcttcgttacactaaccaacgaaacgcttaatctttcgacaacgaaataaaaccttccttatacctaaaaaaacgatacttcgcgatataacttcgacgcctacgcaaaaaaccgcgaaacgcactccaattcccgacaaaccccgcgacgcgcgtttacgtactaacgcacgcaattaatcgtactaacgtacaacgcgacccaaacgaaatacgaataacgcaatcgaaacccgttacgacccctaaaaaaacgaaaaaacgtcgacgtcgactaaaacgaacgaaccgacgaaacgaaacgacgaccccaaacccgaaaaactcgaaaactcgaacaacgacgacgacaaaacctctccccctcgaaaacgacgaacgaaaacgacgaataaaaaaataaaaaaaccaacgaaccgaataaaaaaaaaacgacgaccccgacgcgaaaccaaaacgcgcgaaaaactacccaaaccgccgaactcctccgcgcgcacgcgcgctcgacgcccttcgctaacgcgaacgccctcgcctcccttcccccttcccgccgttcctatcgcgcgcgaacttcacccccccccccgcccctcccccataacaacgacgttcgcaaccgcctatactcgaattcgcgaacgcccttaataaaaaaaaaaaacgcgcgcctcgacttcactcctccccccaacatataccgccgaaataacc

SEQ ID NO: 1463 - DNA, 1086 bp, Artificial Sequence
  chemically treated genomic DNA (Homo sapiens) CpG-island No: 1463
tgtagttaggttcggggttttcgggggtgttcgttggttggggtttgaggcggtttttttcgggtacgggaaggcggattgttgtgtagttgcgggttcgttcgggaaatttaaagttatacgaaagcggtagtattatcgcggttgggatatcgttttttaatatggggagataaaatggtcgttacgtttcgagtcgaaattatattcgggtttcgcgatacgttcgaattataatttttagaatgttttgtatcgatagcgggagacgagacgcgttcgggcgtcgttttgttgtcgttaggttttgtgttttttttcgtagcggaaggtttacgaatacgcggtgttttacgtcgtttttttcgtttttcgttgtattggttaacgggacgtttagtttttcggtaacggggtgaaattttttttgtgtttgaaaaaacggtatttcgcggtgtggtttcggcgtttgcgtaaaaggtcgcggggcgtattttagttttcggtaggtttcgcgacgcgcgtttgcgtgttgacgtacgtagttagtcgtgttgacgtgtagcgcggtttaggcggggtgcgagtggcgtagtcggagttcgttgcggtttttgaggaagcgaggaggcgtcggcgtcggttgaggcgggcggatcggcgaggcgaggcggcggttttaggttcgagggattcgggagttcgagtagcggcggcggtaagatttttttttttcggaggcggcgggcggaggcggcgggtgagagggtgagggagttagcgagtcgggtgggggaggggcggcggtttcggcgcgaggttaaagcgcgcggagaattgtttaggtcgtcgagttttttcgcgcgtacgcgcgttcgacgtttttcgttggcgcggacgttttcgtttttttttttttttttcgtcgtttttgtcgcgcgcgggttttattttttttttcgttttttttttatgataacggcgttcgtagtcgtttgtattcgggttcgcgagcgtttttggtgaggggggagggcgcgcgtttcggttttatttttttttttaatatgtgtcgtcgaggtggtt

SEQ ID NO: 1464 - DNA, 1086 bp, Artificial Sequence
  chemically treated genomic DNA (Homo sapiens) CpG-island No: 1464
aaccacctcgacgacacatattaaaaaaaaaaataaaaccgaaacgcgcgccctcccccctcaccaaaaacgctcgcgaacccgaatacaaacgactacgaacgccgttatcataaaaaaaaaacgaaaaaaaaaataaaacccgcgcgcgacaaaaacgacgaaaaaaaaaaaaaaaaacgaaaacgtccgcgccaacgaaaaacgtcgaacgcgcgtacgcgcgaaaaaactcgacgacctaaacaattctccgcgcgctttaacctcgcgccgaaaccgccgcccctcccccacccgactcgctaactccctcaccctctcacccgccgcctccgcccgccgcctccgaaaaaaaaaaatcttaccgccgccgctactcgaactcccgaatccctcgaacctaaaaccgccgcctcgcctcgccgatccgcccgcctcaaccgacgccgacgcctcctcgcttcctcaaaaaccgcaacgaactccgactacgccactcgcaccccgcctaaaccgcgctacacgtcaacacgactaactacgtacgtcaacacgcaaacgcgcgtcgcgaaacctaccgaaaactaaaatacgccccgcgaccttttacgcaaacgccgaaaccacaccgcgaaataccgttttttcaaacacaaaaaaaatttcaccccgttaccgaaaaactaaacgtcccgttaaccaatacaacgaaaaacgaaaaaaacgacgtaaaacaccgcgtattcgtaaaccttccgctacgaaaaaaaacacaaaacctaacgacaacaaaacgacgcccgaacgcgtctcgtctcccgctatcgatacaaaacattctaaaaattataattcgaacgtatcgcgaaacccgaatataatttcgactcgaaacgtaacgaccattttatctccccatattaaaaaacgatatcccaaccgcgataatactaccgctttcgtataactttaaatttcccgaacgaacccgcaactacacaacaatccgccttcccgtacccgaaaaaaaccgcctcaaaccccaaccaacgaacacccccgaaaaccccgaacctaactaca

SEQ ID NO: 1465 - DNA, 1173 bp, Artificial Sequence
  chemically treated genomic DNA (Homo sapiens) CpG-island No: 1465
attacggacgcgttggaggtcggtgggcggtcgtcgtagtcgtttttttattatttcgtttaggttttttcggtttggggtaagaggtttgtggttcgcgcgggaacgtattgtttatttttagatttgggattgggtcggcgcgcggacgttattaagaggttgcggttttcgttttcgcggtcggacgtggcgttttttttgaggtcgcggtcggagtttggaggtggggtcggagttagagttcggggttttgatgttatcgcgcggttgcgacggtttaggagcgcgtttcggcgggagttttaggtacgcggcgggggcgggggagcgggaagcgggcggttgggttcgtttttttcgggaggtcggcggggttgcgggcggacgggggtgaagagcgggcggcgaggcggtggtcgcggggtagttcgggtatcgttcggtcgggacgtgtttggttcggcgtcgcgttaggttgcgttagtggagtcggattttagcgcgttttttttagttgtagagttgtagggcggagaggcggtttattttaagttggcggcgcggtttaggggcgcggttgggcgcgtcgcgtgtggcgtcggcgggtagcgcggttttatttcgttatttttcgtttttgttttttgtcgttaagtatttggagaagtcgggtttttttttttcgggttcgcgttgttttttgcgcgcgattttttttcgacggtgaatttaacgggaaaggtttagaattgcgcggggttgcggttatttgttgtcgagtcgtttcgcgtgtttttgtcgttttttgcggtcgtcggggtttgcgtttttttttttttcgtgtttcggtttttagagattgaattttaggtaatcgggtttgtttacgttcgcggtcgttttttttcgggtgtcgttagttttttgtattttttgtgtatggtacggagttcgggtttttagagattttgtatttggggtgtagcgatcgatgagttcgtaaattagtcgtatattcggagcgtggatgttgcgtggggtgcgttgttagcgcggataggttgggagaacgggggacgttggggatagggagagtcggtgaattttttagaacgttcgtttagttagatttagttgcgggtattgggttttgagacgtggtttagtatt

SEQ ID NO: 1466 - DNA, 1173 bp, Artificial Sequence
  chemically treated genomic DNA (Homo sapiens) CpG-island No: 1466
aatactaaaccacgtctcaaaacccaatacccgcaactaaatctaactaaacgaacgttctaaaaaattcaccgactctccctatccccaacgtcccccgttctcccaacctatccgcgctaacaacgcaccccacgcaacatccacgctccgaatatacgactaatttacgaactcatcgatcgctacaccccaaatacaaaatctctaaaaacccgaactccgtaccatacacaaaaaatacaaaaaactaacgacacccgaaaaaaaacgaccgcgaacgtaaacaaacccgattacctaaaattcaatctctaaaaaccgaaacacgaaaaaaaaaaaaacgcaaaccccgacgaccgcaaaaaacgacaaaaacacgcgaaacgactcgacaacaaataaccgcaaccccgcgcaattctaaacctttcccgttaaattcaccgtcgaaaaaaaatcgcgcgcaaaaaacaacgcgaacccgaaaaaaaaaaacccgacttctccaaatacttaacgacaaaaaacaaaaacgaaaaataacgaaataaaaccgcgctacccgccgacgccacacgcgacgcgcccaaccgcgcccctaaaccgcgccgccaacttaaaataaaccgcctctccgccctacaactctacaactaaaaaaaacgcgctaaaatccgactccactaacgcaacctaacgcgacgccgaaccaaacacgtcccgaccgaacgatacccgaactaccccgcgaccaccgcctcgccgcccgctcttcacccccgtccgcccgcaaccccgccgacctcccgaaaaaaacgaacccaaccgcccgcttcccgctcccccgcccccgccgcgtacctaaaactcccgccgaaacgcgctcctaaaccgtcgcaaccgcgcgataacatcaaaaccccgaactctaactccgaccccacctccaaactccgaccgcgacctcaaaaaaaacgccacgtccgaccgcgaaaacgaaaaccgcaacctcttaataacgtccgcgcgccgacccaatcccaaatctaaaaataaacaatacgttcccgcgcgaaccacaaacctcttaccccaaaccgaaaaaacctaaacgaaataataaaaaaacgactacgacgaccgcccaccgacctccaacgcgtccgtaat

SEQ ID NO: 1467 - DNA, 1173 bp, Artificial Sequence
  chemically treated genomic DNA (Homo sapiens) CpG-island No: 1467
ggtattggattacgttttaaaatttagtattcgtagttgggtttggttaggcggacgttttgggaagtttatcggttttttttgtttttagcgtttttcgtttttttagtttgttcgcgttgatagcgtattttacgtagtatttacgtttcgagtgtgcgattggtttacgggtttatcggtcgttgtattttagatgtagagtttttggagattcgagtttcgtgttatgtataggaaatgtaggaagttggcgatattcggggagaggcggtcgcgggcgtggatagattcggttatttggggtttaatttttgggagtcgaggtacgggagggagagaggcgtaggtttcggcggtcgtagggggcggtagagatacgcggagcggttcgatagtagatggtcgtagtttcgcgtagttttgggtttttttcgttgggtttatcgtcggggaaggatcgcgcgtaggggatagcgcgagttcgggagggaaggattcggtttttttagatgtttggcgataaagggtaggagcggagggtggcggagtgagatcgcgttgttcgtcggcgttatacgcggcgcgtttagtcgcgtttttgagtcgcgtcgttagtttagagtgggtcgttttttcgttttgtagttttgtagttgggagaggcgcgttggggttcgattttattggcgtaatttgacgcggcgtcgagttagatacgtttcggtcgaacgatgttcgggttgtttcgcgattatcgtttcgtcgttcgttttttattttcgttcgttcgtagtttcgtcggtttttcgggggaagcggatttagtcgttcgtttttcgttttttcgttttcgtcgcgtatttgaggttttcgtcgagacgcgtttttgggtcgtcgtagtcgcgcggtgatattagagtttcgggttttgatttcgattttatttttaggtttcggtcgcggttttaggggaggcgttacgttcggtcgcgggggcgggagtcgtagttttttggtagcgttcgcgcgtcggtttagttttaggtttgagggtggatagtgcgttttcgcgcgggttataggttttttgttttaggtcggagaaatttgagcgaggtggtgggagggcgattacggcgatcgtttatcggtttttagcgcgttcgtgat

SEQ ID NO: 1468 - DNA, 1173 bp, Artificial Sequence
  chemically treated genomic DNA (Homo sapiens) CpG-island No: 1468
atcacgaacgcgctaaaaaccgataaacgatcgccgtaatcgccctcccaccacctcgctcaaatttctccgacctaaaacaaaaaacctataacccgcgcgaaaacgcactatccaccctcaaacctaaaactaaaccgacgcgcgaacgctaccaaaaaactacgactcccgcccccgcgaccgaacgtaacgcctcccctaaaaccgcgaccgaaacctaaaaataaaatcgaaatcaaaacccgaaactctaatatcaccgcgcgactacgacgacccaaaaacgcgtctcgacgaaaacctcaaatacgcgacgaaaacgaaaaaacgaaaaacgaacgactaaatccgcttcccccgaaaaaccgacgaaactacgaacgaacgaaaataaaaaacgaacgacgaaacgataatcgcgaaacaacccgaacatcgttcgaccgaaacgtatctaactcgacgccgcgtcaaattacgccaataaaatcgaaccccaacgcgcctctcccaactacaaaactacaaaacgaaaaaacgacccactctaaactaacgacgcgactcaaaaacgcgactaaacgcgccgcgtataacgccgacgaacaacgcgatctcactccgccaccctccgctcctaccctttatcgccaaacatctaaaaaaaccgaatccttccctcccgaactcgcgctatcccctacgcgcgatccttccccgacgataaacccaacgaaaaaaacccaaaactacgcgaaactacgaccatctactatcgaaccgctccgcgtatctctaccgccccctacgaccgccgaaacctacgcctctctccctcccgtacctcgactcccaaaaattaaaccccaaataaccgaatctatccacgcccgcgaccgcctctccccgaatatcgccaacttcctacatttcctatacataacacgaaactcgaatctccaaaaactctacatctaaaatacaacgaccgataaacccgtaaaccaatcgcacactcgaaacgtaaatactacgtaaaatacgctatcaacgcgaacaaactaaaaaaacgaaaaacgctaaaaacaaaaaaaaccgataaacttcccaaaacgtccgcctaaccaaacccaactacgaatactaaattttaaaacgtaatccaatacc

SEQ ID NO: 1469 - DNA, 532 bp, Artificial Sequence
  chemically treated genomic DNA (Homo sapiens) CpG-island No: 1469
gttcgtttagttttgagatttagacgcggacgtcgggttttatcgtatcgtatagcgcgggtaattttttaggaatcgcggttcgtacgtcgcgggcgcggaggtcgttttagcgttttatgtcgttgtcgtagaggggtaggggacgcgtttcggttttatttatttatgttaattacgttaagttggtgcggattggaatcgcgtttcgggcggagttgggatgttttgataagaagaagttcgggagtggggatattggtacggagtaaatttcgtttagttttgatttttttatagcggttacgttcggacgaacggatcgtcgagcgttaggacgcgtttcgttttttttcgtcgtcgtcgaatcgcgtcgagaggagtcgttagttcggcgcgcggttatttatcgttttcgtcgagtttcgatagtaaatcgacgtttttgttgcggttttaagtgttaagttgtttttagtcggtggttgtttacggtttagtggattagggtatattggtttcggcgggtatt

SEQ ID NO: 1470 - DNA, 532 bp, Artificial Sequence
  chemically treated genomic DNA (Homo sapiens) CpG-island No: 1470
aatacccgccgaaaccaatataccctaatccactaaaccgtaaacaaccaccgactaaaaacaacttaacacttaaaaccgcaacaaaaacgtcgatttactatcgaaactcgacgaaaacgataaataaccgcgcgccgaactaacgactcctctcgacgcgattcgacgacgacgaaaaaaaacgaaacgcgtcctaacgctcgacgatccgttcgtccgaacgtaaccgctataaaaaaatcaaaactaaacgaaatttactccgtaccaatatccccactcccgaacttcttcttatcaaaacatcccaactccgcccgaaacgcgattccaatccgcaccaacttaacgtaattaacataaataaataaaaccgaaacgcgtcccctacccctctacgacaacgacataaaacgctaaaacgacctccgcgcccgcgacgtacgaaccgcgattcctaaaaaattacccgcgctatacgatacgataaaacccgacgtccgcgtctaaatctcaaaactaaacgaac

SEQ ID NO: 1471 - DNA, 532 bp, Artificial Sequence
  chemically treated genomic DNA (Homo sapiens) CpG-island No: 1471
ggtgttcgtcggaattaatgtgttttggtttattgggtcgtgagtagttatcgattgggggtaatttggtatttagaatcgtagtagggacgtcggtttgttatcgggattcggcgaggacggtgagtggtcgcgcgtcgggttagcggtttttttcggcgcggttcggcggcggcgagaggggacgggacgcgttttggcgttcggcggttcgttcgttcgagcgtgatcgttgtggggaggttagggttgggcgggatttatttcgtgttaatatttttattttcgaatttttttttgttaaagtattttaatttcgttcgggacgcggttttagttcgtattaatttggcgtaattgatatgggtaggtggggtcgggacgcgttttttgtttttttgcggtaacgatatggagcgttggggcggttttcgcgttcgcggcgtgcggatcgcggtttttgaaaaattattcgcgttgtgcggtacggtaagattcggcgttcgcgtttggattttaaggttgagcgagt

SEQ ID NO: 1472 - DNA, 532 bp, Artificial Sequence
  chemically treated genomic DNA (Homo sapiens) CpG-island No: 1472
actcgctcaaccttaaaatccaaacgcgaacgccgaatcttaccgtaccgcacaacgcgaataatttttcaaaaaccgcgatccgcacgccgcgaacgcgaaaaccgccccaacgctccatatcgttaccgcaaaaaaacaaaaaacgcgtcccgaccccacctacccatatcaattacgccaaattaatacgaactaaaaccgcgtcccgaacgaaattaaaatactttaacaaaaaaaaattcgaaaataaaaatattaacacgaaataaatcccgcccaaccctaacctccccacaacgatcacgctcgaacgaacgaaccgccgaacgccaaaacgcgtcccgtcccctctcgccgccgccgaaccgcgccgaaaaaaaccgctaacccgacgcgcgaccactcaccgtcctcgccgaatcccgataacaaaccgacgtccctactacgattctaaataccaaattacccccaatcgataactactcacgacccaataaaccaaaacacattaattccgacgaacacc

SEQ ID NO: 1473 - DNA, 937 bp, Artificial Sequence
  chemically treated genomic DNA (Homo sapiens) CpG-island No: 1473
gtagggtattcggttagcgtttaattaaatcgaaatatcgtcgtagcgattataggtgtagattattaagtttatatcgttagtcgttcgggcgtttttaattagtagttggggcgggattaagttttcgagttgtcgtcgtagcggcggttgaaagttttattttttgcgcgtgcgcggtgcgcgtttcgtttttttgttgggtattaggcgttcgcgaagagcgcgcgcgttttcgtcggcgtcgggttcgcgtacgcgtacggcgacggcggcggtggcggtagtttttgttttaggttgcgagcggttggcggtttcgaggggagttgaggcgcggaggggttcggcggtagcggcggcggttcggtattgttatttttcggttcggttggcgtcggggcgcgcggtttggtttttttcgggcgcgcgggggcgatagcggtagcgattcgaggtttgcggtttaggttttagcgcggcggcgggttcgagtgtagcgcggaatcggttcgagggttttattcggaggtattatgagcgtggaggcgtacgggtttagttcgtagatttttatttttttggatacggaggaggtcgagttgtttggcgtcgatatatagggtttcgagttcgagtttatcgattttattttttttagttagacgtagacgtttttcggcggtttcggcggttcgggcggtggcggcgcgggaggttcgggcggcgcgggcgcgggcgttgcggcgggatagttcgacgcgtaggtgagcggtatatggcggtgtcggaagttcgggttcggtttcggcgtttgagatttgtttcgaattcgtttcgggttcggtttgtgtttggtcggagttttttatcgcggtcgggtttggggcgatttgtttcgggttttttattttggttcggtttgagtttatttgtt

SEQ ID NO: 1474 - DNA, 937 bp, Artificial Sequence
  chemically treated genomic DNA (Homo sapiens) CpG-island No: 1474
aacaaataaactcaaaccgaaccaaaataaaaaacccgaaacaaatcgccccaaacccgaccgcgataaaaaactccgaccaaacacaaaccgaacccgaaacgaattcgaaacaaatctcaaacgccgaaaccgaacccgaacttccgacaccgccatataccgctcacctacgcgtcgaactatcccgccgcaacgcccgcgcccgcgccgcccgaacctcccgcgccgccaccgcccgaaccgccgaaaccgccgaaaaacgtctacgtctaactaaaaaaaataaaatcgataaactcgaactcgaaaccctatatatcgacgccaaacaactcgacctcctccgtatccaaaaaaataaaaatctacgaactaaacccgtacgcctccacgctcataatacctccgaataaaaccctcgaaccgattccgcgctacactcgaacccgccgccgcgctaaaacctaaaccgcaaacctcgaatcgctaccgctatcgcccccgcgcgcccgaaaaaaaccaaaccgcgcgccccgacgccaaccgaaccgaaaaataacaataccgaaccgccgccgctaccgccgaacccctccgcgcctcaactcccctcgaaaccgccaaccgctcgcaacctaaaacaaaaactaccgccaccgccgccgtcgccgtacgcgtacgcgaacccgacgccgacgaaaacgcgcgcgctcttcgcgaacgcctaatacccaacaaaaaaacgaaacgcgcaccgcgcacgcgcaaaaaataaaactttcaaccgccgctacgacgacaactcgaaaacttaatcccgccccaactactaattaaaaacgcccgaacgactaacgatataaacttaataatctacacctataatcgctacgacgatatttcgatttaattaaacgctaaccgaataccctac

SEQ ID NO: 1475 - DNA, 937 bp, Artificial Sequence
  chemically treated genomic DNA (Homo sapiens) CpG-island No: 1475
ggtaggtaagtttaggtcgagttagagtaggggattcggggtagatcgttttaggttcggtcgcgatgggggatttcggttaaatataggtcgggttcgaggcgagttcggggtaggttttaggcgtcgaggtcgggttcgggttttcggtatcgttatgtgtcgtttatttgcgcgtcgagttgtttcgtcgtagcgttcgcgttcgcgtcgttcgggtttttcgcgtcgttatcgttcgggtcgtcggggtcgtcggggggcgtttgcgtttggttaggaagagtaaagtcggtgaattcgaattcggagttttgtgtgtcggcgttaagtagttcggtttttttcgtgtttaggaaagtgagagtttgcgagttgggttcgtacgtttttacgtttatggtgttttcgggtagggttttcgggtcggtttcgcgttgtattcgagttcgtcgtcgcgttgaggtttaggtcgtaggtttcgggtcgttgtcgttgtcgttttcgcgcgttcggaaaggattaaatcgcgcgtttcggcgttagtcggatcgagaggtaatagtgtcgagtcgtcgtcgttgtcgtcgagttttttcgcgttttagtttttttcgaagtcgttagtcgttcgtagtttagagtaggaattgtcgttatcgtcgtcgtcgtcgtgcgcgtgcgcgagttcgacgtcggcggaagcgcgcgcgtttttcgcgggcgtttggtgtttagtaggaagacgggacgcgtatcgcgtacgcgtagggggtggggtttttaatcgtcgttgcggcggtagttcgaggatttggtttcgttttaattgttaattggggacgttcgggcggttggcggtgtggatttggtggtttgtatttgtggtcgttgcgacggtgtttcggtttaattgagcgttagtcgaatattttat

SEQ ID NO: 1476 - DNA, 937 bp, Artificial Sequence
  chemically treated genomic DNA (Homo sapiens) CpG-island No: 1476
ataaaatattcgactaacgctcaattaaaccgaaacaccgtcgcaacgaccacaaatacaaaccaccaaatccacaccgccaaccgcccgaacgtccccaattaacaattaaaacgaaaccaaatcctcgaactaccgccgcaacgacgattaaaaaccccaccccctacgcgtacgcgatacgcgtcccgtcttcctactaaacaccaaacgcccgcgaaaaacgcgcgcgcttccgccgacgtcgaactcgcgcacgcgcacgacgacgacgacgataacgacaattcctactctaaactacgaacgactaacgacttcgaaaaaaactaaaacgcgaaaaaactcgacgacaacgacgacgactcgacactattacctctcgatccgactaacgccgaaacgcgcgatttaatcctttccgaacgcgcgaaaacgacaacgacaacgacccgaaacctacgacctaaacctcaacgcgacgacgaactcgaatacaacgcgaaaccgacccgaaaaccctacccgaaaacaccataaacgtaaaaacgtacgaacccaactcgcaaactctcactttcctaaacacgaaaaaaaccgaactacttaacgccgacacacaaaactccgaattcgaattcaccgactttactcttcctaaccaaacgcaaacgccccccgacgaccccgacgacccgaacgataacgacgcgaaaaacccgaacgacgcgaacgcgaacgctacgacgaaacaactcgacgcgcaaataaacgacacataacgataccgaaaacccgaacccgacctcgacgcctaaaacctaccccgaactcgcctcgaacccgacctatatttaaccgaaatcccccatcgcgaccgaacctaaaacgatctaccccgaatcccctactctaactcgacctaaacttacctacc

SEQ ID NO: 1477 - DNA, 557 bp, Artificial Sequence
  chemically treated genomic DNA (Homo sapiens) CpG-island No: 1477
ggcgtagacgtcgtatttcgttcgtttttcgttttgtatttatttcgttcgtatattcgttagcgttcggtatttgagtcgtcggtttcgcgggtgtttttttttttttttcggcgtttaaggggttatttcgagtcgttcgggggttttcgtcgtttttttgtatagtttggttgtcgtcgtttacgttggcgtcggttttttcggtggacgaggcggcggcggcgtcgagtagttcgtgggtttcgttcgcgttttcggtagttacgttgtgtattagttatgtatttacgttggtgcgagggacgaaggggatttcgagcgcgcgtatttttcggagtagttggttttcgggcggcgcggtagggtttagttttcggtttttggggtgtaagtggttcgcgcgtttttattttttcgaggtcgagaaggggttgagcgcgtaggcggagttggtcgggtcgtttaggaatagtagttcgttttgtagtagggtgggcggcggtagtagtaggtaaagatttaggtttacgcggagtttcgttaagtttagtagg

SEQ ID NO: 1478 - DNA, 557 bp, Artificial Sequence
  chemically treated genomic DNA (Homo sapiens) CpG-island No: 1478
cctactaaacttaacgaaactccgcgtaaacctaaatctttacctactactaccgccgcccaccctactacaaaacgaactactattcctaaacgacccgaccaactccgcctacgcgctcaaccccttctcgacctcgaaaaaataaaaacgcgcgaaccacttacaccccaaaaaccgaaaactaaaccctaccgcgccgcccgaaaaccaactactccgaaaaatacgcgcgctcgaaatccccttcgtccctcgcaccaacgtaaatacataactaatacacaacgtaactaccgaaaacgcgaacgaaacccacgaactactcgacgccgccgccgcctcgtccaccgaaaaaaccgacgccaacgtaaacgacgacaaccaaactatacaaaaaaacgacgaaaacccccgaacgactcgaaataaccccttaaacgccgaaaaaaaaaaaaaaacacccgcgaaaccgacgactcaaataccgaacgctaacgaatatacgaacgaaataaatacaaaacgaaaaacgaacgaaatacgacgtctacgcc

SEQ ID NO: 1479 - DNA, 557 bp, Artificial Sequence
  chemically treated genomic DNA (Homo sapiens) CpG-island No: 1479
tttgttgagtttggcggggtttcgcgtagatttagatttttatttgttgttgtcgtcgtttattttgttgtaggacgagttgttgtttttgggcggttcggttagtttcgtttacgcgtttagttttttttcggtttcgggagggtgggggcgcgcgggttatttgtattttaagggtcgggagttggattttgtcgcgtcgttcgagggttagttgtttcgggaggtgcgcgcgttcggggtttttttcgtttttcgtattagcgtggatgtatggttggtgtatagcgtggttgtcgggagcgcggacgaggtttacgggttgttcggcgtcgtcgtcgtttcgtttatcggaggagtcggcgttagcgtggacggcggtagttaggttgtgtaggggggcggcggggattttcgagcggttcggagtggttttttggacgtcggggaagaggagaaggtattcgcggaatcgacggtttaggtgtcggacgttggcggatgtgcgagcgaggtaggtgtagagcgggaagcgagcgaagtgcggcgtttacgtt

SEQ ID NO: 1480 - DNA, 557 bp, Artificial Sequence
  chemically treated genomic DNA (Homo sapiens) CpG-island No: 1480
aacgtaaacgccgcacttcgctcgcttcccgctctacacctacctcgctcgcacatccgccaacgtccgacacctaaaccgtcgattccgcgaataccttctcctcttccccgacgtccaaaaaaccactccgaaccgctcgaaaatccccgccgcccccctacacaacctaactaccgccgtccacgctaacgccgactcctccgataaacgaaacgacgacgacgccgaacaacccgtaaacctcgtccgcgctcccgacaaccacgctatacaccaaccatacatccacgctaatacgaaaaacgaaaaaaaccccgaacgcgcgcacctcccgaaacaactaaccctcgaacgacgcgacaaaatccaactcccgacccttaaaatacaaataacccgcgcgcccccaccctcccgaaaccgaaaaaaaactaaacgcgtaaacgaaactaaccgaaccgcccaaaaacaacaactcgtcctacaacaaaataaacgacgacaacaacaaataaaaatctaaatctacgcgaaaccccgccaaactcaacaaa

SEQ ID NO: 1481 - DNA, 502 bp, Artificial Sequence
  chemically treated genomic DNA (Homo sapiens) CpG-island No: 1481
aggtcgtcgtcggtcgattattatcgttttaggtgttttatcgtcgtcgcgcgttcgggaacgtttttgtcggcgttcgcgggtttcggcgttttagtcgtcggggtgatacgtgcggatttcgcgcgtcgttcgtatttgtttggaatttagataagcgaaataatggatcggggcgcgtggcggtcgtcgcgggtttttagtatcgggtataaaggcgttttttcggtagtcggtatcgtgtttggtatcgtcggggatcgggagaagcgaagaaggagttatttgagcgtcgagttcgttcgtttagtcgttcgtagttcggcgcggtggttaagtttcgttttcggtcgcgggcgtagtcgataggaatacgttttttgtcgttcggggttcgcgttcgtgggaggggtcgtacggggcggggtttttcgagtttaaagtttttttatgttcggggaacgtaaggttttttgggagtagaagttgttttgggtattaa

SEQ ID NO: 1482 - DNA, 502 bp, Artificial Sequence
  chemically treated genomic DNA (Homo sapiens) CpG-island No: 1482
ttaatacccaaaacaacttctactcccaaaaaaccttacgttccccgaacataaaaaaactttaaactcgaaaaaccccgccccgtacgacccctcccacgaacgcgaaccccgaacgacaaaaaacgtattcctatcgactacgcccgcgaccgaaaacgaaacttaaccaccgcgccgaactacgaacgactaaacgaacgaactcgacgctcaaataactccttcttcgcttctcccgatccccgacgataccaaacacgataccgactaccgaaaaaacgcctttatacccgatactaaaaacccgcgacgaccgccacgcgccccgatccattatttcgcttatctaaattccaaacaaatacgaacgacgcgcgaaatccgcacgtatcaccccgacgactaaaacgccgaaacccgcgaacgccgacaaaaacgttcccgaacgcgcgacgacgataaaacacctaaaacgataataatcgaccgacgacgacct

SEQ ID NO: 1483 - DNA, 502 bp, Artificial Sequence
  chemically treated genomic DNA (Homo sapiens) CpG-island No: 1483
ttggtgtttagaataatttttgtttttagaaagttttgcgtttttcggatataaagaggttttgagttcggggagtttcgtttcgtgcggttttttttacgggcgcgggtttcgggcggtagggggcgtgtttttgtcggttgcgttcgcggtcgggggcggagtttggttatcgcgtcgggttgcgggcggttgggcgaacgggttcggcgtttaggtggtttttttttcgtttttttcgattttcggcggtgttaggtacggtgtcggttgtcgagggaacgtttttgtgttcggtgttgggaattcgcgacggtcgttacgcgtttcggtttattgtttcgtttatttgggttttaggtaggtgcgggcggcgcgcggggttcgtacgtgttatttcggcggttggggcgtcgggattcgcgggcgtcggtaggggcgttttcgggcgcgcggcggcgatgaagtatttgaagcggtggtggtcggtcggcggcggttt

SEQ ID NO: 1484 - DNA, 502 bp, Artificial Sequence
  chemically treated genomic DNA (Homo sapiens) CpG-island No: 1484
aaaccgccgccgaccgaccaccaccgcttcaaatacttcatcgccgccgcgcgcccgaaaacgcccctaccgacgcccgcgaatcccgacgccccaaccgccgaaataacacgtacgaaccccgcgcgccgcccgcacctacctaaaacccaaataaacgaaacaataaaccgaaacgcgtaacgaccgtcgcgaattcccaacaccgaacacaaaaacgttccctcgacaaccgacaccgtacctaacaccgccgaaaatcgaaaaaaacgaaaaaaaaaccacctaaacgccgaacccgttcgcccaaccgcccgcaacccgacgcgataaccaaactccgcccccgaccgcgaacgcaaccgacaaaaacacgccccctaccgcccgaaacccgcgcccgtaaaaaaaaccgcacgaaacgaaactccccgaactcaaaacctctttatatccgaaaaacgcaaaactttctaaaaacaaaaattattctaaacaccaa

SEQ ID NO: 1485 - DNA, 706 bp, Artificial Sequence
  chemically treated genomic DNA (Homo sapiens) CpG-island No: 1485
ggtgtttacgtatttcgggtttcgcgttttcgttgtcgttcggcggtaaggacggaatcgggcgttgtttcgcgcgtatcgagagtcgcgggttcgggtttcgttcggagtcggggtggttttcgtggttttcgtcggcggtcgagtttttttcgaacgtttttagtcggcgtgttcgggcgatattttcgtaattcgattcgcgcgcgggtttcggattttatttgcgcgtttttgttttattcgtcgttcgggcgtttaagcgggaagtgggggatttttgggtggtttttttttggttcgcgtcgcgcggggtttttttgggcgcggagatttagttcgtttcggttttttgtttttcgtttcggcgttcggtagatttgtatgcgtcgtttcgttcggcgcgttcggttcgggtttcggttatttcgcgtttttgtcgttgttttcgtcgtcgtcgtcggatagttcgagtcgtcgtttttttttgggggcgattttagtatttcgttgggtgttttgtcgcgcgtttttttttacgttgtagttcgaggttacgtttagcggagaattttgtagtggatttttttggtttcggaataaaacgtttacgtcgattaggtttttaggatttgtttttgtttggttttcgcggttttttttgcgtcggggtagttgcgtttgtggggggagggttgggcgattg

SEQ ID NO: 1486 - DNA, 706 bp, Artificial Sequence
  chemically treated genomic DNA (Homo sapiens) CpG-island No: 1486
caatcgcccaaccctccccccacaaacgcaactaccccgacgcaaaaaaaaccgcgaaaaccaaacaaaaacaaatcctaaaaacctaatcgacgtaaacgttttattccgaaaccaaaaaaatccactacaaaattctccgctaaacgtaacctcgaactacaacgtaaaaaaaaacgcgcgacaaaacacccaacgaaatactaaaatcgcccccaaaaaaaaacgacgactcgaactatccgacgacgacgacgaaaacaacgacaaaaacgcgaaataaccgaaacccgaaccgaacgcgccgaacgaaacgacgcatacaaatctaccgaacgccgaaacgaaaaacaaaaaaccgaaacgaactaaatctccgcgcccaaaaaaaccccgcgcgacgcgaaccaaaaaaaaaccacccaaaaatcccccacttcccgcttaaacgcccgaacgacgaataaaacaaaaacgcgcaaataaaatccgaaacccgcgcgcgaatcgaattacgaaaatatcgcccgaacacgccgactaaaaacgttcgaaaaaaactcgaccgccgacgaaaaccacgaaaaccaccccgactccgaacgaaacccgaacccgcgactctcgatacgcgcgaaacaacgcccgattccgtccttaccgccgaacgacaacgaaaacgcgaaacccgaaatacgtaaacacc

SEQ ID NO: 1487 - DNA, 706 bp, Artificial Sequence
  chemically treated genomic DNA (Homo sapiens) CpG-island No: 1487
tagtcgtttagttttttttttataaacgtaattgtttcggcgtaaaagaggtcgcggaggttaggtaggagtaggttttggaggtttggtcggcgtgggcgttttatttcgagattaaggggatttattgtagagtttttcgttgggcgtgatttcgggttgtagcgtgggaggaagcgcgcggtaagatatttagcgaggtgttggggtcgtttttaggagaggacggcggttcggattgttcggcggcggcggcggggatagcgataggggcgcgaggtggtcgggattcgggtcgggcgcgtcgggcggggcggcgtatgtaaatttgtcgggcgtcggggcggggagtaggaagtcggggcgggttgggttttcgcgtttaggaaagtttcgcgcggcgcgggttagggaagggttatttaggggttttttatttttcgtttgggcgttcggacggcgaatggagtaggggcgcgtaggtaggattcggggttcgcgcgcggatcgggttgcgaaggtatcgttcgggtacgtcggttgagggcgttcgggaagggttcggtcgtcggcggggattacggggattatttcgatttcgagcggggttcgagttcgcgattttcggtgcgcgcggagtagcgttcggtttcgtttttgtcgtcgaacggtagcggaggcgcgaggttcggggtacgtggatatt

SEQ ID NO: 1488 - DNA, 706 bp, Artificial Sequence
  chemically treated genomic DNA (Homo sapiens) CpG-island No: 1488
aatatccacgtaccccgaacctcgcgcctccgctaccgttcgacgacaaaaacgaaaccgaacgctactccgcgcgcaccgaaaatcgcgaactcgaaccccgctcgaaatcgaaataatccccgtaatccccgccgacgaccgaacccttcccgaacgccctcaaccgacgtacccgaacgataccttcgcaacccgatccgcgcgcgaaccccgaatcctacctacgcgcccctactccattcgccgtccgaacgcccaaacgaaaaataaaaaacccctaaataacccttccctaacccgcgccgcgcgaaactttcctaaacgcgaaaacccaacccgccccgacttcctactccccgccccgacgcccgacaaatttacatacgccgccccgcccgacgcgcccgacccgaatcccgaccacctcgcgcccctatcgctatccccgccgccgccgccgaacaatccgaaccgccgtcctctcctaaaaacgaccccaacacctcgctaaatatcttaccgcgcgcttcctcccacgctacaacccgaaatcacgcccaacgaaaaactctacaataaatccccttaatctcgaaataaaacgcccacgccgaccaaacctccaaaacctactcctacctaacctccgcgacctcttttacgccgaaacaattacgtttataaaaaaaaaactaaacgacta

SEQ ID NO: 1489 - DNA, 612 bp, Artificial Sequence
  chemically treated genomic DNA (Homo sapiens) CpG-island No: 1489
aaacgttatagaggtagcggcggttaattagtggagggcgcgcgcggtcgcgtgtttttcgcgtttttcgttttttttcgcgcgtcgcgtacgtgtagtaatcgatttcgtttagcgaggcggagtttagggaagtcgcgggcggttcgtcgttgttttggagttgttgttgttgttgcggcggttgtatcggcggcgtcgaggtcgagatcgaggtcggggtgcgcgtttcgtaaacgtgttttattcgtgcggtttggttgcgttagtttttgcggttattcgggcgtttaggcgggtttgtgcgtcgttcgggcgaggatgcggttgtttcggtggttgttgaagtagtcggtgtttaagtagatcgagcgttattcgcgtttttcgtcgtcgtcgttttttattaaataatttttggatttcggtgagtacggggttaagggtttttatgggttcggggtcgtcgttattcgggttgttatttcggattttcgtagtttcggggtaaagtttgtgggaatcgtaggcggggttagggaatattcggggggtttttttggggttcggatttcggggcgcggaggggtagggtttggttttttcgtattt

SEQ ID NO: 1490 - DNA, 612 bp, Artificial Sequence
  chemically treated genomic DNA (Homo sapiens) CpG-island No: 1490
aaatacgaaaaaaccaaaccctacccctccgcgccccgaaatccgaaccccaaaaaaaccccccgaatattccctaaccccgcctacgattcccacaaactttaccccgaaactacgaaaatccgaaataacaacccgaataacgacgaccccgaacccataaaaacccttaaccccgtactcaccgaaatccaaaaattatttaataaaaaacgacgacgacgaaaaacgcgaataacgctcgatctacttaaacaccgactacttcaacaaccaccgaaacaaccgcatcctcgcccgaacgacgcacaaacccgcctaaacgcccgaataaccgcaaaaactaacgcaaccaaaccgcacgaataaaacacgtttacgaaacgcgcaccccgacctcgatctcgacctcgacgccgccgatacaaccgccgcaacaacaacaacaactccaaaacaacgacgaaccgcccgcgacttccctaaactccgcctcgctaaacgaaatcgattactacacgtacgcgacgcgcgaaaaaaaacgaaaaacgcgaaaaacacgcgaccgcgcgcgccctccactaattaaccgccgctacctctataacgttt

SEQ ID NO: 1491 - DNA, 612 bp, Artificial Sequence
  chemically treated genomic DNA (Homo sapiens) CpG-island No: 1491
gggtgcgagggggttaggttttgttttttcgcgtttcgaaattcgagttttaggagagtttttcggatattttttagtttcgtttgcggtttttatagattttatttcgaagttgcggagattcggggtggtagttcgaatggcggcggtttcgggtttatggggatttttggtttcgtatttatcgaagtttaggaattgtttgatggagagcggcgacggcgaaaagcgcgagtagcgttcgatttgtttgggtatcggttgttttagtagttatcggaatagtcgtattttcgttcgggcggcgtatagattcgtttagacgttcgggtggtcgtaagggttggcgtagttaagtcgtacggatagggtacgtttgcgaagcgcgtatttcggtttcgatttcggtttcggcgtcgtcggtgtagtcgtcgtagtagtagtagtagttttaggatagcggcgggtcgttcgcggtttttttaggtttcgtttcgttgggcggagtcggttgttgtacgtacgcggcgcgcgaggggaggcgaggagcgcgaggggtacgcggtcgcgcgcgttttttattgattggtcgtcgttgtttttgtgacgttt

SEQ ID NO: 1492 - DNA, 612 bp, Artificial Sequence
  chemically treated genomic DNA (Homo sapiens) CpG-island No: 1492
aaacgtcacaaaaacaacgacgaccaatcaataaaaaacgcgcgcgaccgcgtacccctcgcgctcctcgcctcccctcgcgcgccgcgtacgtacaacaaccgactccgcccaacgaaacgaaacctaaaaaaaccgcgaacgacccgccgctatcctaaaactactactactactacgacgactacaccgacgacgccgaaaccgaaatcgaaaccgaaatacgcgcttcgcaaacgtaccctatccgtacgacttaactacgccaacccttacgaccacccgaacgtctaaacgaatctatacgccgcccgaacgaaaatacgactattccgataactactaaaacaaccgatacccaaacaaatcgaacgctactcgcgcttttcgccgtcgccgctctccatcaaacaattcctaaacttcgataaatacgaaaccaaaaatccccataaacccgaaaccgccgccattcgaactaccaccccgaatctccgcaacttcgaaataaaatctataaaaaccgcaaacgaaactaaaaaatatccgaaaaactctcctaaaactcgaatttcgaaacgcgaaaaaacaaaacctaaccccctcgcaccc

SEQ ID NO: 1493 - DNA, 1182 bp, Artificial Sequence
  chemically treated genomic DNA (Homo sapiens) CpG-island No: 1493
tttaagcgtggttatatttatcggcgcgttgttttgttaagggggttgacgcggcgcgtacggttagggagtttttgggggtagacgtcgtttagtttttcggtcgtcgggtgtttattttagatcggttttttttttttttaggcgttttttacgttcgggtcggagagcgggcgttcggggcgacggacgattttgcgcgtacgtgggcgtagtttggaggtcgcggggatttttttttatgggggcgacgggagacgttttgtcggtagattttggttagggggtcgcgtttttcgttcgtatttttttcggagtttcggcggggacgtgcggggacgcgttcgggcgggagcgcgcgcgttaggcgttttcgaggtttcggtagcggttcggggcgggcggaggaggggtcgagggcggggcggtcgtagttttcgttattttcggtttttttcggttacggcgtatcgttttttcgttttcgttcgtttttttttatcgcgcgcgtttcgttcgtttcggagtttcgtttttcgttacgatgagtaaatgagcgcgagcgagggtatgaaatttaaattttatttaggggagaaagtgttgtgtttcgagtttgattttattaaggcgcgagtgttgtacgatgttaaggtgtcgtcgcggagggatagggaggaggcgcgggttgggggattcgggatcgggggcgggggcgggggcggacggtcgcgcggagttgagggatcggtcgggtttttcggtttgcgaggagcggtgcggtcggtagggggcgtttatagggcgttacgttcgggagtcggggcggggtttgggatgtttttattttttttcgttaggtcgggcggcgtacgcgcggttgggagtttcgtttatgttttgtcgcgttatcggggttatcgtttgcgttttcgattgtaacggtggtcgttgagggaggaggtttttcgaatacggtttttgttttcgcgttaaatgtttttttttgtgcggtttggtgtcgggtgggtttttgtgggacgttttggtcgttcgatttaggttttaatttatagttatacggcgttggtcgttgatttgcgacgttgtgtttttgggattttagtttagtttaggttttatttcgtttgtaggtcgtgaattttatttcgagggtaaggt

SEQ ID NO: 1494 - DNA, 1182 bp, Artificial Sequence
  chemically treated genomic DNA (Homo sapiens) CpG-island No: 1494
accttaccctcgaaataaaattcacgacctacaaacgaaataaaacctaaactaaactaaaatcccaaaaacacaacgtcgcaaatcaacgaccaacgccgtataactataaattaaaacctaaatcgaacgaccaaaacgtcccacaaaaacccacccgacaccaaaccgcacaaaaaaaaacatttaacgcgaaaacaaaaaccgtattcgaaaaacctcctccctcaacgaccaccgttacaatcgaaaacgcaaacgataaccccgataacgcgacaaaacataaacgaaactcccaaccgcgcgtacgccgcccgacctaacgaaaaaaaataaaaacatcccaaaccccgccccgactcccgaacgtaacgccctataaacgccccctaccgaccgcaccgctcctcgcaaaccgaaaaacccgaccgatccctcaactccgcgcgaccgtccgcccccgcccccgcccccgatcccgaatcccccaacccgcgcctcctccctatccctccgcgacgacaccttaacatcgtacaacactcgcgccttaataaaatcaaactcgaaacacaacactttctcccctaaataaaatttaaatttcataccctcgctcgcgctcatttactcatcgtaacgaaaaacgaaactccgaaacgaacgaaacgcgcgcgataaaaaaaaacgaacgaaaacgaaaaaacgatacgccgtaaccgaaaaaaaccgaaaataacgaaaactacgaccgccccgccctcgacccctcctccgcccgccccgaaccgctaccgaaacctcgaaaacgcctaacgcgcgcgctcccgcccgaacgcgtccccgcacgtccccgccgaaactccgaaaaaaatacgaacgaaaaacgcgaccccctaaccaaaatctaccgacaaaacgtctcccgtcgcccccataaaaaaaaatccccgcgacctccaaactacgcccacgtacgcgcaaaatcgtccgtcgccccgaacgcccgctctccgacccgaacgtaaaaaacgcctaaaaaaaaaaaaaaccgatctaaaataaacacccgacgaccgaaaaactaaacgacgtctacccccaaaaactccctaaccgtacgcgccgcgtcaacccccttaacaaaacaacgcgccgataaatataaccacgcttaaa

SEQ ID NO: 1495 - DNA, 1182 bp, Artificial Sequence
  chemically treated genomic DNA (Homo sapiens) CpG-island No: 1495
attttgttttcgggatggggtttacggtttataggcgggatggggtttaaattggattagggttttagggatataacgtcgtaagttagcggttagcgtcgtgtaattatgaattagaatttggatcggacggttagggcgttttataggagtttattcggtattaggtcgtatagaaggagatatttaacgcgaagatagaaatcgtattcgagaagtttttttttttagcggttatcgttgtagtcgggggcgtaaacggtagtttcggtaacgcgataaagtatgggcgaggtttttaatcgcgcgtgcgtcgttcggtttgacggaaggaagtggaagtattttagatttcgtttcgattttcgggcgtagcgttttgtgagcgttttttgtcggtcgtatcgtttttcgtaggtcgaggagttcggtcggttttttagtttcgcgcggtcgttcgttttcgttttcgttttcggtttcgggttttttagttcgcgttttttttttgttttttcgcggcggtattttggtatcgtatagtattcgcgttttggtggggttaggttcgaagtatagtatttttttttttgagtggaatttaaattttatgttttcgttcgcgtttatttgtttatcgtggcggagggcgaggtttcggggcgggcggagcgcgcgcggtgggggagggcgggcgggggcggggaggcggtgcgtcgtggtcggggggggtcgggaatggcggaggttgcggtcgtttcgttttcggtttttttttcgttcgtttcgagtcgttgtcgggatttcggaggcgtttggcgcgcgcgttttcgttcgggcgcgttttcgtacgttttcgtcggggtttcgggaggggtgcgggcggggagcgcgattttttggttaaggtttatcggtaggacgtttttcgtcgtttttatgggagagggttttcgcggtttttaggttgcgtttacgtgcgcgtagggtcgttcgtcgtttcgagcgttcgtttttcggttcgggcgtgggaggcgtttagggagagagagagtcggtttggagtaggtattcggcggtcgggaggttggacggcgtttgtttttaagagttttttggtcgtgcgcgtcgcgttagtttttttggtagagtagcgcgtcgatgagtgtggttacgtttgga

SEQ ID NO: 1496 - DNA, 1182 bp, Artificial Sequence
  chemically treated genomic DNA (Homo sapiens) CpG-island No: 1496
tccaaacgtaaccacactcatcgacgcgctactctaccaaaaaaactaacgcgacgcgcacgaccaaaaaactcttaaaaacaaacgccgtccaacctcccgaccgccgaatacctactccaaaccgactctctctctccctaaacgcctcccacgcccgaaccgaaaaacgaacgctcgaaacgacgaacgaccctacgcgcacgtaaacgcaacctaaaaaccgcgaaaaccctctcccataaaaacgacgaaaaacgtcctaccgataaaccttaaccaaaaaatcgcgctccccgcccgcacccctcccgaaaccccgacgaaaacgtacgaaaacgcgcccgaacgaaaacgcgcgcgccaaacgcctccgaaatcccgacaacgactcgaaacgaacgaaaaaaaaaccgaaaacgaaacgaccgcaacctccgccattcccgaccccccccgaccacgacgcaccgcctccccgcccccgcccgccctcccccaccgcgcgcgctccgcccgccccgaaacctcgccctccgccacgataaacaaataaacgcgaacgaaaacataaaatttaaattccactcaaaaaaaaaaatactatacttcgaacctaaccccaccaaaacgcgaatactatacgataccaaaataccgccgcgaaaaaacaaaaaaaaaacgcgaactaaaaaacccgaaaccgaaaacgaaaacgaaaacgaacgaccgcgcgaaactaaaaaaccgaccgaactcctcgacctacgaaaaacgatacgaccgacaaaaaacgctcacaaaacgctacgcccgaaaatcgaaacgaaatctaaaatacttccacttccttccgtcaaaccgaacgacgcacgcgcgattaaaaacctcgcccatactttatcgcgttaccgaaactaccgtttacgcccccgactacaacgataaccgctaaaaaaaaaaacttctcgaatacgatttctatcttcgcgttaaatatctccttctatacgacctaataccgaataaactcctataaaacgccctaaccgtccgatccaaattctaattcataattacacgacgctaaccgctaacttacgacgttatatccctaaaaccctaatccaatttaaaccccatcccgcctataaaccgtaaaccccatcccgaaaacaaaat

SEQ ID NO: 1497 - DNA, 532 bp, Artificial Sequence
  chemically treated genomic DNA (Homo sapiens) CpG-island No: 1497
aggtcgggagtttcgcgtcggagtaggaaaatttttcgttaagtttcgtaaaggagcgggatatagcgcgcgttttcgcgagggtcgtcgagtttcgagagtcgttttcgtttcggaggtttcgtaacggtatttcgggcgttacgtacgcgttgttttggcgtgtaggagtcgcggtcgcgcggcgagggatatttagtaggattcgcgttcggcgatttgtttcgtttcggtcgtttttcgtttcggtcggcgttgtagtaggtggcggtttcgcgcgttttgttttttttcgcggttcgcggttcggttttcgtgggaggtttttagtatcggagttagcgcggttttcgacgttattttcgggattcgtgggtttcgtatttatgtttcgcgggatcggtaattcgttcgacgaggacgtcggttatcgtggtaagtaaatgtttttattcgaatgtgcgcgcgagttatttttagtttaatatgggtttcgtatttttttttaaatcgtttttttcgtttgatattt

SEQ ID NO: 1498 - DNA, 532 bp, Artificial Sequence
  chemically treated genomic DNA (Homo sapiens) CpG-island No: 1498
aaatatcaaacgaaaaaaacgatttaaaaaaaaatacgaaacccatattaaactaaaaataactcgcgcgcacattcgaataaaaacatttacttaccacgataaccgacgtcctcgtcgaacgaattaccgatcccgcgaaacataaatacgaaacccacgaatcccgaaaataacgtcgaaaaccgcgctaactccgatactaaaaacctcccacgaaaaccgaaccgcgaaccgcgaaaaaaaacaaaacgcgcgaaaccgccacctactacaacgccgaccgaaacgaaaaacgaccgaaacgaaacaaatcgccgaacgcgaatcctactaaatatccctcgccgcgcgaccgcgactcctacacgccaaaacaacgcgtacgtaacgcccgaaataccgttacgaaacctccgaaacgaaaacgactctcgaaactcgacgaccctcgcgaaaacgcgcgctatatcccgctcctttacgaaacttaacgaaaaattttcctactccgacgcgaaactcccgacct

SEQ ID NO: 1499 - DNA, 532 bp, Artificial Sequence
  chemically treated genomic DNA (Homo sapiens) CpG-island No: 1499
agatattagacgaagggggcggtttaagagagggtgcgaaatttatgttagattagggatagttcgcgcgtatattcgggtagaaatatttgtttattacggtgatcggcgttttcgtcgagcgagttgtcggtttcgcggggtatgggtgcggggtttacgggtttcggggatggcgtcggaaatcgcgttaatttcggtattgagagttttttacgagggtcggatcgcgggtcgcgagggagggtagggcgcgcgggatcgttatttgttgtagcgtcggtcgaggcggggagcggtcggggcgagataggtcgtcgggcgcgggttttgttgggtgtttttcgtcgcgcggtcgcggtttttgtacgttagggtagcgcgtgcgtggcgttcggggtgtcgttacggggttttcggggcgggggcgattttcgggattcggcggttttcgcggaggcgcgcgttgtgtttcgtttttttacggaatttgacgaaaagtttttttatttcgacgcgaggttttcggttt

SEQ ID NO: 1500 - DNA, 532 bp, Artificial Sequence
  chemically treated genomic DNA (Homo sapiens) CpG-island No: 1500
aaaccgaaaacctcgcgtcgaaataaaaaaacttttcgtcaaattccgtaaaaaaacgaaacacaacgcgcgcctccgcgaaaaccgccgaatcccgaaaatcgcccccgccccgaaaaccccgtaacgacaccccgaacgccacgcacgcgctaccctaacgtacaaaaaccgcgaccgcgcgacgaaaaacacccaacaaaacccgcgcccgacgacctatctcgccccgaccgctccccgcctcgaccgacgctacaacaaataacgatcccgcgcgccctaccctccctcgcgacccgcgatccgaccctcgtaaaaaactctcaataccgaaattaacgcgatttccgacgccatccccgaaacccgtaaaccccgcacccataccccgcgaaaccgacaactcgctcgacgaaaacgccgatcaccgtaataaacaaatatttctacccgaatatacgcgcgaactatccctaatctaacataaatttcgcaccctctcttaaaccgcccccttcgtctaatatct

SEQ ID NO: 1501 - DNA, 523 bp, Artificial Sequence
  chemically treated genomic DNA (Homo sapiens) CpG-island No: 1501
tcggtcgcgcgttttcgtattaggcggatttttagtagatcgattattttttgatcgtagaacgttcgtattttttttttagttatcggtttatatagtcgggtttttattaagtatcgatttagtattcgggaggttatcggtaatttcgatttgagatgtttttttaaattcgggcgagttttaattcgaggtcgcggtttacgttcggaaatacgtagtcgacggcgttatcgtatatacggtcgaaaggagttataggatgttagtcgcgtacgcgtcggatatatataggaggtcgttcggttattatcgtagacgtcgttcgtagattcgttagcggtttagttatgtttagaaagaatagtcgcgttcgtaagggcgcgtcgttttttcgcgttttttcgggtttcgttttttttcggtagtaaattataattataacgatttatttttcgagcggtcgtcgcgtattaagtatcgcgttaggtttttaaatacgttttttattatatatttttta

SEQ ID NO: 1502 - DNA, 523 bp, Artificial Sequence
  chemically treated genomic DNA (Homo sapiens) CpG-island No: 1502
taaaaaatatataataaaaaacgtatttaaaaacctaacgcgatacttaatacgcgacgaccgctcgaaaaataaatcgttataattataatttactaccgaaaaaaaacgaaacccgaaaaaacgcgaaaaaacgacgcgcccttacgaacgcgactattctttctaaacataactaaaccgctaacgaatctacgaacgacgtctacgataataaccgaacgacctcctatatatatccgacgcgtacgcgactaacatcctataactcctttcgaccgtatatacgataacgccgtcgactacgtatttccgaacgtaaaccgcgacctcgaattaaaactcgcccgaatttaaaaaaacatctcaaatcgaaattaccgataacctcccgaatactaaatcgatacttaataaaaacccgactatataaaccgataactaaaaaaaaaatacgaacgttctacgatcaaaaaataatcgatctactaaaaatccgcctaatacgaaaacgcgcgaccga

SEQ ID NO: 1503 - DNA, 523 bp, Artificial Sequence
  chemically treated genomic DNA (Homo sapiens) CpG-island No: 1503
tgggaggtatgtagtagagggcgtgtttggaggtttgacgcgatatttaatgcgcgacgatcgttcggggggtaagtcgttgtaattatagtttattatcggggaggggcgggattcgaagggacgcgaaaggacgacgcgtttttgcggacgcgattattttttttaggtataattaagtcgttaacgaatttacgagcgacgtttacgatgatggtcgagcggttttttatatatattcgacgcgtgcgcgattaatattttgtaatttttttcggtcgtatatacgatagcgtcgtcgattacgtattttcgagcgtaggtcgcggtttcgggttaggattcgttcgagtttgggagggtattttaaatcggaattgtcgatagtttttcgaatattaggtcggtatttaatggaggttcgattatatgggtcgataattaaggggaggatacgagcgttttacggttagagaatggtcggtttattaggggttcgtttaatgcgggggcgcgcggtcga

SEQ ID NO: 1504 - DNA, 523 bp, Artificial Sequence
  chemically treated genomic DNA (Homo sapiens) CpG-island No: 1504
tcgaccgcgcgcccccgcattaaacgaacccctaataaaccgaccattctctaaccgtaaaacgctcgtatcctccccttaattatcgacccatataatcgaacctccattaaataccgacctaatattcgaaaaactatcgacaattccgatttaaaataccctcccaaactcgaacgaatcctaacccgaaaccgcgacctacgctcgaaaatacgtaatcgacgacgctatcgtatatacgaccgaaaaaaattacaaaatattaatcgcgcacgcgtcgaatatatataaaaaaccgctcgaccatcatcgtaaacgtcgctcgtaaattcgttaacgacttaattatacctaaaaaaaataatcgcgtccgcaaaaacgcgtcgtcctttcgcgtcccttcgaatcccgcccctccccgataataaactataattacaacgacttaccccccgaacgatcgtcgcgcattaaatatcgcgtcaaacctccaaacacgccctctactacatacctccca

SEQ ID NO: 1505 - DNA, 680 bp, Artificial Sequence
  chemically treated genomic DNA (Homo sapiens) CpG-island No: 1505
ttagggggcggaacggcggaggagagggttagcgaaaggttcgtttcgcgagcgtattttttttttaacgttcggaagattttattagtaaggttattcgattcggagtttttttcgcgagtttttaaattatcgatttaatttcgtcgtcgtcgtcgtcgaggtataatatataaatcgcgatcgtcgagcgtcgaggaaggattcggagaggtacgggaatatgaggtcgtagggttcgtattcgggaaggagatcggtgacgaggtggtagggtcgggaaggtttcggtcgataggtcgtcgttgcggttacgttttttcgcggagcgatcgtttcgggttttatttatagtcgacgcgttagattagacgcggttcgaaatttttcgggtagcgggaattgacgagaagcgttaagtaggatagtaggaattatttttttaagcgtacgtggttgtttagaatagcggtttttagatttaggcgcgtattggagttatcgtagggtttgtcgaattagagatcgtcggattttatttggggtttacggttttataggttcgggcgggatttaagaaattcgcgtttttagttagcgtttaggtgacgttgtcgtcggtttagattttttattcgagaattatagggttcgattgtatttattaatcggtttttttt

SEQ ID NO: 1506 - DNA, 680 bp, Artificial Sequence
  chemically treated genomic DNA (Homo sapiens) CpG-island No: 1506
aaaaaaaaccgattaataaatacaatcgaaccctataattctcgaataaaaaatctaaaccgacgacaacgtcacctaaacgctaactaaaaacgcgaatttcttaaatcccgcccgaacctataaaaccgtaaaccccaaataaaatccgacgatctctaattcgacaaaccctacgataactccaatacgcgcctaaatctaaaaaccgctattctaaacaaccacgtacgcttaaaaaaataattcctactatcctacttaacgcttctcgtcaattcccgctacccgaaaaatttcgaaccgcgtctaatctaacgcgtcgactataaataaaacccgaaacgatcgctccgcgaaaaaacgtaaccgcaacgacgacctatcgaccgaaaccttcccgaccctaccacctcgtcaccgatctccttcccgaatacgaaccctacgacctcatattcccgtacctctccgaatccttcctcgacgctcgacgatcgcgatttatatattatacctcgacgacgacgacgacgaaattaaatcgataatttaaaaactcgcgaaaaaaactccgaatcgaataaccttactaataaaatcttccgaacgttaaaaaaaaaatacgctcgcgaaacgaacctttcgctaaccctctcctccgccgttccgccccctaa

SEQ ID NO: 1507 - DNA, 680 bp, Artificial Sequence
  chemically treated genomic DNA (Homo sapiens) CpG-island No: 1507
aagaaaaatcggttggtaggtgtagtcgggttttataattttcggataaaaggtttaagtcgacgataacgttatttaaacgttaattgagggcgcgggttttttagatttcgttcgagtttgtaaggtcgtgggttttaaataaagttcgacggtttttaattcggtagattttacgataattttagtacgcgtttaagtttagaggtcgttattttaggtaattacgtacgtttgagggaatagtttttattattttgtttggcgtttttcgttaattttcgttgttcgaaagatttcgggtcgcgtttaatttgacgcgtcgattgtaaataaaattcgagacgatcgtttcgcgggaaaacgtggtcgtagcggcgatttgtcgatcgggattttttcgattttattatttcgttatcgatttttttttcgggtgcgagttttacgattttatattttcgtattttttcgggttttttttcggcgttcggcgatcgcggtttgtgtgttgtgtttcggcggcggcggcggcggggttggatcggtggtttgagggttcgcgggaggggtttcgaatcgggtaattttgttaataggatttttcgggcgttggaaggagggtgcgttcgcgaggcgagtttttcgttgattttttttttcgtcgtttcgttttttaa

SEQ ID NO: 1508 - DNA, 680 bp, Artificial Sequence
  chemically treated genomic DNA (Homo sapiens) CpG-island No: 1508
ttaaaaaacgaaacgacgaaaaaaaaaatcaacgaaaaactcgcctcgcgaacgcaccctccttccaacgcccgaaaaatcctattaacaaaattacccgattcgaaacccctcccgcgaaccctcaaaccaccgatccaaccccgccgccgccgccgccgaaacacaacacacaaaccgcgatcgccgaacgccgaaaaaaaacccgaaaaaatacgaaaatataaaatcgtaaaactcgcacccgaaaaaaaaatcgataacgaaataataaaatcgaaaaaatcccgatcgacaaatcgccgctacgaccacgttttcccgcgaaacgatcgtctcgaattttatttacaatcgacgcgtcaaattaaacgcgacccgaaatctttcgaacaacgaaaattaacgaaaaacgccaaacaaaataataaaaactattccctcaaacgtacgtaattacctaaaataacgacctctaaacttaaacgcgtactaaaattatcgtaaaatctaccgaattaaaaaccgtcgaactttatttaaaacccacgaccttacaaactcgaacgaaatctaaaaaacccgcgccctcaattaacgtttaaataacgttatcgtcgacttaaaccttttatccgaaaattataaaacccgactacacctaccaaccgatttttctt

SEQ ID NO: 1509 - DNA, 656 bp, Artificial Sequence
  chemically treated genomic DNA (Homo sapiens) CpG-island No: 1509
acggcggcgggaggtttttggggttgggaggggtgcgggcgtgggcggggcgcgagtagtaggggcgcgggttcgggttttaggttgtggggtcgggagtgcggggcgggattgttgcggtttcgcgttttgtggagtttgcggcgcggggagtgggggtcggggcggggaggaacgtggggtgcgggataggaggggggtagggagggagaagaaggcggcgcggggcggggcgggcgtagggttggggacggtacgggcgggcggtacgggcgttggcgcgtgcggggggggcggcgcggttttcggaagcgagggggcgttgtgttaggcggcggtcgtgcggggcgggcgcgttgtttttttcgtttcgcggatttcggaagcgcgcgtggtcgttatggcgcggaatgtggtgtgagtaggggtcgttattttttcgtcgcggggcgttttttagtgttataagtagacggattttatagggcgcgcggatttcggggagcggggtgggcgtttttgggtcgttttttggttcgggcgaggtagggtttttcgggattttttgttatgttttgagatacgcgaggcgggtggcggaggagtttttcgttaggtttagggtaattttagggggcgggcgtggtcgggttggg

SEQ ID NO: 1510 - DNA, 656 bp, Artificial Sequence
  chemically treated genomic DNA (Homo sapiens) CpG-island No: 1510
cccaacccgaccacgcccgccccctaaaattaccctaaacctaacgaaaaactcctccgccacccgcctcgcgtatctcaaaacataacaaaaaatcccgaaaaaccctacctcgcccgaaccaaaaaacgacccaaaaacgcccaccccgctccccgaaatccgcgcgccctataaaatccgtctacttataacactaaaaaacgccccgcgacgaaaaaataacgacccctactcacaccacattccgcgccataacgaccacgcgcgcttccgaaatccgcgaaacgaaaaaaacaacgcgcccgccccgcacgaccgccgcctaacacaacgccccctcgcttccgaaaaccgcgccgccccccccgcacgcgccaacgcccgtaccgcccgcccgtaccgtccccaaccctacgcccgccccgccccgcgccgccttcttctccctccctacccccctcctatcccgcaccccacgttcctccccgccccgacccccactccccgcgccgcaaactccacaaaacgcgaaaccgcaacaatcccgccccgcactcccgaccccacaacctaaaacccgaacccgcgcccctactactcgcgccccgcccacgcccgcacccctcccaaccccaaaaacctcccgccgccgt

SEQ ID NO: 1511 - DNA, 656 bp, Artificial Sequence
  chemically treated genomic DNA (Homo sapiens) CpG-island No: 1511
tttagttcggttacgttcgttttttggggttgttttaaatttggcggggggttttttcgttattcgtttcgcgtgttttaaggtatgatagggggtttcggagaattttgtttcgttcgggttaggaggcggtttagggacgtttatttcgtttttcggagttcgcgcgttttgtggggttcgtttgtttgtgatattaaggggcgtttcgcgacgggggggtgacgatttttatttatattatatttcgcgttatggcggttacgcgcgttttcggggttcgcgaggcggaaggagtagcgcgttcgtttcgtacggtcgtcgtttggtatagcgttttttcgttttcggaggtcgcgtcgtttttttcgtacgcgttagcgttcgtgtcgttcgttcgtgtcgtttttagttttgcgttcgtttcgtttcgcgtcgtttttttttttttttttgttttttttttgtttcgtattttacgttttttttcgtttcgatttttatttttcgcgtcgtagattttataggacgcggggtcgtagtagtttcgtttcgtattttcggttttatagtttgaagttcgggttcgcgtttttgttgttcgcgtttcgtttacgttcgtattttttttagttttagagatttttcgtcgtcgt

SEQ ID NO: 1512 - DNA, 656 bp, Artificial Sequence
  chemically treated genomic DNA (Homo sapiens) CpG-island No: 1512
acgacgacgaaaaatctctaaaactaaaaaaaatacgaacgtaaacgaaacgcgaacaacaaaaacgcgaacccgaacttcaaactataaaaccgaaaatacgaaacgaaactactacgaccccgcgtcctataaaatctacgacgcgaaaaataaaaatcgaaacgaaaaaaaacgtaaaatacgaaacaaaaaaaaaacaaaaaaaaaaaaaaaaacgacgcgaaacgaaacgaacgcaaaactaaaaacgacacgaacgaacgacacgaacgctaacgcgtacgaaaaaaacgacgcgacctccgaaaacgaaaaaacgctataccaaacgacgaccgtacgaaacgaacgcgctactccttccgcctcgcgaaccccgaaaacgcgcgtaaccgccataacgcgaaatataatataaataaaaatcgtcacccccccgtcgcgaaacgccccttaatatcacaaacaaacgaaccccacaaaacgcgcgaactccgaaaaacgaaataaacgtccctaaaccgcctcctaacccgaacgaaacaaaattctccgaaaccccctatcataccttaaaacacgcgaaacgaataacgaaaaaaccccccgccaaatttaaaacaaccccaaaaaacgaacgtaaccgaactaaa

SEQ ID NO: 1513 - DNA, 677 bp, Artificial Sequence
  chemically treated genomic DNA (Homo sapiens) CpG-island No: 1513
tgatgtcgcgagagaggtggttttgcgtaaatggggggtttggggcgagaatgggtcgcgtatacgtaaaagcgtatacgttagtaaagatgggggttataacgtgtgaatacgtggtgttagcgtcggtgaataatattttgtttgcgtcgagaaacgacggtttatttaagaagcgtttgtcggagatgagaatttttttaagtgtaattcgttgcgggaagttttatggaaaggtagaagtcgcgagagggcgggagacgtttgggggcgcgggaaatcggagagggttgtgtagcgagtgtggtatcgcggtgtgtcggcgtaaaaaagagagtatcgtcgaggagtagcgcgcgaaattagtggggcgtatagagagattttgcgtggggggggtttgtagaacggtcgtaaaaaaatcgcgtgacgcggtggagttcgttacggggggggggtcgtataagaggcgtagaatgtgcgttttacgggtggcgtatgttagagatcgtgtgatattaagtgtagtgtacgtgcgcgcgggagggtgtgtagacggtggaggagttcgagatcggcgagacgtaggggtgtttgggggggtataaaaattgcgtgatgggggagagtttgttataaacgtttagagcgtaagagcgggggtggttttaatatat

SEQ ID NO: 1514 - DNA, 677 bp, Artificial Sequence
  chemically treated genomic DNA (Homo sapiens) CpG-island No: 1514
atatattaaaaccacccccgctcttacgctctaaacgtttataacaaactctcccccatcacgcaatttttatacccccccaaacacccctacgtctcgccgatctcgaactcctccaccgtctacacaccctcccgcgcgcacgtacactacacttaatatcacacgatctctaacatacgccacccgtaaaacgcacattctacgcctcttatacgaccccccccccgtaacgaactccaccgcgtcacgcgatttttttacgaccgttctacaaaccccccccacgcaaaatctctctatacgccccactaatttcgcgcgctactcctcgacgatactctcttttttacgccgacacaccgcgataccacactcgctacacaaccctctccgatttcccgcgcccccaaacgtctcccgccctctcgcgacttctacctttccataaaacttcccgcaacgaattacacttaaaaaaattctcatctccgacaaacgcttcttaaataaaccgtcgtttctcgacgcaaacaaaatattattcaccgacgctaacaccacgtattcacacgttataacccccatctttactaacgtatacgcttttacgtatacgcgacccattctcgccccaaaccccccatttacgcaaaaccacctctctcgcgacatca

SEQ ID NO: 1515 - DNA, 677 bp, Artificial Sequence
  chemically treated genomic DNA (Homo sapiens) CpG-island No: 1515
gtgtgttggagttattttcgtttttgcgttttaggcgtttgtgataagtttttttttattacgtaatttttgtatttttttaggtatttttgcgtttcgtcgatttcggatttttttatcgtttatatattttttcgcgcgtacgtgtattatatttggtgttatacggtttttgatatacgttattcgtggagcgtatattttgcgttttttgtgcgatttttttttcgtggcgagttttatcgcgttacgcggtttttttgcggtcgttttgtagattttttttacgtagggtttttttgtgcgttttattggtttcgcgcgttgtttttcgacgatgtttttttttttgcgtcgatatatcgcgatgttatattcgttatataatttttttcgatttttcgcgtttttaagcgtttttcgttttttcgcgatttttgtttttttatgaagtttttcgtaacgggttatatttggggaggtttttattttcggtaggcgttttttgggtgggtcgtcgtttttcggcgtaaataaaatgttgtttatcggcgttggtattacgtgtttatacgttgtaatttttatttttattggcgtgtgcgtttttacgtgtgcgcggtttattttcgttttaggttttttatttgcgtaaggttatttttttcgcgatatta

SEQ ID NO: 1516 - DNA, 677 bp, Artificial Sequence
  chemically treated genomic DNA (Homo sapiens) CpG-island No: 1516
taatatcgcgaaaaaaataaccttacgcaaataaaaaacctaaaacgaaaataaaccgcgcacacgtaaaaacgcacacgccaataaaaataaaaattacaacgtataaacacgtaataccaacgccgataaacaacattttatttacgccgaaaaacgacgacccacccaaaaaacgcctaccgaaaataaaaacctccccaaatataacccgttacgaaaaacttcataaaaaaacaaaaatcgcgaaaaaacgaaaaacgcttaaaaacgcgaaaaatcgaaaaaaattatataacgaatataacatcgcgatatatcgacgcaaaaaaaaaaacatcgtcgaaaaacaacgcgcgaaaccaataaaacgcacaaaaaaaccctacgtaaaaaaaatctacaaaacgaccgcaaaaaaaccgcgtaacgcgataaaactcgccacgaaaaaaaaatcgcacaaaaaacgcaaaatatacgctccacgaataacgtatatcaaaaaccgtataacaccaaatataatacacgtacgcgcgaaaaaatatataaacgataaaaaaatccgaaatcgacgaaacgcaaaaatacctaaaaaaatacaaaaattacgtaataaaaaaaaacttatcacaaacgcctaaaacgcaaaaacgaaaataactccaacacac

SEQ ID NO: 1517 - DNA, 594 bp, Artificial Sequence
  chemically treated genomic DNA (Homo sapiens) CpG-island No: 1517
gacgttggagaaggcggagtgaaggaattcgaggtcgagtggaaaaagttcgtgaacgggtaatacgtattttgcgatacgaagtttttcgagtatcgttgtggtttcggtttcgagttgcggtacggaaatgagtaattatagtttttgtttagggtatattcggttcggttcggtttcgttgcgtgattttggataaagttcgagtttttttggtcgtttttttaatcgtataagttgcggttgtttttgcgttcgtgagcgtcgagatcgtgaatgcgcgcgaggcgtcgtcgtaggttttggattatacgcgtacgtgggttatcgtatttttcgagttaaacgtttttcgcgttgcggttttttttttttgatacggcgttcgttcgttttacgttttttaagttttgagttggtagtttggtagtagagtaggttttagcggggcggttcgcgtttcgcggcggggaatcgcgagttcggagatgtttagtttcggggtcgaggtcgggaaggaggtttcggggtcgggaaaggtttttatcggagcgggaggtcgcgttgttatttttatttagggagattaagtgt

SEQ ID NO: 1518 - DNA, 594 bp, Artificial Sequence
  chemically treated genomic DNA (Homo sapiens) CpG-island No: 1518
acacttaatctccctaaataaaaataacaacgcgacctcccgctccgataaaaacctttcccgaccccgaaacctccttcccgacctcgaccccgaaactaaacatctccgaactcgcgattccccgccgcgaaacgcgaaccgccccgctaaaacctactctactaccaaactaccaactcaaaacttaaaaaacgtaaaacgaacgaacgccgtatcaaaaaaaaaaaaccgcaacgcgaaaaacgtttaactcgaaaaatacgataacccacgtacgcgtataatccaaaacctacgacgacgcctcgcgcgcattcacgatctcgacgctcacgaacgcaaaaacaaccgcaacttatacgattaaaaaaacgaccaaaaaaactcgaactttatccaaaatcacgcaacgaaaccgaaccgaaccgaatataccctaaacaaaaactataattactcatttccgtaccgcaactcgaaaccgaaaccacaacgatactcgaaaaacttcgtatcgcaaaatacgtattacccgttcacgaactttttccactcgacctcgaattccttcactccgccttctccaacgtc

SEQ ID NO: 1519 - DNA, 594 bp, Artificial Sequence
  chemically treated genomic DNA (Homo sapiens) CpG-island No: 1519
gtatttggtttttttgggtggaggtggtagcgcgatttttcgtttcgatgggggtttttttcggtttcggggtttttttttcggtttcggtttcggagttgggtattttcgggttcgcggtttttcgtcgcgggacgcggatcgtttcgttggggtttgttttgttgttaggttgttagtttagggtttgggaagcgtggagcgggcgggcgtcgtgttaggaggagaggatcgtagcgcggggggcgtttggttcggaaggtacggtggtttacgtgcgcgtgtggtttagggtttgcggcgacgtttcgcgcgtatttacggtttcggcgtttacgggcgtagaggtagtcgtaatttgtgcggttgaagaagcgattaaagaagttcgagttttgtttaaggttacgtagcgaggtcgagtcgggtcgggtgtgttttgggtaggagttgtggttatttattttcgtgtcgtagttcgaggtcggggttatagcggtgttcgggaaatttcgtgtcgtaaggtgcgtgttgttcgtttacgggttttttttattcgatttcgaatttttttatttcgttttttttagcgtt

SEQ ID NO: 1520 - DNA, 594 bp, Artificial Sequence
  chemically treated genomic DNA (Homo sapiens) CpG-island No: 1520
aacgctaaaaaaaacgaaataaaaaaattcgaaatcgaataaaaaaaacccgtaaacgaacaacacgcaccttacgacacgaaatttcccgaacaccgctataaccccgacctcgaactacgacacgaaaataaataaccacaactcctacccaaaacacacccgacccgactcgacctcgctacgtaaccttaaacaaaactcgaacttctttaatcgcttcttcaaccgcacaaattacgactacctctacgcccgtaaacgccgaaaccgtaaatacgcgcgaaacgtcgccgcaaaccctaaaccacacgcgcacgtaaaccaccgtaccttccgaaccaaacgccccccgcgctacgatcctctcctcctaacacgacgcccgcccgctccacgcttcccaaaccctaaactaacaacctaacaacaaaacaaaccccaacgaaacgatccgcgtcccgcgacgaaaaaccgcgaacccgaaaatacccaactccgaaaccgaaaccgaaaaaaaaaccccgaaaccgaaaaaaacccccatcgaaacgaaaaatcgcgctaccacctccacccaaaaaaaccaaatac

SEQ ID NO: 1521 - DNA, 885 bp, Artificial Sequence
  chemically treated genomic DNA (Homo sapiens) CpG-island No: 1521
cggtttcgttcgggtgtttcgcggtgtttcgggtaggggtcgcggcgagcgcgtggaggttatttacgttgttgttttcgttcgtttagtgtattatcgtttggttgtgcgtcgcgttttttttgagtacgaacgacgtgttgatgagcgagatttgcgttcgcgaagttatttcggttagcggcgtcgttcgtttttagcgtcggtagttcgcggcgggggcgtcgttttcgtcgggattaggagcgggatcgggattcggattcggggcgtttggtttcgtgtcgcgcgtttgtcggttttcgtcgttatcgggtttcgcgcgtttcgcgggagggtttcgcggtattcgggttagttgggcgtgaggatttaggcgttcgggtttaggggagcgtttcgtcgtttcgtaggcgtttagtagtagtagtagtagtaggagcggtcgcgagcgcggcgagcgcggtggcggcggagtttcggggttcggggttcgggcggtggggtcggggtttttttatgtgcgcgagggttttcggtgcgttatggtcgttaggggcggtagcggagtcggcggcggggcggcgcgaacgaggggatcgcggtcgggaaagtaggagggcgttggggagcgcgagcgagagcgtagagaaaggagtcggcgaggggagggaacggcgggagaaggggattcggcggtttcggcgttattcgcgacgtcgagcgcgtatcgttatttgtcggtcggttcgtcgtttaggcgttcgtgggaagttcggcgtattcgagcgcggttttatttttaggttaggattttttttttagttcggtggttttttcggttttttttttcggtttttttattttttttcgtttttttttttt

SEQ ID NO: 1522 - DNA, 885 bp, Artificial Sequence
  chemically treated genomic DNA (Homo sapiens) CpG-island No: 1522
aaaaaaaaaaaacgaaaaaaaataaaaaaaccgaaaaaaaaaaccgaaaaaaccaccgaactaaaaaaaaaatcctaacctaaaaataaaaccgcgctcgaatacgccgaacttcccacgaacgcctaaacgacgaaccgaccgacaaataacgatacgcgctcgacgtcgcgaataacgccgaaaccgccgaatccccttctcccgccgttccctcccctcgccgactcctttctctacgctctcgctcgcgctccccaacgccctcctactttcccgaccgcgatcccctcgttcgcgccgccccgccgccgactccgctaccgcccctaacgaccataacgcaccgaaaaccctcgcgcacataaaaaaaccccgaccccaccgcccgaaccccgaaccccgaaactccgccgccaccgcgctcgccgcgctcgcgaccgctcctactactactactactactaaacgcctacgaaacgacgaaacgctcccctaaacccgaacgcctaaatcctcacgcccaactaacccgaataccgcgaaaccctcccgcgaaacgcgcgaaacccgataacgacgaaaaccgacaaacgcgcgacacgaaaccaaacgccccgaatccgaatcccgatcccgctcctaatcccgacgaaaacgacgcccccgccgcgaactaccgacgctaaaaacgaacgacgccgctaaccgaaataacttcgcgaacgcaaatctcgctcatcaacacgtcgttcgtactcaaaaaaaacgcgacgcacaaccaaacgataatacactaaacgaacgaaaacaacaacgtaaataacctccacgcgctcgccgcgacccctacccgaaacaccgcgaaacacccgaacgaaaccg

SEQ ID NO: 1523 - DNA, 885 bp, Artificial Sequence
  chemically treated genomic DNA (Homo sapiens) CpG-island No: 1523
agggagggaggacgggaagaggtgggagagtcgggaaggaagatcggaggaattatcgagttgggaaggggattttggtttggaggtggggtcgcgttcgggtacgtcgggttttttacgagcgtttgggcggcgggtcggtcggtaggtggcggtgcgcgttcggcgtcgcgggtggcgtcggggtcgtcgagtttttttttttcgtcgtttttttttttcgtcggtttttttttttgcgttttcgttcgcgttttttagcgtttttttgttttttcggtcgcggttttttcgttcgcgtcgtttcgtcgtcggtttcgttgtcgtttttggcgattatggcgtatcgggggttttcgcgtatatagaagggtttcggttttatcgttcgagtttcgagtttcggggtttcgtcgttatcgcgttcgtcgcgttcgcggtcgtttttgttgttgttgttgttgttgggcgtttgcggggcggcggggcgtttttttgagttcgggcgtttgggtttttacgtttaattgattcgggtgtcgcggagttttttcgcggggcgcgcggagttcggtggcggcgaggatcggtaggcgcgcggtacggagttaggcgtttcgggttcgagtttcggtttcgtttttggtttcggcgaggacggcgttttcgtcgcgggttatcggcgttgggagcgggcggcgtcgttggtcggagtggtttcgcgggcgtaggtttcgtttattagtacgtcgttcgtgtttaagggggacgcgacgtataattaggcgatggtgtattggacgggcgagaatagtagcgtaagtgatttttacgcgttcgtcgcggtttttattcgggatatcgcgggatattcgggcgggatcg

SEQ ID NO: 1524 - DNA, 885 bp, Artificial Sequence
  chemically treated genomic DNA (Homo sapiens) CpG-island No: 1524
cgatcccgcccgaatatcccgcgatatcccgaataaaaaccgcgacgaacgcgtaaaaatcacttacgctactattctcgcccgtccaatacaccatcgcctaattatacgtcgcgtcccccttaaacacgaacgacgtactaataaacgaaacctacgcccgcgaaaccactccgaccaacgacgccgcccgctcccaacgccgataacccgcgacgaaaacgccgtcctcgccgaaaccaaaaacgaaaccgaaactcgaacccgaaacgcctaactccgtaccgcgcgcctaccgatcctcgccgccaccgaactccgcgcgccccgcgaaaaaactccgcgacacccgaatcaattaaacgtaaaaacccaaacgcccgaactcaaaaaaacgccccgccgccccgcaaacgcccaacaacaacaacaacaacaaaaacgaccgcgaacgcgacgaacgcgataacgacgaaaccccgaaactcgaaactcgaacgataaaaccgaaacccttctatatacgcgaaaacccccgatacgccataatcgccaaaaacgacaacgaaaccgacgacgaaacgacgcgaacgaaaaaaccgcgaccgaaaaaacaaaaaaacgctaaaaaacgcgaacgaaaacgcaaaaaaaaaaaccgacgaaaaaaaaaaacgacgaaaaaaaaaaactcgacgaccccgacgccacccgcgacgccgaacgcgcaccgccacctaccgaccgacccgccgcccaaacgctcgtaaaaaacccgacgtacccgaacgcgaccccacctccaaaccaaaatccccttcccaactcgataattcctccgatcttccttcccgactctcccacctcttcccgtcctccctccct

SEQ ID NO: 1525 - DNA, 548 bp, Artificial Sequence
  chemically treated genomic DNA (Homo sapiens) CpG-island No: 1525
aggcggtgtcgttttaggcgttgtggtggggtcgcgtataggttgtttgggtgattttaggagggcgaagttttacgacgtaggtttggggcggttttgtttaattttttgcgtatttcgggtgtttagaaacgtaggttgaacgttggagttcggggcgttttcggtgtcggaagcggtcgtgcggtcggagtttcggggagggatagtcgggtagaggagtcgggttttggggttttagtcgtttgtaggggttttcgggttttcgtttttttacgcggagggcgtgaagcggcggggacgcggttggggagtttttttcgcggcggtgaggacgcggcgtcgttttttttcggtgttgtttatttggaagtcggaggtcgttgggggtttggggcggttgtacgtttcggggtggggggatgcgggagttcggttaggtttagtcgtttttttcggtggtgaggagcgttgtgtcgggtttcgggggttttacgtttttagttgtcgggtttgttttcggttataataaggttttgatttagttt

SEQ ID NO: 1526 - DNA, 548 bp, Artificial Sequence
  chemically treated genomic DNA (Homo sapiens) CpG-island No: 1526
aaactaaatcaaaaccttattataaccgaaaacaaacccgacaactaaaaacgtaaaacccccgaaacccgacacaacgctcctcaccaccgaaaaaaacgactaaacctaaccgaactcccgcatccccccaccccgaaacgtacaaccgccccaaacccccaacgacctccgacttccaaataaacaacaccgaaaaaaaacgacgccgcgtcctcaccgccgcgaaaaaaactccccaaccgcgtccccgccgcttcacgccctccgcgtaaaaaaacgaaaacccgaaaacccctacaaacgactaaaaccccaaaacccgactcctctacccgactatccctccccgaaactccgaccgcacgaccgcttccgacaccgaaaacgccccgaactccaacgttcaacctacgtttctaaacacccgaaatacgcaaaaaattaaacaaaaccgccccaaacctacgtcgtaaaacttcgccctcctaaaatcacccaaacaacctatacgcgaccccaccacaacgcctaaaacgacaccgcct

SEQ ID NO: 1527 - DNA, 548 bp, Artificial Sequence
  chemically treated genomic DNA (Homo sapiens) CpG-island No: 1527
gagttgggttagggttttgttgtggtcgggggtaggttcggtagttgaaagcgtaagattttcggagttcggtatagcgttttttattatcgggaaaggcggttgggtttgatcgggttttcgtatttttttatttcggagcgtgtagtcgttttaaatttttagcggttttcggtttttaggtgagtagtatcggaagggagcggcgtcgcgtttttatcgtcgcggggggggttttttagtcgcgttttcgtcgttttacgtttttcgcgtggaaggacgggggttcggggatttttgtaaacggttgagattttaaagttcggtttttttgttcggttgttttttttcggagtttcggtcgtacggtcgttttcggtatcgaggacgtttcgggttttagcgtttagtttgcgtttttggatattcgggatgcgtagggggttggataggatcgttttaaatttgcgtcgtggggtttcgtttttttgagattatttaggtagtttgtgcgcggttttattatagcgtttgaggcggtatcgttt

SEQ ID NO: 1528 - DNA, 548 bp, Artificial Sequence
  chemically treated genomic DNA (Homo sapiens) CpG-island No: 1528
aaacgataccgcctcaaacgctataataaaaccgcgcacaaactacctaaataatctcaaaaaaacgaaaccccacgacgcaaatttaaaacgatcctatccaaccccctacgcatcccgaatatccaaaaacgcaaactaaacgctaaaacccgaaacgtcctcgataccgaaaacgaccgtacgaccgaaactccgaaaaaaaacaaccgaacaaaaaaaccgaactttaaaatctcaaccgtttacaaaaatccccgaacccccgtccttccacgcgaaaaacgtaaaacgacgaaaacgcgactaaaaaaccccccccgcgacgataaaaacgcgacgccgctcccttccgatactactcacctaaaaaccgaaaaccgctaaaaatttaaaacgactacacgctccgaaataaaaaaatacgaaaacccgatcaaacccaaccgcctttcccgataataaaaaacgctataccgaactccgaaaatcttacgctttcaactaccgaacctacccccgaccacaacaaaaccctaacccaactc

SEQ ID NO: 1529 - DNA, 694 bp, Artificial Sequence
  chemically treated genomic DNA (Homo sapiens) CpG-island No: 1529
gttattcgattcgcgttttggatagttatagttagtgtgagcgttattattcgtcgcggcgtgattaagagcgtttcgggttaagtagtttttcgtgggagtgcgggagtgcgtgcgtgcggcggaaatttcgtttttcggcgttcgttgttggttttggtcgtagttagggcgttttaagtaggaagataagcgggattgttggaagcgggagagtcgggaggagcggcgaagggttttttttttttattggttgcgtttacggagtagtttcgttgcgattggtcgtacgcggggggcggtagtttcgcgtcggttcgtttttcgggtcgcgagaggcgtcgggatcgcgggcgtcggttgagttagcggtttttgggaggttgcgttcgcgcgtcggcgaggcgaggcggtcgggttttgcgcgttaggttttggtttggggtatttgggcggtcggtggcgggggcggtacgggcgcggggttggcgggcggtcgagttcgggaggcgggcgtgggcgcggcggtcgtatcggggtttgcgcggattattcgcggggtagtttcgggtttttttttattttttaagtggtggtggttgtgggtttttttgtaggcgatttttttgagtaattttttgttttacgtacgcgttttgttgtggggtaaagcggtagatttatgttgttgtta

SEQ ID NO: 1530 - DNA, 694 bp, Artificial Sequence
  chemically treated genomic DNA (Homo sapiens) CpG-island No: 1530
taacaacaacataaatctaccgctttaccccacaacaaaacgcgtacgtaaaacaaaaaattactcaaaaaaatcgcctacaaaaaaacccacaaccaccaccacttaaaaaataaaaaaaaacccgaaactaccccgcgaataatccgcgcaaaccccgatacgaccgccgcgcccacgcccgcctcccgaactcgaccgcccgccaaccccgcgcccgtaccgcccccgccaccgaccgcccaaataccccaaaccaaaacctaacgcgcaaaacccgaccgcctcgcctcgccgacgcgcgaacgcaacctcccaaaaaccgctaactcaaccgacgcccgcgatcccgacgcctctcgcgacccgaaaaacgaaccgacgcgaaactaccgccccccgcgtacgaccaatcgcaacgaaactactccgtaaacgcaaccaataaaaaaaaaaaacccttcgccgctcctcccgactctcccgcttccaacaatcccgcttatcttcctacttaaaacgccctaactacgaccaaaaccaacaacgaacgccgaaaaacgaaatttccgccgcacgcacgcactcccgcactcccacgaaaaactacttaacccgaaacgctcttaatcacgccgcgacgaataataacgctcacactaactataactatccaaaacgcgaatcgaataac

SEQ ID NO: 1531 - DNA, 694 bp, Artificial Sequence
  chemically treated genomic DNA (Homo sapiens) CpG-island No: 1531
tgatagtagtatgaatttgtcgttttattttatagtagggcgcgtgcgtgaaataaaaaattatttaaaaggatcgtttgtagaaaaatttatagttattattatttaagagatggagagaggttcgaggttgtttcgcgggtggttcgcgtaggtttcggtgcggtcgtcgcgtttacgttcgtttttcgggttcggtcgttcgttagtttcgcgttcgtatcgttttcgttatcggtcgtttaggtgttttaggttaggatttgacgcgtagggttcggtcgtttcgtttcgtcggcgcgcggacgtagttttttaagagtcgttggtttagtcggcgttcgcgatttcggcgtttttcgcggttcgaggggcgggtcgacgcgggattgtcgtttttcgcgtacggttaatcgtaacgaggttgtttcgtgggcgtagttaatggggaagaggagtttttcgtcgtttttttcgattttttcgtttttagtaatttcgtttatttttttatttggagcgttttggttgcggttaaggttaatagcgggcgtcggaaggcgggattttcgtcgtacgtacgtattttcgtatttttacgggagattgtttggttcggagcgtttttgattacgtcgcggcgggtggtggcgtttatattaattatagttatttagggcgcgggtcgagtggt

SEQ ID NO: 1532 - DNA, 694 bp, Artificial Sequence
  chemically treated genomic DNA (Homo sapiens) CpG-island No: 1532
accactcgacccgcgccctaaataactataattaatataaacgccaccacccgccgcgacgtaatcaaaaacgctccgaaccaaacaatctcccgtaaaaatacgaaaatacgtacgtacgacgaaaatcccgccttccgacgcccgctattaaccttaaccgcaaccaaaacgctccaaataaaaaaataaacgaaattactaaaaacgaaaaaatcgaaaaaaacgacgaaaaactcctcttccccattaactacgcccacgaaacaacctcgttacgattaaccgtacgcgaaaaacgacaatcccgcgtcgacccgcccctcgaaccgcgaaaaacgccgaaatcgcgaacgccgactaaaccaacgactcttaaaaaactacgtccgcgcgccgacgaaacgaaacgaccgaaccctacgcgtcaaatcctaacctaaaacacctaaacgaccgataacgaaaacgatacgaacgcgaaactaacgaacgaccgaacccgaaaaacgaacgtaaacgcgacgaccgcaccgaaacctacgcgaaccacccgcgaaacaacctcgaacctctctccatctcttaaataataataactataaatttttctacaaacgatccttttaaataattttttatttcacgcacgcgccctactataaaataaaacgacaaattcatactactatca

SEQ ID NO: 1533 - DNA, 648 bp, Artificial Sequence
  chemically treated genomic DNA (Homo sapiens) CpG-island No: 1533
tcgcgtttttgttttatttacgttttattatttcgtttgtacgcgtttagtatcgtgttagattcgtttttattttattgttttttttttcgtatacgttttttgatttatcgcgtagttggtttttttttatttacgtattttcgcgatcggtgaatgttttttttttatacgtttacgttgtttcgtcgttgttattcgtttattcgtcggcgtcgttgttaattttattagttgtgcgttgttgcgttgatatatttatttatcgttcgagttcgttgtgatttacgaattatcgcggtggttttgttttcgtcgtttgttttcgtttatcgacgcgtagtttttttgtatgtcgtatatagacgttatttgtttcggtgttgatatttttttttttgtagcgttgtttgtgttttttttcgttaggtttatgtcggttacgtatttttgtcggtttattttttattttcggttcgtttttttttacgtttttttttcggtcgtttttttttttttttttcgggaagtcggattattttttttttttttttttttaagcggtttggtatttttatcgggtttaggttttcgggtttttacgtaaatttcgtgtttttttggtttttaattaatttttgttttttt

SEQ ID NO: 1534 - DNA, 648 bp, Artificial Sequence
  chemically treated genomic DNA (Homo sapiens) CpG-island No: 1534
aaaaaaacaaaaattaattaaaaaccaaaaaaacacgaaatttacgtaaaaacccgaaaacctaaacccgataaaaataccaaaccgcttaaaaaaaaaaaaaaaaaaaataatccgacttcccgaaaaaaaaaaaaaaaaacgaccgaaaaaaaaacgtaaaaaaaaacgaaccgaaaataaaaaataaaccgacaaaaatacgtaaccgacataaacctaacgaaaaaaaacacaaacaacgctacaaaaaaaaaaatatcaacaccgaaacaaataacgtctatatacgacatacaaaaaaactacgcgtcgataaacgaaaacaaacgacgaaaacaaaaccaccgcgataattcgtaaatcacaacgaactcgaacgataaataaatatatcaacgcaacaacgcacaactaataaaattaacaacgacgccgacgaataaacgaataacaacgacgaaacaacgtaaacgtataaaaaaaaaacattcaccgatcgcgaaaatacgtaaataaaaaaaaaccaactacgcgataaatcaaaaaacgtatacgaaaaaaaaaacaataaaataaaaacgaatctaacacgatactaaacgcgtacaaacgaaataataaaacgtaaataaaacaaaaacgcga

SEQ ID NO: 1535 - DNA, 648 bp, Artificial Sequence
  chemically treated genomic DNA (Homo sapiens) CpG-island No: 1535
gaaggagtaaaagttggttgaaagttaggggggtacgaagtttgcgtgagagttcgagggtttaagttcgatgggagtgttaagtcgtttggaggggaaaaaggggggggtggttcggtttttcgaagaaaagagaggagagcgatcggaagagaagcgtgaagaggggcgaatcgaggatagagggtgggtcgataaagatgcgtgatcgatataagtttggcgaggaggagtatagatagcgttgtagagagagagatgttagtatcgaggtagatagcgtttatgtgcgatatgtagagagattgcgcgtcgatagacgagagtaagcgacgagagtaaggttatcgcggtggttcgtggattatagcgagttcgagcggtaggtggatgtgttaacgtagtagcgtataattagtgaggttggtagcggcgtcgacgagtggacgagtgatagcggcgggatagcgtagacgtgtagaggagagatatttatcgatcgcgggagtgcgtaggtgaagaaaagttagttgcgcgatgagttagagagcgtgtgcgagaggaggagtagtgaggtgagagcgagtttgatacggtgttagacgcgtatagacgaagtagtagagcgtgagtgaggtagaggcgcga

SEQ ID NO: 1536 - DNA, 648 bp, Artificial Sequence
  chemically treated genomic DNA (Homo sapiens) CpG-island No: 1536
tcgcgcctctacctcactcacgctctactacttcgtctatacgcgtctaacaccgtatcaaactcgctctcacctcactactcctcctctcgcacacgctctctaactcatcgcgcaactaacttttcttcacctacgcactcccgcgatcgataaatatctctcctctacacgtctacgctatcccgccgctatcactcgtccactcgtcgacgccgctaccaacctcactaattatacgctactacgttaacacatccacctaccgctcgaactcgctataatccacgaaccaccgcgataaccttactctcgtcgcttactctcgtctatcgacgcgcaatctctctacatatcgcacataaacgctatctacctcgatactaacatctctctctctacaacgctatctatactcctcctcgccaaacttatatcgatcacgcatctttatcgacccaccctctatcctcgattcgcccctcttcacgcttctcttccgatcgctctcctctcttttcttcgaaaaaccgaaccacccccccctttttcccctccaaacgacttaacactcccatcgaacttaaaccctcgaactctcacgcaaacttcgtacccccctaactttcaaccaacttttactccttc

SEQ ID NO: 1537 - DNA, 732 bp, Artificial Sequence
  chemically treated genomic DNA (Homo sapiens) CpG-island No: 1537
tttaggcgcgtatcgttacgatcgtttagttcggtttgcgtcgtacgattcgttttttagttaagtataacgtagtattttttttacgcgagtttttattttataatttatgacgtttcgtatataaaatatattttttttttatagcgcgtcgtttagtaaatcgttgcgaagatatatttttattacgcgatatacgtatttcgttaacggtaagttttttttaaatatacggcgaggatttacgcgcgtagatttttttagtcgtagagagattttttatatttcgtagcgtatacgtattcgtttcgaatttcgcgtttatatataaaatagttttatcgcgttaatatcgaaaatagttcgtagcgatagaatcgtttacgaaacgtatttcgttcggaagaaatatcgtttttgttttatatagagtacgacgcgtacgcgtttgttaagacgattattttttttatttttatagttttcgacggtttacgtttatataaatttttttttcgatatacgtacgtcgtacgatatatataatatattatttcgttcgtgtttcgatatataagcgtttttttcgtacgagtagatacgcgcgcgtttattttattaagttacgcgttcgcgttcgtaatggggggtttcgaggattaaatattattacggtggttaagtattttatattgtgttatgtagtgtaatttttgtgtatgcgggattcgt

SEQ ID NO: 1538 - DNA, 732 bp, Artificial Sequence
  chemically treated genomic DNA (Homo sapiens) CpG-island No: 1538
acgaatcccgcatacacaaaaattacactacataacacaatataaaatacttaaccaccgtaataatatttaatcctcgaaaccccccattacgaacgcgaacgcgtaacttaataaaataaacgcgcgcgtatctactcgtacgaaaaaaacgcttatatatcgaaacacgaacgaaataatatattatatatatcgtacgacgtacgtatatcgaaaaaaaaatttatataaacgtaaaccgtcgaaaactataaaaataaaaaaaataatcgtcttaacaaacgcgtacgcgtcgtactctatataaaacaaaaacgatatttcttccgaacgaaatacgtttcgtaaacgattctatcgctacgaactattttcgatattaacgcgataaaactattttatatataaacgcgaaattcgaaacgaatacgtatacgctacgaaatataaaaaatctctctacgactaaaaaaatctacgcgcgtaaatcctcgccgtatatttaaaaaaaacttaccgttaacgaaatacgtatatcgcgtaataaaaatatatcttcgcaacgatttactaaacgacgcgctataaaaaaaaaatatattttatatacgaaacgtcataaattataaaataaaaactcgcgtaaaaaaaatactacgttatacttaactaaaaaacgaatcgtacgacgcaaaccgaactaaacgatcgtaacgatacgcgcctaaa

SEQ ID NO: 1539 - DNA, 732 bp, Artificial Sequence
  chemically treated genomic DNA (Homo sapiens) CpG-island No: 1539
acgggtttcgtatatatagaggttatattgtatggtatagtgtgaagtgtttgattatcgtggtggtgtttagttttcgaggttttttattgcgggcgcgggcgcgtggtttggtggggtgggcgcgcgcgtgtttgttcgtgcgggaggggcgtttgtgtgtcggggtacgggcggggtggtgtgttgtgtgtgtcgtgcggcgtgcgtgtgtcgagagaggagtttgtgtggacgtagatcgtcgagagttgtgggagtgaggagagtggtcgttttggtaggcgcgtgcgcgtcgtgttttgtgtgaggtagaggcggtgtttttttcgagcggggtgcgtttcgtgggcggttttgtcgttgcggattgttttcggtgttggcgcggtagagttgttttgtgtgtgagcgcggagttcgggacggatgcgtgtgcgttgcggagtgtgggggatttttttgcggttgggggagtttgcgcgcgtgggttttcgtcgtgtgtttgggaggggtttgtcgttgacgaagtgcgtgtgtcgcgtggtgggggtgtgttttcgtagcggtttgttgggcggcgcgttgtggggaggaggtgtgttttgtgtgcgggacgttatggattgtggggtgagggttcgcgtgaggggggtgttgcgttgtgtttggttggggagcgagtcgtgcggcgtaggtcgggttggacggtcgtggcggtgcgcgtttggg

SEQ ID NO: 1540 - DNA, 732 bp, Artificial Sequence
  chemically treated genomic DNA (Homo sapiens) CpG-island No: 1540
cccaaacgcgcaccgccacgaccgtccaacccgacctacgccgcacgactcgctccccaaccaaacacaacgcaacacccccctcacgcgaaccctcaccccacaatccataacgtcccgcacacaaaacacacctcctccccacaacgcgccgcccaacaaaccgctacgaaaacacacccccaccacgcgacacacgcacttcgtcaacgacaaacccctcccaaacacacgacgaaaacccacgcgcgcaaactcccccaaccgcaaaaaaatcccccacactccgcaacgcacacgcatccgtcccgaactccgcgctcacacacaaaacaactctaccgcgccaacaccgaaaacaatccgcaacgacaaaaccgcccacgaaacgcaccccgctcgaaaaaaacaccgcctctacctcacacaaaacacgacgcgcacgcgcctaccaaaacgaccactctcctcactcccacaactctcgacgatctacgtccacacaaactcctctctcgacacacgcacgccgcacgacacacacaacacaccaccccgcccgtaccccgacacacaaacgcccctcccgcacgaacaaacacgcgcgcgcccaccccaccaaaccacgcgcccgcgcccgcaataaaaaacctcgaaaactaaacaccaccacgataatcaaacacttcacactataccatacaatataacctctatatatacgaaacccgt

SEQ ID NO: 1541 - DNA, 1091 bp, Artificial Sequence
  chemically treated genomic DNA (Homo sapiens) CpG-island No: 1541
tcgcggtcgttttttcggggagttcgcggggcgaagagtcgagttcgggggcgggggtacggtagcggggtttgagggacgcgtcgggcggtcgcgaggattttgggatcgtttgttttattttttatttgtttttattaggagtcggagtacgcgggcgttttagaaggtttcgtagggtagtcgcgcggggtcggacgcgttggggtttacggcgttgggaacgcgggttcgtagtcgggttcgggcggtatgggcggcgggcggacgagtcggagtcggcggtggtggcggcggcggcggtcggggaagcgcggaggtggcgtcgcgagggggaggggcgcggcggcggaggaggaggtgttcgggtcgttgtcgtcgtcgtcgtcgttgatagcggttcgagtaaataagtcgcgtcgtcgcggttcggtcgttgttttcgttcgcgtcggagttggagtttaggtcgagttttgttttggtcgtcggtcgggtcgaggtcgcgtcgtcgcgttttttcgttttcgcgtcgtgacgttgtcgtcgggcgcggggatcgcgtcgagtttaggttttcgtcgtcgggtttttcgttcggtcgaggggcgttcgagtcgtcgcggcggtcgtttggaaaagttttttcgttagggttttttagggtaagtagcgagggcgcggggttcggggttcggggaaggtaagcgcgtttgggagtcgggttcgaggggagtcggtcgggtcgggtcgtggagttttgttttaggagcgggtttcgcggttcgggtgttcgggtcggggagggtcggggtattggcgtcggtgtagttttgattcgggtttttcggggttcggttgttcgtcggtttttcggaattggtttcggggtcggtttcgagggtggagttgtcgggagtagatagggcgtttcgtagtttatttgagcgcgtcgggttcgtttcggtttttcggtcgtggttggtattttttcgcgtggggttagggcgagttttttgattttaggaagcgtttgcggggtttttgttgggggcgggatggggagaaaatttcgtaggcgtcgggtgttt

SEQ ID NO: 1542 - DNA, 1091 bp, Artificial Sequence
  chemically treated genomic DNA (Homo sapiens) CpG-island No: 1542
aaacacccgacgcctacgaaattttctccccatcccgcccccaacaaaaaccccgcaaacgcttcctaaaatcaaaaaactcgccctaaccccacgcgaaaaaataccaaccacgaccgaaaaaccgaaacgaacccgacgcgctcaaataaactacgaaacgccctatctactcccgacaactccaccctcgaaaccgaccccgaaaccaattccgaaaaaccgacgaacaaccgaaccccgaaaaacccgaatcaaaactacaccgacgccaataccccgaccctccccgacccgaacacccgaaccgcgaaacccgctcctaaaacaaaactccacgacccgacccgaccgactcccctcgaacccgactcccaaacgcgcttaccttccccgaaccccgaaccccgcgccctcgctacttaccctaaaaaaccctaacgaaaaaacttttccaaacgaccgccgcgacgactcgaacgcccctcgaccgaacgaaaaacccgacgacgaaaacctaaactcgacgcgatccccgcgcccgacgacaacgtcacgacgcgaaaacgaaaaaacgcgacgacgcgacctcgacccgaccgacgaccaaaacaaaactcgacctaaactccaactccgacgcgaacgaaaacaacgaccgaaccgcgacgacgcgacttatttactcgaaccgctatcaacgacgacgacgacgacaacgacccgaacacctcctcctccgccgccgcgcccctccccctcgcgacgccacctccgcgcttccccgaccgccgccgccgccaccaccgccgactccgactcgtccgcccgccgcccataccgcccgaacccgactacgaacccgcgttcccaacgccgtaaaccccaacgcgtccgaccccgcgcgactaccctacgaaaccttctaaaacgcccgcgtactccgactcctaataaaaacaaataaaaaataaaacaaacgatcccaaaatcctcgcgaccgcccgacgcgtccctcaaaccccgctaccgtacccccgcccccgaactcgactcttcgccccgcgaactccccgaaaaaacgaccgcga

SEQ ID NO: 1543 - DNA, 1091 bp, Artificial Sequence
  chemically treated genomic DNA (Homo sapiens) CpG-island No: 1543
gagtattcggcgtttgcggaattttttttttatttcgtttttagtaggggtttcgtaggcgttttttgaggttagagggttcgttttggttttacgcggaaaagtattagttacggtcggggggtcgagacgggttcggcgcgtttaggtgggttgcggagcgttttgtttgttttcggtagttttattttcggggtcggtttcggggttagtttcggaaagtcggcgggtagtcgggtttcgggggattcgggttagggttgtatcggcgttagtgtttcgatttttttcggttcgagtattcgggtcgcggagttcgtttttggggtagagttttacggttcggttcggtcggtttttttcgggttcggtttttagacgcgtttgtttttttcgggtttcgggtttcgcgttttcgttatttattttggggagttttggcggggaaatttttttaggcgatcgtcgcggcggttcgggcgtttttcggtcgagcggagagttcggcggcgggggtttgggttcggcgcggttttcgcgttcggcggtagcgttacggcgcggaggcggggaggcgcggcggcgcggtttcggttcggtcggcgattagggtagggttcggtttgggttttagtttcggcgcgggcgggggtagcggtcgggtcgcggcggcgcggtttgtttattcgggtcgttgttagcggcggcggcggcggtagcggttcgggtattttttttttcgtcgtcgcgtttttttttttcgcggcgttattttcgcgttttttcggtcgtcgtcgtcgttattatcgtcggtttcggttcgttcgttcgtcgtttatgtcgttcgggttcgattgcgggttcgcgtttttagcgtcgtgggttttagcgcgttcggtttcgcgcggttgttttgcggggttttttggggcgttcgcgtgtttcggtttttggtaggggtaggtaggaagtggggtaggcgattttaaagttttcgcggtcgttcggcgcgttttttaggtttcgttgtcgtgttttcgttttcgggttcggtttttcgtttcgcgagtttttcgggaagacggtcgcgg

SEQ ID NO: 1544 - DNA, 1091 bp, Artificial Sequence
  chemically treated genomic DNA (Homo sapiens) CpG-island No: 1544
ccgcgaccgtcttcccgaaaaactcgcgaaacgaaaaaccgaacccgaaaacgaaaacacgacaacgaaacctaaaaaacgcgccgaacgaccgcgaaaactttaaaatcgcctaccccacttcctacctacccctaccaaaaaccgaaacacgcgaacgccccaaaaaaccccgcaaaacaaccgcgcgaaaccgaacgcgctaaaacccacgacgctaaaaacgcgaacccgcaatcgaacccgaacgacataaacgacgaacgaacgaaccgaaaccgacgataataacgacgacgacgaccgaaaaaacgcgaaaataacgccgcgaaaaaaaaaaacgcgacgacgaaaaaaaaaatacccgaaccgctaccgccgccgccgccgctaacaacgacccgaataaacaaaccgcgccgccgcgacccgaccgctacccccgcccgcgccgaaactaaaacccaaaccgaaccctaccctaatcgccgaccgaaccgaaaccgcgccgccgcgcctccccgcctccgcgccgtaacgctaccgccgaacgcgaaaaccgcgccgaacccaaacccccgccgccgaactctccgctcgaccgaaaaacgcccgaaccgccgcgacgatcgcctaaaaaaatttccccgccaaaactccccaaaataaataacgaaaacgcgaaacccgaaacccgaaaaaaacaaacgcgtctaaaaaccgaacccgaaaaaaaccgaccgaaccgaaccgtaaaactctaccccaaaaacgaactccgcgacccgaatactcgaaccgaaaaaaatcgaaacactaacgccgatacaaccctaacccgaatcccccgaaacccgactacccgccgactttccgaaactaaccccgaaaccgaccccgaaaataaaactaccgaaaacaaacaaaacgctccgcaacccacctaaacgcgccgaacccgtctcgaccccccgaccgtaactaatacttttccgcgtaaaaccaaaacgaaccctctaacctcaaaaaacgcctacgaaacccctactaaaaacgaaataaaaaaaaaattccgcaaacgccgaatactc

SEQ ID NO: 1545 - DNA, 874 bp, Artificial Sequence
  chemically treated genomic DNA (Homo sapiens) CpG-island No: 1545
atgcgttgtatcgataggaggtagtatttttttgttcgaggggcgtaacgatagagatttaaggttatttgggtcggagtcgggtgaggtcgcggagaacgtatttcgttacgcgtttgtcgagacggaggcgggcgtttcgattattgttcgattatgcgtttatttaagtaggatttcgaaaaaatttagtcgcgcgttttttttgaggtttcgtagttggttaggttcggttcgggttggtgcggttgcgtattgtagtttagcggacgggttcgggaggagtcgggcggggatcgcggcggttagagtttttgttagtttcgtcgggtatacgtaggtcggggcgggcggcgcggttgttttcgtttcgtacgttgttgggttcggtagttttagaggttggcggattcgcgcggagtcggcgtagcggagcgcgtcggttgttcggggtttagcgggagagttgtagtagcgcgcggagtagggggttacgggtgggcgggcgttcgttttcgtttgcgtcgttgtttgtacgcgggtcgtcgttttcgggcgtgtgagagtcggtagttcggtcgattgggttcggagcggcgcggaggtcgggcgttgacggtaacgggtcgggtgcgcgcgcgggagggtttcggttgtttcgatagaggtcgggttcgggcggcgggagtgcgagcgttattgcggcgttagaggggttaggaagggataggaggttgtttgaggttcgtatttggcgtttgtttttgcggttttcggggtcgacgaagtcggagcgggtggggagggagtcgggcgggcggttagagatttggcggtaggtgtttgttttttgtgatttaattttttttttagt

SEQ ID NO: 1546 - DNA, 874 bp, Artificial Sequence
  chemically treated genomic DNA (Homo sapiens) CpG-island No: 1546
actaaaaaaaaaattaaatcacaaaaaacaaacacctaccgccaaatctctaaccgcccgcccgactccctccccacccgctccgacttcgtcgaccccgaaaaccgcaaaaacaaacgccaaatacgaacctcaaacaacctcctatcccttcctaacccctctaacgccgcaataacgctcgcactcccgccgcccgaacccgacctctatcgaaacaaccgaaaccctcccgcgcgcgcacccgacccgttaccgtcaacgcccgacctccgcgccgctccgaacccaatcgaccgaactaccgactctcacacgcccgaaaacgacgacccgcgtacaaacaacgacgcaaacgaaaacgaacgcccgcccacccgtaaccccctactccgcgcgctactacaactctcccgctaaaccccgaacaaccgacgcgctccgctacgccgactccgcgcgaatccgccaacctctaaaactaccgaacccaacaacgtacgaaacgaaaacaaccgcgccgcccgccccgacctacgtatacccgacgaaactaacaaaaactctaaccgccgcgatccccgcccgactcctcccgaacccgtccgctaaactacaatacgcaaccgcaccaacccgaaccgaacctaaccaactacgaaacctcaaaaaaaacgcgcgactaaattttttcgaaatcctacttaaataaacgcataatcgaacaataatcgaaacgcccgcctccgtctcgacaaacgcgtaacgaaatacgttctccgcgacctcacccgactccgacccaaataaccttaaatctctatcgttacgcccctcgaacaaaaaaatactacctcctatcgatacaacgcat

SEQ ID NO: 1547 - DNA, 874 bp, Artificial Sequence
  chemically treated genomic DNA (Homo sapiens) CpG-island No: 1547
gttggggagagagttggattatagagggtaggtatttgtcgttaggtttttggtcgttcgttcggttttttttttattcgtttcgatttcgtcggtttcggggatcgtagagataggcgttaggtacgggttttaggtagttttttgtttttttttggtttttttgacgtcgtagtggcgttcgtattttcgtcgttcgagttcggtttttgtcggggtagtcggagttttttcgcgcgcgtattcggttcgttatcgttagcgttcggttttcgcgtcgtttcgggtttagtcggtcgagttgtcggtttttatacgttcggggacggcggttcgcgtgtaggtagcgacgtaggcgaaggcgggcgttcgtttattcgtagttttttgtttcgcgcgttgttgtagttttttcgttgggtttcgggtagtcggcgcgtttcgttgcgtcggtttcgcgcgggttcgttagtttttgaagttgtcgggtttagtagcgtgcggggcggggatagtcgcgtcgttcgtttcggtttgcgtgtgttcggcggagttgataggagttttggtcgtcgcggttttcgttcggtttttttcgggttcgttcgttgggttgtagtgcgtagtcgtattagttcgggtcgggtttggttagttgcggaattttaggagggacgcgcgattgaattttttcggaattttatttgagtaagcgtatgatcgggtagtggtcgaaacgttcgttttcgtttcggtagacgcgtagcggggtgcgtttttcgcggttttattcggtttcggtttaggtagttttaggtttttgtcgttgcgtttttcgggtaaaggggtgttgttttttgtcggtatagcgtat

SEQ ID NO: 1548 - DNA, 874 bp, Artificial Sequence
  chemically treated genomic DNA (Homo sapiens) CpG-island No: 1548
atacgctataccgacaaaaaacaacacccctttacccgaaaaacgcaacgacaaaaacctaaaactacctaaaccgaaaccgaataaaaccgcgaaaaacgcaccccgctacgcgtctaccgaaacgaaaacgaacgtttcgaccactacccgatcatacgcttactcaaataaaattccgaaaaaattcaatcgcgcgtccctcctaaaattccgcaactaaccaaacccgacccgaactaatacgactacgcactacaacccaacgaacgaacccgaaaaaaaccgaacgaaaaccgcgacgaccaaaactcctatcaactccgccgaacacacgcaaaccgaaacgaacgacgcgactatccccgccccgcacgctactaaacccgacaacttcaaaaactaacgaacccgcgcgaaaccgacgcaacgaaacgcgccgactacccgaaacccaacgaaaaaactacaacaacgcgcgaaacaaaaaactacgaataaacgaacgcccgccttcgcctacgtcgctacctacacgcgaaccgccgtccccgaacgtataaaaaccgacaactcgaccgactaaacccgaaacgacgcgaaaaccgaacgctaacgataacgaaccgaatacgcgcgcgaaaaaactccgactaccccgacaaaaaccgaactcgaacgacgaaaatacgaacgccactacgacgtcaaaaaaaccaaaaaaaaacaaaaaactacctaaaacccgtacctaacgcctatctctacgatccccgaaaccgacgaaatcgaaacgaataaaaaaaaaaccgaacgaacgaccaaaaacctaacgacaaatacctaccctctataatccaactctctccccaac

SEQ ID NO: 1549 - DNA, 720 bp, Artificial Sequence
  chemically treated genomic DNA (Homo sapiens) CpG-island No: 1549
ggttatcggttttcgttttcgagtttcgttagagcgcgcgagggtttttagcggtcgttttttttttatagtaggggcggggtttcgcgtttatcggaaggagcgggttcggggcgggcggcgttgattggtcggggcgggtttgacgtcgacgcggttataagagattataagcgattcgtagggttagacgtttttcgtcgagagtcgtcggggttttttgttttaatagtgtttggacggaattcggcgttcgttttttatttcggtcggtcgtttatagttagtttttcgttatttttttatcgtattttcggattgttttaaggttttcgtcgtcgttttagcgtcgcgtagttatcgtcgtcgtcgtcgtttttttttagtcgtcgttatgacgatcgcgtttatttcgtaggtgcgttagaattattattaggatttagaggtcgttattaatcgttagattaatttggagttttacgttttttacgtttatttgtttatggtgagcgcgggcgggtttaagcggtggcgggggtcgggcgcggttttcggggcgcgcgttggggcgggtcgggggtgtggttattcgcgggttttttcgtttttttgcgtttttttggaaaatggaggttgttcgaggttttcgaggatttttttggcgtagaaagtcggggtagttggtttttttcggttgtattttgagaatgttttttt

SEQ ID NO: 1550 - DNA, 720 bp, Artificial Sequence
  chemically treated genomic DNA (Homo sapiens) CpG-island No: 1550
aaaaaaacattctcaaaatacaaccgaaaaaaaccaactaccccgactttctacgccaaaaaaatcctcgaaaacctcgaacaacctccattttccaaaaaaacgcaaaaaaacgaaaaaacccgcgaataaccacacccccgacccgccccaacgcgcgccccgaaaaccgcgcccgacccccgccaccgcttaaacccgcccgcgctcaccataaacaaataaacgtaaaaaacgtaaaactccaaattaatctaacgattaataacgacctctaaatcctaataataattctaacgcacctacgaaataaacgcgatcgtcataacgacgactaaaaaaaaacgacgacgacgacgataactacgcgacgctaaaacgacgacgaaaaccttaaaacaatccgaaaatacgataaaaaaataacgaaaaactaactataaacgaccgaccgaaataaaaaacgaacgccgaattccgtccaaacactattaaaacaaaaaaccccgacgactctcgacgaaaaacgtctaaccctacgaatcgcttataatctcttataaccgcgtcgacgtcaaacccgccccgaccaatcaacgccgcccgccccgaacccgctccttccgataaacgcgaaaccccgcccctactataaaaaaaaaacgaccgctaaaaaccctcgcgcgctctaacgaaactcgaaaacgaaaaccgataacc

SEQ ID NO: 1551 - DNA, 720 bp, Artificial Sequence
  chemically treated genomic DNA (Homo sapiens) CpG-island No: 1551
gagggagtatttttagggtatagtcgagaagaattagttgtttcgattttttgcgttagagaagttttcggaaatttcgagtagtttttattttttagaagggcgtagggaggcgggagagttcgcgggtggttatattttcggttcgttttagcgcgcgtttcgggaatcgcgttcggttttcgttatcgtttaggttcgttcgcgtttattatggataggtaaacgtaggaggcgtagagttttaggttgatttggcggttgatggcggtttttgagttttggtggtagttttggcgtatttgcgaggtggacgcggtcgttatggcggcgattaaggagaggcggcggcggcggcggtggttgcgcggcgttggagcggcggcgggggttttggggtagttcgagggtgcggtgaagaggtgacggagggttggttatgggcggtcggtcggggtggggaacgagcgtcgggtttcgtttaagtattgttgaagtaggaaatttcgacgattttcggcgaagaacgtttggttttgcgggtcgtttgtggttttttatagtcgcgtcggcgttaggttcgtttcggttaattagcgtcgttcgtttcgagttcgtttttttcggtgggcgcgggatttcgtttttgttgtgggggaggggcggtcgttggaggttttcgcgcgttttggcggagttcgggagcggggatcggtagtt

SEQ ID NO: 1552 - DNA, 720 bp, Artificial Sequence
  chemically treated genomic DNA (Homo sapiens) CpG-island No: 1552
aactaccgatccccgctcccgaactccgccaaaacgcgcgaaaacctccaacgaccgcccctcccccacaacaaaaacgaaatcccgcgcccaccgaaaaaaacgaactcgaaacgaacgacgctaattaaccgaaacgaacctaacgccgacgcgactataaaaaaccacaaacgacccgcaaaaccaaacgttcttcgccgaaaatcgtcgaaatttcctacttcaacaatacttaaacgaaacccgacgctcgttccccaccccgaccgaccgcccataaccaaccctccgtcacctcttcaccgcaccctcgaactaccccaaaacccccgccgccgctccaacgccgcgcaaccaccgccgccgccgccgcctctccttaatcgccgccataacgaccgcgtccacctcgcaaatacgccaaaactaccaccaaaactcaaaaaccgccatcaaccgccaaatcaacctaaaactctacgcctcctacgtttacctatccataataaacgcgaacgaacctaaacgataacgaaaaccgaacgcgattcccgaaacgcgcgctaaaacgaaccgaaaatataaccacccgcgaactctcccgcctccctacgcccttctaaaaaataaaaactactcgaaatttccgaaaacttctctaacgcaaaaaatcgaaacaactaattcttctcgactataccctaaaaatactccctc

SEQ ID NO: 1553 - DNA, 1082 bp, Artificial Sequence
  chemically treated genomic DNA (Homo sapiens) CpG-island No: 1553
ttcgagcgatcgcgtttttttttttttttttgtgtgtgcgcgagcggagttggggcggagggagaagggggaggtcgttttgtttgttcgtttttcgtcgtttttgttcggtttattcgaagtgcggcgggagaggcgggagtttaggagagggtgcgggagttggcggggcggttcggagttgttaggacgttttggttttagtcgcgtataggggagcgtggacggtagaggggttcggcgggagtcgagattcgttcgtttcggttgtttttcggtttttttttgtttttatttattttttgatatttatagaaaagcgtgtaaaggcgcggagcgggacggaaattataaataaatagcggcggcggtagcgcgttatttggtggagtaggaagtgtaggtagagttcggaggttggtgttttttgcgcgtttttaggattttgttatgggttgggggtcgcggaggttgcgagcggtcgggcgagggtagcggcggcggcgttcgtatcggggttgagcgagtagcgacgcgaggggcgcgcggagatggtagcgtttagtaattttagtttgttcggttcgtcggtgtttttcggtgagttttagttcgtcgggcgttgttgtcgcgtcgggtttcgttttattgttttcgtttcgtagtttgggatggatagagtttatttgtggttatttcgttcgttttttcggaatgggggtaggcgttcggggtgatatttgtttggttcgttagtatttcggtgtttagagtattttcgcgtttgatatttgatagcgtagaggtgggagagcggtggtgtttttagtgtgcggacgcgggtgtttcggggtttggagtgtagcgagcgaaaagcgaaaggagcgggtaggttcgtattttttggcgtagttggagcgggggttggcggggcggagaaggttggggtgaagtagagcgtttcgatttgtttgtcgtgtcgcgttcgttattttggatatttaaattcggagtagaggggagtaaattttcgtttttcgtagatttgattttttttgtttgttttagaaattagttttatg

SEQ ID NO: 1554 - DNA, 1082 bp, Artificial Sequence
  chemically treated genomic DNA (Homo sapiens) CpG-island No: 1554
cataaaactaatttctaaaacaaacaaaaaaaatcaaatctacgaaaaacgaaaatttactcccctctactccgaatttaaatatccaaaataacgaacgcgacacgacaaacaaatcgaaacgctctacttcaccccaaccttctccgccccgccaacccccgctccaactacgccaaaaaatacgaacctacccgctcctttcgcttttcgctcgctacactccaaaccccgaaacacccgcgtccgcacactaaaaacaccaccgctctcccacctctacgctatcaaatatcaaacgcgaaaatactctaaacaccgaaatactaacgaaccaaacaaatatcaccccgaacgcctacccccattccgaaaaaacgaacgaaataaccacaaataaactctatccatcccaaactacgaaacgaaaacaataaaacgaaacccgacgcgacaacaacgcccgacgaactaaaactcaccgaaaaacaccgacgaaccgaacaaactaaaattactaaacgctaccatctccgcgcgcccctcgcgtcgctactcgctcaaccccgatacgaacgccgccgccgctaccctcgcccgaccgctcgcaacctccgcgacccccaacccataacaaaatcctaaaaacgcgcaaaaaacaccaacctccgaactctacctacacttcctactccaccaaataacgcgctaccgccgccgctatttatttataatttccgtcccgctccgcgcctttacacgcttttctataaatatcaaaaaataaataaaaacaaaaaaaaaccgaaaaacaaccgaaacgaacgaatctcgactcccgccgaacccctctaccgtccacgctcccctatacgcgactaaaaccaaaacgtcctaacaactccgaaccgccccgccaactcccgcaccctctcctaaactcccgcctctcccgccgcacttcgaataaaccgaacaaaaacgacgaaaaacgaacaaacaaaacgacctcccccttctccctccgccccaactccgctcgcgcacacacaaaaaaaaaaaaaaaaacgcgatcgctcgaa

SEQ ID NO: 1555 - DNA, 1082 bp, Artificial Sequence
  chemically treated genomic DNA (Homo sapiens) CpG-island No: 1555
tatagagttaatttttgaaataaataaagaaaattaagtttgcgaggagcgagggtttgtttttttttgtttcggatttgggtgtttagggtagcgggcgcggtacggtaaataggtcggggcgttttgttttattttaatttttttcgtttcgttagttttcgttttagttgcgttagaaagtgcgagtttgttcgtttttttcgtttttcgttcgttgtattttaagtttcggaatattcgcgttcgtatattaagggtattatcgtttttttatttttgcgttgttagatgttaggcgcggaggtgttttgggtatcgaggtgttggcgaattaaataagtattatttcggacgtttgtttttatttcgagagagcgggcgggatggttataggtaggttttgtttattttaggttgcggggcgagggtagtggggcgagattcggcgcggtagtagcgttcgacgggttgaaatttatcggaggatatcgacgagtcggataggttggagttgttggacgttgttattttcgcgcgtttttcgcgtcgttgttcgtttagtttcggtgcggacgtcgtcgtcgttgttttcgttcggtcgttcgtagttttcgcggtttttagtttatggtaaagttttggggacgcgtagaaagtattagttttcggattttgtttgtattttttgttttattagatgacgcgttgtcgtcgtcgttatttatttgtggttttcgtttcgtttcgcgtttttgtacgtttttttatgggtgttagggggtaggtgggagtagagggaggtcgaggggtagtcgggacgggcggatttcggttttcgtcgagtttttttgtcgtttacgtttttttgtgcgcggttgggattagggcgttttggtagtttcgagtcgtttcgttagttttcgtatttttttttgggttttcgtttttttcgtcgtatttcgagtagatcgggtagaggcggcgggagacggatagatagagcgatttttttttttttttttcgttttaatttcgttcgcgtatatataaaggaagaagaggagacgcggtcgttcggg

SEQ ID NO: 1556 - DNA, 1082 bp, Artificial Sequence
  chemically treated genomic DNA (Homo sapiens) CpG-island No: 1556
cccgaacgaccgcgtctcctcttcttcctttatatatacgcgaacgaaattaaaacgaaaaaaaaaaaaaaaaatcgctctatctatccgtctcccgccgcctctacccgatctactcgaaatacgacgaaaaaaacgaaaacccaaaaaaaaatacgaaaactaacgaaacgactcgaaactaccaaaacgccctaatcccaaccgcgcacaaaaaaacgtaaacgacaaaaaaactcgacgaaaaccgaaatccgcccgtcccgactacccctcgacctccctctactcccacctaccccctaacacccataaaaaaacgtacaaaaacgcgaaacgaaacgaaaaccacaaataaataacgacgacgacaacgcgtcatctaataaaacaaaaaatacaaacaaaatccgaaaactaatactttctacgcgtccccaaaactttaccataaactaaaaaccgcgaaaactacgaacgaccgaacgaaaacaacgacgacgacgtccgcaccgaaactaaacgaacaacgacgcgaaaaacgcgcgaaaataacaacgtccaacaactccaacctatccgactcgtcgatatcctccgataaatttcaacccgtcgaacgctactaccgcgccgaatctcgccccactaccctcgccccgcaacctaaaataaacaaaacctacctataaccatcccgcccgctctctcgaaataaaaacaaacgtccgaaataatacttatttaattcgccaacacctcgatacccaaaacacctccgcgcctaacatctaacaacgcaaaaataaaaaaacgataatacccttaatatacgaacgcgaatattccgaaacttaaaatacaacgaacgaaaaacgaaaaaaacgaacaaactcgcactttctaacgcaactaaaacgaaaactaacgaaacgaaaaaaattaaaataaaacaaaacgccccgacctatttaccgtaccgcgcccgctaccctaaacacccaaatccgaaacaaaaaaaaacaaaccctcgctcctcgcaaacttaattttctttatttatttcaaaaattaactctata

SEQ ID NO: 1557 - DNA, 597 bp, Artificial Sequence
  chemically treated genomic DNA (Homo sapiens) CpG-island No: 1557
ttacgtcgtcgttcgtttaatcgtcgagcgtttcgggtgtgagttcgtttcgcggggagcggtttggagtcgaggaggcggcggtagaggtggtttgggtagtttcgcgcggcggataggtttaggtaaataatatttattttttttttttttcgtttagtttaatttttattcggtttcggttacgttttgtcgttatcgttttttcgggtagtttttcgttcggtagttaggtttcggtcgggggcgggagagaggcggtgtttcgaagaaggtatcgcgatcgtcggaaattacgagtatcgatagttttcgcggtagtgttttatttttttttttttattatttagcgcgcgttattttgggtttagttaatggagatagagttagggaaaaagggcgttcgggttcggatgcgttttaggaaagttatgttttttgcgcgggggtagcgggtagtttatttagcgcgtcgatttgttggtggttcgcgcgcgtttacgttcgtcgttttcgtttgtttggattaagggttttatttttttttttagtggtaattggagggattgttggagggggtttttgagtggagggcgt

SEQ ID NO: 1558 - DNA, 597 bp, Artificial Sequence
  chemically treated genomic DNA (Homo sapiens) CpG-island No: 1558
acgccctccactcaaaaaccccctccaacaatccctccaattaccactaaaaaaaaaaataaaacccttaatccaaacaaacgaaaacgacgaacgtaaacgcgcgcgaaccaccaacaaatcgacgcgctaaataaactacccgctacccccgcgcaaaaaacataactttcctaaaacgcatccgaacccgaacgccctttttccctaactctatctccattaactaaacccaaaataacgcgcgctaaataataaaaaaaaaaaaataaaacactaccgcgaaaactatcgatactcgtaatttccgacgatcgcgataccttcttcgaaacaccgcctctctcccgcccccgaccgaaacctaactaccgaacgaaaaactacccgaaaaaacgataacgacaaaacgtaaccgaaaccgaataaaaattaaactaaacgaaaaaaaaaaaaaataaatattatttacctaaacctatccgccgcgcgaaactacccaaaccacctctaccgccgcctcctcgactccaaaccgctccccgcgaaacgaactcacacccgaaacgctcgacgattaaacgaacgacgacgtaa

SEQ ID NO: 1559 - DNA, 597 bp, Artificial Sequence
  chemically treated genomic DNA (Homo sapiens) CpG-island No: 1559
gcgttttttatttaaaaattttttttagtaatttttttaattgttattaaagaaaaaagtagggtttttgatttaggtaagcgagagcggcggacgtgggcgcgcgcggattattaataggtcggcgcgttgggtgaattgttcgttgttttcgcgtagggagtatggtttttttgaggcgtattcggattcgggcgttttttttttttggttttgtttttattggttgagtttagggtgacgcgcgttgagtggtgggagaaagggggtggggtattatcgcgaaggttgtcggtattcgtagttttcggcggtcgcggtgtttttttcgaggtatcgtttttttttcgttttcgatcgaggtttggttgtcgagcggaaagttgttcgagggggcggtggcggtagggcgtggtcggggtcgagtgggagttgaattgagcgaggaggagggggaatgggtgttgtttgtttgggtttattcgtcgcgcggggttgtttaaattatttttgtcgtcgttttttcggttttaagtcgtttttcgcggggcgagtttatattcggagcgttcggcgattgagcgggcggcggcgtgg

SEQ ID NO: 1560 - DNA, 597 bp, Artificial Sequence
  chemically treated genomic DNA (Homo sapiens) CpG-island No: 1560
ccacgccgccgcccgctcaatcgccgaacgctccgaatataaactcgccccgcgaaaaacgacttaaaaccgaaaaaacgacgacaaaaataatttaaacaaccccgcgcgacgaataaacccaaacaaacaacacccattccccctcctcctcgctcaattcaactcccactcgaccccgaccacgccctaccgccaccgccccctcgaacaactttccgctcgacaaccaaacctcgatcgaaaacgaaaaaaaaacgatacctcgaaaaaaacaccgcgaccgccgaaaactacgaataccgacaaccttcgcgataataccccaccccctttctcccaccactcaacgcgcgtcaccctaaactcaaccaataaaaacaaaaccaaaaaaaaaaaacgcccgaatccgaatacgcctcaaaaaaaccatactccctacgcgaaaacaacgaacaattcacccaacgcgccgacctattaataatccgcgcgcgcccacgtccgccgctctcgcttacctaaatcaaaaaccctacttttttctttaataacaattaaaaaaattactaaaaaaaatttttaaataaaaaacgc

SEQ ID NO: 1561 - DNA, 660 bp, Artificial Sequence
  chemically treated genomic DNA (Homo sapiens) CpG-island No: 1561
acgcggtttttcggtcgtgttcgggatttagagttcgagggttttttttttcggttttggttttggcgtatattgggcggtggcgcggtgcgtttatttcgtttttagcgggttggggcggggatatcgtttttcgggaaacgggacgcgttgtttgttttaggttttcgtttcggtttgcgaggttatagttgtgcgtagtggcgcggttgttaagtagtagtaggtgggagattagggtttgcgttcgcggcgatcgcggaggagggtgggcgtttgcggaggtgttttcgtttatttcggggggtttagagtttcgggtgaggagttagtcggtttcgcgttttttcggacggttgtttaatggtagtttaggtggtagttcgggaggcgcgagattttagagaagtttcgatttttcgtttaatttcgggggtcggtttggaggtagtgggcgttgtggagttcgaggaggaggaggagaacgaggaggaggcggcggttaggagagcgcggagtttcgtttaagacgcgcgggtgcgttttttcggcggtcgtttggcgatgatgttggggtttacggaggagaaatggagttagtatttggaaagcgaggataatcggtaggtttttggggagtttttggaaagtattagttcg

SEQ ID NO: 1562 - DNA, 660 bp, Artificial Sequence
  chemically treated genomic DNA (Homo sapiens) CpG-island No: 1562
cgaactaatactttccaaaaactccccaaaaacctaccgattatcctcgctttccaaatactaactccatttctcctccgtaaaccccaacatcatcgccaaacgaccgccgaaaaaacgcacccgcgcgtcttaaacgaaactccgcgctctcctaaccgccgcctcctcctcgttctcctcctcctcctcgaactccacaacgcccactacctccaaaccgacccccgaaattaaacgaaaaatcgaaacttctctaaaatctcgcgcctcccgaactaccacctaaactaccattaaacaaccgtccgaaaaaacgcgaaaccgactaactcctcacccgaaactctaaaccccccgaaataaacgaaaacacctccgcaaacgcccaccctcctccgcgatcgccgcgaacgcaaaccctaatctcccacctactactacttaacaaccgcgccactacgcacaactataacctcgcaaaccgaaacgaaaacctaaaacaaacaacgcgtcccgtttcccgaaaaacgatatccccgccccaacccgctaaaaacgaaataaacgcaccgcgccaccgcccaatatacgccaaaaccaaaaccgaaaaaaaaaaccctcgaactctaaatcccgaacacgaccgaaaaaccgcgt

SEQ ID NO: 1563 - DNA, 660 bp, Artificial Sequence
  chemically treated genomic DNA (Homo sapiens) CpG-island No: 1563
cgggttggtgttttttagaaattttttaagaatttgtcggttgttttcgttttttaaatattggttttatttttttttcgtgaattttagtattatcgttaggcggtcgtcgaggaagcgtattcgcgcgttttgggcgaaatttcgcgtttttttggtcgtcgtttttttttcgttttttttttttttttcgagttttatagcgtttattgtttttaggtcggttttcgaggttaggcgaagggtcggggtttttttgaagtttcgcgtttttcgggttgttatttgggttgttattgggtaatcgttcgagggaacgcgaggtcggttggttttttattcgagattttgggtttttcgaagtgagcgaggatattttcgtaggcgtttattttttttcgcggtcgtcgcgagcgtagattttagttttttatttgttgttatttagtagtcgcgttattgcgtatagttgtagtttcgtaggtcgaagcgaaggtttgggataagtagcgcgtttcgtttttcgggggacggtgttttcgttttagttcgttgggggcggagtgagcgtatcgcgttatcgtttagtatacgttaaggttaaggtcgaggggagaggttttcgggttttaggtttcgaatacggtcgagaagtcgcgt

SEQ ID NO: 1564 - DNA, 660 bp, Artificial Sequence
  chemically treated genomic DNA (Homo sapiens) CpG-island No: 1564
acgcgacttctcgaccgtattcgaaacctaaaacccgaaaacctctcccctcgaccttaaccttaacgtatactaaacgataacgcgatacgctcactccgcccccaacgaactaaaacgaaaacaccgtcccccgaaaaacgaaacgcgctacttatcccaaaccttcgcttcgacctacgaaactacaactatacgcaataacgcgactactaaataacaacaaataaaaaactaaaatctacgctcgcgacgaccgcgaaaaaaaataaacgcctacgaaaatatcctcgctcacttcgaaaaacccaaaatctcgaataaaaaaccaaccgacctcgcgttccctcgaacgattacccaataacaacccaaataacaacccgaaaaacgcgaaacttcaaaaaaaccccgacccttcgcctaacctcgaaaaccgacctaaaaacaataaacgctataaaactcgaaaaaaaaaaaaaaaacgaaaaaaaaacgacgaccaaaaaaacgcgaaatttcgcccaaaacgcgcgaatacgcttcctcgacgaccgcctaacgataatactaaaattcacgaaaaaaaaataaaaccaatatttaaaaaacgaaaacaaccgacaaattcttaaaaaatttctaaaaaacaccaacccg

SEQ ID NO: 1565 - DNA, 510 bp, Artificial Sequence
  chemically treated genomic DNA (Homo sapiens) CpG-island No: 1565
ggcgaggtcggggtggttcgggaggcggcggcgtcgaggcggttttgacgggtaagcgttcggagcggcgttgcgttgcgtcgaggcgggcgggcgggcgggcggagcggggcgggcggagcgcggcgcgtggggttcgttattagtcgtcgtttcgtttcgttatttcgggttttgtttggcgattcgttgtttcggcgtcggttgtagcggagttgcggttcgattgttcggttcgtcgtgtttttaggtgttttcggtttgcgtttttatttatacgttcggtaagtgagttcgggagtcgcggatttcgggggagaggggttgttacgagtggcggcggcgtcgatttttatgcgttcgggtaggtttggagaattatgtcgggttggattgaatcggtttttatagcggttttttcgtcggagttcgtcgtttttttgtcgttttcggggtgtaaagagtaacggggattttttttttttaatgtagaggttttagttttcgggt

SEQ ID NO: 1566 - DNA, 510 bp, Artificial Sequence
  chemically treated genomic DNA (Homo sapiens) CpG-island No: 1566
acccgaaaactaaaacctctacattaaaaaaaaaaaatccccgttactctttacaccccgaaaacgacaaaaaaacgacgaactccgacgaaaaaaccgctataaaaaccgattcaatccaacccgacataattctccaaacctacccgaacgcataaaaatcgacgccgccgccactcgtaacaacccctctcccccgaaatccgcgactcccgaactcacttaccgaacgtataaataaaaacgcaaaccgaaaacacctaaaaacacgacgaaccgaacaatcgaaccgcaactccgctacaaccgacgccgaaacaacgaatcgccaaacaaaacccgaaataacgaaacgaaacgacgactaataacgaaccccacgcgccgcgctccgcccgccccgctccgcccgcccgcccgcccgcctcgacgcaacgcaacgccgctccgaacgcttacccgtcaaaaccgcctcgacgccgccgcctcccgaaccaccccgacctcgcc

SEQ ID NO: 1567 - DNA, 510 bp, Artificial Sequence
  chemically treated genomic DNA (Homo sapiens) CpG-island No: 1567
attcgaaaattaaaatttttgtattaaaaaaaaaaaattttcgttgttttttatatttcggaaacggtaagggaacgacgggtttcggcggaggggtcgttgtgggagtcggtttaatttagttcggtatggttttttaggtttgttcgggcgtatgaagatcggcgtcgtcgttattcgtagtaatttttttttttcgaaattcgcggttttcgggtttatttatcgagcgtgtggatgggagcgtaggtcgggggtatttgggagtacggcgggtcgaatagtcgagtcgtagtttcgttgtagtcgacgtcggggtagcgagtcgttagataaagttcgagatggcgaagcggagcgacggttaatggcgagttttacgcgtcgcgtttcgttcgtttcgtttcgttcgttcgttcgttcgtttcggcgtagcgtagcgtcgtttcgagcgtttgttcgttagagtcgtttcggcgtcgtcgtttttcgggttatttcggtttcgtt

SEQ ID NO: 1568 - DNA, 510 bp, Artificial Sequence
  chemically treated genomic DNA (Homo sapiens) CpG-island No: 1568
aacgaaaccgaaataacccgaaaaacgacgacgccgaaacgactctaacgaacaaacgctcgaaacgacgctacgctacgccgaaacgaacgaacgaacgaacgaaacgaaacgaacgaaacgcgacgcgtaaaactcgccattaaccgtcgctccgcttcgccatctcgaactttatctaacgactcgctaccccgacgtcgactacaacgaaactacgactcgactattcgacccgccgtactcccaaatacccccgacctacgctcccatccacacgctcgataaataaacccgaaaaccgcgaatttcgaaaaaaaaaaattactacgaataacgacgacgccgatcttcatacgcccgaacaaacctaaaaaaccataccgaactaaattaaaccgactcccacaacgacccctccgccgaaacccgtcgttcccttaccgtttccgaaatataaaaaacaacgaaaattttttttttttaatacaaaaattttaattttcgaat

SEQ ID NO: 1569 - DNA, 1651 bp, Artificial Sequence
  chemically treated genomic DNA (Homo sapiens) CpG-island No: 1569
cgcggtcgtatttcggttttttttcgtcggcgaagtttgttagttttttcgcgggtttggcgaggtcgttttcggcgttcgttcgttcgtttaggtttcgagtttcgtcgttattcgggcggttgcgtgtttttttgtttcggttttttttttttttttcggcggcggtagtagtagtagtagtagtcgtcgtcgtcgttagtattattattattatttttttttttttttttttttttttcgtttcggtcgttcgggtttttttagttttcgtttttttttttagttgtttttcgcggagttcgttcgggtaggttgtgggagggagcggagtcggcgaggcgggcgggttggcgttcgtttttcgggggtcggtgtgcgttttacggggaaggacgcgttcgttgtttcgtttttttcgttttttttttcgtttttttttttttttttttttttttttttttcgtttcggcggttgaggttgcggcggcggcggggggtgtgcgagttgaggtcggggtcggcggcgggcgggttgtttgtaggcggagggcgttgtgttttgtgtttttcgtcgcgaggagtagtaggtagtagttatagtcgtcgtcgtcgtcgtcgtcgttatagtagtagtagtcgtcgttttagcgtcgtcgtttcgttcggaggaggagtcgttgtcgtcgcgggagggagttgcggttgtgttcggtcgagcgggggagggcgtcgttatttagagttagggagggagtcgttggagcgggaagttcggaggtcgcgttgcgtcgggtaatcgaggcggttgaggacgcgcgttggggtcggggtcggacggcgggagcgaatcgcggggtgcggtgggcgtttagcggggattcgaagcgattatcgagtaggcgatcgggcgcgagtagattagggtatttgggaggacgtcgagagtcgggggaggggaaggtaggaagcgaggtttgagtcgagtttcggtcgttggcggaggagttcgcgtttttcggagtcggtaggcgtagtttttttcggtcgtcggagggggcggcggggtcggtgagcgttgcgttttcgtttttcggtcgtcgttttttcgttttttttttggttcggtttttcggaggtcggggcgggggcgtcggcggggttgggtcgtaggttcgggggaggaggcggcggttttcgtcgcggtcgcgtttttgtgtcgggttttttcgtgcgcgtcggggtggttgggcggtggcggcgtttttggtcggggtgggtggttcgggggcggggggtaggttaggtcgttttttttcggttgtttgttcgtttgtgcgggcggggacggcgaagggagttcgggaggggggagcggcgggaattcggattcggttttcgggggcggtgcggtcgtttcgtttcggggttggcggcggttgcgttgcgttcgggttttcgtcgggttgcggaggcggggggaatcggtcggggggaggcgggaggaggagattggggcgcgtgttcgttttcgtggtcgcgcgcgttttttattcgtttttttttttttttcgttttttagtttggggttttttcggggcgggcgtttcgaggaggaggagattttttttttttttttttttttggttgg

SEQ ID NO: 1570 - DNA, 1651 bp, Artificial Sequence
  chemically treated genomic DNA (Homo sapiens) CpG-island No: 1570
ccaaccaaaaaaaaaaaaaaaaaaaaaatctcctcctcctcgaaacgcccgccccgaaaaaaccccaaactaaaaaacgaaaaaaaaaaaaaaacgaataaaaaacgcgcgcgaccacgaaaacgaacacgcgccccaatctcctcctcccgcctccccccgaccgattccccccgcctccgcaacccgacgaaaacccgaacgcaacgcaaccgccgccaaccccgaaacgaaacgaccgcaccgcccccgaaaaccgaatccgaattcccgccgctcccccctcccgaactcccttcgccgtccccgcccgcacaaacgaacaaacaaccgaaaaaaaacgacctaacctaccccccgcccccgaaccacccaccccgaccaaaaacgccgccaccgcccaaccaccccgacgcgcacgaaaaaacccgacacaaaaacgcgaccgcgacgaaaaccgccgcctcctcccccgaacctacgacccaaccccgccgacgcccccgccccgacctccgaaaaaccgaaccaaaaaaaaaacgaaaaaacgacgaccgaaaaacgaaaacgcaacgctcaccgaccccgccgccccctccgacgaccgaaaaaaactacgcctaccgactccgaaaaacgcgaactcctccgccaacgaccgaaactcgactcaaacctcgcttcctaccttcccctcccccgactctcgacgtcctcccaaataccctaatctactcgcgcccgatcgcctactcgataatcgcttcgaatccccgctaaacgcccaccgcaccccgcgattcgctcccgccgtccgaccccgaccccaacgcgcgtcctcaaccgcctcgattacccgacgcaacgcgacctccgaacttcccgctccaacgactccctccctaactctaaataacgacgccctcccccgctcgaccgaacacaaccgcaactccctcccgcgacgacaacgactcctcctccgaacgaaacgacgacgctaaaacgacgactactactactataacgacgacgacgacgacgacgactataactactacctactactcctcgcgacgaaaaacacaaaacacaacgccctccgcctacaaacaacccgcccgccgccgaccccgacctcaactcgcacaccccccgccgccgccgcaacctcaaccgccgaaacgaaaaaaaaaaaaaaaaaaaaaaaaaaaaaaacgaaaaaaaaaacgaaaaaaacgaaacaacgaacgcgtccttccccgtaaaacgcacaccgacccccgaaaaacgaacgccaacccgcccgcctcgccgactccgctccctcccacaacctacccgaacgaactccgcgaaaaacaactaaaaaaaaaaacgaaaactaaaaaaacccgaacgaccgaaacgaaaaaaaaaaaaaaaaaaaaaaaaataataataataatactaacgacgacgacgactactactactactactaccgccgccgaaaaaaaaaaaaaaaaccgaaacaaaaaaacacgcaaccgcccgaataacgacgaaactcgaaacctaaacgaacgaacgaacgccgaaaacgacctcgccaaacccgcgaaaaaactaacaaacttcgccgacgaaaaaaaaccgaaatacgaccgcg

SEQ ID NO: 1571 - DNA, 1651 bp, Artificial Sequence
  chemically treated genomic DNA (Homo sapiens) CpG-island No: 1571
ttagttaaaaaaaaaaaaaaagaaaaaattttttttttttcggagcgttcgtttcggggaggttttaggttggagggcgggggaagaggaagggcgggtaaagggcgcgcgcggttacggaagcgggtacgcgttttagtttttttttttcgttttttttcggtcggtttttttcgttttcgtaattcggcggggattcggacgtagcgtagtcgtcgttagtttcggagcggagcggtcgtatcgttttcggggatcggattcggattttcgtcgtttttttttttcgggtttttttcgtcgttttcgttcgtataggcgggtaagtagtcggagagaagcggtttagtttgtttttcgttttcgagttatttatttcggttagaggcgtcgttatcgtttagttatttcgacgcgtacggaggagttcggtatagaggcgcgatcgcggcgggaatcgtcgttttttttttcgagtttgcggtttagtttcgtcggcgttttcgtttcggttttcggggagtcgagttaaggagagggcgggaggacggcggtcgggaggcgggggcgtagcgtttatcggtttcgtcgtttttttcggcggtcggggagaattgcgtttgtcggtttcgagaagcgcgggttttttcgttagcggtcggggttcggtttaggtttcgttttttgtttttttttttttcggttttcggcgtttttttaagtgttttggtttgttcgcgttcggtcgtttgttcggtggtcgtttcgggttttcgttgggcgtttatcgtatttcgcggttcgttttcgtcgttcggtttcgattttagcgcgcgtttttagtcgtttcggttattcggcgtagcgcggttttcgggtttttcgttttagcggttttttttttggttttgagtggcggcgttttttttcgttcggtcgggtatagtcgtagttttttttcgcggcggtagcggtttttttttcgggcgaggcggcggcgttggggcggcggttgttgttgttgtggcggcggcggcggcggcggcggttgtggttgttgtttgttgtttttcgcggcgaaaagtataaagtatagcgtttttcgtttgtaggtagttcgttcgtcgtcggtttcggttttagttcgtatatttttcgtcgtcgtcgtagttttagtcgtcggagcggggaggaggagggagaagggaggaggaggagcgggagggggggcgggagaagcggggtagcgagcgcgttttttttcgtagagcgtatatcgattttcggggagcgagcgttagttcgttcgtttcgtcggtttcgtttttttttatagtttgttcgggcgggtttcgcggggggtagttgggaggaggggcgggagttggggggattcgggcggtcgaggcggagggaaggaaggaggggaggggggtggtggtggtggtgttggcggcggcggcggttgttgttgttgttgttgtcgtcgtcggggaagggggggggggtcggggtagggagatacgtagtcgttcggatggcggcggggttcggagtttaggcgggcgggcgggcgtcgagagcgatttcgttagattcgcgggggaattagtaggtttcgtcggcgagggagggtcgaggtgcggtcgcg

SEQ ID NO: 1572 - DNA, 1651 bp, Artificial Sequence
  chemically treated genomic DNA (Homo sapiens) CpG-island No: 1572
cgcgaccgcacctcgaccctccctcgccgacgaaacctactaattcccccgcgaatctaacgaaatcgctctcgacgcccgcccgcccgcctaaactccgaaccccgccgccatccgaacgactacgtatctccctaccccgacccccccccccttccccgacgacgacaacaacaacaacaacaaccgccgccgccgccaacaccaccaccaccacccccctcccctccttccttccctccgcctcgaccgcccgaatccccccaactcccgcccctcctcccaactaccccccgcgaaacccgcccgaacaaactataaaaaaaaacgaaaccgacgaaacgaacgaactaacgctcgctccccgaaaatcgatatacgctctacgaaaaaaaacgcgctcgctaccccgcttctcccgccccccctcccgctcctcctcctcccttctccctcctcctccccgctccgacgactaaaactacgacgacgacgaaaaatatacgaactaaaaccgaaaccgacgacgaacgaactacctacaaacgaaaaacgctatactttatacttttcgccgcgaaaaacaacaaacaacaaccacaaccgccgccgccgccgccgccgccacaacaacaacaaccgccgccccaacgccgccgcctcgcccgaaaaaaaaaccgctaccgccgcgaaaaaaaactacgactatacccgaccgaacgaaaaaaaacgccgccactcaaaaccaaaaaaaaaaccgctaaaacgaaaaacccgaaaaccgcgctacgccgaataaccgaaacgactaaaaacgcgcgctaaaatcgaaaccgaacgacgaaaacgaaccgcgaaatacgataaacgcccaacgaaaacccgaaacgaccaccgaacaaacgaccgaacgcgaacaaaccaaaacacttaaaaaaacgccgaaaaccgaaaaaaaaaaaaacaaaaaacgaaacctaaaccgaaccccgaccgctaacgaaaaaacccgcgcttctcgaaaccgacaaacgcaattctccccgaccgccgaaaaaaacgacgaaaccgataaacgctacgcccccgcctcccgaccgccgtcctcccgccctctccttaactcgactccccgaaaaccgaaacgaaaacgccgacgaaactaaaccgcaaactcgaaaaaaaaaacgacgattcccgccgcgatcgcgcctctataccgaactcctccgtacgcgtcgaaataactaaacgataacgacgcctctaaccgaaataaataactcgaaaacgaaaaacaaactaaaccgcttctctccgactacttacccgcctatacgaacgaaaacgacgaaaaaaacccgaaaaaaaaaaacgacgaaaatccgaatccgatccccgaaaacgatacgaccgctccgctccgaaactaacgacgactacgctacgtccgaatccccgccgaattacgaaaacgaaaaaaaccgaccgaaaaaaaacgaaaaaaaaaaactaaaacgcgtacccgcttccgtaaccgcgcgcgccctttacccgcccttcctcttcccccgccctccaacctaaaacctccccgaaacgaacgctccgaaaaaaaaaaaattttttctttttttttttttttaactaa

SEQ ID NO: 1573 - DNA, 823 bp, Artificial Sequence
  chemically treated genomic DNA (Homo sapiens) CpG-island No: 1573
ggaagggcgggggagtttgggtcggaaggcgttttaggttcggttggtagtcggcgttttttttcgacgttattcgttgttttcgttttcgagtcggtcgggacggtaaaacgttttcgtttttagcgtatcgcgtattttattttgaacgtcgttttatttatttttattttattggttttttcgggtcgaggtttttttgcgattggtcggggaggttcgcgaaggtttcgtttattttttcgttttcgttttcgttcgtcggtattttggacggcggcgtggcgtttttttttttttttcggttttcgttttttggagtaaatgttgtcgagttgcggtcgcggggtagatgtacgcgttcgggtttttttagtaggcgcgagtagtcgttgggcgcgcgaaagcgaaagaaggaagaggaagggagggggagggcggggtgttggggaggggcgggaggaggaagaggaggaggttggagcgcgttcgcgtttggtttcgcgttcgcgtagagggagggggagaggggcgcgcgcgcgtacgttcgcgtttacgttcgttttatttatttatttttcggtcgcggtatacgcgcgcgcgtttcgggttcgcgtcgtatttttcgttcgggagaggcgggttggagtggggggcggggggaggggcgcgcggacggcgcgcggattgcgcgcgggcggggtgaggtgaggaggaggaggcggcgacgggataagaagggaggggaaggggttatggtcgttcggtgaggcggttaggcgggggggcggttcgatttttcggtttcgggttttgggtttcg

SEQ ID NO: 1574 - DNA, 823 bp, Artificial Sequence
  chemically treated genomic DNA (Homo sapiens) CpG-island No: 1574
cgaaacccaaaacccgaaaccgaaaaatcgaaccgcccccccgcctaaccgcctcaccgaacgaccataaccccttcccctcccttcttatcccgtcgccgcctcctcctcctcacctcaccccgcccgcgcgcaatccgcgcgccgtccgcgcgcccctccccccgccccccactccaacccgcctctcccgaacgaaaaatacgacgcgaacccgaaacgcgcgcgcgtataccgcgaccgaaaaataaataaataaaacgaacgtaaacgcgaacgtacgcgcgcgcgcccctctccccctccctctacgcgaacgcgaaaccaaacgcgaacgcgctccaacctcctcctcttcctcctcccgcccctccccaacaccccgccctccccctcccttcctcttccttctttcgctttcgcgcgcccaacgactactcgcgcctactaaaaaaacccgaacgcgtacatctaccccgcgaccgcaactcgacaacatttactccaaaaaacgaaaaccgaaaaaaaaaaaaaaacgccacgccgccgtccaaaataccgacgaacgaaaacgaaaacgaaaaaataaacgaaaccttcgcgaacctccccgaccaatcgcaaaaaaacctcgacccgaaaaaaccaataaaataaaaataaataaaacgacgttcaaaataaaatacgcgatacgctaaaaacgaaaacgttttaccgtcccgaccgactcgaaaacgaaaacaacgaataacgtcgaaaaaaaacgccgactaccaaccgaacctaaaacgccttccgacccaaactcccccgcccttcc

SEQ ID NO: 1575 - DNA, 823 bp, Artificial Sequence
  chemically treated genomic DNA (Homo sapiens) CpG-island No: 1575
cggggtttagggttcggggtcggggggtcgggtcgttttttcgtttggtcgttttatcgggcggttatggtttttttttttttttttttgtttcgtcgtcgtttttttttttttattttatttcgttcgcgcgtagttcgcgcgtcgttcgcgcgttttttttttcgttttttattttagttcgtttttttcgggcggggggtgcggcgcgagttcggagcgcgcgcgcgtgtgtcgcgatcggaggatggatggatggagcgagcgtgaacgcgagcgtgcgcgcgcgcgtttttttttttttttttttgcgcgggcgcgaggttaagcgcgagcgcgttttaattttttttttttttttttttcgtttttttttaatatttcgtttttttttttttttttttttttttttttcgttttcgcgcgtttagcgattgttcgcgtttgttagaagggttcgagcgcgtgtatttgtttcgcggtcgtagttcggtagtatttgttttagggggcggggatcgggaggggaggaggggcgttacgtcgtcgtttaaagtatcggcggacggggacgggggcggagagatgggcggggttttcgcggattttttcgattaatcgtagggaggtttcggttcgggaggattaataagatgggggtgggtggggcggcgtttaaggtgaggtgcgcggtgcgttgggggcggagacgttttgtcgtttcggtcggttcgggggcgggggtagcgggtggcgtcgaaagagagcgtcggttgttagtcgagtttgggacgtttttcggtttaggttttttcgttttttt

SEQ ID NO: 1576 - DNA, 823 bp, Artificial Sequence
  chemically treated genomic DNA (Homo sapiens) CpG-island No: 1576
aaaaaaacgaaaaaacctaaaccgaaaaacgtcccaaactcgactaacaaccgacgctctctttcgacgccacccgctacccccgcccccgaaccgaccgaaacgacaaaacgtctccgcccccaacgcaccgcgcacctcaccttaaacgccgccccacccacccccatcttattaatcctcccgaaccgaaacctccctacgattaatcgaaaaaatccgcgaaaaccccgcccatctctccgcccccgtccccgtccgccgatactttaaacgacgacgtaacgcccctcctcccctcccgatccccgccccctaaaacaaatactaccgaactacgaccgcgaaacaaatacacgcgctcgaacccttctaacaaacgcgaacaatcgctaaacgcgcgaaaacgaaaaaaaaaaaaaaaaaaaaaaaaaaaaacgaaatattaaaaaaaaacgaaaaaaaaaaaaaaaaaaaattaaaacgcgctcgcgcttaacctcgcgcccgcgcaaaaaaaaaaaaaaaaaaacgcgcgcgcgcacgctcgcgttcacgctcgctccatccatccatcctccgatcgcgacacacgcgcgcgcgctccgaactcgcgccgcaccccccgcccgaaaaaaacgaactaaaataaaaaacgaaaaaaaaaacgcgcgaacgacgcgcgaactacgcgcgaacgaaataaaataaaaaaaaaaaaacgacgacgaaacaaaaaaaaaaaaaaaaaaaccataaccgcccgataaaacgaccaaacgaaaaaacgacccgaccccccgaccccgaaccctaaaccccg

SEQ ID NO: 1577 - DNA, 547 bp, Artificial Sequence
  chemically treated genomic DNA (Homo sapiens) CpG-island No: 1577
acgtatttatataaatttattttatatatatatatataatttatttttatatatatatatgtagtttatttttatatatacgtatttatataatttatttttatatatatttatatatacgtaatttattcgtatttaaataatttatttttatatatatatttatatatacgtaatttatttttatatatatatacgtaatttattcgtatttatataatttatttttatatatatatttatatatacgtaatttattcgtaaataatttatttttatatatatatttatatatacgtaatttatttttatatatatacgtaatttatttgtatttaaatttatttttatatatatatttatatatacgtaatttatttttatatatatatttatataatttatttttatatatatttatatatacgtaatttatttttatatatacgtgtatatttatttttatacgtgtatttttatatatgtatatttatttttatacgtgtgtatttatatatatatattagcgtatttttatttttttata

SEQ ID NO: 1578 - DNA, 547 bp, Artificial Sequence
  chemically treated genomic DNA (Homo sapiens) CpG-island No: 1578
tataaaaaaataaaaatacgctaatatatatatataaatacacacgtataaaaataaatatacatatataaaaatacacgtataaaaataaatatacacgtatatataaaaataaattacgtatatataaatatatataaaaataaattatataaatatatatataaaaataaattacgtatatataaatatatatataaaaataaatttaaatacaaataaattacgtatatatataaaaataaattacgtatatataaatatatatataaaaataaattatttacgaataaattacgtatatataaatatatatataaaaataaattatataaatacgaataaattacgtatatatatataaaaataaattacgtatatataaatatatatataaaaataaattatttaaatacgaataaattacgtatatataaatatatataaaaataaattatataaatacgtatatataaaaataaactacatatatatatataaaaataaattatatatatatatataaaataaatttatataaatacgt

SEQ ID NO: 1579 - DNA, 547 bp, Artificial Sequence
  chemically treated genomic DNA (Homo sapiens) CpG-island No: 1579
tatggggaggtaggggtgcgttggtgtgtatgtgtaggtgtatacgtgtaggggtgggtgtgtatgtgtgagggtgtacgtgtgggggtgggtgtgtacgtgtgtgtaggggtgggttgcgtgtgtgtgaatgtgtataggggtgggttgtgtgaatgtgtgtgtaggggtgggttgcgtgtgtgtgaatgtgtgtgtaggggtgggtttgaatgtaggtaggttgcgtgtgtgtgtaggggtgggttgcgtgtgtgtgaatgtgtgtgtaggggtgggttgtttgcgggtaggttgcgtgtgtgtgaatgtgtgtgtaggggtgggttgtgtgaatgcgggtaggttgcgtgtgtgtgtgtaggggtgggttgcgtgtgtgtgaatgtgtgtgtaggggtgggttgtttgaatgcgggtaggttgcgtgtgtgtgaatgtgtataggggtgggttgtgtgaatgcgtgtgtgtaggggtgggttgtatgtgtgtgtgtaggggtgggttgtgtgtgtgtgtatggggtgggtttgtgtgaatgcgt

SEQ ID NO: 1580 - DNA, 547 bp, Artificial Sequence
  chemically treated genomic DNA (Homo sapiens) CpG-island No: 1580
acgcattcacacaaacccaccccatacacacacacacaacccacccctacacacacacatacaacccacccctacacacacgcattcacacaacccacccctatacacattcacacacacgcaacctacccgcattcaaacaacccacccctacacacacattcacacacacgcaacccacccctacacacacacacgcaacctacccgcattcacacaacccacccctacacacacattcacacacacgcaacctacccgcaaacaacccacccctacacacacattcacacacacgcaacccacccctacacacacacgcaacctacctacattcaaacccacccctacacacacattcacacacacgcaacccacccctacacacacattcacacaacccacccctatacacattcacacacacgcaacccacccctacacacacgtacacacccacccccacacgtacaccctcacacatacacacccacccctacacgtatacacctacacatacacaccaacgcacccctacctccccata

SEQ ID NO: 1581 - DNA, 589 bp, Artificial Sequence
  chemically treated genomic DNA (Homo sapiens) CpG-island No: 1581
gcgttatttgtttagggtcgaagtatttatcggttcgtgagtggggtcgacgcggggtttgcgacgttttggggttttgggtcgggtaaaaaagttgttcgggagtagttgaacgcggcgtaaacgggagatttgcgttcgcgggggagtaatttgtattcgttgttaaatattcggttagcgcggttttttgtattagggggcgggataggggcgggggttttcgatttttttttattttaaacgcggtttttcgaatgcggcgttagttcggtttgttgagtggtcggtgtagtcgttaattattttatattttcgttaattacggtgcgtttcgtttagttgcggttcggtattttttttgcgtggttgggttcgaggggttagaaggcgggttcggttcgtttatagcgaaagttttcgagcggattcgggtttcggtttcgttttcgtttcgttcgcggaacgtttagttgtttagcgaggtcgttcgtttttttttgtaataggtggtttggattcgtggaaaaggtttcggttattttttatttattatttcggttttagcgtttttaattgtagatttatt

SEQ ID NO: 1582 - DNA, 589 bp, Artificial Sequence
  chemically treated genomic DNA (Homo sapiens) CpG-island No: 1582
aataaatctacaattaaaaacgctaaaaccgaaataataaataaaaaataaccgaaaccttttccacgaatccaaaccacctattacaaaaaaaaacgaacgacctcgctaaacaactaaacgttccgcgaacgaaacgaaaacgaaaccgaaacccgaatccgctcgaaaactttcgctataaacgaaccgaacccgccttctaacccctcgaacccaaccacgcaaaaaaaataccgaaccgcaactaaacgaaacgcaccgtaattaacgaaaatataaaataattaacgactacaccgaccactcaacaaaccgaactaacgccgcattcgaaaaaccgcgtttaaaataaaaaaaaatcgaaaacccccgcccctatcccgccccctaatacaaaaaaccgcgctaaccgaatatttaacaacgaatacaaattactcccccgcgaacgcaaatctcccgtttacgccgcgttcaactactcccgaacaacttttttacccgacccaaaaccccaaaacgtcgcaaaccccgcgtcgaccccactcacgaaccgataaatacttcgaccctaaacaaataacgc

SEQ ID NO: 1583 - DNA, 589 bp, Artificial Sequence
  chemically treated genomic DNA (Homo sapiens) CpG-island No: 1583
aatgaatttgtagttggggacgttgaggtcggagtggtggatgaaaggtggtcggagttttttttacgggtttaaattatttgttataggagaaggcgagcggtttcgttaagtaattggacgtttcgcgggcggggcgggggcggggtcggggttcgagttcgttcggaaattttcgttgtgggcgagtcggattcgttttttggtttttcgggtttaattacgtagggggagtgtcgggtcgtagttaggcgaggcgtatcgtgattggcggagatgtggagtgattggcggttatatcggttatttagtaggtcgagttggcgtcgtattcggggggtcgcgtttggagtggagggaggtcgaaagttttcgtttttgtttcgttttttagtgtagaaggtcgcgttagtcggatatttagtagcgagtgtagattgttttttcgcggacgtagatttttcgtttgcgtcgcgtttagttgttttcgaataatttttttgttcggtttaaggttttagggcgtcgtaggtttcgcgtcggttttatttacgggtcggtgagtatttcggttttgggtaagtggcgt

SEQ ID NO: 1584 - DNA, 589 bp, Artificial Sequence
  chemically treated genomic DNA (Homo sapiens) CpG-island No: 1584
acgccacttacccaaaaccgaaatactcaccgacccgtaaataaaaccgacgcgaaacctacgacgccctaaaaccttaaaccgaacaaaaaaattattcgaaaacaactaaacgcgacgcaaacgaaaaatctacgtccgcgaaaaaacaatctacactcgctactaaatatccgactaacgcgaccttctacactaaaaaacgaaacaaaaacgaaaactttcgacctccctccactccaaacgcgaccccccgaatacgacgccaactcgacctactaaataaccgatataaccgccaatcactccacatctccgccaatcacgatacgcctcgcctaactacgacccgacactccccctacgtaattaaacccgaaaaaccaaaaaacgaatccgactcgcccacaacgaaaatttccgaacgaactcgaaccccgaccccgcccccgccccgcccgcgaaacgtccaattacttaacgaaaccgctcgccttctcctataacaaataatttaaacccgtaaaaaaaactccgaccacctttcatccaccactccgacctcaacgtccccaactacaaattcatt

SEQ ID NO: 1585 - DNA, 1081 bp, Artificial Sequence
  chemically treated genomic DNA (Homo sapiens) CpG-island No: 1585
tttcgtttcgtttcgggttcgttcgcgttttttcgggcgataaaattttttcgtcgtcgtttagttaggattgatagttacggttgtagtagtcgcggttattaggggtttatttttggtattagttttttcggattacgcgtttttaaatattcgtttcggcggcggggggcggggaaggggggtgtcgatttcgttatagcgggtttcgaaggtcggtcgagtgacggaggggagttagcgtcgtttggcgtaggtcgcggtaatattgatttgtcgtcgttttcgcgtttgggttgcggcggtcgttttattggtcgtagtcgttttcgttcgtcgttttcgttcgttatcgtttcgttttttttcgttgtcgttatcgtcggggtttatgcgggattcgcgtttttttattcggaaaacgaggtcgggaaagggagcgtcggggtcgtcgaaatttcggcgttcgtcgttagtcgtcgttgtttgtttatatcggggggttgaggggtttttttgttaggggttataggtcgcgagttatttcgaggaggagtcgaaggaggcgtcgtcgttcgtagtcgagcgcgtcgggtcggtagaggtgaagcgtaagtaggcggcggatggcgggcgttcgcgttggcggatggttacgcggcggaggggtgcgcgagcgagcgaagtttggtgtgtcgggttttggcgaagggaaaaggtttcgtcgttttttgtagttatttcgagtttagcgttattattttgggagatatacggatttcgcggtcgcggcgtaagacgggaggattggttgggcgggtcgagtatttcggtaggtagcgcgcgtcgttcggtcgggcgagggttttaggtcgggacgcggggacgtggggcggggttaagacgcgcgggagggcgtcgcgtttcgtttttttttttttcgtcggtttcgtttttttttcgtttgtcgtcgtcgtcggcgtacgggttattgggaagaggaggtggtttgcggtttttcggagttttattaggttcggtcgttattttgcgattggatagaaagggtaatttttttttt

SEQ ID NO: 1586 - DNA, 1081 bp, Artificial Sequence
  chemically treated genomic DNA (Homo sapiens) CpG-island No: 1586
aaaaaaaaaattaccctttctatccaatcgcaaaataacgaccgaacctaataaaactccgaaaaaccgcaaaccacctcctcttcccaataacccgtacgccgacgacgacgacaaacgaaaaaaaaacgaaaccgacgaaaaaaaaaaaaacgaaacgcgacgccctcccgcgcgtcttaaccccgccccacgtccccgcgtcccgacctaaaaccctcgcccgaccgaacgacgcgcgctacctaccgaaatactcgacccgcccaaccaatcctcccgtcttacgccgcgaccgcgaaatccgtatatctcccaaaataataacgctaaactcgaaataactacaaaaaacgacgaaaccttttcccttcgccaaaacccgacacaccaaacttcgctcgctcgcgcacccctccgccgcgtaaccatccgccaacgcgaacgcccgccatccgccgcctacttacgcttcacctctaccgacccgacgcgctcgactacgaacgacgacgcctccttcgactcctcctcgaaataactcgcgacctataacccctaacaaaaaaacccctcaaccccccgatataaacaaacaacgacgactaacgacgaacgccgaaatttcgacgaccccgacgctccctttcccgacctcgttttccgaataaaaaaacgcgaatcccgcataaaccccgacgataacgacaacgaaaaaaaacgaaacgataacgaacgaaaacgacgaacgaaaacgactacgaccaataaaacgaccgccgcaacccaaacgcgaaaacgacgacaaatcaatattaccgcgacctacgccaaacgacgctaactcccctccgtcactcgaccgaccttcgaaacccgctataacgaaatcgacaccccccttccccgccccccgccgccgaaacgaatatttaaaaacgcgtaatccgaaaaaactaataccaaaaataaacccctaataaccgcgactactacaaccgtaactatcaatcctaactaaacgacgacgaaaaaattttatcgcccgaaaaaacgcgaacgaacccgaaacgaaacgaaa

SEQ ID NO: 1587 - DNA, 1081 bp, Artificial Sequence
  chemically treated genomic DNA (Homo sapiens) CpG-island No: 1587
aaaagagggattattttttttgtttagtcgtaagatggcgatcgagtttggtgggatttcgaggggtcgtaggttattttttttttttaatggttcgtgcgtcggcggcgacggtaagcgggagggaggcggggtcggcgaaggaaggaggggcggagcgcggcgttttttcgcgcgttttggtttcgttttacgttttcgcgtttcggtttggagttttcgttcggtcgggcggcgcgcgttgtttgtcgggatattcggttcgtttagttagttttttcgttttgcgtcgcggtcgcgagattcgtgtgttttttaagatggtggcgttgggttcggggtgattataggagacgacggggtttttttttttcgttaggattcgatatattaggtttcgttcgttcgcgtattttttcgtcgcgtagttattcgttagcgcgggcgttcgttattcgtcgtttatttacgttttatttttgtcgattcggcgcgttcggttgcgggcggcggcgtttttttcggttttttttcggaatagttcgcggtttgtagtttttggtaggagggttttttagtttttcggtgtggataggtagcggcggttggcgacgaacgtcgggatttcggcggtttcggcgttttttttttcggtttcgtttttcggataaggaagcgcgggtttcgtatgagtttcggcggtggcggtagcgaaagagaacgaggcggtggcgggcggaggcggcgggcgagggcgattacgattagtgaggcggtcgtcgtagtttaggcgcgggggcgacgataggttagtgttgtcgcggtttgcgttaggcggcgttggttttttttcgttattcggtcggttttcggggttcgttgtggcgaggtcgatatttttttttttcgtttttcgtcgtcgaggcgagtgtttgggggcgcgtggttcgaaggggttggtgttagaagtaggtttttggtggtcgcggttgttgtagtcgtaattgttagttttggttgagcgacggcgggagggttttgtcgttcgaggggacgcgagcgggttcggggcggggcggga

SEQ ID NO: 1588 - DNA, 1081 bp, Artificial Sequence
  chemically treated genomic DNA (Homo sapiens) CpG-island No: 1588
tcccgccccgccccgaacccgctcgcgtcccctcgaacgacaaaaccctcccgccgtcgctcaaccaaaactaacaattacgactacaacaaccgcgaccaccaaaaacctacttctaacaccaaccccttcgaaccacgcgcccccaaacactcgcctcgacgacgaaaaacgaaaaaaaaaaatatcgacctcgccacaacgaaccccgaaaaccgaccgaataacgaaaaaaaaccaacgccgcctaacgcaaaccgcgacaacactaacctatcgtcgcccccgcgcctaaactacgacgaccgcctcactaatcgtaatcgccctcgcccgccgcctccgcccgccaccgcctcgttctctttcgctaccgccaccgccgaaactcatacgaaacccgcgcttccttatccgaaaaacgaaaccgaaaaaaaaaacgccgaaaccgccgaaatcccgacgttcgtcgccaaccgccgctacctatccacaccgaaaaactaaaaaaccctcctaccaaaaactacaaaccgcgaactattccgaaaaaaaaccgaaaaaaacgccgccgcccgcaaccgaacgcgccgaatcgacaaaaataaaacgtaaataaacgacgaataacgaacgcccgcgctaacgaataactacgcgacgaaaaaatacgcgaacgaacgaaacctaatatatcgaatcctaacgaaaaaaaaaaaccccgtcgtctcctataatcaccccgaacccaacgccaccatcttaaaaaacacacgaatctcgcgaccgcgacgcaaaacgaaaaaactaactaaacgaaccgaatatcccgacaaacaacgcgcgccgcccgaccgaacgaaaactccaaaccgaaacgcgaaaacgtaaaacgaaaccaaaacgcgcgaaaaaacgccgcgctccgcccctccttccttcgccgaccccgcctccctcccgcttaccgtcgccgccgacgcacgaaccattaaaaaaaaaaaataacctacgacccctcgaaatcccaccaaactcgatcgccatcttacgactaaacaaaaaaaataatccctctttt

SEQ ID NO: 1589 - DNA, 510 bp, Artificial Sequence
  chemically treated genomic DNA (Homo sapiens) CpG-island No: 1589
gatcggcggggggtttttaaggcgtatgttttatattaaattttattttttttatcgatagggacggaagggaagtcgttgttttgttggaagggtgaatatcgttgttacgttggttttcgttttgtttacgttttgggcgggatttatcggtttaggtcgtagggttttcgttcgggtcgtcgtttttgttcgtaacgtagttgtttttgttggcgtcgtagtttttcgcgttcgcggtggatgcgtttttgtttttttttgcgtttacgttttacgcgtatgcgttcgcgttttagtcgttttcgttttatgcgttttcgttttagtcgttggcgttggtattcgagttgtaggcgttttcgttgtagtcgggtttttttttttcgtttatggaaggtttcgaggcgttgttttcgttttcgttgttcgcgttttttgcggggataggtgaggttgttttgaattttttgcgtgagtttttaaggagaaagttcggtgtttaaaatt

SEQ ID NO: 1590 - DNA, 510 bp, Artificial Sequence
  chemically treated genomic DNA (Homo sapiens) CpG-island No: 1590
aattttaaacaccgaactttctccttaaaaactcacgcaaaaaattcaaaacaacctcacctatccccgcaaaaaacgcgaacaacgaaaacgaaaacaacgcctcgaaaccttccataaacgaaaaaaaaaaacccgactacaacgaaaacgcctacaactcgaataccaacgccaacgactaaaacgaaaacgcataaaacgaaaacgactaaaacgcgaacgcatacgcgtaaaacgtaaacgcaaaaaaaaacaaaaacgcatccaccgcgaacgcgaaaaactacgacgccaacaaaaacaactacgttacgaacaaaaacgacgacccgaacgaaaaccctacgacctaaaccgataaatcccgcccaaaacgtaaacaaaacgaaaaccaacgtaacaacgatattcacccttccaacaaaacaacgacttcccttccgtccctatcgataaaaaaaataaaatttaatataaaacatacgccttaaaaaccccccgccgatc

SEQ ID NO: 1591 - DNA, 510 bp, Artificial Sequence
  chemically treated genomic DNA (Homo sapiens) CpG-island No: 1591
agttttgggtatcgggttttttttttggaggtttacgtagggagtttagggtagttttatttgttttcgtagggagcgcgagtagcgggagcgggagtaacgtttcgaggttttttatgagcggaaggagaaggttcggttatagcgggaacgtttgtagttcgagtgttagcgttagcggttggagcgggagcgtatggagcgggagcggttggagcgcgagcgtatgcgcgtggagcgtgagcgtaggaaggagtaggagcgtatttatcgcgagcgcgaggagttgcggcgttagtaggagtagttgcgttacgagtaggagcggcggttcgggcggaggttttacgatttggatcggtgagtttcgtttagagcgtgggtaggacggagattagcgtggtagcggtgtttatttttttagtagaatagcggtttttttttcgtttttgtcggtggggagaatgaaatttgatatggagtatgcgttttggggatttttcgtcgatt

SEQ ID NO: 1592 - DNA, 510 bp, Artificial Sequence
  chemically treated genomic DNA (Homo sapiens) CpG-island No: 1592
aatcgacgaaaaatccccaaaacgcatactccatatcaaatttcattctccccaccgacaaaaacgaaaaaaaaaccgctattctactaaaaaaataaacaccgctaccacgctaatctccgtcctacccacgctctaaacgaaactcaccgatccaaatcgtaaaacctccgcccgaaccgccgctcctactcgtaacgcaactactcctactaacgccgcaactcctcgcgctcgcgataaatacgctcctactccttcctacgctcacgctccacgcgcatacgctcgcgctccaaccgctcccgctccatacgctcccgctccaaccgctaacgctaacactcgaactacaaacgttcccgctataaccgaaccttctccttccgctcataaaaaacctcgaaacgttactcccgctcccgctactcgcgctccctacgaaaacaaataaaactaccctaaactccctacgtaaacctccaaaaaaaaaacccgatacccaaaact

SEQ ID NO: 1593 - DNA, 821 bp, Artificial Sequence
  chemically treated genomic DNA (Homo sapiens) CpG-island No: 1593
tcggggtcggttaagacgcggggcgaatttagggcgtttcgggttcgggagtcgcggtgataggtgtaggcgggggcgtgttcgggttttttgcgttattttcgagtttcgcgtcgttttatttttttgagtcgttttattaggacgtttttgttgtcgttcgtgtttaggtttcgtttttttagtttcgttcgtagatcgattattcgtagttcgttgagtcgtttcgttttagttttcgtaacgttcgggtcgagagaagtcgtgttagggttcgagtcgttcgattcgggtagagttttcgttatcgtcgcgttttcgttttcgttatcgatttagtcgtatatcgtcggtagttatagcggttttgaatataaaatggcgtcgtttaagaggaaaacgtattcgttttttttcgtttcgttttgcggtcgcgtacgcgtacgcgtatcgtttttattagcgtatttagtagtaaggacgttcgcgcgtttattaatcgcgggtttttcggtataacgcgtaagcgttgaatttgtagttcgtatgcgtttcggtagttttcggcgggaggttgacgagacgtaacgcgtttgcgtatattttcgcgttgtttttattgcgtatgtgtagttgtaatcgggatattagaatttacgtttggtgcgtttgcgtagaagcgaggcgcgttggggcgattggagcggttttttcgtaggcggcgttattttgtgttaggagtttgataaaatcggttcggttttgtggaaagtgggcggcggagttagggtttttggaatggcggagattttgttaggttt

SEQ ID NO: 1594 - DNA, 821 bp, Artificial Sequence
  chemically treated genomic DNA (Homo sapiens) CpG-island No: 1594
aaacctaacaaaatctccgccattccaaaaaccctaactccgccgcccactttccacaaaaccgaaccgattttatcaaactcctaacacaaaataacgccgcctacgaaaaaaccgctccaatcgccccaacgcgcctcgcttctacgcaaacgcaccaaacgtaaattctaatatcccgattacaactacacatacgcaataaaaacaacgcgaaaatatacgcaaacgcgttacgtctcgtcaacctcccgccgaaaactaccgaaacgcatacgaactacaaattcaacgcttacgcgttataccgaaaaacccgcgattaataaacgcgcgaacgtccttactactaaatacgctaataaaaacgatacgcgtacgcgtacgcgaccgcaaaacgaaacgaaaaaaaacgaatacgttttcctcttaaacgacgccattttatattcaaaaccgctataactaccgacgatatacgactaaatcgataacgaaaacgaaaacgcgacgataacgaaaactctacccgaatcgaacgactcgaaccctaacacgacttctctcgacccgaacgttacgaaaactaaaacgaaacgactcaacgaactacgaataatcgatctacgaacgaaactaaaaaaacgaaacctaaacacgaacgacaacaaaaacgtcctaataaaacgactcaaaaaaataaaacgacgcgaaactcgaaaataacgcaaaaaacccgaacacgcccccgcctacacctatcaccgcgactcccgaacccgaaacgccctaaattcgccccgcgtcttaaccgaccccga

SEQ ID NO: 1595 - DNA, 821 bp, Artificial Sequence
  chemically treated genomic DNA (Homo sapiens) CpG-island No: 1595
aggtttgatagagttttcgttattttagggattttggtttcgtcgtttattttttatagaatcgggtcggttttattaggtttttagtataaaatggcgtcgtttgcgagggaatcgttttagtcgttttagcgcgtttcgtttttgcgtaggcgtattaagcgtaggttttagtatttcggttgtaattgtatatgcgtagtgagaataacgcggggatgtgcgtagacgcgttgcgtttcgttagtttttcgtcgggaattgtcgggacgtatgcgagttgtagatttagcgtttgcgcgttgtgtcggggaattcgcggttggtggacgcgcgagcgtttttgttgttaagtacgttagtgggggcggtgcgcgtgcgcgtgcgcggtcgtaaagcggggcgggaggaaacgagtgcgttttttttttaggcggcgttattttgtgtttagagtcgttatagttgtcggcggtgtgcgattgagtcggtggcgaagacgggaacgcgacgatggcggagattttgttcgggtcgggcgattcgggttttggtacggtttttttcggttcgggcgttgcggagattgggacgaggcggtttagcgagttgcgggtgatcgatttgcgggcggagttgaagaagcggaatttggatacgggcggtaataagagcgttttgatggagcggtttaagaaggtgaggcggcgcggggttcgggggtggcgtaggaggttcgggtacgttttcgtttgtatttgttatcgcggttttcggattcggggcgttttgggttcgtttcgcgttttggtcgatttcgg

SEQ ID NO: 1596 - DNA, 821 bp, Artificial Sequence
  chemically treated genomic DNA (Homo sapiens) CpG-island No: 1596
ccgaaatcgaccaaaacgcgaaacgaacccaaaacgccccgaatccgaaaaccgcgataacaaatacaaacgaaaacgtacccgaacctcctacgccacccccgaaccccgcgccgcctcaccttcttaaaccgctccatcaaaacgctcttattaccgcccgtatccaaattccgcttcttcaactccgcccgcaaatcgatcacccgcaactcgctaaaccgcctcgtcccaatctccgcaacgcccgaaccgaaaaaaaccgtaccaaaacccgaatcgcccgacccgaacaaaatctccgccatcgtcgcgttcccgtcttcgccaccgactcaatcgcacaccgccgacaactataacgactctaaacacaaaataacgccgcctaaaaaaaaaacgcactcgtttcctcccgccccgctttacgaccgcgcacgcgcacgcgcaccgcccccactaacgtacttaacaacaaaaacgctcgcgcgtccaccaaccgcgaattccccgacacaacgcgcaaacgctaaatctacaactcgcatacgtcccgacaattcccgacgaaaaactaacgaaacgcaacgcgtctacgcacatccccgcgttattctcactacgcatatacaattacaaccgaaatactaaaacctacgcttaatacgcctacgcaaaaacgaaacgcgctaaaacgactaaaacgattccctcgcaaacgacgccattttatactaaaaacctaataaaaccgacccgattctataaaaaataaacgacgaaaccaaaatccctaaaataacgaaaactctatcaaacct

SEQ ID NO: 1597 - DNA, 516 bp, Artificial Sequence
  chemically treated genomic DNA (Homo sapiens) CpG-island No: 1597
gagcgttcgtgtcgtttgcggttttttgagttttttgtattgtttggtacgagcgttcgtgtcgtgtgcggttttcgaattatttgtattgtttggtacgagagcgcgcgttttatgcggtttttgagtttttagaattatcgattattgtttggtataagcgtgcgcgtcgtgtgtagtttttgagtttcgtggattgtttggtataagagtatttattgggtgcggttttcgagttttcgtgtattgttaggtacgagcgcgtaattatgtgattttcgtgagttttttgtacggtttggtacgagcgttcgtgttgtgtgcggttttcgatttttttgtattgtttgaaaagagtacgtaagttatgtatagtttttgatttttttgtataatttgttacgagcgcgtgtatcgtttgcggtgtttgagtttcgttagttatcgtattttattggataagggcgtttttgtcgtgtgcggtttttgagttatttaagttattgtgttttgttt

SEQ ID NO: 1598 - DNA, 516 bp, Artificial Sequence
  chemically treated genomic DNA (Homo sapiens) CpG-island No: 1598
aaacaaaacacaataacttaaataactcaaaaaccgcacacgacaaaaacgcccttatccaataaaatacgataactaacgaaactcaaacaccgcaaacgatacacgcgctcgtaacaaattatacaaaaaaatcaaaaactatacataacttacgtactcttttcaaacaatacaaaaaaatcgaaaaccgcacacaacacgaacgctcgtaccaaaccgtacaaaaaactcacgaaaatcacataattacgcgctcgtacctaacaatacacgaaaactcgaaaaccgcacccaataaatactcttataccaaacaatccacgaaactcaaaaactacacacgacgcgcacgcttataccaaacaataatcgataattctaaaaactcaaaaaccgcataaaacgcgcgctctcgtaccaaacaatacaaataattcgaaaaccgcacacgacacgaacgctcgtaccaaacaatacaaaaaactcaaaaaaccgcaaacgacacgaacgctc

SEQ ID NO: 1599 - DNA, 516 bp, Artificial Sequence
  chemically treated genomic DNA (Homo sapiens) CpG-island No: 1599
aaatagggtatagtggtttaggtggtttagagatcgtatacggtaaaagcgtttttgtttagtagagtacggtggttgacgaggtttaggtatcgtaggcggtgtacgcgttcgtgataaattgtgtaggagggttagggattgtatatggtttgcgtgttttttttaaatagtgtagggggatcggggatcgtatataatacgggcgttcgtgttaaatcgtgtaggaggtttacggaggttatatggttgcgcgttcgtgtttaatagtgtacggaagttcggggatcgtatttagtgggtgtttttgtgttaaatagtttacgaggtttagggattgtatacggcgcgtacgtttgtgttaaatagtgatcggtggttttggaggtttagggatcgtatagggcgcgcgttttcgtgttaaatagtgtaggtggttcgggagtcgtatacggtacgggcgttcgtgttaaatagtgtagggggtttaggggatcgtaaacggtacgggcgttt

SEQ ID NO: 1600 - DNA, 516 bp, Artificial Sequence
  chemically treated genomic DNA (Homo sapiens) CpG-island No: 1600
aaacgcccgtaccgtttacgatcccctaaaccccctacactatttaacacgaacgcccgtaccgtatacgactcccgaaccacctacactatttaacacgaaaacgcgcgccctatacgatccctaaacctccaaaaccaccgatcactatttaacacaaacgtacgcgccgtatacaatccctaaacctcgtaaactatttaacacaaaaacacccactaaatacgatccccgaacttccgtacactattaaacacgaacgcgcaaccatataacctccgtaaacctcctacacgatttaacacgaacgcccgtattatatacgatccccgatccccctacactatttaaaaaaaacacgcaaaccatatacaatccctaaccctcctacacaatttatcacgaacgcgtacaccgcctacgatacctaaacctcgtcaaccaccgtactctactaaacaaaaacgcttttaccgtatacgatctctaaaccacctaaaccactataccctattt

SEQ ID NO: 1601 - DNA, 684 bp, Artificial Sequence
  chemically treated genomic DNA (Homo sapiens) CpG-island No: 1601
tggcgcgtagttttcgggttgggaggtgtcgtaggatttggaagattttcgaaagttttggaaggtttttttagggatcgtcgcgggcgggggagtttgtttttttatcgagattcgcgagggcggtgttcggggtttgattgtaggataaagggtcgggagcgcgggagggcggcgttcgggagcggttatatatgtttcgttaatcggtttttttaggtagtattttcgggaaaaaggggtagacgcgcggcggaaggggcggggtcggcgcgcggtcgtggacgtcggagagggcgaggtcggcgttttttgggagcgcgcgcgttttattgggtagcgggcggaagggggcggagtttggcgtcgtcgcgaggtaagtttcgttttcggtttcgcggggagcggcggcggcggcggcggcggcggtggcggaggcggtgagcgcgggcggcgcggacggtagcggttggcgggcgggtttttcgttgttgcggtcgttgcggtttttttgttcgggtttggggcgtcgcgttggggaaagtcgggggttcggtgagttcgcgggatgcgttttttcggtttcgtcgggcggggttgaggcgaggaggtcgggtttggggggagggggggtttcggtttagagattttttcgggagcgttcggtttttatcgtcgtgggtt

SEQ ID NO: 1602 - DNA, 684 bp, Artificial Sequence
  chemically treated genomic DNA (Homo sapiens) CpG-island No: 1602
aacccacgacgataaaaaccgaacgctcccgaaaaaatctctaaaccgaaaccccccctccccccaaacccgacctcctcgcctcaaccccgcccgacgaaaccgaaaaaacgcatcccgcgaactcaccgaacccccgactttccccaacgcgacgccccaaacccgaacaaaaaaaccgcaacgaccgcaacaacgaaaaacccgcccgccaaccgctaccgtccgcgccgcccgcgctcaccgcctccgccaccgccgccgccgccgccgccgccgctccccgcgaaaccgaaaacgaaacttacctcgcgacgacgccaaactccgcccccttccgcccgctacccaataaaacgcgcgcgctcccaaaaaacgccgacctcgccctctccgacgtccacgaccgcgcgccgaccccgccccttccgccgcgcgtctacccctttttcccgaaaatactacctaaaaaaaccgattaacgaaacatatataaccgctcccgaacgccgccctcccgcgctcccgaccctttatcctacaatcaaaccccgaacaccgccctcgcgaatctcgataaaaaaacaaactcccccgcccgcgacgatccctaaaaaaaccttccaaaactttcgaaaatcttccaaatcctacgacacctcccaacccgaaaactacgcgcca

SEQ ID NO: 1603 - DNA, 684 bp, Artificial Sequence
  chemically treated genomic DNA (Homo sapiens) CpG-island No: 1603
gatttacggcggtagggatcgggcgttttcggaggagtttttaggtcggggttttttttttttttaggttcggttttttcgttttagtttcgttcggcggaatcgaggggacgtatttcgcgggtttatcgggttttcggttttttttagcgcggcgttttaagttcgggtaaggaggtcgtagcggtcgtaatagcggaggattcgttcgttaatcgttgtcgttcgcgtcgttcgcgtttatcgttttcgttatcgtcgtcgtcgtcgtcgtcgtcgtttttcgcggggtcgggggcggggtttgtttcgcggcggcgttaagtttcgttttttttcgttcgttgtttaatgggacgcgcgcgtttttaaggagcgtcggtttcgtttttttcggcgtttacggtcgcgcgtcggtttcgtttttttcgtcgcgcgtttatttttttttttcgggagtgttgtttgaggagatcggttggcggggtatgtgtggtcgttttcgggcgtcgttttttcgcgttttcggttttttgttttgtagttagatttcggatatcgttttcgcgggtttcggtgggaaaataggttttttcgttcgcggcgatttttgagagaattttttagaattttcgagaattttttaggttttacggtattttttagttcgggagttgcgcgtta

SEQ ID NO: 1604 - DNA, 684 bp, Artificial Sequence
  chemically treated genomic DNA (Homo sapiens) CpG-island No: 1604
taacgcgcaactcccgaactaaaaaataccgtaaaacctaaaaaattctcgaaaattctaaaaaattctctcaaaaatcgccgcgaacgaaaaaacctattttcccaccgaaacccgcgaaaacgatatccgaaatctaactacaaaacaaaaaaccgaaaacgcgaaaaaacgacgcccgaaaacgaccacacataccccgccaaccgatctcctcaaacaacactcccgaaaaaaaaaaataaacgcgcgacgaaaaaaacgaaaccgacgcgcgaccgtaaacgccgaaaaaaacgaaaccgacgctccttaaaaacgcgcgcgtcccattaaacaacgaacgaaaaaaaacgaaacttaacgccgccgcgaaacaaaccccgcccccgaccccgcgaaaaacgacgacgacgacgacgacgacgataacgaaaacgataaacgcgaacgacgcgaacgacaacgattaacgaacgaatcctccgctattacgaccgctacgacctccttacccgaacttaaaacgccgcgctaaaaaaaaccgaaaacccgataaacccgcgaaatacgtcccctcgattccgccgaacgaaactaaaacgaaaaaaccgaacctaaaaaaaaaaaaaaccccgacctaaaaactcctccgaaaacgcccgatccctaccgccgtaaatc

SEQ ID NO: 1605 - DNA, 821 bp, Artificial Sequence
  chemically treated genomic DNA (Homo sapiens) CpG-island No: 1605
cggttgtttcggtttggttttaaaaattgtgaacgtcgtttttttttttcgtttagtttttcgtcgcgttcgcggggtcgggggttgcgttgtcggcgtcgcgagtcgggcgagttttttagtacgggaggagggagggggcggcgtcgggcggggcggagttttcgcgttttttggagttttattttcggtcgcgagtcgggtagcgtttattcggtcgaaggagttacgcgggttacgttgttggttggtttgatttaggcgcgcggggtcgggcggtcgcgcgggcgggttgagtgagtaagataagatatttaagaagagcgagttgcgtttgggtttcggttaggtttgtacgtagaggcgggcggtagacggtgttcggcggaattttttgagtttcgtcgtttagttttggtgttagcgtttagtggtcgtcgtttcgaaagtgattggtgtttcgtcgttttttttcggtgcgggattatgaagttgttgtcgtcggtggtgttgaagttttttttggttgtaggtaagagggttgtcgacgttttcggagatcggggggatgggggcgttgtgttgggggtatgggggaaggtcgtcgtagcgtattcggtacgggttatttggtggggtttttgcgttttggcggacgggcgtcggtatcggtgcgtgttggttaggggtttgggcgggtgtttgatgcggtttggtttttcgttcgtagttttttcggtattggtgattggcgagagtttggagcggtttcggagagggttagttgttggaattagtaattcggatttttttattgtatt

SEQ ID NO: 1606 - DNA, 821 bp, Artificial Sequence
  chemically treated genomic DNA (Homo sapiens) CpG-island No: 1606
aatacaataaaaaaatccgaattactaattccaacaactaaccctctccgaaaccgctccaaactctcgccaatcaccaataccgaaaaaactacgaacgaaaaaccaaaccgcatcaaacacccgcccaaacccctaaccaacacgcaccgataccgacgcccgtccgccaaaacgcaaaaaccccaccaaataacccgtaccgaatacgctacgacgaccttcccccatacccccaacacaacgcccccatccccccgatctccgaaaacgtcgacaaccctcttacctacaaccaaaaaaaacttcaacaccaccgacgacaacaacttcataatcccgcaccgaaaaaaaacgacgaaacaccaatcactttcgaaacgacgaccactaaacgctaacaccaaaactaaacgacgaaactcaaaaaattccgccgaacaccgtctaccgcccgcctctacgtacaaacctaaccgaaacccaaacgcaactcgctcttcttaaatatcttatcttactcactcaacccgcccgcgcgaccgcccgaccccgcgcgcctaaatcaaaccaaccaacaacgtaacccgcgtaactccttcgaccgaataaacgctacccgactcgcgaccgaaaataaaactccaaaaaacgcgaaaactccgccccgcccgacgccgccccctccctcctcccgtactaaaaaactcgcccgactcgcgacgccgacaacgcaacccccgaccccgcgaacgcgacgaaaaactaaacgaaaaaaaaaaacgacgttcacaatttttaaaaccaaaccgaaacaaccg

SEQ ID NO: 1607 - DNA, 821 bp, Artificial Sequence
  chemically treated genomic DNA (Homo sapiens) CpG-island No: 1607
gatatagtgggagggttcgggttgttggttttagtagttagtttttttcgaagtcgttttaggttttcgttagttattagtgtcgagagaattgcgggcgagaggttaggtcgtattagatattcgtttagatttttgattaatacgtatcgatgtcgacgttcgttcgttagagcgtaagggttttattaagtggttcgtgtcgggtgcgttgcggcgatttttttttatgtttttagtataacgtttttattttttcgattttcgggggcgtcggtagtttttttatttgtagttagaaagagttttagtattatcgacggtagtagttttatggtttcgtatcgagaggaggcggcgaggtattagttattttcgaagcggcggttattgggcgttggtattagagttgggcggcggagtttaggagatttcgtcgggtatcgtttgtcgttcgtttttgcgtgtaagtttggtcgggatttaggcgtagttcgttttttttgagtgttttgttttgtttatttagttcgttcgcgcggtcgttcgatttcgcgcgtttaggttaggttagttagtagcgtggttcgcgtagttttttcggtcgaatgagcgttgttcggttcgcggtcgggaataaggttttaggaggcgcggaagtttcgtttcgttcggcgtcgtttttttttttttttcgtgttgggaagttcgttcggttcgcggcgtcggtagcgtagttttcgatttcgcgggcgcggcggaggattgggcgggaggagagggcggcgtttataatttttgggattaggtcgaggtagtcg

SEQ ID NO: 1608 - DNA, 821 bp, Artificial Sequence
  chemically treated genomic DNA (Homo sapiens) CpG-island No: 1608
cgactacctcgacctaatcccaaaaattataaacgccgccctctcctcccgcccaatcctccgccgcgcccgcgaaatcgaaaactacgctaccgacgccgcgaaccgaacgaacttcccaacacgaaaaaaaaaaaaaaacgacgccgaacgaaacgaaacttccgcgcctcctaaaaccttattcccgaccgcgaaccgaacaacgctcattcgaccgaaaaaactacgcgaaccacgctactaactaacctaacctaaacgcgcgaaatcgaacgaccgcgcgaacgaactaaataaacaaaacaaaacactcaaaaaaaacgaactacgcctaaatcccgaccaaacttacacgcaaaaacgaacgacaaacgatacccgacgaaatctcctaaactccgccgcccaactctaataccaacgcccaataaccgccgcttcgaaaataactaatacctcgccgcctcctctcgatacgaaaccataaaactactaccgtcgataatactaaaactctttctaactacaaataaaaaaactaccgacgcccccgaaaatcgaaaaaataaaaacgttatactaaaaacataaaaaaaaatcgccgcaacgcacccgacacgaaccacttaataaaacccttacgctctaacgaacgaacgtcgacatcgatacgtattaatcaaaaatctaaacgaatatctaatacgacctaacctctcgcccgcaattctctcgacactaataactaacgaaaacctaaaacgacttcgaaaaaaactaactactaaaaccaacaacccgaaccctcccactatatc

SEQ ID NO: 1609 - DNA, 681 bp, Artificial Sequence
  chemically treated genomic DNA (Homo sapiens) CpG-island No: 1609
aacggggatttttagcggcgtttacgtcgagtcgttttcggttcgggagcggtgggaggtagtttttcgtaggtttttcgtttttcggcgcggttttagtttcgtttttttcgcggttttaggggattgtttcgttttaggtttttggaatcggcggcgttttcgtagcgatcgtgtagttttcgtttcggtttcgtagtttcgcgattttcggcgttcggacgagtttagcgggtcgtagtttcgggaggtcgggtcgttatttgtcgtcgtttcgttttttgtcgtttacgtcgttttcgagggtacggttttcgttttagcgtttttcgtttcgttcggtatttttagttttatggtcgcgcgcggacggcggcgggggcgttcgagggggattcgagttgcgatcgtcgtcgtcgaataataagcgtcgtcggttaagggagggcgcgtcgggtcggcgcggggcggacggggcggggtttgcgtgcgtgcgacgtcgcggacggcgcgcggttaatcggggttcgggggcggggtttgtttgcgattcgtagttaggagcgtttcgagtgttttttcgcgtttaggggtgggagtatagagttaggttcgttattttatcgtattaggttagtaagattgataggtacgatacgtattaataatattgttgtgtat

SEQ ID NO: 1610 - DNA, 681 bp, Artificial Sequence
  chemically treated genomic DNA (Homo sapiens) CpG-island No: 1610
atacacaacaatattattaatacgtatcgtacctatcaatcttactaacctaatacgataaaataacgaacctaactctatactcccacccctaaacgcgaaaaaacactcgaaacgctcctaactacgaatcgcaaacaaaccccgcccccgaaccccgattaaccgcgcgccgtccgcgacgtcgcacgcacgcaaaccccgccccgtccgccccgcgccgacccgacgcgccctcccttaaccgacgacgcttattattcgacgacgacgatcgcaactcgaatccccctcgaacgcccccgccgccgtccgcgcgcgaccataaaactaaaaataccgaacgaaacgaaaaacgctaaaacgaaaaccgtaccctcgaaaacgacgtaaacgacaaaaaacgaaacgacgacaaataacgacccgacctcccgaaactacgacccgctaaactcgtccgaacgccgaaaatcgcgaaactacgaaaccgaaacgaaaactacacgatcgctacgaaaacgccgccgattccaaaaacctaaaacgaaacaatcccctaaaaccgcgaaaaaaacgaaactaaaaccgcgccgaaaaacgaaaaacctacgaaaaactacctcccaccgctcccgaaccgaaaacgactcgacgtaaacgccgctaaaaatccccgtt

SEQ ID NO: 1611 - DNA, 681 bp, Artificial Sequence
  chemically treated genomic DNA (Homo sapiens) CpG-island No: 1611
gtgtatagtaatgttattgatacgtatcgtgtttgttaattttattgatttaatacgatggaatggcgagtttggttttgtatttttatttttgggcgcgagggggtattcgaggcgtttttggttgcgggtcgtaagtaggtttcgttttcgagtttcgattggtcgcgcgtcgttcgcggcgtcgtacgtacgtaggtttcgtttcgttcgtttcgcgtcggttcggcgcgtttttttttggtcggcggcgtttgttgttcggcggcggcggtcgtagttcgggtttttttcgggcgttttcgtcgtcgttcgcgcgcggttatggagttggaggtatcggacgaggcggagagcgttgaggcgggggtcgtgttttcggaggcggcgtgggcggtagagagcggggcggcggtaggtaacggttcggtttttcggggttgcggttcgttgggttcgttcgagcgtcgagagtcgcggggttgcggggtcggggcgggggttgtacggtcgttgcgggggcgtcgtcggttttaggagtttggggcggggtagttttttggagtcgcggggaggacggggttgaagtcgcgtcgggaagcgggaggtttgcgaggggttattttttatcgttttcgggtcgggggcgattcggcgtgggcgtcgttggggattttcgtt

SEQ ID NO: 1612 - DNA, 681 bp, Artificial Sequence
  chemically treated genomic DNA (Homo sapiens) CpG-island No: 1612
aacgaaaatccccaacgacgcccacgccgaatcgcccccgacccgaaaacgataaaaaataacccctcgcaaacctcccgcttcccgacgcgacttcaaccccgtcctccccgcgactccaaaaaactaccccgccccaaactcctaaaaccgacgacgcccccgcaacgaccgtacaacccccgccccgaccccgcaaccccgcgactctcgacgctcgaacgaacccaacgaaccgcaaccccgaaaaaccgaaccgttacctaccgccgccccgctctctaccgcccacgccgcctccgaaaacacgacccccgcctcaacgctctccgcctcgtccgatacctccaactccataaccgcgcgcgaacgacgacgaaaacgcccgaaaaaaacccgaactacgaccgccgccgccgaacaacaaacgccgccgaccaaaaaaaaacgcgccgaaccgacgcgaaacgaacgaaacgaaacctacgtacgtacgacgccgcgaacgacgcgcgaccaatcgaaactcgaaaacgaaacctacttacgacccgcaaccaaaaacgcctcgaataccccctcgcgcccaaaaataaaaatacaaaaccaaactcgccattccatcgtattaaatcaataaaattaacaaacacgatacgtatcaataacattactatacac

SEQ ID NO: 1613 - DNA, 606 bp, Artificial Sequence
  chemically treated genomic DNA (Homo sapiens) CpG-island No: 1613
tattcggaaaacgaggagtttgggcgtaacggggtcggtagtcgttttagttattcggttggcgttggggatttcgtttttcgaattgtatatcgcgtggcgggggaaggggttttagttttcgcggagtatttttggtttagggcgggagtttcgagcgtcggtttttcgcgtttcgtacggttcggtttagtttggaagaaggtttgaggaaggttcgatcgcgtcgttcgcgtttttaggttcggttcgaatgttggaaagttcgtcggttcgttttcggttcggtgagtttcggtttattttagttgtcggtcgtatttttgttttttgagtagtttttttagttgcgttatggtcgcgtttgtcgcgcggaaaatagtcgagtttttgcggagcgtcgttattagttttataagcgcgtaggcgtattgagcgttttttcgtcgttatcgttttttgcgcgttgtttgtagggggcgtcgtattgtattgcgtacgcgtcgtcggtacgtcggggtttaagcggttttggtattcgagcgggtttggggtttttggtttttatcggttagaaaggtagattcgttagtttgttaatttgtt

SEQ ID NO: 1614 - DNA, 606 bp, Artificial Sequence
  chemically treated genomic DNA (Homo sapiens) CpG-island No: 1614
aacaaattaacaaactaacgaatctacctttctaaccgataaaaaccaaaaaccccaaacccgctcgaataccaaaaccgcttaaaccccgacgtaccgacgacgcgtacgcaatacaatacgacgccccctacaaacaacgcgcaaaaaacgataacgacgaaaaaacgctcaatacgcctacgcgcttataaaactaataacgacgctccgcaaaaactcgactattttccgcgcgacaaacgcgaccataacgcaactaaaaaaactactcaaaaaacaaaaatacgaccgacaactaaaataaaccgaaactcaccgaaccgaaaacgaaccgacgaactttccaacattcgaaccgaacctaaaaacgcgaacgacgcgatcgaaccttcctcaaaccttcttccaaactaaaccgaaccgtacgaaacgcgaaaaaccgacgctcgaaactcccgccctaaaccaaaaatactccgcgaaaactaaaaccccttcccccgccacgcgatatacaattcgaaaaacgaaatccccaacgccaaccgaataactaaaacgactaccgaccccgttacgcccaaactcctcgttttccgaata

SEQ ID NO: 1615 - DNA, 606 bp, Artificial Sequence
  chemically treated genomic DNA (Homo sapiens) CpG-island No: 1615
ggtaaattggtaggttagcgggtttgtttttttggtcgatggggattaagagttttagattcgttcgggtattagggtcgtttaggtttcggcgtatcggcgacgcgtgcgtagtgtagtgcggcgttttttgtaggtagcgcgtaggagacggtagcggcgaaggggcgtttagtgcgtttgcgcgtttgtggagttggtggcggcgtttcgtaggggttcggttgtttttcgcgcggtaggcgcggttatggcgtagttgggaaagttgtttaaggagtagaagtacgatcggtagttgaggtgagtcgaggtttatcgagtcgagggcgggtcggcgggttttttagtattcgggtcgggtttaagggcgcgggcggcgcggtcgggttttttttaggtttttttttaggttgggtcgggtcgtgcggggcgcgggaagtcggcgttcggagttttcgttttgggttaaaggtgtttcgcgagggttgggattttttttttcgttacgcggtgtgtagttcgggggacggggtttttagcgttagtcgggtagttaaggcggttgtcggtttcgttgcgtttaggtttttcgtttttcgaatg

SEQ ID NO: 1616 - DNA, 606 bp, Artificial Sequence
  chemically treated genomic DNA (Homo sapiens) CpG-island No: 1616
cattcgaaaaacgaaaaacctaaacgcaacgaaaccgacaaccgccttaactacccgactaacgctaaaaaccccgtcccccgaactacacaccgcgtaacgaaaaaaaaaatcccaaccctcgcgaaacacctttaacccaaaacgaaaactccgaacgccgacttcccgcgccccgcacgacccgacccaacctaaaaaaaaacctaaaaaaaacccgaccgcgccgcccgcgcccttaaacccgacccgaatactaaaaaacccgccgacccgccctcgactcgataaacctcgactcacctcaactaccgatcgtacttctactccttaaacaactttcccaactacgccataaccgcgcctaccgcgcgaaaaacaaccgaacccctacgaaacgccgccaccaactccacaaacgcgcaaacgcactaaacgccccttcgccgctaccgtctcctacgcgctacctacaaaaaacgccgcactacactacgcacgcgtcgccgatacgccgaaacctaaacgaccctaatacccgaacgaatctaaaactcttaatccccatcgaccaaaaaaacaaacccgctaacctaccaatttacc

SEQ ID NO: 1617 - DNA, 503 bp, Artificial Sequence
  chemically treated genomic DNA (Homo sapiens) CpG-island No: 1617
agacgtaaagttcgcgttgcgtttcgggtggtttcgtcgttagtaagcgatttggcggttgtgttttgtcgtttttttcgcgaagtttttgattgtttagttcgtttagatttaggtttagatttttatttattcgtttcgggcgtgcgtagcgcgtgggggtggtttagggtagcggggggcgggcgtcgcggagcgttgtgcgcgggtgtttgcggggagcgcgtacggtaagtgagcggggatttcgggggagcggggtttcgcgtggtaagggcgtagtgtttttcggagagaattttttcgtagaagtggtcgagttgttttttcggtcggtacgtgagggaagggggtatttgggggcgtaagtatgtgtttgggtgtttatatcgagtagggtgtttgcgtacgttcgggtgtgagtcgtgggagttcgtggtttatattagttttttgggttgacgcggaagagagtttttttattttgttttagtttttttagg

SEQ ID NO: 1618 - DNA, 503 bp, Artificial Sequence
  chemically treated genomic DNA (Homo sapiens) CpG-island No: 1618
cctaaaaaaactaaaacaaaataaaaaaactctcttccgcgtcaacccaaaaaactaatataaaccacgaactcccacgactcacacccgaacgtacgcaaacaccctactcgatataaacacccaaacacatacttacgcccccaaatacccccttccctcacgtaccgaccgaaaaaacaactcgaccacttctacgaaaaaattctctccgaaaaacactacgcccttaccacgcgaaaccccgctcccccgaaatccccgctcacttaccgtacgcgctccccgcaaacacccgcgcacaacgctccgcgacgcccgccccccgctaccctaaaccacccccacgcgctacgcacgcccgaaacgaataaataaaaatctaaacctaaatctaaacgaactaaacaatcaaaaacttcgcgaaaaaaacgacaaaacacaaccgccaaatcgcttactaacgacgaaaccacccgaaacgcaacgcgaactttacgtct

SEQ ID NO: 1619 - DNA, 503 bp, Artificial Sequence
  chemically treated genomic DNA (Homo sapiens) CpG-island No: 1619
tttaaggaaattgaggtaggatgaaggagttttttttcgcgttagtttaggaggttggtgtgggttacgggtttttacgatttatattcggacgtgcgtaaatattttgttcggtgtagatatttagatatatgtttgcgtttttaagtgttttttttttttacgtatcggtcgagaaggtagttcggttatttttgcggggaaatttttttcgggggatattgcgtttttgttacgcggagtttcgttttttcgaggttttcgtttatttgtcgtgcgcgtttttcgtagatattcgcgtatagcgtttcgcggcgttcgtttttcgttgttttgggttatttttacgcgttgcgtacgttcggggcgagtgagtgagagtttgggtttgggtttgagcgggttgggtaattaggggtttcgcggaggaggcggtaggatatagtcgttaggtcgtttgttggcggcggggttattcggggcgtagcgcggattttgcgttt

SEQ ID NO: 1620 - DNA, 503 bp, Artificial Sequence
  chemically treated genomic DNA (Homo sapiens) CpG-island No: 1620
aaacgcaaaatccgcgctacgccccgaataaccccgccgccaacaaacgacctaacgactatatcctaccgcctcctccgcgaaacccctaattacccaacccgctcaaacccaaacccaaactctcactcactcgccccgaacgtacgcaacgcgtaaaaataacccaaaacaacgaaaaacgaacgccgcgaaacgctatacgcgaatatctacgaaaaacgcgcacgacaaataaacgaaaacctcgaaaaaacgaaactccgcgtaacaaaaacgcaatatcccccgaaaaaaatttccccgcaaaaataaccgaactaccttctcgaccgatacgtaaaaaaaaaaaacacttaaaaacgcaaacatatatctaaatatctacaccgaacaaaatatttacgcacgtccgaatataaatcgtaaaaacccgtaacccacaccaacctcctaaactaacgcgaaaaaaaactccttcatcctacctcaatttccttaaa

SEQ ID NO: 1621 - DNA, 879 bp, Artificial Sequence
  chemically treated genomic DNA (Homo sapiens) CpG-island No: 1621
ggcgataggaagaaatgcgggggcgggggtacgggcgggggcgggggaaaggcggatagcggttatgggtcgcgggtttcgggggtcgttagtaggttgaagggagagggtcgcgcgggtagcggcggtagcggatgcgggggcggttcggagattaggggcgggcggtcgcgcgcgtttacgggttcgggggttgcggcgacggcggtttcgggtagcggaggtagcggtaggtgcgcgggcggcggcgcgggcgcgggtaggcgcggtaggttttgtagtgcgagtacggcggcggggagcgcgggtgagtaggtttcgggcggtagttcgggtagtgttagatgcgcgtcggggttttagggcgttagcggttcgggtcgtagcgggagcgcgggtagcggtggtagttcggttagggcgagagcggagggcggcggcggttcggggtttaggtcgggcggtaggtcgggtaacggcgggtgcggtagggacggcgggggtagcggggtgggcggtagcgtcgagcgggttcggtttaatcgcgagtgggcgcgggcgcgggcgagtcgcgggtgcgagttggagcggggtagtcgcgtcgttagtttggttgcggtcgttatttcggttgcggtcgttagtttagggttttagagcgcgtcgttagtcgtgatttggtatttcgggaggtggttaagcgtcgtatttcgagcggtttagttaatcgtagatgttcgtcgtcgtattttaattaattacgggttagtgcgttcgcggtttacgggttttattcggtagttgttaagggttatttttggtagttaattagagatatgagcgcgtttcgttaagttttttttttcgtttttttttggt

SEQ ID NO: 1622 - DNA, 879 bp, Artificial Sequence
  chemically treated genomic DNA (Homo sapiens) CpG-island No: 1622
accaaaaaaaaacgaaaaaaaaaacttaacgaaacgcgctcatatctctaattaactaccaaaaataacccttaacaactaccgaataaaacccgtaaaccgcgaacgcactaacccgtaattaattaaaatacgacgacgaacatctacgattaactaaaccgctcgaaatacgacgcttaaccacctcccgaaataccaaatcacgactaacgacgcgctctaaaaccctaaactaacgaccgcaaccgaaataacgaccgcaaccaaactaacgacgcgactaccccgctccaactcgcacccgcgactcgcccgcgcccgcgcccactcgcgattaaaccgaacccgctcgacgctaccgcccaccccgctacccccgccgtccctaccgcacccgccgttacccgacctaccgcccgacctaaaccccgaaccgccgccgccctccgctctcgccctaaccgaactaccaccgctacccgcgctcccgctacgacccgaaccgctaacgccctaaaaccccgacgcgcatctaacactacccgaactaccgcccgaaacctactcacccgcgctccccgccgccgtactcgcactacaaaacctaccgcgcctacccgcgcccgcgccgccgcccgcgcacctaccgctacctccgctacccgaaaccgccgtcgccgcaacccccgaacccgtaaacgcgcgcgaccgcccgcccctaatctccgaaccgcccccgcatccgctaccgccgctacccgcgcgaccctctcccttcaacctactaacgacccccgaaacccgcgacccataaccgctatccgcctttcccccgcccccgcccgtacccccgcccccgcatttcttcctatcgcc

SEQ ID NO: 1623 - DNA, 879 bp, Artificial Sequence
  chemically treated genomic DNA (Homo sapiens) CpG-island No: 1623
attaggagagggcgggaagaagaatttggcggagcgcgtttatatttttgattggttgttaagggtagtttttgatagttgtcgggtgggattcgtagatcgcgagcgtattggttcgtgattggttggggtgcggcggcgagtatttgcgattggttgggtcgttcggagtgcggcgtttggttatttttcgaggtattaggttacggttggcggcgcgttttggggttttgggttggcggtcgtaatcggggtggcggtcgtagttaagttggcggcgcggttgtttcgttttagttcgtattcgcggttcgttcgcgttcgcgtttattcgcgattgggtcgggttcgttcgacgttgtcgtttatttcgttgttttcgtcgtttttgtcgtattcgtcgttgttcggtttgtcgttcggtttgagtttcgggtcgtcgtcgtttttcgttttcgttttggtcgagttgttatcgttgttcgcgttttcgttgcggttcgagtcgttggcgttttggggtttcggcgcgtatttggtattgttcgagttgtcgttcgaagtttgtttattcgcgtttttcgtcgtcgtgttcgtattgtaggatttgtcgcgtttgttcgcgttcgcgtcgtcgttcgcgtatttgtcgttgttttcgttgttcgaggtcgtcgtcgtcgtagttttcgggttcgtgggcgcgcgcggtcgttcgtttttggttttcgagtcgttttcgtattcgttgtcgtcgttgttcgcgcgattttttttttttagtttgttggcggttttcgagattcgcgatttatggtcgttgttcgtttttttttcgttttcgttcgtgttttcgttttcgtatttttttttgtcgtt

SEQ ID NO: 1624 - DNA, 879 bp, Artificial Sequence
  chemically treated genomic DNA (Homo sapiens) CpG-island No: 1624
aacgacaaaaaaaaatacgaaaacgaaaacacgaacgaaaacgaaaaaaaaacgaacaacgaccataaatcgcgaatctcgaaaaccgccaacaaactaaaaaaaaaaaatcgcgcgaacaacgacgacaacgaatacgaaaacgactcgaaaaccaaaaacgaacgaccgcgcgcgcccacgaacccgaaaactacgacgacgacgacctcgaacaacgaaaacaacgacaaatacgcgaacgacgacgcgaacgcgaacaaacgcgacaaatcctacaatacgaacacgacgacgaaaaacgcgaataaacaaacttcgaacgacaactcgaacaataccaaatacgcgccgaaaccccaaaacgccaacgactcgaaccgcaacgaaaacgcgaacaacgataacaactcgaccaaaacgaaaacgaaaaacgacgacgacccgaaactcaaaccgaacgacaaaccgaacaacgacgaatacgacaaaaacgacgaaaacaacgaaataaacgacaacgtcgaacgaacccgacccaatcgcgaataaacgcgaacgcgaacgaaccgcgaatacgaactaaaacgaaacaaccgcgccgccaacttaactacgaccgccaccccgattacgaccgccaacccaaaaccccaaaacgcgccgccaaccgtaacctaatacctcgaaaaataaccaaacgccgcactccgaacgacccaaccaatcgcaaatactcgccgccgcaccccaaccaatcacgaaccaatacgctcgcgatctacgaatcccacccgacaactatcaaaaactacccttaacaaccaatcaaaaatataaacgcgctccgccaaattcttcttcccgccctctcctaat

SEQ ID NO: 1625 - DNA, 550 bp, Artificial Sequence
  chemically treated genomic DNA (Homo sapiens) CpG-island No: 1625
ggttttcgagtataatgttttgttgagtagcgtttaggaacgtcgggttttggtaggtcggttgtgcgcgggagatcgcggagattgggtttgagttagggcgcgatcgggtttttttttgttaggtagagcgttggcgagatttcgagatttttgatataggtaaggttcgaggtagtcggggaatcggcgggtttttacgcgggggttttagtgcgtttcgatacgcgtttaggtttcgcggtgcggtatttagggcgttcggcggtttggttcgcgttcggggtagataacgagtaatcggagcgtcggtacgcgtcggtaggtcgtttcggagtgttcgggttttgttcgttggttgggggttcgttggattagggtagttaggttttttttcgtcgtcgttatattcgcgatttttttttttttttcgcgagaaattcgaggattcgcggacgatatttattttagtaggcgagagaggtggtgtttagtatttattcggttatttttaaaaatgattttggttggtatttttttgcggatgatt

SEQ ID NO: 1626 - DNA, 550 bp, Artificial Sequence
  chemically treated genomic DNA (Homo sapiens) CpG-island No: 1626
aatcatccgcaaaaaaataccaaccaaaatcatttttaaaaataaccgaataaatactaaacaccacctctctcgcctactaaaataaatatcgtccgcgaatcctcgaatttctcgcgaaaaaaaaaaaaaaatcgcgaatataacgacgacgaaaaaaaacctaactaccctaatccaacgaacccccaaccaacgaacaaaacccgaacactccgaaacgacctaccgacgcgtaccgacgctccgattactcgttatctaccccgaacgcgaaccaaaccgccgaacgccctaaataccgcaccgcgaaacctaaacgcgtatcgaaacgcactaaaacccccgcgtaaaaacccgccgattccccgactacctcgaaccttacctatatcaaaaatctcgaaatctcgccaacgctctacctaacaaaaaaaaacccgatcgcgccctaactcaaacccaatctccgcgatctcccgcgcacaaccgacctaccaaaacccgacgttcctaaacgctactcaacaaaacattatactcgaaaacc

SEQ ID NO: 1627 - DNA, 550 bp, Artificial Sequence
  chemically treated genomic DNA (Homo sapiens) CpG-island No: 1627
gattattcgtaaggaaatattagttaaaattatttttgaggatgatcgggtaggtattgggtattatttttttcgtttgttgaggtgggtatcgttcgcggattttcgggtttttcgcggagggagaggaggggtcgcgagtgtagcggcgacgggaggggatttggttgttttggtttagcgggtttttagttagcggatagggttcgggtatttcgaggcggtttgtcggcgcgtgtcggcgtttcggttattcgttatttgtttcgggcgcgggttaggtcgtcgggcgttttgagtgtcgtatcgcggggtttgggcgcgtgtcggggcgtattggggttttcgcgtggaagttcgtcggtttttcggttgtttcggattttgtttgtattaggaatttcgaaatttcgttagcgttttgtttgatagagagaaattcgatcgcgttttgatttaggtttaattttcgcgatttttcgcgtatagtcggtttgttagggttcggcgtttttgggcgttgtttagtaaggtattgtgttcgagggtt

SEQ ID NO: 1628 - DNA, 550 bp, Artificial Sequence
  chemically treated genomic DNA (Homo sapiens) CpG-island No: 1628
aaccctcgaacacaataccttactaaacaacgcccaaaaacgccgaaccctaacaaaccgactatacgcgaaaaatcgcgaaaattaaacctaaatcaaaacgcgatcgaatttctctctatcaaacaaaacgctaacgaaatttcgaaattcctaatacaaacaaaatccgaaacaaccgaaaaaccgacgaacttccacgcgaaaaccccaatacgccccgacacgcgcccaaaccccgcgatacgacactcaaaacgcccgacgacctaacccgcgcccgaaacaaataacgaataaccgaaacgccgacacgcgccgacaaaccgcctcgaaatacccgaaccctatccgctaactaaaaacccgctaaaccaaaacaaccaaatcccctcccgtcgccgctacactcgcgacccctcctctccctccgcgaaaaacccgaaaatccgcgaacgatacccacctcaacaaacgaaaaaaataatacccaatacctacccgatcatcctcaaaaataattttaactaatatttccttacgaataatc

SEQ ID NO: 1629 - DNA, 671 bp, Artificial Sequence
  chemically treated genomic DNA (Homo sapiens) CpG-island No: 1629
aaacgatttaattacgtttatttttttgttcgttcgcgtttttttttcgggaaaatgggttttgagaattagagcgtttttttttttacgcgtttaaatttttttttattagtatgcgtgcgtttgcgtagtttttaggcggtttttttttagcgttcgatcgttttttttttttgttttttttcggtttttttttagttttagtttttttttaaggggttattatagggcgttaaacgcgcgttcgcgggaaggtcgggggcggagcgcggcgcggcgcggtacgttagtggtttttcggtcggaagttcgtagtttttcgagtcgttgattggtttttaggttggcgtttgtttcggttttcgcgttagttttgggttggttggcgcggaatcgggagattcgggattatggtatttgtgtacggcgacgattgtgagataggggcgagtggtgagggataatttcgcgcgcggggtttcgggttgggatagtggtatgattgtcggtggtgggggttttgagggaggcgtatattcgggtttgtttgggcgtagattttggtcgttttcggcgggggtttttttggcgtcggatcgggttttttttaggcgcggtttgtttttggaggattagagtttggagggatttttgtttgggaggttgtttta

SEQ ID NO: 1630 - DNA, 671 bp, Artificial Sequence
  chemically treated genomic DNA (Homo sapiens) CpG-island No: 1630
taaaacaacctcccaaacaaaaatccctccaaactctaatcctccaaaaacaaaccgcgcctaaaaaaaacccgatccgacgccaaaaaaacccccgccgaaaacgaccaaaatctacgcccaaacaaacccgaatatacgcctccctcaaaacccccaccaccgacaatcataccactatcccaacccgaaaccccgcgcgcgaaattatccctcaccactcgcccctatctcacaatcgtcgccgtacacaaataccataatcccgaatctcccgattccgcgccaaccaacccaaaactaacgcgaaaaccgaaacaaacgccaacctaaaaaccaatcaacgactcgaaaaactacgaacttccgaccgaaaaaccactaacgtaccgcgccgcgccgcgctccgcccccgaccttcccgcgaacgcgcgtttaacgccctataataaccccttaaaaaaaaactaaaactaaaaaaaaaccgaaaaaaaacaaaaaaaaaaaacgatcgaacgctaaaaaaaaaccgcctaaaaactacgcaaacgcacgcatactaataaaaaaaaatttaaacgcgtaaaaaaaaaaacgctctaattctcaaaacccattttcccgaaaaaaaaacgcgaacgaacaaaaaaataaacgtaattaaatcgttt

SEQ ID NO: 1631 - DNA, 671 bp, Artificial Sequence
  chemically treated genomic DNA (Homo sapiens) CpG-island No: 1631
tgagatagttttttaaataaaaatttttttaggttttggttttttaagagtaaatcgcgtttaaaggaagttcggttcgacgttagaagggttttcgtcggggacgattaaggtttgcgtttaaataaattcgggtgtgcgttttttttagaatttttattatcggtaattatgttattgttttaattcggagtttcgcgcgcggaattgttttttattattcgtttttattttatagtcgtcgtcgtgtataggtgttatggtttcgaatttttcgatttcgcgttaattagtttaaaattggcgcgggggtcgagataggcgttagtttgaaagttaattagcggttcgggaggttgcggattttcggtcggaaggttattgacgtgtcgcgtcgcgtcgcgtttcgttttcggttttttcgcggacgcgcgtttggcgttttgtgatgattttttagggaaaagttagagttgaggggaagtcggaggagagtaggagaaagaagcggtcgggcgttggaaaggagtcgtttggagattgcgtaagcgtacgtatgttgatgggaaaagatttgggcgcgtgggagaaagggcgttttggtttttagagtttattttttcggaaaggaggcgcgggcgggtaggagagtgggcgtggttggatcgttt

SEQ ID NO: 1632 - DNA, 671 bp, Artificial Sequence
  chemically treated genomic DNA (Homo sapiens) CpG-island No: 1632
aaacgatccaaccacgcccactctcctacccgcccgcgcctcctttccgaaaaaataaactctaaaaaccaaaacgccctttctcccacgcgcccaaatcttttcccatcaacatacgtacgcttacgcaatctccaaacgactcctttccaacgcccgaccgcttctttctcctactctcctccgacttcccctcaactctaacttttccctaaaaaatcatcacaaaacgccaaacgcgcgtccgcgaaaaaaccgaaaacgaaacgcgacgcgacgcgacacgtcaataaccttccgaccgaaaatccgcaacctcccgaaccgctaattaactttcaaactaacgcctatctcgacccccgcgccaattttaaactaattaacgcgaaatcgaaaaattcgaaaccataacacctatacacgacgacgactataaaataaaaacgaataataaaaaacaattccgcgcgcgaaactccgaattaaaacaataacataattaccgataataaaaattctaaaaaaaacgcacacccgaatttatttaaacgcaaaccttaatcgtccccgacgaaaacccttctaacgtcgaaccgaacttcctttaaacgcgatttactcttaaaaaaccaaaacctaaaaaaatttttatttaaaaaactatctca

SEQ ID NO: 1633 - DNA, 503 bp, Artificial Sequence
  chemically treated genomic DNA (Homo sapiens) CpG-island No: 1633
agggcggcggagaagtggggacgtgggcgtagggagcgttttatacgtttgattttagcgtttcggattttttatttgttcgtaattttcgcgtcgtagttatatcgagttttcgcgtcgagtcgcggagtttttatttatcggcgttcggagcggcgggggcggtttgttcgcgtttcggtttgcgcgttgcgttcggatgtaggagtcggagttcggcgaagcgttcggtcggggtcgcggggattcgttagggattgtgtagtatcggcgcggggatcggatcgtggaggtatcggcgcggagtcgggacgcgttatgttgcgggagggattcgggtcggttttgcgtttacgtgggtgtgggggtatcgagcggtcgggggagggggcgggatttttttcgcgatgtttttcgtttttttcgcgtttagtttaggtttcgtagtcgtgtgggagaagggggatagcgtgtttgcgaagggagggggattgggggtgggt

SEQ ID NO: 1634 - DNA, 503 bp, Artificial Sequence
  chemically treated genomic DNA (Homo sapiens) CpG-island No: 1634
acccacccccaatccccctcccttcgcaaacacgctatcccccttctcccacacgactacgaaacctaaactaaacgcgaaaaaaacgaaaaacatcgcgaaaaaaatcccgccccctcccccgaccgctcgatacccccacacccacgtaaacgcaaaaccgacccgaatccctcccgcaacataacgcgtcccgactccgcgccgatacctccacgatccgatccccgcgccgatactacacaatccctaacgaatccccgcgaccccgaccgaacgcttcgccgaactccgactcctacatccgaacgcaacgcgcaaaccgaaacgcgaacaaaccgcccccgccgctccgaacgccgataaataaaaactccgcgactcgacgcgaaaactcgatataactacgacgcgaaaattacgaacaaataaaaaatccgaaacgctaaaatcaaacgtataaaacgctccctacgcccacgtccccacttctccgccgccct

SEQ ID NO: 1635 - DNA, 503 bp, Artificial Sequence
  chemically treated genomic DNA (Homo sapiens) CpG-island No: 1635
gtttatttttagttttttttttttcgtaagtacgttgtttttttttttttatacggttgcggagtttgggttgggcgcgggggaggcggagggtatcgcggaggggatttcgttttttttttcggtcgttcggtgtttttatatttacgtgagcgtagggtcggttcggatttttttcgtagtatagcgcgtttcggtttcgcgtcggtgtttttacggttcggttttcgcgtcggtgttgtatagtttttggcgggttttcgcggtttcggtcgggcgtttcgtcgggtttcggtttttgtattcgggcgtagcgcgtaggtcgaggcgcgggtaggtcgttttcgtcgtttcggacgtcggtgagtggggatttcgcggttcggcgcggggattcggtgtggttgcggcgcggaggttgcgggtaggtgggggattcgaggcgttggggttaggcgtgtggggcgttttttgcgtttacgtttttattttttcgtcgtttt

SEQ ID NO: 1636 - DNA, 503 bp, Artificial Sequence
  chemically treated genomic DNA (Homo sapiens) CpG-island No: 1636
aaaacgacgaaaaaataaaaacgtaaacgcaaaaaacgccccacacgcctaaccccaacgcctcgaatcccccacctacccgcaacctccgcgccgcaaccacaccgaatccccgcgccgaaccgcgaaatccccactcaccgacgtccgaaacgacgaaaacgacctacccgcgcctcgacctacgcgctacgcccgaatacaaaaaccgaaacccgacgaaacgcccgaccgaaaccgcgaaaacccgccaaaaactatacaacaccgacgcgaaaaccgaaccgtaaaaacaccgacgcgaaaccgaaacgcgctatactacgaaaaaaatccgaaccgaccctacgctcacgtaaatataaaaacaccgaacgaccgaaaaaaaaaacgaaatcccctccgcgataccctccgcctcccccgcgcccaacccaaactccgcaaccgtataaaaaaaaaaaaacaacgtacttacgaaaaaaaaaaaactaaaaataaac

SEQ ID NO: 1637 - DNA, 567 bp, Artificial Sequence
  chemically treated genomic DNA (Homo sapiens) CpG-island No: 1637
cgtgttggtattttcggttgagcgtagttaggatatacgcgttggggttttagtatggcgcgaggtagtttaggttatggcgaggatcgcgtatattttgatcgatcgttgcgggtaggaggcggtgattatgtggtagtttaaggatagcgtgttggattcgaacgtggtttattatttcggtcgcgtcgtttatatttagttttggcgttttcgcgtggagatgattaaaggcggcggtattttggagaagtcgtcgttaggcgagggcgttacgttgtggaagggtaagatgaagtcgttcgtttggtacgttcgtttgtcgttatttttgtatcgtaaagcgcgcgttttgtagattatcgaggtggtgtacgcgtacgcgcgtggagcgcgttttatcgtcgttcgtttcggtcgcgcgtagtattagattaacgggcgggtgcgatagttgttgcgttagcgcgaggttatcgattataggtttagcgaagtgcgtaagggtttgtttattaattagtagagcgttaagttgcggggttataggtttaagtttgagaaggt

SEQ ID NO: 1638 - DNA, 567 bp, Artificial Sequence
  chemically treated genomic DNA (Homo sapiens) CpG-island No: 1638
accttctcaaacttaaacctataaccccgcaacttaacgctctactaattaataaacaaacccttacgcacttcgctaaacctataatcgataacctcgcgctaacgcaacaactatcgcacccgcccgttaatctaatactacgcgcgaccgaaacgaacgacgataaaacgcgctccacgcgcgtacgcgtacaccacctcgataatctacaaaacgcgcgctttacgatacaaaaataacgacaaacgaacgtaccaaacgaacgacttcatcttacccttccacaacgtaacgccctcgcctaacgacgacttctccaaaataccgccgcctttaatcatctccacgcgaaaacgccaaaactaaatataaacgacgcgaccgaaataataaaccacgttcgaatccaacacgctatccttaaactaccacataatcaccgcctcctacccgcaacgatcgatcaaaatatacgcgatcctcgccataacctaaactacctcgcgccatactaaaaccccaacgcgtatatcctaactacgctcaaccgaaaataccaacacg

SEQ ID NO: 1639 - DNA, 567 bp, Artificial Sequence
  chemically treated genomic DNA (Homo sapiens) CpG-island No: 1639
atttttttagatttgggtttgtagtttcgtagtttgacgttttgttggttaataagtagatttttgcgtatttcgttgagtttgtggtcggtgatttcgcgttggcgtagtagttgtcgtattcgttcgttaatttggtgttgcgcgcggtcgaggcgggcggcggtgaggcgcgttttacgcgcgtgcgcgtgtattatttcggtggtttgtagggcgcgcgttttgcggtgtaagggtagcggtaggcgggcgtattaggcgggcggttttattttgtttttttatagcgtgacgttttcgtttggcggcggtttttttaaggtgtcgtcgtttttgattatttttacgcggaagcgttagggttggatgtaggcggcgcggtcgaggtggtgggttacgttcgggtttagtacgttgtttttgggttgttatatggttatcgttttttgttcgtagcgatcggttagaatgtgcgcggttttcgttatggtttgagttgtttcgcgttatgttggggttttaacgcgtgtgttttggttgcgtttagtcgggggtattaatacg

SEQ ID NO: 1640 - DNA, 567 bp, Artificial Sequence
  chemically treated genomic DNA (Homo sapiens) CpG-island No: 1640
cgtattaatacccccgactaaacgcaaccaaaacacacgcgttaaaaccccaacataacgcgaaacaactcaaaccataacgaaaaccgcgcacattctaaccgatcgctacgaacaaaaaacgataaccatataacaacccaaaaacaacgtactaaacccgaacgtaacccaccacctcgaccgcgccgcctacatccaaccctaacgcttccgcgtaaaaataatcaaaaacgacgacaccttaaaaaaaccgccgccaaacgaaaacgtcacgctataaaaaaacaaaataaaaccgcccgcctaatacgcccgcctaccgctacccttacaccgcaaaacgcgcgccctacaaaccaccgaaataatacacgcgcacgcgcgtaaaacgcgcctcaccgccgcccgcctcgaccgcgcgcaacaccaaattaacgaacgaatacgacaactactacgccaacgcgaaatcaccgaccacaaactcaacgaaatacgcaaaaatctacttattaaccaacaaaacgtcaaactacgaaactacaaacccaaatctaaaaaaat

SEQ ID NO: 1641 - DNA, 1341 bp, Artificial Sequence
  chemically treated genomic DNA (Homo sapiens) CpG-island No: 1641
cggaacgtgtggttaggcgttttggacgtgatatgtgtggcggggttcgagtttcgttgcgtgttagcgtgtgtttgcgttggaacgcgggttagtacgtgttagggcggtcgcgtcggtgtgcgttttcgcgcgcgcgtgtgcgtgtgttcgtgtgtgtgtgtgtatgtgtgtgtttgtgtgtgtgcgtcggtcgtcgttttttcgttttgttcgttttttttcgcgttttttttttcgttcgcgtcgttcgttcgtttttttttttcggagtgcgtcgtttttaaattttgtttaaatttttatttttatagcgcggcggttgcggcggcggcggcggcgggcgagggtgatcggtcgagcggcggcggtatggagtagacgcgcggcggtagcggcggcggcggcggacgcgagaggtagcggcgagcgcggcggcggcggcggtagcggcggtttcggagtcggcggggtcgagtttgcgagcggcgagcgcggagcggcgtcgggtcgagcgcggggtcgcgggtcgggcgggcgtagcgcggcggaggtcggaggagtcgagtcggagttcgagttcgagcgcggtcgtcgtttgtcgggttttttttcgtcgcggtcggtcgtcgcgttttcgttcgggcgtttagttatgtatttttcgtattgttttatttaggtatcggtcgtcgttttcgcgcgatcgggggaggggagcgggcgcgggaggtcggtcggcggcgcgggcggaggggacgcgcggcggtcgggaagggggggtcgagagttcgcgggtcgtcgaggggtgtaggttgtgtcgcggggagtttaggtacgcgtgcgggcgttatcgtgcgcgtgcgattttggttatcgggcggattttttttgggggtttcgggggtggttagttgcgtcgtggcgttgttcgtggagcgtaggcgggagtgcgtgtacgtgtgtgtgtgtgtgtgtgtgtgtgtgcgcgttcgattggggtgcgatgggtagcgggatttcggttgatttgtgggttattgtagcgcgtattcgggtagcgtggtcgttggtagtgtttgcggggttgatagagtggtaagagggtggtttcgagggcgtagaggggatattgggtttcgcgacgttttttggggagggcgtagcggttttcgagggtggtagtggtcggcgtgcgtggcggcggtttttgcgtgcggtcggggtgtttggggtgggtcgagcggttcgggcgtttttttaaagtttttgtttaggttttatatgggagcggggttaagaaaatggcggggtttttaaatttcggaggggtaggggagg

SEQ ID NO: 1642 - DNA, 1341 bp, Artificial Sequence
  chemically treated genomic DNA (Homo sapiens) CpG-island No: 1642
cctcccctacccctccgaaatttaaaaaccccgccattttcttaaccccgctcccatataaaacctaaacaaaaactttaaaaaaacgcccgaaccgctcgacccaccccaaacaccccgaccgcacgcaaaaaccgccgccacgcacgccgaccactaccaccctcgaaaaccgctacgccctccccaaaaaacgtcgcgaaacccaatatcccctctacgccctcgaaaccaccctcttaccactctatcaaccccgcaaacactaccaacgaccacgctacccgaatacgcgctacaataacccacaaatcaaccgaaatcccgctacccatcgcaccccaatcgaacgcgcacacacacacacacacacacacacacgtacacgcactcccgcctacgctccacgaacaacgccacgacgcaactaaccacccccgaaacccccaaaaaaaatccgcccgataaccaaaatcgcacgcgcacgataacgcccgcacgcgtacctaaactccccgcgacacaacctacacccctcgacgacccgcgaactctcgacccccccttcccgaccgccgcgcgtcccctccgcccgcgccgccgaccgacctcccgcgcccgctcccctcccccgatcgcgcgaaaacgacgaccgatacctaaataaaacaatacgaaaaatacataactaaacgcccgaacgaaaacgcgacgaccgaccgcgacgaaaaaaaacccgacaaacgacgaccgcgctcgaactcgaactccgactcgactcctccgacctccgccgcgctacgcccgcccgacccgcgaccccgcgctcgacccgacgccgctccgcgctcgccgctcgcaaactcgaccccgccgactccgaaaccgccgctaccgccgccgccgccgcgctcgccgctacctctcgcgtccgccgccgccgccgctaccgccgcgcgtctactccataccgccgccgctcgaccgatcaccctcgcccgccgccgccgccgccgcaaccgccgcgctataaaaataaaaatttaaacaaaatttaaaaacgacgcactccgaaaaaaaaaaacgaacgaacgacgcgaacgaaaaaaaaaacgcgaaaaaaaacgaacaaaacgaaaaaacgacgaccgacgcacacacacaaacacacacatacacacacacacacgaacacacgcacacgcgcgcgcgaaaacgcacaccgacgcgaccgccctaacacgtactaacccgcgttccaacgcaaacacacgctaacacgcaacgaaactcgaaccccgccacacatatcacgtccaaaacgcctaaccacacgttccg

SEQ ID NO: 1643 - DNA, 1341 bp, Artificial Sequence
  chemically treated genomic DNA (Homo sapiens) CpG-island No: 1643
ttttttttgttttttcgaaatttgggagtttcgttatttttttagtttcgtttttatgtgaggtttaaataaagattttggggagacgttcgggtcgttcggtttattttaggtatttcggtcgtacgtaagggtcgtcgttacgtacgtcggttattgttattttcgggaatcgttgcgttttttttaggaagcgtcgcgggatttagtgttttttttgcgttttcgggattatttttttgttattttgttaatttcgtaaatattgttagcgattacgttgttcgggtgcgcgttatagtagtttataggttagtcggagtttcgttgtttatcgtattttagtcgagcgcgtatatatatatatatatatatatatacgtatacgtattttcgtttgcgttttacgggtagcgttacgacgtagttggttattttcggaatttttaaaaggagttcgttcggtggttagggtcgtacgcgtacggtgacgttcgtacgcgtgtttgggtttttcgcggtatagtttgtatttttcggcggttcgcgggttttcggtttttttttttcggtcgtcgcgcgtttttttcgttcgcgtcgtcggtcggtttttcgcgttcgtttttttttttcggtcgcgcgggggcggcggtcggtatttgggtgaggtagtacggggagtatatagttgggcgttcgggcgggagcgcggcggtcggtcgcggcgaggggaggttcggtaggcggcggtcgcgttcgggttcgggtttcggttcggttttttcggttttcgtcgcgttgcgttcgttcggttcgcggtttcgcgttcggttcggcgtcgtttcgcgttcgtcgttcgtaagttcggtttcgtcggtttcggggtcgtcgttgtcgtcgtcgtcgtcgcgttcgtcgttgtttttcgcgttcgtcgtcgtcgtcgttgtcgtcgcgcgtttattttatgtcgtcgtcgttcggtcggttattttcgttcgtcgtcgtcgtcgtcgtagtcgtcgcgttgtgaaagtgaaagtttagataaagtttggaagcggcgtatttcggggagagggagcgggcgggcggcgcgggcgggaggaggggcgcggggaggggcgggtagggcgggggagcggcggtcggcgtatatatataagtatatatatgtatatatatatacgaatatacgtatacgcgcgcgcgggggcgtatatcgacgcggtcgttttgatacgtgttggttcgcgttttagcgtagatatacgttgatacgtagcgggattcggatttcgttatatatgttacgtttagaacgtttggttatacgtttcg

SEQ ID NO: 1644 - DNA, 1341 bp, Artificial Sequence
  chemically treated genomic DNA (Homo sapiens) CpG-island No: 1644
cgaaacgtataaccaaacgttctaaacgtaacatatataacgaaatccgaatcccgctacgtatcaacgtatatctacgctaaaacgcgaaccaacacgtatcaaaacgaccgcgtcgatatacgcccccgcgcgcgcgtatacgtatattcgtatatatatatacatatatatacttatatatatacgccgaccgccgctcccccgccctacccgcccctccccgcgcccctcctcccgcccgcgccgcccgcccgctccctctccccgaaatacgccgcttccaaactttatctaaactttcactttcacaacgcgacgactacgacgacgacgacgacgaacgaaaataaccgaccgaacgacgacgacataaaataaacgcgcgacgacaacgacgacgacgacgaacgcgaaaaacaacgacgaacgcgacgacgacgacgacaacgacgaccccgaaaccgacgaaaccgaacttacgaacgacgaacgcgaaacgacgccgaaccgaacgcgaaaccgcgaaccgaacgaacgcaacgcgacgaaaaccgaaaaaaccgaaccgaaacccgaacccgaacgcgaccgccgcctaccgaacctcccctcgccgcgaccgaccgccgcgctcccgcccgaacgcccaactatatactccccgtactacctcacccaaataccgaccgccgcccccgcgcgaccgaaaaaaaaaaacgaacgcgaaaaaccgaccgacgacgcgaacgaaaaaaacgcgcgacgaccgaaaaaaaaaaaccgaaaacccgcgaaccgccgaaaaatacaaactataccgcgaaaaacccaaacacgcgtacgaacgtcaccgtacgcgtacgaccctaaccaccgaacgaactccttttaaaaattccgaaaataaccaactacgtcgtaacgctacccgtaaaacgcaaacgaaaatacgtatacgtatatatatatatatatatatatatacgcgctcgactaaaatacgataaacaacgaaactccgactaacctataaactactataacgcgcacccgaacaacgtaatcgctaacaatatttacgaaattaacaaaataacaaaaaaataatcccgaaaacgcaaaaaaaacactaaatcccgcgacgcttcctaaaaaaaacgcaacgattcccgaaaataacaataaccgacgtacgtaacgacgacccttacgtacgaccgaaatacctaaaataaaccgaacgacccgaacgtctccccaaaatctttatttaaacctcacataaaaacgaaactaaaaaaataacgaaactcccaaatttcgaaaaaacaaaaaaaa

SEQ ID NO: 1645 - DNA, 1035 bp, Artificial Sequence
  chemically treated genomic DNA (Homo sapiens) CpG-island No: 1645
gaggacgtgttttcgaagttgtttcgtttttttatcgttttgggacgttatagttagattcgtcgacgagttttttttttagcgtttacgagaaggagggttgcgggcggcggcggcggcgataggcgaggaagcgagtgtagggaatttaggttttggcggggttaggcgcgttcgtttcgtttttatagtaaaatttgcggcggttttcgttcgtcgcgtttcggtttagttgtgcgttagcggaatacggatttatcgttcgttcggtttttcggttcgttcggtttggcgtagcgttttttattttggaaacgttgagtagatttcgtcgtaaatattaattttttatttagtcggtagtcgcgtcgtcgcgttttagcgtttcggtttcgtttttggttttacgggtcgttcgtttcgagtttttaaaagtattacgtttatttagaagtttagggtcgtttcgcgatttttatttatttttttcggtatcgtcgttgtcggaattgtagttagttttttgttagttggttagttggttttttcggggttcggttcggtcgcgttaggagagtttaaggcgtaggcgcgggagggttttaaagagattcggtagtttttatcgtagaatgggttggagtaggttaggggtcgggcgggtcggtcgagaaaaggagaaggcgaagggattggacggagtgtagaggaggcggggaaatcgttttcgtttttcgttttttttttaaagtattagtttttagttttgtaagtcgtcgattttttcggttattggaatcgttttttttatgttaaaacggtagaagatatattttttcgggggttcgaagcgatttcgagtttaggattgtaggtttcgcgttgtcgtatcgacgcggagtttgatttttagggttttggtacgcggtgttgacgcgtatgtttcggaaggtagtttcgagtttttttagaggtggttttagggtattcgtaaaaataataattaacgcgtaaatgatatttgtaattgtaatg

SEQ ID NO: 1646 - DNA, 1035 bp, Artificial Sequence
  chemically treated genomic DNA (Homo sapiens) CpG-island No: 1646
cattacaattacaaatatcatttacgcgttaattattatttttacgaataccctaaaaccacctctaaaaaaactcgaaactaccttccgaaacatacgcgtcaacaccgcgtaccaaaaccctaaaaatcaaactccgcgtcgatacgacaacgcgaaacctacaatcctaaactcgaaatcgcttcgaacccccgaaaaaatatatcttctaccgttttaacataaaaaaaacgattccaataaccgaaaaaatcgacgacttacaaaactaaaaactaatactttaaaaaaaaaacgaaaaacgaaaacgatttccccgcctcctctacactccgtccaatcccttcgccttctccttttctcgaccgacccgcccgacccctaacctactccaacccattctacgataaaaactaccgaatctctttaaaaccctcccgcgcctacgccttaaactctcctaacgcgaccgaaccgaaccccgaaaaaaccaactaaccaactaacaaaaaactaactacaattccgacaacgacgataccgaaaaaaataaataaaaatcgcgaaacgaccctaaacttctaaataaacgtaatacttttaaaaactcgaaacgaacgacccgtaaaaccaaaaacgaaaccgaaacgctaaaacgcgacgacgcgactaccgactaaataaaaaattaatatttacgacgaaatctactcaacgtttccaaaataaaaaacgctacgccaaaccgaacgaaccgaaaaaccgaacgaacgataaatccgtattccgctaacgcacaactaaaccgaaacgcgacgaacgaaaaccgccgcaaattttactataaaaacgaaacgaacgcgcctaaccccgccaaaacctaaattccctacactcgcttcctcgcctatcgccgccgccgccgcccgcaaccctccttctcgtaaacgctaaaaaaaaaactcgtcgacgaatctaactataacgtcccaaaacgataaaaaaacgaaacaacttcgaaaacacgtcctc

SEQ ID NO: 1647 - DNA, 1035 bp, Artificial Sequence
  chemically treated genomic DNA (Homo sapiens) CpG-island No: 1647
tattataattataagtgttatttacgcgttgattattgtttttgcgagtgttttaaggttatttttgggggagttcggggttgtttttcgaagtatgcgcgttagtatcgcgtgttagggttttgaaagttaggtttcgcgtcggtgcggtagcgcgaggtttgtagttttaagttcggggtcgtttcgggttttcgagggggtgtgttttttatcgttttaatatggaaggggcggttttagtggtcggggaagtcggcgatttgtaggattgaaggttggtgttttgaaagagaggcggagggcgagagcgattttttcgttttttttgtatttcgtttaattttttcgttttttttttttttcggtcggttcgttcggtttttaatttgttttaatttattttgcggtagaggttgtcgggtttttttaaggttttttcgcgtttgcgttttgggtttttttgacgcggtcgggtcggatttcggaggaattagttggttagttggtaaggggttggttgtagtttcgatagcggcggtgtcgggaggggtaggtgagggtcgcgaggcggttttgagtttttgagtgagcgtggtgtttttgggaattcgggacgggcgattcgtggagttaggagcggggtcgaggcgttgagacgcggcggcgcggttgtcggttggatgggaagttaatgtttacggcgaagtttatttaacgtttttaaggtgaggggcgttgcgttaggtcgggcgggtcgggaggtcgggcgggcggtgagttcgtgtttcgttggcgtatagttgggtcgaggcgcggcgggcgggggtcgtcgtaagttttgttgtgggagcggggcgggcgcgtttggtttcgttagggtttaagttttttgtattcgttttttcgtttgtcgtcgtcgtcgtcgttcgtagttttttttttcgtgggcgttggggaagaaattcgtcggcgggtttaattgtggcgttttagggcggtggagggacggagtagtttcgggggtacgttttt

SEQ ID NO: 1648 - DNA, 1035 bp, Artificial Sequence
  chemically treated genomic DNA (Homo sapiens) CpG-island No: 1648
aaaaacgtacccccgaaactactccgtccctccaccgccctaaaacgccacaattaaacccgccgacgaatttcttccccaacgcccacgaaaaaaaaaactacgaacgacgacgacgacgacaaacgaaaaaacgaatacaaaaaacttaaaccctaacgaaaccaaacgcgcccgccccgctcccacaacaaaacttacgacgacccccgcccgccgcgcctcgacccaactatacgccaacgaaacacgaactcaccgcccgcccgacctcccgacccgcccgacctaacgcaacgcccctcaccttaaaaacgttaaataaacttcgccgtaaacattaacttcccatccaaccgacaaccgcgccgccgcgtctcaacgcctcgaccccgctcctaactccacgaatcgcccgtcccgaattcccaaaaacaccacgctcactcaaaaactcaaaaccgcctcgcgaccctcacctacccctcccgacaccgccgctatcgaaactacaaccaaccccttaccaactaaccaactaattcctccgaaatccgacccgaccgcgtcaaaaaaacccaaaacgcaaacgcgaaaaaaccttaaaaaaacccgacaacctctaccgcaaaataaattaaaacaaattaaaaaccgaacgaaccgaccgaaaaaaaaaaaaaacgaaaaaattaaacgaaatacaaaaaaaacgaaaaaatcgctctcgccctccgcctctctttcaaaacaccaaccttcaatcctacaaatcgccgacttccccgaccactaaaaccgccccttccatattaaaacgataaaaaacacaccccctcgaaaacccgaaacgaccccgaacttaaaactacaaacctcgcgctaccgcaccgacgcgaaacctaactttcaaaaccctaacacgcgatactaacgcgcatacttcgaaaaacaaccccgaactcccccaaaaataaccttaaaacactcgcaaaaacaataatcaacgcgtaaataacacttataattataata

SEQ ID NO: 1649 - DNA, 664 bp, Artificial Sequence
  chemically treated genomic DNA (Homo sapiens) CpG-island No: 1649
agtgcgttcgcggttatcggcgtggtagtcgaagttgtcgtagaggtaggcgggcgagttgtaggcggggtcgtagcggttgttgttgaagaggcgttagtattgtagcgtttcgtattgtcgttaggggtcgtttacgtttagcgagtagtcgtcgtcgttttagtcgtagtttgggttgttgtattcgcggtcgtagcgttggttttcgcgtttggtttggtaggcggcgcgcgggtatcgcggttttttcgagatttcgggtgtcgcggcgggcgtttcgtagcgcggttcggtttagttttgcgcgtaagcgtagcggaagaagggcgcgagcggcgcggggcggtaggagttttcgtggagatagggggcggtcgcgtagttggcgttgttggttttcggcggcgatttcgggaagttgcggtaggagggtttcgataattttggggggtaggcgtagcgcggttcgcggggcgtttgttggtatgggacgtttatcgggtattgtagttttcggtaggagcgcgttattcgttcgtaacgcggattttagaacggttgggggtcgggtttggggagggagggataaaaatgagggtggggagtggagggaaggaggagaagaaatggaggagtggggaaaagaagagttaaggggaga

SEQ ID NO: 1650 - DNA, 664 bp, Artificial Sequence
  chemically treated genomic DNA (Homo sapiens) CpG-island No: 1650
tctccccttaactcttcttttccccactcctccatttcttctcctccttccctccactccccaccctcatttttatccctccctccccaaacccgacccccaaccgttctaaaatccgcgttacgaacgaataacgcgctcctaccgaaaactacaatacccgataaacgtcccataccaacaaacgccccgcgaaccgcgctacgcctaccccccaaaattatcgaaaccctcctaccgcaacttcccgaaatcgccgccgaaaaccaacaacgccaactacgcgaccgccccctatctccacgaaaactcctaccgccccgcgccgctcgcgcccttcttccgctacgcttacgcgcaaaactaaaccgaaccgcgctacgaaacgcccgccgcgacacccgaaatctcgaaaaaaccgcgatacccgcgcgccgcctaccaaaccaaacgcgaaaaccaacgctacgaccgcgaatacaacaacccaaactacgactaaaacgacgacgactactcgctaaacgtaaacgacccctaacgacaatacgaaacgctacaatactaacgcctcttcaacaacaaccgctacgaccccgcctacaactcgcccgcctacctctacgacaacttcgactaccacgccgataaccgcgaacgcact

SEQ ID NO: 1651 - DNA, 664 bp, Artificial Sequence
  chemically treated genomic DNA (Homo sapiens) CpG-island No: 1651
tttttttttgattttttttttttttatttttttatttttttttttttttttttttattttttatttttatttttatttttttttttttaaattcgatttttagtcgttttggggttcgcgttgcgagcgggtggcgcgtttttgtcgggagttgtagtgttcggtgggcgttttatgttagtagacgtttcgcgggtcgcgttgcgtttgttttttagggttgtcgggatttttttgtcgtagtttttcggggtcgtcgtcgggggttagtaacgttagttgcgcggtcgttttttgtttttacgggggtttttgtcgtttcgcgtcgttcgcgtttttttttcgttgcgtttgcgcgtagggttggatcgggtcgcgttgcgaggcgttcgtcgcggtattcgaggtttcggaggagtcgcggtgttcgcgcgtcgtttgttaggttaagcgcggggattagcgttgcgatcgcgagtgtaatagtttaggttgcggttgggacggcggcgattgttcgttgagcgtgggcgatttttggcggtaatgcgaggcgttgtagtgttggcgtttttttaataatagtcgttgcgatttcgtttgtagttcgttcgtttgtttttacgataatttcgattgttacgtcggtggtcgcgagcgtatt

SEQ ID NO: 1652 - DNA, 664 bp, Artificial Sequence
  chemically treated genomic DNA (Homo sapiens) CpG-island No: 1652
aatacgctcgcgaccaccgacgtaacaatcgaaattatcgtaaaaacaaacgaacgaactacaaacgaaatcgcaacgactattattaaaaaaacgccaacactacaacgcctcgcattaccgccaaaaatcgcccacgctcaacgaacaatcgccgccgtcccaaccgcaacctaaactattacactcgcgatcgcaacgctaatccccgcgcttaacctaacaaacgacgcgcgaacaccgcgactcctccgaaacctcgaataccgcgacgaacgcctcgcaacgcgacccgatccaaccctacgcgcaaacgcaacgaaaaaaaaacgcgaacgacgcgaaacgacaaaaacccccgtaaaaacaaaaaacgaccgcgcaactaacgttactaacccccgacgacgaccccgaaaaactacgacaaaaaaatcccgacaaccctaaaaaacaaacgcaacgcgacccgcgaaacgtctactaacataaaacgcccaccgaacactacaactcccgacaaaaacgcgccacccgctcgcaacgcgaaccccaaaacgactaaaaatcgaatttaaaaaaaaaaaaataaaaataaaaataaaaaataaaaaaaaaaaaaaaaaaaaataaaaaaataaaaaaaaaaaaaatcaaaaaaaaa

SEQ ID NO: 1653 - DNA, 756 bp, Artificial Sequence
  chemically treated genomic DNA (Homo sapiens) CpG-island No: 1653
gatagttttgacggtgcggggcggggttggcggttgtttaggtttggttgaggcgtcgcggtcgggtttttttttatttgtcgggcggagcgtacgggttatgggttgagtttcgttgagttcgtcgggtcggttatgggcgatcgcgagcgtaataagaagcggttgttggagttgttgcgggcgtcggatataggtaacgcgtattgcgtcgattgcggggcggtaggtaagggcgcggcggcgcgggtagcgcgagattttcggtcggattttaggtttattcgattttttttttcggttttatcgggtttcgttttcggttttttggatttagacgtggtatttgcgggtttcgattttttttatttatatcgtgaattttttattcgagtttcgagggtcgtttttattatattttgtttcggtttttacgagtttaggttttgtttttttcgcgggattagatgcgtatttttttacgtgtttggattcggatacgagagtcggtagtttagagtttttttagtttcgtttttttttttggttaggtattcgatcgttcgagttcgggttttcgatgtttgcgtatttaggcgcgttttacgttttcggatttagatattttagttagggttaaacgtcgggtttaggtcgtcgatagttttgtgttttttgttcgtttttagacgtttttcgaaggtttttttagcgttttatttcggggacgtcgagggttttttaatttagtttttt

SEQ ID NO: 1654 - DNA, 756 bp, Artificial Sequence
  chemically treated genomic DNA (Homo sapiens) CpG-island No: 1654
aaaaaactaaattaaaaaaccctcgacgtccccgaaataaaacgctaaaaaaaccttcgaaaaacgtctaaaaacgaacaaaaaacacaaaactatcgacgacctaaacccgacgtttaaccctaactaaaatatctaaatccgaaaacgtaaaacgcgcctaaatacgcaaacatcgaaaacccgaactcgaacgatcgaatacctaaccaaaaaaaaaaacgaaactaaaaaaactctaaactaccgactctcgtatccgaatccaaacacgtaaaaaaatacgcatctaatcccgcgaaaaaaacaaaacctaaactcgtaaaaaccgaaacaaaatataataaaaacgaccctcgaaactcgaataaaaaattcacgatataaataaaaaaaatcgaaacccgcaaataccacgtctaaatccaaaaaaccgaaaacgaaacccgataaaaccgaaaaaaaaaatcgaataaacctaaaatccgaccgaaaatctcgcgctacccgcgccgccgcgcccttacctaccgccccgcaatcgacgcaatacgcgttacctatatccgacgcccgcaacaactccaacaaccgcttcttattacgctcgcgatcgcccataaccgacccgacgaactcaacgaaactcaacccataacccgtacgctccgcccgacaaataaaaaaaaacccgaccgcgacgcctcaaccaaacctaaacaaccgccaaccccgccccgcaccgtcaaaactatc

SEQ ID NO: 1655 - DNA, 756 bp, Artificial Sequence
  chemically treated genomic DNA (Homo sapiens) CpG-island No: 1655
gggaggttgagttagggggttttcggcgttttcgaggtggggcgttggggaggttttcggggggcgtttgggagcgggtagggggtataggattgtcggcggtttgggttcgacgtttagttttggttgggatgtttgagttcgagggcgtggggcgcgtttgggtgcgtagatatcgagagttcggattcgggcggtcgggtgtttggttagggaagagagcgggattggaagggttttaggttgtcggttttcgtgttcgggtttaagtacgtgggaagatgcgtatttggtttcgcgaggggagtagagtttgggttcgtaggggtcggggtagggtgtggtggagacggttttcggggttcgggtgagaggtttacggtgtgggtgggaggggtcggggttcgtaggtgttacgtttgggtttagggggtcgagggcgggattcggtggggtcgaggggaggagtcgggtgggtttggggttcggtcgggggtttcgcgttgttcgcgtcgtcgcgtttttatttgtcgtttcgtagtcggcgtagtgcgcgttgtttgtgttcggcgttcgtagtagttttagtagtcgttttttgttgcgttcgcgatcgtttatggtcggttcggcgggtttagcggggtttagtttatggttcgtgcgtttcgttcggtaggtggagagggattcggtcgcggcgttttagttaggtttgggtagtcgttagtttcgtttcgtatcgttaggattgtt

SEQ ID NO: 1656 - DNA, 756 bp, Artificial Sequence
  chemically treated genomic DNA (Homo sapiens) CpG-island No: 1656
aacaatcctaacgatacgaaacgaaactaacgactacccaaacctaactaaaacgccgcgaccgaatccctctccacctaccgaacgaaacgcacgaaccataaactaaaccccgctaaacccgccgaaccgaccataaacgatcgcgaacgcaacaaaaaacgactactaaaactactacgaacgccgaacacaaacaacgcgcactacgccgactacgaaacgacaaataaaaacgcgacgacgcgaacaacgcgaaacccccgaccgaaccccaaacccacccgactcctcccctcgaccccaccgaatcccgccctcgaccccctaaacccaaacgtaacacctacgaaccccgacccctcccacccacaccgtaaacctctcacccgaaccccgaaaaccgtctccaccacaccctaccccgacccctacgaacccaaactctactcccctcgcgaaaccaaatacgcatcttcccacgtacttaaacccgaacacgaaaaccgacaacctaaaacccttccaatcccgctctcttccctaaccaaacacccgaccgcccgaatccgaactctcgatatctacgcacccaaacgcgccccacgccctcgaactcaaacatcccaaccaaaactaaacgtcgaacccaaaccgccgacaatcctataccccctacccgctcccaaacgccccccgaaaacctccccaacgccccacctcgaaaacgccgaaaaccccctaactcaacctccc

SEQ ID NO: 1657 - DNA, 566 bp, Artificial Sequence
  chemically treated genomic DNA (Homo sapiens) CpG-island No: 1657
ggggcggcgcgcggggaagttattggcggagttgtgcgtattgcgggtgttgtaggcgttggggagagtgtggagaggttgcgtggagttgtgcgttcggggtgggggttgtatttttaatgaagcgcgtgaagggtaagcggtgatgggttttgcgttagtggggttgggagtttgtcgggggttgtacgtgaggttgcgcgtaaggtgagaattgcgtatgtgggtttaggaattgcgcgtatcgaagtttgtaggcgttggggagggtgtggggggttgtgcgtggggttgtttttatcggaagttgtacgttcggggaagcgcggaggcgggggtgttgcgcgcgttggggagtacgtggggggatacgtagggattgttcgcgcgaatggtttttaacgtatgcgttttattttatattttatagtcgttatgacgattaggaggttcgttagttaacggttcgttaacggttgcggggataagttcgttgaggttgttaggcgagttaggtttttttggatttcgtttgattcggttgggttgtgtttgaaattgattta

SEQ ID NO: 1658 - DNA, 566 bp, Artificial Sequence
  chemically treated genomic DNA (Homo sapiens) CpG-island No: 1658
taaatcaatttcaaacacaacccaaccgaatcaaacgaaatccaaaaaaacctaactcgcctaacaacctcaacgaacttatccccgcaaccgttaacgaaccgttaactaacgaacctcctaatcgtcataacgactataaaatataaaataaaacgcatacgttaaaaaccattcgcgcgaacaatccctacgtatccccccacgtactccccaacgcgcgcaacacccccgcctccgcgcttccccgaacgtacaacttccgataaaaacaaccccacgcacaaccccccacaccctccccaacgcctacaaacttcgatacgcgcaattcctaaacccacatacgcaattctcaccttacgcgcaacctcacgtacaacccccgacaaactcccaaccccactaacgcaaaacccatcaccgcttacccttcacgcgcttcattaaaaatacaacccccaccccgaacgcacaactccacgcaacctctccacactctccccaacgcctacaacacccgcaatacgcacaactccgccaataacttccccgcgcgccgcccc

SEQ ID NO: 1659 - DNA, 566 bp, Artificial Sequence
  chemically treated genomic DNA (Homo sapiens) CpG-island No: 1659
tgggttaattttaggtatagtttagtcgagttaggcgaggtttagaaaggtttgattcgtttggtagttttaacggatttgttttcgtagtcgttgacgagtcgttgattagcggattttttggtcgttatggcgattgtgaaatgtagggtggggcgtatgcgttggaagttattcgcgcgggtagtttttgcgtgtttttttacgtgttttttagcgcgcgtagtattttcgttttcgcgttttttcgagcgtgtagttttcggtgagggtagttttacgtatagttttttatattttttttagcgtttgtagatttcggtgcgcgtagtttttaagtttatatgcgtagtttttattttgcgcgtagttttacgtatagttttcgataggtttttagttttattggcgtagaatttattatcgtttgttttttacgcgttttattgggagtgtagtttttatttcgagcgtatagttttacgtagtttttttatattttttttagcgtttgtagtattcgtagtgcgtatagtttcgttagtagttttttcgcgcgtcgtttt

SEQ ID NO: 1660 - DNA, 566 bp, Artificial Sequence
  chemically treated genomic DNA (Homo sapiens) CpG-island No: 1660
aaaacgacgcgcgaaaaaactactaacgaaactatacgcactacgaatactacaaacgctaaaaaaaatataaaaaaactacgtaaaactatacgctcgaaataaaaactacactcccaataaaacgcgtaaaaaacaaacgataataaattctacgccaataaaactaaaaacctatcgaaaactatacgtaaaactacgcgcaaaataaaaactacgcatataaacttaaaaactacgcgcaccgaaatctacaaacgctaaaaaaaatataaaaaactatacgtaaaactaccctcaccgaaaactacacgctcgaaaaaacgcgaaaacgaaaatactacgcgcgctaaaaaacacgtaaaaaaacacgcaaaaactacccgcgcgaataacttccaacgcatacgccccaccctacatttcacaatcgccataacgaccaaaaaatccgctaatcaacgactcgtcaacgactacgaaaacaaatccgttaaaactaccaaacgaatcaaacctttctaaacctcgcctaactcgactaaactatacctaaaattaaccca

SEQ ID NO: 1661 - DNA, 578 bp, Artificial Sequence
  chemically treated genomic DNA (Homo sapiens) CpG-island No: 1661
  misc_feature (242)..(242): n is either a, c, g or t
ttattatatttttattaattttattttttttttcgtatttttttatatttttatttttttttttattagttatttttatttcgcgtttttttttagtttcgttttatattttttatcgattatttttcgttattttttatattttcgtatttttatacgttttttttatttcgatttttttagttaagatttttagattatttttttatattgttttttatatacgtttttttattttattnttttttttcgtcgcgtgattgcgttttttcgattcgtttttttttattttcgttacgttttttttttttcgtttatttatagttatatattatttttttattttattttatttgtattcgtgttttttttcgtttatttttttttatatttattattcgttttttattcgttttatttttttttttaatttttattttttttttttttttcgttttttttacgttattatatacgttttacgcgtgtataattttttattcgcgattttatttttttattttatattcgcgtattaatattttcgcgttcgttttttagtattttcgttttttttt

SEQ ID NO: 1662 - DNA, 578 bp, Artificial Sequence
  chemically treated genomic DNA (Homo sapiens) CpG-island No: 1662
  misc_feature (337)..(337): n is either a, c, g or t
aaaaaaaaacgaaaatactaaaaaacgaacgcgaaaatattaatacgcgaatataaaataaaaaaataaaatcgcgaataaaaaattatacacgcgtaaaacgtatataataacgtaaaaaaaacgaaaaaaaaaaaaaaaataaaaattaaaaaaaaaaataaaacgaataaaaaacgaataataaatataaaaaaaaataaacgaaaaaaaacacgaatacaaataaaataaaataaaaaaataatatataactataaataaacgaaaaaaaaaaaacgtaacgaaaataaaaaaaaacgaatcgaaaaaacgcaatcacgcgacgaaaaaaaanaataaaataaaaaaacgtatataaaaaacaatataaaaaaataatctaaaaatcttaactaaaaaaatcgaaataaaaaaaacgtataaaaatacgaaaatataaaaaataacgaaaaataatcgataaaaaatataaaacgaaactaaaaaaaaacgcgaaataaaaataactaataaaaaaaaaaataaaaatataaaaaaatacgaaaaaaaaaataaaattaataaaaatataataa

SEQ ID NO: 1663 - DNA, 578 bp, Artificial Sequence
  chemically treated genomic DNA (Homo sapiens) CpG-island No: 1663
  misc_feature (337)..(337): n is either a, c, g or t
gaaagaggacggaagtattagaggacgagcgcggagatattggtacgcggatgtgaagtgagaggatgggatcgcgagtaggagattgtatacgcgtagggcgtgtatagtgacgtggagaggacgagagagggagagagagtggggattagaggaaagagtgagacggatagagagcgagtggtggatgtggagagaggtaggcgggggagagtacggatataggtagagtgaggtagaggagtggtatgtggttgtggatagacgagagggaagaggcgtagcgggggtagagggaggcggatcgaggaggcgtaattacgcggcgagagagagnggtgaggtgaggaggcgtgtgtaggaggtagtatgaaagagtgatttagaagttttggttggaaggatcggagtgggaggggcgtataagagtgcgggagtgtgaggggtagcggggggtgatcggtggggggtgtggggcggagttgagggggagcgcgaggtggagatggttagtggagggggggatgggagtgtggagggatacggagaagggggtgagattggtggggatgtggtga

SEQ ID NO: 1664 - DNA, 578 bp, Artificial Sequence
  chemically treated genomic DNA (Homo sapiens) CpG-island No: 1664
  misc_feature (242)..(242): n is either a, c, g or t
tcaccacatccccaccaatctcacccccttctccgtatccctccacactcccatccccccctccactaaccatctccacctcgcgctccccctcaactccgccccacaccccccaccgatcaccccccgctacccctcacactcccgcactcttatacgcccctcccactccgatccttccaaccaaaacttctaaatcactctttcatactacctcctacacacgcctcctcacctcaccnctctctctcgccgcgtaattacgcctcctcgatccgcctccctctacccccgctacgcctcttccctctcgtctatccacaaccacataccactcctctacctcactctacctatatccgtactctcccccgcctacctctctccacatccaccactcgctctctatccgtctcactctttcctctaatccccactctctctccctctctcgtcctctccacgtcactatacacgccctacgcgtatacaatctcctactcgcgatcccatcctctcacttcacatccgcgtaccaatatctccgcgctcgtcctctaatacttccgtcctctttc

SEQ ID NO: 1665 - DNA, 1750 bp, Artificial Sequence
  chemically treated genomic DNA (Homo sapiens) CpG-island No: 1665
ggacgcgtagtaagaaagcggaggatataatttttttttttttttagagtttcgggtttcgtagacgtcgaggtgggcgttcgtgttaggatcgcggggcgcgggtacgggttttttgggcgtttcgagggggttgttggtcggggtaagagtcgcggttttttcggaggatcgggtcgagttttaggagaagggggtagtaggcgtgcggcgtcgggagaagggggtcgggcggcggagatttttcgttcgtattttcgcggcgaggttttcgggtcgttttgtttaggggtcgagggagtcgggcgggaggtaggtgcggaggtcgcggttttagcgtttgggaggagttttcgggagggtgtcgcggttcggttggtgggtaggagcgagtcggggtcggcgcggttgtcgggggcggggaggaggcgcgggaggcggggcggaggcggcggcgtttttaggatttattcgtttagcgtcgggttttgtatttcgagtcgcggtcgttattcgtttcgtagttaatttgggtcgaaattttttcgggtttcgcgtttcggagtagggcgcgtagttcggcgagatcgacggcggtttttcgagttcgcgtttcgggtttagggttttttttcggatcggtcgtaggttgcgcgttttcgatcgttttcgttcgttgagttcgggggttttcggcgcggagtagggagtttttcgggcggtaggagggcgcgtagatttcgagcgtcggggttgtttggtcgggtttcggtggatatttcggaggttgttttagtatcggggggggggttcgagacgtttcggcgggatttcgggagtcgagtacgttcgttcgcgtcgttagtttcgcgtttcggtcgcggatgaagagtcggaggcggcggttcgagcggttcgcgcgttgagaggagcgggtagggtttgtttcgggtttcgtcggtcgttttttgcgttttcgcgggtcgcgtttcgttcgtcgatttagcgtagtcgggcgtaggaagagtcgggtcgggtcgagcggcgttcggagttcgcgggtttgatacgcggcgggatatgtaggtaagcgtcggttttcgttttcggggacggtttcgtcgtcgtcgtcgtcgtttcggttgtcgaatttcgcgcggttttttcgttttttcggtttcgcggtcgcgttgggtgttcgtcgggtgggtttgcgcgtcgcgggcgtcgggtcggggcgggtcggggttaggtcgggggaagggagtcgtttcgggtcggggcggcgaataaagttggggatcgtcgggttttcgcgcgggtaggtataggaggtttcggggtcggcggcgtaggcggggcggtttttgagtttcgcgtttattttttcgggtttggtcgggtttagtttcgatttttcgtcgaggtttgcgtcggtatcgaggattttatttgggttattttattcgtcggacgcgggtgggagtttgcgtttttgttcggatcgcgtaggtagagttcgagcgtcgttcggttttgtgttttttcggtcgtttcggcgttttacgttttcgtcgtgggagaggcgggacgagatttttttttttatttttttggagtttcggtggacgcgtagttcgcgttttagtcggagtcgaattttcgggtatttgttgtagatcgttgggagaggtagttcggtttgcggggagtttgttcggttttgttttatagggagggaaattgaggt

SEQ ID NO: 1666 - DNA, 1750 bp, Artificial Sequence
  chemically treated genomic DNA (Homo sapiens) CpG-island No: 1666
acctcaatttccctccctataaaacaaaaccgaacaaactccccgcaaaccgaactacctctcccaacgatctacaacaaatacccgaaaattcgactccgactaaaacgcgaactacgcgtccaccgaaactccaaaaaaataaaaaaaaaaatctcgtcccgcctctcccacgacgaaaacgtaaaacgccgaaacgaccgaaaaaacacaaaaccgaacgacgctcgaactctacctacgcgatccgaacaaaaacgcaaactcccacccgcgtccgacgaataaaataacccaaataaaatcctcgataccgacgcaaacctcgacgaaaaatcgaaactaaacccgaccaaacccgaaaaaataaacgcgaaactcaaaaaccgccccgcctacgccgccgaccccgaaacctcctatacctacccgcgcgaaaacccgacgatccccaactttattcgccgccccgacccgaaacgactcccttcccccgacctaaccccgacccgccccgacccgacgcccgcgacgcgcaaacccacccgacgaacacccaacgcgaccgcgaaaccgaaaaaacgaaaaaaccgcgcgaaattcgacaaccgaaacgacgacgacgacgacgaaaccgtccccgaaaacgaaaaccgacgcttacctacatatcccgccgcgtatcaaacccgcgaactccgaacgccgctcgacccgacccgactcttcctacgcccgactacgctaaatcgacgaacgaaacgcgacccgcgaaaacgcaaaaaacgaccgacgaaacccgaaacaaaccctacccgctcctctcaacgcgcgaaccgctcgaaccgccgcctccgactcttcatccgcgaccgaaacgcgaaactaacgacgcgaacgaacgtactcgactcccgaaatcccgccgaaacgtctcgaaccccccccccgatactaaaacaacctccgaaatatccaccgaaacccgaccaaacaaccccgacgctcgaaatctacgcgccctcctaccgcccgaaaaactccctactccgcgccgaaaacccccgaactcaacgaacgaaaacgatcgaaaacgcgcaacctacgaccgatccgaaaaaaaaccctaaacccgaaacgcgaactcgaaaaaccgccgtcgatctcgccgaactacgcgccctactccgaaacgcgaaacccgaaaaaatttcgacccaaattaactacgaaacgaataacgaccgcgactcgaaatacaaaacccgacgctaaacgaataaatcctaaaaacgccgccgcctccgccccgcctcccgcgcctcctccccgcccccgacaaccgcgccgaccccgactcgctcctacccaccaaccgaaccgcgacaccctcccgaaaactcctcccaaacgctaaaaccgcgacctccgcacctacctcccgcccgactccctcgacccctaaacaaaacgacccgaaaacctcgccgcgaaaatacgaacgaaaaatctccgccgcccgacccccttctcccgacgccgcacgcctactacccccttctcctaaaactcgacccgatcctccgaaaaaaccgcgactcttaccccgaccaacaaccccctcgaaacgcccaaaaaacccgtacccgcgccccgcgatcctaacacgaacgcccacctcgacgtctacgaaacccgaaactctaaaaaaaaaaaaaaattatatcctccgctttcttactacgcgtcc

SEQ ID NO: 1667 - DNA, 1750 bp, Artificial Sequence
  chemically treated genomic DNA (Homo sapiens) CpG-island No: 1667
attttagtttttttttttgtaaaatagggtcgggtaggtttttcgtaaatcgaattgttttttttagcggtttgtagtaaatattcgggggttcggtttcgattggagcgcgggttacgcgtttatcgaggttttaagaaagtgaaggaggaggtttcgtttcgttttttttacggcggggacgtggagcgtcggagcgatcggagaagtataaagtcgagcggcgttcgggttttatttgcgcggttcgggtagaaacgtaggtttttattcgcgttcggcgggtaaagtaatttagatggggttttcgatgtcggcgtagatttcggcggagggtcggggttgggttcgattagattcgggagagtgagcgcgaagtttagaggtcgtttcgtttgcgtcgtcgatttcggagttttttatgtttgttcgcgcgagggttcggcggtttttagttttgttcgtcgtttcggttcggggcgatttttttttttcgatttgatttcggttcgtttcgattcgacgttcgcggcgcgtagatttattcggcggatatttagcgcggtcgcggggtcgggaaggcggaggagtcgcgcgaggttcggtagtcggggcggcggcggcggcggcggggtcgttttcgggggcgagggtcggcgtttatttgtatgtttcgtcgcgtgttaggttcgcgggtttcgggcgtcgttcggttcggttcggttttttttgcgttcggttgcgttgggtcggcgggcgaggcgcggttcgcgggggcgtagggggcggtcggcggggttcggggtagattttgttcgttttttttagcgcgcgggtcgttcgggtcgtcgttttcgattttttattcgcggtcggggcgcggggttggcggcgcgggcgggcgtgttcggttttcggggtttcgtcgaggcgtttcgggtttttttttcgatgttggggtagttttcgaggtgtttatcggagttcggttaggtagtttcggcgttcggagtttgcgcgtttttttgtcgttcggagggttttttgtttcgcgtcggggattttcgaatttagcgggcggggacggtcgggggcgcgtagtttgcggtcgattcggagggaggttttgggttcgaggcgcgggttcgggaggtcgtcgtcgatttcgtcgggttgcgcgttttgtttcggagcgcgggattcggggaagtttcggtttaagttggttgcggggcgggtggcggtcgcggttcggagtgtagggttcggcgttgggcgagtggattttgggggcgtcgtcgttttcgtttcgtttttcgcgtttttttttcgttttcgatagtcgcgtcggtttcggttcgtttttgtttattagtcgggtcgcgatattttttcgagggttttttttaggcgttgggatcgcgattttcgtatttgtttttcgttcggttttttcggtttttaagtagagcggttcgggggtttcgtcgcgggggtgcggacggggagttttcgtcgttcggtttttttttttcggcgtcgtacgtttgttgttttttttttttggaattcgattcgatttttcgaagaaatcgcggtttttatttcggttagtagttttttcggggcgtttaaggagttcgtattcgcgtttcgcgattttggtacgagcgtttatttcggcgtttgcggggttcgaggttttgagaggggaagagagttatgtttttcgtttttttgttacgcgttt

SEQ ID NO: 1668 - DNA, 1750 bp, Artificial Sequence
  chemically treated genomic DNA (Homo sapiens) CpG-island No: 1668
aaacgcgtaacaaaaaaacgaaaaacataactctcttcccctctcaaaacctcgaaccccgcaaacgccgaaataaacgctcgtaccaaaatcgcgaaacgcgaatacgaactccttaaacgccccgaaaaaactactaaccgaaataaaaaccgcgatttcttcgaaaaatcgaatcgaattccaaaaaaaaaaaacaacaaacgtacgacgccgaaaaaaaaaaaccgaacgacgaaaactccccgtccgcacccccgcgacgaaacccccgaaccgctctacttaaaaaccgaaaaaaccgaacgaaaaacaaatacgaaaatcgcgatcccaacgcctaaaaaaaaccctcgaaaaaatatcgcgacccgactaataaacaaaaacgaaccgaaaccgacgcgactatcgaaaacgaaaaaaaaacgcgaaaaacgaaacgaaaacgacgacgcccccaaaatccactcgcccaacgccgaaccctacactccgaaccgcgaccgccacccgccccgcaaccaacttaaaccgaaacttccccgaatcccgcgctccgaaacaaaacgcgcaacccgacgaaatcgacgacgacctcccgaacccgcgcctcgaacccaaaacctccctccgaatcgaccgcaaactacgcgcccccgaccgtccccgcccgctaaattcgaaaatccccgacgcgaaacaaaaaaccctccgaacgacaaaaaaacgcgcaaactccgaacgccgaaactacctaaccgaactccgataaacacctcgaaaactaccccaacatcgaaaaaaaaacccgaaacgcctcgacgaaaccccgaaaaccgaacacgcccgcccgcgccgccaaccccgcgccccgaccgcgaataaaaaatcgaaaacgacgacccgaacgacccgcgcgctaaaaaaaacgaacaaaatctaccccgaaccccgccgaccgccccctacgcccccgcgaaccgcgcctcgcccgccgacccaacgcaaccgaacgcaaaaaaaaccgaaccgaaccgaacgacgcccgaaacccgcgaacctaacacgcgacgaaacatacaaataaacgccgaccctcgcccccgaaaacgaccccgccgccgccgccgccgccccgactaccgaacctcgcgcgactcctccgccttcccgaccccgcgaccgcgctaaatatccgccgaataaatctacgcgccgcgaacgtcgaatcgaaacgaaccgaaatcaaatcgaaaaaaaaaaatcgccccgaaccgaaacgacgaacaaaactaaaaaccgccgaaccctcgcgcgaacaaacataaaaaactccgaaatcgacgacgcaaacgaaacgacctctaaacttcgcgctcactctcccgaatctaatcgaacccaaccccgaccctccgccgaaatctacgccgacatcgaaaaccccatctaaattactttacccgccgaacgcgaataaaaacctacgtttctacccgaaccgcgcaaataaaacccgaacgccgctcgactttatacttctccgatcgctccgacgctccacgtccccgccgtaaaaaaaacgaaacgaaacctcctccttcactttcttaaaacctcgataaacgcgtaacccgcgctccaatcgaaaccgaacccccgaatatttactacaaaccgctaaaaaaaacaattcgatttacgaaaaacctacccgaccctattttacaaaaaaaaaaactaaaat

SEQ ID NO: 1669 - DNA, 612 bp, Artificial Sequence
  chemically treated genomic DNA (Homo sapiens) CpG-island No: 1669
ggcgcgcgttggtcgagtgtttgtgcggcggttcgtttaggtcggcgttgatgttttggttcgttttggttcgtagtagttgttcgtttttcgggtggtgtcgtacgaagttggagaggtcgtagaggcgggtttcgcggcggatttagtacgcgtcggtcgttaggcgtcgttggatttcggagggcgagaaggaggcggcggggggcggagcgggggttatggtcggagatcgtagtttttagcgcgtagttcggcgtttgttttgttgttattttgagcgtttttaatatttcgggagtttcgcggtcgtttcgggcgggtcgttatcgtatttgtttatttgtatatcgcgtttttattggtcggtcgggagtttcggtagagtcgcgaggggcgggttcggcgtcgggagttgcgcgttaggtggtcgcggatagggagtgtcgcgttcgttaggtgtgtttcgcgcgggaggagggtgggcggatataggcggagcgagttttttcgtcgcgggtggttgtttgggcggatattttcggtggtttgatcgttgttggaataattttaattgtttttacggaggagttggtcgtatgggattttttg

SEQ ID NO: 1670 - DNA, 612 bp, Artificial Sequence
  chemically treated genomic DNA (Homo sapiens) CpG-island No: 1670
caaaaaatcccatacgaccaactcctccgtaaaaacaattaaaattattccaacaacgatcaaaccaccgaaaatatccgcccaaacaaccacccgcgacgaaaaaactcgctccgcctatatccgcccaccctcctcccgcgcgaaacacacctaacgaacgcgacactccctatccgcgaccacctaacgcgcaactcccgacgccgaacccgcccctcgcgactctaccgaaactcccgaccgaccaataaaaacgcgatatacaaataaacaaatacgataacgacccgcccgaaacgaccgcgaaactcccgaaatattaaaaacgctcaaaataacaacaaaacaaacgccgaactacgcgctaaaaactacgatctccgaccataacccccgctccgccccccgccgcctccttctcgccctccgaaatccaacgacgcctaacgaccgacgcgtactaaatccgccgcgaaacccgcctctacgacctctccaacttcgtacgacaccacccgaaaaacgaacaactactacgaaccaaaacgaaccaaaacatcaacgccgacctaaacgaaccgccgcacaaacactcgaccaacgcgcgcc

SEQ ID NO: 1671 - DNA, 612 bp, Artificial Sequence
  chemically treated genomic DNA (Homo sapiens) CpG-island No: 1671
tagagggttttatgcggttagttttttcgtggaagtagttgaagttattttagtagcgattaggttatcgaggatgttcgtttagataattattcgcgacggggagattcgtttcgtttgtgttcgtttatttttttttcgcgcgggatatatttggcgggcgcggtattttttgttcgcggttatttggcgcgtagttttcggcgtcgggttcgtttttcgcggttttgtcggggttttcggtcggttaatgggagcgcggtatgtaaatgagtaggtgcggtggcggttcgttcggaacggtcgcggggttttcgggatgttagaggcgtttagggtggtagtagagtagacgtcgggttgcgcgttgggagttgcggttttcggttatggttttcgtttcgtttttcgtcgtttttttttcgtttttcgaggtttagcggcgtttggcggtcggcgcgtgttgggttcgtcgcggggttcgtttttacgatttttttagtttcgtgcggtattattcggggggcgagtagttgttgcgggttagggcgggttaggatattagcgtcgatttggacgggtcgtcgtataggtattcggttaacgcgcgtt

SEQ ID NO: 1672 - DNA, 612 bp, Artificial Sequence
  chemically treated genomic DNA (Homo sapiens) CpG-island No: 1672
aacgcgcgttaaccgaatacctatacgacgacccgtccaaatcgacgctaatatcctaacccgccctaacccgcaacaactactcgccccccgaataataccgcacgaaactaaaaaaatcgtaaaaacgaaccccgcgacgaacccaacacgcgccgaccgccaaacgccgctaaacctcgaaaaacgaaaaaaaaacgacgaaaaacgaaacgaaaaccataaccgaaaaccgcaactcccaacgcgcaacccgacgtctactctactaccaccctaaacgcctctaacatcccgaaaaccccgcgaccgttccgaacgaaccgccaccgcacctactcatttacataccgcgctcccattaaccgaccgaaaaccccgacaaaaccgcgaaaaacgaacccgacgccgaaaactacgcgccaaataaccgcgaacaaaaaataccgcgcccgccaaatatatcccgcgcgaaaaaaaaataaacgaacacaaacgaaacgaatctccccgtcgcgaataattatctaaacgaacatcctcgataacctaatcgctactaaaataacttcaactacttccacgaaaaaactaaccgcataaaaccctcta

SEQ ID NO: 1673 - DNA, 1085 bp, Artificial Sequence
  chemically treated genomic DNA (Homo sapiens) CpG-island No: 1673
gggtcgcggtgttcgttaggtcgcgtagggtgagagttagagcgggcgcgggcgggcggtatttcgttcgggattggaagggagggcgtagcggggttacggcggggggatttcgttagtcgggcggttcgcgagttttttgagtgtattagttttcgttgtcgcgggatcgcggtcgggacggagttttttgcgcgtttttcgggggtcggtagcggttaggaggcggcgcggggttcggtcgttcggttttgtagtttcgcgtattcggtagcggcggcggtgtagtttcgggcgttcggatagttttcgagtttatggcggggagcgacgtggatagcgagggtttcgtacggaggggcggcgcggcgcggcgttcgggggtttttggcgggttaggaagcgaggcggtagtcggttgttcggagtcgttgtttattgttgaagcgtcggttgagagcgttacgttgttcgtttggatgcgtttttatttttacgggatgtacgggattattttggacgtgttggtgttttcggttcggcgtttcgttcgtagttcggatttgcggatgttaggttttttttcgttttatcgttgtttgttgtattcgtttatttatttcgttttggagaaggtgtatttgtagtagcggcgttgttttaacgttttcgtttttaatttttttttttatttttcggtttacgtggggttgtagattttagcgggttaggcgttattatttagtttgggcggcggggcgggggtcgcggtggcgttaggggcgttggatttggcgttgtagtacgtgttggcgttttattattgttaagtgtttttgaagcgttttttgcgtttgcggtacgggcgatagaggcggcggtagtagtaatagtagtagtagtagtagtagtagtagcggaggggcgcgtttttcgtttttttcggcgttcgggtttttattgcggtcggagttcggcggcgacgatttcgtggttttaggggcgtcgggggagtttttagttaggggttgttcgatttatttcgttttttttttttcggaatgtacggttttttggatgagatt

SEQ ID NO: 1674 - DNA, 1085 bp, Artificial Sequence
  chemically treated genomic DNA (Homo sapiens) CpG-island No: 1674
aatctcatccaaaaaaccgtacattccgaaaaaaaaaaaacgaaataaatcgaacaacccctaactaaaaactcccccgacgcccctaaaaccacgaaatcgtcgccgccgaactccgaccgcaataaaaacccgaacgccgaaaaaaacgaaaaacgcgcccctccgctactactactactactactactactattactactaccgccgcctctatcgcccgtaccgcaaacgcaaaaaacgcttcaaaaacacttaacaataataaaacgccaacacgtactacaacgccaaatccaacgcccctaacgccaccgcgacccccgccccgccgcccaaactaaataataacgcctaacccgctaaaatctacaaccccacgtaaaccgaaaaataaaaaaaaaaattaaaaacgaaaacgttaaaacaacgccgctactacaaatacaccttctccaaaacgaaataaataaacgaatacaacaaacaacgataaaacgaaaaaaaacctaacatccgcaaatccgaactacgaacgaaacgccgaaccgaaaacaccaacacgtccaaaataatcccgtacatcccgtaaaaataaaaacgcatccaaacgaacaacgtaacgctctcaaccgacgcttcaacaataaacaacgactccgaacaaccgactaccgcctcgcttcctaacccgccaaaaacccccgaacgccgcgccgcgccgcccctccgtacgaaaccctcgctatccacgtcgctccccgccataaactcgaaaactatccgaacgcccgaaactacaccgccgccgctaccgaatacgcgaaactacaaaaccgaacgaccgaaccccgcgccgcctcctaaccgctaccgacccccgaaaaacgcgcaaaaaactccgtcccgaccgcgatcccgcgacaacgaaaactaatacactcaaaaaactcgcgaaccgcccgactaacgaaatccccccgccgtaaccccgctacgccctcccttccaatcccgaacgaaataccgcccgcccgcgcccgctctaactctcaccctacgcgacctaacgaacaccgcgaccc

SEQ ID NO: 1675 - DNA, 1085 bp, Artificial Sequence
  chemically treated genomic DNA (Homo sapiens) CpG-island No: 1675
gattttatttagaaagtcgtgtatttcgaagaaaagaaagcggggtaggtcgggtagtttttggttgggggttttttcggcgtttttggggttacggggtcgtcgtcgtcgggtttcggtcgtagtagggattcgggcgtcgggagggacggggagcgcgttttttcgttgttgttgttgttgttgttgttgttgttgttgttgtcgtcgtttttgtcgttcgtatcgtaagcgtaggaagcgttttaggaatatttggtagtggtagagcgttagtacgtattgtagcgttaggtttagcgtttttggcgttatcgcgattttcgtttcgtcgtttaggttgagtagtagcgtttggttcgttagggtttgtagttttacgtgggtcgaggggtagaggaggaaattgaagacgaaggcgttgggatagcgtcgttgttgtaggtatattttttttagggcgaaatgggtgagcgagtgtagtaggtagcggtagggcgaggagaagtttagtattcgtaggttcgggttgcgggcgaagcgtcgggtcgaggatattagtacgtttagggtgatttcgtgtatttcgtagaagtagaggcgtatttaggcgggtagcgtggcgtttttagtcggcgttttagtagtggatagcggtttcgggtagtcggttgtcgtttcgttttttggttcgttaggggttttcggacgtcgcgtcgcgtcgttttttcgtgcggggttttcgttgtttacgtcgtttttcgttatgggttcggaggttgttcgaacgttcgaggttgtatcgtcgtcgttgtcgggtgcgcggagttgtagggtcgagcggtcgagtttcgcgtcgttttttggtcgttgtcggttttcggggggcgcgtagggagtttcgtttcggtcgcggtttcgcggtagcgggggttgatgtatttaggggattcgcgggtcgttcggttagcggaattttttcgtcgtggtttcgttgcgtttttttttttagtttcgggcgaggtgtcgttcgttcgcgttcgttttagtttttattttgcgcggtttaacgggtatcgcggttt

SEQ ID NO: 1676 - DNA, 1085 bp, Artificial Sequence
  chemically treated genomic DNA (Homo sapiens) CpG-island No: 1676
aaaccgcgatacccgttaaaccgcgcaaaataaaaactaaaacgaacgcgaacgaacgacacctcgcccgaaactaaaaaaaaaaacgcaacgaaaccacgacgaaaaaattccgctaaccgaacgacccgcgaatcccctaaatacatcaacccccgctaccgcgaaaccgcgaccgaaacgaaactccctacgcgccccccgaaaaccgacaacgaccaaaaaacgacgcgaaactcgaccgctcgaccctacaactccgcgcacccgacaacgacgacgatacaacctcgaacgttcgaacaacctccgaacccataacgaaaaacgacgtaaacaacgaaaaccccgcacgaaaaaacgacgcgacgcgacgtccgaaaacccctaacgaaccaaaaaacgaaacgacaaccgactacccgaaaccgctatccactactaaaacgccgactaaaaacgccacgctacccgcctaaatacgcctctacttctacgaaatacacgaaatcaccctaaacgtactaatatcctcgacccgacgcttcgcccgcaacccgaacctacgaatactaaacttctcctcgccctaccgctacctactacactcgctcacccatttcgccctaaaaaaaatatacctacaacaacgacgctatcccaacgccttcgtcttcaatttcctcctctacccctcgacccacgtaaaactacaaaccctaacgaaccaaacgctactactcaacctaaacgacgaaacgaaaatcgcgataacgccaaaaacgctaaacctaacgctacaatacgtactaacgctctaccactaccaaatattcctaaaacgcttcctacgcttacgatacgaacgacaaaaacgacgacaacaacaacaacaacaacaacaacaacaacaacaacgaaaaaacgcgctccccgtccctcccgacgcccgaatccctactacgaccgaaacccgacgacgacgaccccgtaaccccaaaaacgccgaaaaaacccccaaccaaaaactacccgacctaccccgctttcttttcttcgaaatacacgactttctaaataaaatc

SEQ ID NO: 1677 - DNA, 742 bp, Artificial Sequence
  chemically treated genomic DNA (Homo sapiens) CpG-island No: 1677
gcgtattttttagcgcggggcgcgggcggtggcgcgtattcggtttcgaagcgttgcgtttttttggttgttggattcgggtcgggcggtcgcgttgggttgtacggtttttcgcggcgtatttaggttttgcgttgcgttcggggtttttcggatcgtcgcggttcgttcgttcgttttggtttcgcggtcgtcggcgggacggggcgtttagagtcgcgcggggagcgtcggtaattggtcgttcgtgggcgatatttgtatagcgtagtttcgtttcgttcggttcgtttagttttattttcggggcgggattcgtttagttatcgtttcgttttcgttttatttgttcgtgggtcgggtttagggtttttaggcggtgggtatttcgcgtcgggggagattagtttgtatttttcgttttcgttttcgtttcgcgggcggcgttttcgtttcgttttggttttgtttttttgtgaatatatcgtatatatcgcgtttggtgtttattcgggtatttaattttttggcgagaagggttgtagcgttagggagtaacgagtttgcgtttatttgagtattttttttcgcgttttttatttttattcgtcgtcggtcgtgtttttggtttcgtgcgtgggtttcgcggcgtaggatttttgattgttcgggttgtttagtaggtggcggtgtagtttttgggacggttggtatcgtcggattttttcgcgggtttagtttt

SEQ ID NO: 1678 - DNA, 742 bp, Artificial Sequence
  chemically treated genomic DNA (Homo sapiens) CpG-island No: 1678
aaaactaaacccgcgaaaaaatccgacgataccaaccgtcccaaaaactacaccgccacctactaaacaacccgaacaatcaaaaatcctacgccgcgaaacccacgcacgaaaccaaaaacacgaccgacgacgaataaaaataaaaaacgcgaaaaaaaatactcaaataaacgcaaactcgttactccctaacgctacaacccttctcgccaaaaaattaaatacccgaataaacaccaaacgcgatatatacgatatattcacaaaaaaacaaaaccaaaacgaaacgaaaacgccgcccgcgaaacgaaaacgaaaacgaaaaatacaaactaatctcccccgacgcgaaatacccaccgcctaaaaaccctaaacccgacccacgaacaaataaaacgaaaacgaaacgataactaaacgaatcccgccccgaaaataaaactaaacgaaccgaacgaaacgaaactacgctatacaaatatcgcccacgaacgaccaattaccgacgctccccgcgcgactctaaacgccccgtcccgccgacgaccgcgaaaccaaaacgaacgaacgaaccgcgacgatccgaaaaaccccgaacgcaacgcaaaacctaaatacgccgcgaaaaaccgtacaacccaacgcgaccgcccgacccgaatccaacaaccaaaaaaacgcaacgcttcgaaaccgaatacgcgccaccgcccgcgccccgcgctaaaaaatacgc

SEQ ID NO: 1679 - DNA, 742 bp, Artificial Sequence
  chemically treated genomic DNA (Homo sapiens) CpG-island No: 1679
gaggttgagttcgcgggaaggttcggcggtgttagtcgttttaggggttgtatcgttatttgttgagtagttcgggtagttaggggttttgcgtcgcggggtttacgtacgggattaggggtacggtcggcggcgagtgggaatgagggacgcggaagggggtgtttaggtgagcgtaggttcgttgttttttggcgttgtagtttttttcgttagggagttgaatgttcgggtaaatattaggcgcgatgtgtgcggtgtatttatagagagataaagttagggcggggcgggggcgtcgttcgcgaagcgggggcgggggcgaggggtgtagattagtttttttcggcgcggggtgtttatcgtttgggaattttgagttcggtttacggataggtggagcgggggcggggcggtggttgggcgggtttcgtttcgggggtggggttgggcgggtcgggcggggcggggttgcgttatgtaaatgtcgtttacgggcggttaattgtcggcgtttttcgcgcggttttgagcgtttcgtttcgtcggcggtcgcgagattagagcgagcgaacgaatcgcggcggttcggagagtttcgagcgtagcgtaggatttgggtacgtcgcgaggaatcgtgtagtttagcgcggtcgttcggttcgggtttagtagttaggagagcgtagcgtttcgaagtcgagtgcgcgttatcgttcgcgtttcgcgttggggaatgcgt

SEQ ID NO: 1680 - DNA, 742 bp, Artificial Sequence
  chemically treated genomic DNA (Homo sapiens) CpG-island No: 1680
acgcattccccaacgcgaaacgcgaacgataacgcgcactcgacttcgaaacgctacgctctcctaactactaaacccgaaccgaacgaccgcgctaaactacacgattcctcgcgacgtacccaaatcctacgctacgctcgaaactctccgaaccgccgcgattcgttcgctcgctctaatctcgcgaccgccgacgaaacgaaacgctcaaaaccgcgcgaaaaacgccgacaattaaccgcccgtaaacgacatttacataacgcaaccccgccccgcccgacccgcccaaccccacccccgaaacgaaacccgcccaaccaccgccccgcccccgctccacctatccgtaaaccgaactcaaaattcccaaacgataaacaccccgcgccgaaaaaaactaatctacacccctcgcccccgcccccgcttcgcgaacgacgcccccgccccgccctaactttatctctctataaatacaccgcacacatcgcgcctaatatttacccgaacattcaactccctaacgaaaaaaactacaacgccaaaaaacaacgaacctacgctcacctaaacacccccttccgcgtccctcattcccactcgccgccgaccgtacccctaatcccgtacgtaaaccccgcgacgcaaaacccctaactacccgaactactcaacaaataacgatacaacccctaaaacgactaacaccgccgaaccttcccgcgaactcaacctc

SEQ ID NO: 1681 - DNA, 535 bp, Artificial Sequence
  chemically treated genomic DNA (Homo sapiens) CpG-island No: 1681
gtttttcgcgaaattcgtgcgttttagtttagggttttcgggatcggtgttcgttagtgggtataggacgtcgggtgttcgaagggttgtttggagatgtaattgattttggcgggtattagaatgacgagtggtagtagtaggagcggggtgacgaataagattacgaaggatttgaatttggagatatagtttagcgtcgaggttatcgcgcgggagggagattggcgggcgagacgagtgaggggtagttagaggcgtcgcgggtttaagaaggggttatagttttcggggattggggagggggcggtgataatttcgtttcgtacgggggcgttttttcgcggttttggggcggggttatttttcggggtttgtgggacgcgtttgtttttaattttgttattcggcggcggtgggaggcgtttttggattttaacgtttcgggttagttttttaggggtagtttgggttttagtatttcgcgttgtttaagttttttttgcgttgtcgaggtagaggtgcgtttcggggt

SEQ ID NO: 1682 - DNA, 535 bp, Artificial Sequence
  chemically treated genomic DNA (Homo sapiens) CpG-island No: 1682
accccgaaacgcacctctacctcgacaacgcaaaaaaaacttaaacaacgcgaaatactaaaacccaaactacccctaaaaaactaacccgaaacgttaaaatccaaaaacgcctcccaccgccgccgaataacaaaattaaaaacaaacgcgtcccacaaaccccgaaaaataaccccgccccaaaaccgcgaaaaaacgcccccgtacgaaacgaaattatcaccgccccctccccaatccccgaaaactataaccccttcttaaacccgcgacgcctctaactacccctcactcgtctcgcccgccaatctccctcccgcgcgataacctcgacgctaaactatatctccaaattcaaatccttcgtaatcttattcgtcaccccgctcctactactaccactcgtcattctaatacccgccaaaatcaattacatctccaaacaacccttcgaacacccgacgtcctatacccactaacgaacaccgatcccgaaaaccctaaactaaaacgcacgaatttcgcgaaaaac

SEQ ID NO: 1683 - DNA, 535 bp, Artificial Sequence
  chemically treated genomic DNA (Homo sapiens) CpG-island No: 1683
gtttcgggacgtatttttgtttcggtagcgtaggagaggtttggatagcgcgagatgttagggtttaggttgtttttagagggttggttcgaagcgttggagtttaaagacgttttttatcgtcgtcgggtggtagaattgggggtaggcgcgttttatagatttcgaggggtggtttcgttttagggtcgcggggaggcgttttcgtgcggggcggagttgttatcgttttttttttaattttcggggattgtggtttttttttaagttcgcggcgtttttagttgttttttattcgtttcgttcgttagtttttttttcgcgcgatggtttcggcgttgagttatgtttttaagtttaagtttttcgtgattttgttcgttatttcgtttttgttgttgttattcgttattttgatgttcgttaaggttagttgtatttttaggtagtttttcggatattcggcgttttgtgtttattaacgggtatcgatttcgggagttttgagttggagcgtacggatttcgcggggagt

SEQ ID NO: 1684 - DNA, 535 bp, Artificial Sequence
  chemically treated genomic DNA (Homo sapiens) CpG-island No: 1684
actccccgcgaaatccgtacgctccaactcaaaactcccgaaatcgatacccgttaataaacacaaaacgccgaatatccgaaaaactacctaaaaatacaactaaccttaacgaacatcaaaataacgaataacaacaacaaaaacgaaataacgaacaaaatcacgaaaaacttaaacttaaaaacataactcaacgccgaaaccatcgcgcgaaaaaaaaactaacgaacgaaacgaataaaaaacaactaaaaacgccgcgaacttaaaaaaaaaccacaatccccgaaaattaaaaaaaaaacgataacaactccgccccgcacgaaaacgcctccccgcgaccctaaaacgaaaccacccctcgaaatctataaaacgcgcctacccccaattctaccacccgacgacgataaaaaacgtctttaaactccaacgcttcgaaccaaccctctaaaaacaacctaaaccctaacatctcgcgctatccaaacctctcctacgctaccgaaacaaaaatacgtcccgaaac

SEQ ID NO: 1685 - DNA, 610 bp, Artificial Sequence
  chemically treated genomic DNA (Homo sapiens) CpG-island No: 1685
ttcgcgggttacgggtgaacgtgaatcgagttcgtagtttttaattttattttttcggcggcggcgacgtgtagtgtattattttgggtattagggggcgtgttcgtatacgttcgggtcgttttggtttagtttattttagtggtcgcggaaggtgacgtggatacggaagtggtcgtcgtcgcggtatcggtgggagttaggcgcgaggttcggagtgcggttagcgggcggaggcggtttcgtatcggcggcgacggagggtttaggcgtcgtcgtttgggtggggggtcgttgaattgataagcgatattttagttttttttattcgtcggaatttcggagtcggggttcgtttagtcggcgttattatgattaaggtcggtagtaagggcgggaattttcgcgataagttggacggtaacgaattggatttgagttttagcgatttgaatgaggtttcggtgaaggagttggttagtatcgtttcgcgaggtttaggcgtttattttcgtcgggcgttggtttttacgtgggttatttattttttttttttttaaaagtattagtttttttttttttaaaaagaagcggggtggtgggattaagt

SEQ ID NO: 1686 - DNA, 610 bp, Artificial Sequence
  chemically treated genomic DNA (Homo sapiens) CpG-island No: 1686
acttaatcccaccaccccgcttctttttaaaaaaaaaaaaactaatacttttaaaaaaaaaaaaaataaataacccacgtaaaaaccaacgcccgacgaaaataaacgcctaaacctcgcgaaacgatactaaccaactccttcaccgaaacctcattcaaatcgctaaaactcaaatccaattcgttaccgtccaacttatcgcgaaaattcccgcccttactaccgaccttaatcataataacgccgactaaacgaaccccgactccgaaattccgacgaataaaaaaaactaaaatatcgcttatcaattcaacgaccccccacccaaacgacgacgcctaaaccctccgtcgccgccgatacgaaaccgcctccgcccgctaaccgcactccgaacctcgcgcctaactcccaccgataccgcgacgacgaccacttccgtatccacgtcaccttccgcgaccactaaaataaactaaaccaaaacgacccgaacgtatacgaacacgccccctaatacccaaaataatacactacacgtcgccgccgccgaaaaaataaaattaaaaactacgaactcgattcacgttcacccgtaacccgcgaa

SEQ ID NO: 1687 - DNA, 610 bp, Artificial Sequence
  chemically treated genomic DNA (Homo sapiens) CpG-island No: 1687
atttagttttattatttcgtttttttttaaagaaaaggaaattgatgtttttagagaagaggaaagtaagtggtttacgtaggggttagcgttcggcgaaggtgggcgtttgggtttcgcgggacgatattgattagtttttttatcgggattttatttaggtcgttgaggtttaggtttagttcgttgtcgtttagtttgtcgcggaggttttcgtttttgttatcggttttggttatggtaacgtcggttgagcgggtttcggtttcggggtttcggcgggtgaaaggagttgaaatgtcgtttgttagtttagcggttttttatttaaacgacgacgtttgagtttttcgtcgtcgtcgatgcgagatcgttttcgttcgttggtcgtatttcgagtttcgcgtttagtttttatcggtgtcgcgacgacgattattttcgtgtttacgttatttttcgcgattattgagatgggttgggttagagcggttcgagcgtgtgcgggtacgttttttggtgtttagggtgatgtattgtacgtcgtcgtcgtcggaggggtggggttggaggttgcgagttcggtttacgtttattcgtggttcgcggg

SEQ ID NO: 1688 - DNA, 610 bp, Artificial Sequence
  chemically treated genomic DNA (Homo sapiens) CpG-island No: 1688
cccgcgaaccacgaataaacgtaaaccgaactcgcaacctccaaccccacccctccgacgacgacgacgtacaatacatcaccctaaacaccaaaaaacgtacccgcacacgctcgaaccgctctaacccaacccatctcaataatcgcgaaaaataacgtaaacacgaaaataatcgtcgtcgcgacaccgataaaaactaaacgcgaaactcgaaatacgaccaacgaacgaaaacgatctcgcatcgacgacgacgaaaaactcaaacgtcgtcgtttaaataaaaaaccgctaaactaacaaacgacatttcaactcctttcacccgccgaaaccccgaaaccgaaacccgctcaaccgacgttaccataaccaaaaccgataacaaaaacgaaaacctccgcgacaaactaaacgacaacgaactaaacctaaacctcaacgacctaaataaaatcccgataaaaaaactaatcaatatcgtcccgcgaaacccaaacgcccaccttcgccgaacgctaacccctacgtaaaccacttactttcctcttctctaaaaacatcaatttccttttctttaaaaaaaaacgaaataataaaactaaat

SEQ ID NO: 1689 - DNA, 833 bp, Artificial Sequence
  chemically treated genomic DNA (Homo sapiens) CpG-island No: 1689
tatatattttttttcgattttgaattttttaggcgttagtttttcggtttatttttgttcgcggggaggtataggacgttgttttttcgtttcgtttttttgatgggtaaattgttatttattcgcgcgtagcgggacgagtacgggttttcgaagagcgtttagatgcgcggttgttagcggcgttaaaagtcgttaggtcggttattcggggagttattgagcgttaggcgtttggttatttttagttcgttttcgtcgtcgttcgagtcgttagggtcgtcggcgttcgcgtcgtcggcgttgttgtttagaggagcgtcgtcgaagttgtttagagttttttcggcgtcgcggtgttggcggtacgttatttagtagtagggttttacgtcggtttcgtcgatgttttagaaggttagttttttttcgtagagcggttcgtatacgtcggttgggtagtgtagtttgttcgtgcggtagtagtttaggatgtgcgcgaagacgtcggggtggcggtcgaagaagaattcgttagtacgcgggttatagtcgaagtggttgtgggcgtcgggtttcgttagttaggcgagtcgcgtgtcgggtagcgtgcgtagggtcgagcggtacgtttggtggcgcgtgtcgtttacgttgattacgatgcgttcgttttcgtttttttggtttatcgcggcgtttttttaggtatggcgcggtttagcgatatttatgggagcggtcgttagggggagttggcgtcggggaggggggcgcgcgttttttttttttttttttttagtcgtcggggggaatagaggtttgcggttttg

SEQ ID NO: 1690 - DNA, 833 bp, Artificial Sequence
  chemically treated genomic DNA (Homo sapiens) CpG-island No: 1690
caaaaccgcaaacctctattccccccgacgactaaaaaaaaaaaaaaaaaaaacgcgcgcccccctccccgacgccaactccccctaacgaccgctcccataaatatcgctaaaccgcgccatacctaaaaaaacgccgcgataaaccaaaaaaacgaaaacgaacgcatcgtaatcaacgtaaacgacacgcgccaccaaacgtaccgctcgaccctacgcacgctacccgacacgcgactcgcctaactaacgaaacccgacgcccacaaccacttcgactataacccgcgtactaacgaattcttcttcgaccgccaccccgacgtcttcgcgcacatcctaaactactaccgcacgaacaaactacactacccaaccgacgtatacgaaccgctctacgaaaaaaaactaaccttctaaaacatcgacgaaaccgacgtaaaaccctactactaaataacgtaccgccaacaccgcgacgccgaaaaaactctaaacaacttcgacgacgctcctctaaacaacaacgccgacgacgcgaacgccgacgaccctaacgactcgaacgacgacgaaaacgaactaaaaataaccaaacgcctaacgctcaataactccccgaataaccgacctaacgacttttaacgccgctaacaaccgcgcatctaaacgctcttcgaaaacccgtactcgtcccgctacgcgcgaataaataacaatttacccatcaaaaaaacgaaacgaaaaaacaacgtcctatacctccccgcgaacaaaaataaaccgaaaaactaacgcctaaaaaattcaaaatcgaaaaaaaatatata

SEQ ID NO: 1691 - DNA, 833 bp, Artificial Sequence
  chemically treated genomic DNA (Homo sapiens) CpG-island No: 1691
tagagtcgtaggtttttgtttttttcgacggttggggggaggggggaagagggcgcgcgttttttttttcggcgttaattttttttggcggtcgtttttatgggtgtcgttgggtcgcgttatgtttaagggggcgtcgcgatgggttaaggggacgagagcgagcgtatcgtgattaacgtgggcggtacgcgttattagacgtatcgttcgattttgcgtacgttgttcggtacgcggttcgtttggttggcggagttcgacgtttatagttatttcgattatgattcgcgtgttgacgagttttttttcgatcgttatttcggcgttttcgcgtatattttgaattattatcgtacgggtaagttgtattgtttagtcgacgtgtgcgggtcgttttacgaggaggagttggttttttggggtatcgacgagatcgacgtggagttttgttgttggatgacgtatcgttagtatcgcgacgtcgaggaggttttggatagtttcggcggcgtttttttggataatagcgtcgacgacgcggacgtcgacggttttggcgattcgggcgacggcgaggacgagttggagatgattaagcgtttggcgtttagtgatttttcggatggtcggtttggcggtttttggcgtcgttggtagtcgcgtatttgggcgtttttcgaggattcgtattcgtttcgttacgcgcgggtaagtgataatttatttattagaagagcggggcgggaaggtagcgttttgtgttttttcgcgggtaggggtggatcggagaattggcgtttagggagtttagaatcgaaagggggtgtgtg

SEQ ID NO: 1692 - DNA, 833 bp, Artificial Sequence
  chemically treated genomic DNA (Homo sapiens) CpG-island No: 1692
cacacaccccctttcgattctaaactccctaaacgccaattctccgatccacccctacccgcgaaaaaacacaaaacgctaccttcccgccccgctcttctaataaataaattatcacttacccgcgcgtaacgaaacgaatacgaatcctcgaaaaacgcccaaatacgcgactaccaacgacgccaaaaaccgccaaaccgaccatccgaaaaatcactaaacgccaaacgcttaatcatctccaactcgtcctcgccgtcgcccgaatcgccaaaaccgtcgacgtccgcgtcgtcgacgctattatccaaaaaaacgccgccgaaactatccaaaacctcctcgacgtcgcgatactaacgatacgtcatccaacaacaaaactccacgtcgatctcgtcgataccccaaaaaaccaactcctcctcgtaaaacgacccgcacacgtcgactaaacaatacaacttacccgtacgataataattcaaaatatacgcgaaaacgccgaaataacgatcgaaaaaaaactcgtcaacacgcgaatcataatcgaaataactataaacgtcgaactccgccaaccaaacgaaccgcgtaccgaacaacgtacgcaaaatcgaacgatacgtctaataacgcgtaccgcccacgttaatcacgatacgctcgctctcgtccccttaacccatcgcgacgcccccttaaacataacgcgacccaacgacacccataaaaacgaccgccaaaaaaaattaacgccgaaaaaaaaaacgcgcgccctcttcccccctccccccaaccgtcgaaaaaaacaaaaacctacgactcta

SEQ ID NO: 1693 - DNA, 768 bp, Artificial Sequence
  chemically treated genomic DNA (Homo sapiens) CpG-island No: 1693
tattcggggtgttgttcgtgcggttaacgtcgagcgttgtttttcgtgagttcgggttcgagttggggtttcgttgggttgcgttcggatttgggttttcgcggcggtgttgaagggatagttttcggcggtcgcggagttgtacggggttaggcgggggtttttttggttgggtttgatttgcggggtcggcgggtattggtttcggtgtttttgcgtttcgtatttcgtttttcgtttcgggtaggcggtgggcgttgtcggtcgagacgggggttgcggaggtcgggcggggaggcgggggtggcgggttcgggcgcggcgaggtgaggttagcgaggtcggtgaggcgaggcgcggagcggtcgttgtcgtcgtcgtcgcgacgttgttgtcgttcgggttgttgtttcgtttgttgttcgttcgtcgtttgttcgttcgcgcggttcgcgtttagttcgtcgtttttcggatacgggtatacggcgcgcgtagtcgtattcgttttcggaggaaggcgtcgcgttgggttttaaaaagttttgatttcgcgttttttttttagtttcgtatcgagttcggttttttttaatttcggcgttgggggcgttcgtttcgcgcggtttttgttgttttcgggggattcgtttacggttcgttttcggggaacgttattttaggggcgggggtttcgagagacgtttgggttcgcgttttcgggttagattgaggtgagaagggcgttggtattttttttttgttttt

SEQ ID NO: 1694 - DNA, 768 bp, Artificial Sequence
  chemically treated genomic DNA (Homo sapiens) CpG-island No: 1694
aaaaacaaaaaaaaaataccaacgcccttctcacctcaatctaacccgaaaacgcgaacccaaacgtctctcgaaacccccgcccctaaaataacgttccccgaaaacgaaccgtaaacgaatcccccgaaaacaacaaaaaccgcgcgaaacgaacgcccccaacgccgaaattaaaaaaaaccgaactcgatacgaaactaaaaaaaaaacgcgaaatcaaaactttttaaaacccaacgcgacgccttcctccgaaaacgaatacgactacgcgcgccgtatacccgtatccgaaaaacgacgaactaaacgcgaaccgcgcgaacgaacaaacgacgaacgaacaacaaacgaaacaacaacccgaacgacaacaacgtcgcgacgacgacgacaacgaccgctccgcgcctcgcctcaccgacctcgctaacctcacctcgccgcgcccgaacccgccacccccgcctccccgcccgacctccgcaacccccgtctcgaccgacaacgcccaccgcctacccgaaacgaaaaacgaaatacgaaacgcaaaaacaccgaaaccaatacccgccgaccccgcaaatcaaacccaaccaaaaaaacccccgcctaaccccgtacaactccgcgaccgccgaaaactatcccttcaacaccgccgcgaaaacccaaatccgaacgcaacccaacgaaaccccaactcgaacccgaactcacgaaaaacaacgctcgacgttaaccgcacgaacaacaccccgaata

SEQ ID NO: 1695 - DNA, 768 bp, Artificial Sequence
  chemically treated genomic DNA (Homo sapiens) CpG-island No: 1695
gaaggtaaggggagggtgttaacgttttttttattttagtttgattcgggggcgcgggtttagacgtttttcggagttttcgtttttggagtggcgtttttcgagggcggatcgtgggcgggtttttcgggagtagtaggagtcgcgcggggcgggcgtttttagcgtcgaggttgagggaggtcgggttcggtgcggggttgggaggggggcgcggaattagggttttttaggatttagcgcggcgttttttttcgggggcgagtgcggttgcgcgcgtcgtgtgttcgtgttcggagagcggcgggttggacgcggatcgcgcgaacgagtaggcgacgggcgagtagtaagcggagtagtagttcgggcggtagtagcgtcgcggcggcggcggtagcggtcgtttcgcgtttcgttttatcggtttcgttggttttatttcgtcgcgttcggattcgttattttcgttttttcgttcgattttcgtagttttcgtttcggtcggtagcgtttatcgtttgttcgaagcgaggagcggagtgcggggcgtagaggtatcggagttagtgttcgtcggtttcgtaaattaaatttagttaggagaattttcgtttggtttcgtgtagtttcgcgatcgtcgggagttgtttttttagtatcgtcgcgggagtttaagttcgagcgtagtttagcggaattttagttcgagttcgggtttacggagagtagcgttcggcgttagtcgtacgagtaatatttcgggtg

SEQ ID NO: 1696 - DNA, 768 bp, Artificial Sequence
  chemically treated genomic DNA (Homo sapiens) CpG-island No: 1696
cacccgaaatattactcgtacgactaacgccgaacgctactctccgtaaacccgaactcgaactaaaattccgctaaactacgctcgaacttaaactcccgcgacgatactaaaaaaacaactcccgacgatcgcgaaactacacgaaaccaaacgaaaattctcctaactaaatttaatttacgaaaccgacgaacactaactccgatacctctacgccccgcactccgctcctcgcttcgaacaaacgataaacgctaccgaccgaaacgaaaactacgaaaatcgaacgaaaaaacgaaaataacgaatccgaacgcgacgaaataaaaccaacgaaaccgataaaacgaaacgcgaaacgaccgctaccgccgccgccgcgacgctactaccgcccgaactactactccgcttactactcgcccgtcgcctactcgttcgcgcgatccgcgtccaacccgccgctctccgaacacgaacacacgacgcgcgcaaccgcactcgcccccgaaaaaaaacgccgcgctaaatcctaaaaaaccctaattccgcgcccccctcccaaccccgcaccgaacccgacctccctcaacctcgacgctaaaaacgcccgccccgcgcgactcctactactcccgaaaaacccgcccacgatccgccctcgaaaaacgccactccaaaaacgaaaactccgaaaaacgtctaaacccgcgcccccgaatcaaactaaaataaaaaaaacgttaacaccctccccttaccttc

SEQ ID NO: 1697 - DNA, 804 bp, Artificial Sequence
  chemically treated genomic DNA (Homo sapiens) CpG-island No: 1697
tatttcgagcgtcgttttaatttttttattttttggggtttcggttttattatgtcgtcggagtagttggagcgcgggttggacgcgtcggagtcgtcgttgtagtgttcgtcgtcgcggttcgggggtagcgggttcggcgtatagaaggcggttgcggcgttagggggcgcggcgttttggtcgcgtagtagagtttgtaggttttcgatatagcggatggcgttgcgtaggatttttattttgggtaatcgttggtttggattgttcgacgtgtagcgtttgagtgttttaaaggttttatttattttgtttaggcggcgtcgttcgcgtatggtggcggttttgcggcggtcggcgttggtggttttgcgtttgtacgttttgtaggtttatagtaggtagcggttcgtttggtggtgttcgttgggcgcgcgtatatgttcgtttttacgtgcgttcggggtcgggtgtatcgtcgcggggaagtgcgagtgtttttcgggttttaggagcgcgtttacgtgtattaggcgcgggtttaggttttcgaagaagcgtaggttcggggagtcgaaatacgggtcgttatagaagtcgttcgttgtggtaaaggagtagagagagtcgtcgggggtcgttaggtttacgtcgcggagcggtggcgatagtagttttatattttggcggtggcgcggtacggttttggtttcgtttaatttaagcggtagagagtggtcggaattttttgtcgttcgggagtttcggttgtagatagtaaagtgttggtagtttgaatgttta

SEQ ID NO: 1698 - DNA, 804 bp, Artificial Sequence
  chemically treated genomic DNA (Homo sapiens) CpG-island No: 1698
taaacattcaaactaccaacactttactatctacaaccgaaactcccgaacgacaaaaaattccgaccactctctaccgcttaaattaaacgaaaccaaaaccgtaccgcgccaccgccaaaatataaaactactatcgccaccgctccgcgacgtaaacctaacgacccccgacgactctctctactcctttaccacaacgaacgacttctataacgacccgtatttcgactccccgaacctacgcttcttcgaaaacctaaacccgcgcctaatacacgtaaacgcgctcctaaaacccgaaaaacactcgcacttccccgcgacgatacacccgaccccgaacgcacgtaaaaacgaacatatacgcgcgcccaacgaacaccaccaaacgaaccgctacctactataaacctacaaaacgtacaaacgcaaaaccaccaacgccgaccgccgcaaaaccgccaccatacgcgaacgacgccgcctaaacaaaataaataaaacctttaaaacactcaaacgctacacgtcgaacaatccaaaccaacgattacccaaaataaaaatcctacgcaacgccatccgctatatcgaaaacctacaaactctactacgcgaccaaaacgccgcgccccctaacgccgcaaccgccttctatacgccgaacccgctacccccgaaccgcgacgacgaacactacaacgacgactccgacgcgtccaacccgcgctccaactactccgacgacataataaaaccgaaaccccaaaaaataaaaaaattaaaacgacgctcgaaata

SEQ ID NO: 1699 - DNA, 804 bp, Artificial Sequence
  chemically treated genomic DNA (Homo sapiens) CpG-island No: 1699
tgggtatttagattgttagtattttgttatttatagtcggggttttcgagcggtagaaagtttcggttattttttgtcgtttgggttgggcgaagttaggatcgtgtcgcgttatcgttaggatatggagttattgtcgttatcgtttcgcgacgtagatttgacggttttcgacggttttttttgtttttttgttataacggacgatttttatgacgattcgtgtttcgatttttcggatttgcgttttttcgaagatttggattcgcgtttgatgtacgtgggcgcgtttttgaaattcgaagagtattcgtattttttcgcggcggtgtattcggtttcgggcgtacgtgaggacgagtatgtgcgcgcgtttagcgggtattattaggcgggtcgttgtttattgtgggtttgtaaggcgtgtaagcgtaagattattaacgtcgatcgtcgtaaggtcgttattatgcgcgagcggcgtcgtttgagtaaagtaaatgaggtttttgagatatttaagcgttgtacgtcgagtaatttaaattagcggttgtttaaggtggagattttgcgtaacgttattcgttatatcgagggtttgtaggttttgttgcgcgattaggacgtcgcgttttttggcgtcgtagtcgttttttatgcgtcgggttcgttgttttcgggtcgcggcggcgagtattatagcggcgatttcgacgcgtttagttcgcgttttaattgtttcgacggtatggtaaggtcgggattttaggaagtgaggaagttagggcggcgttcgggata

SEQ ID NO: 1700 - DNA, 804 bp, Artificial Sequence
  chemically treated genomic DNA (Homo sapiens) CpG-island No: 1700
tatcccgaacgccgccctaacttcctcacttcctaaaatcccgaccttaccataccgtcgaaacaattaaaacgcgaactaaacgcgtcgaaatcgccgctataatactcgccgccgcgacccgaaaacaacgaacccgacgcataaaaaacgactacgacgccaaaaaacgcgacgtcctaatcgcgcaacaaaacctacaaaccctcgatataacgaataacgttacgcaaaatctccaccttaaacaaccgctaatttaaattactcgacgtacaacgcttaaatatctcaaaaacctcatttactttactcaaacgacgccgctcgcgcataataacgaccttacgacgatcgacgttaataatcttacgcttacacgccttacaaacccacaataaacaacgacccgcctaataatacccgctaaacgcgcgcacatactcgtcctcacgtacgcccgaaaccgaatacaccgccgcgaaaaaatacgaatactcttcgaatttcaaaaacgcgcccacgtacatcaaacgcgaatccaaatcttcgaaaaaacgcaaatccgaaaaatcgaaacacgaatcgtcataaaaatcgtccgttataacaaaaaaacaaaaaaaaccgtcgaaaaccgtcaaatctacgtcgcgaaacgataacgacaataactccatatcctaacgataacgcgacacgatcctaacttcgcccaacccaaacgacaaaaaataaccgaaactttctaccgctcgaaaaccccgactataaataacaaaatactaacaatctaaataccca

SEQ ID NO: 1701 - DNA, 831 bp, Artificial Sequence
  chemically treated genomic DNA (Homo sapiens) CpG-island No: 1701
tcggtggagggatagtgatggtggaggtggtggagtcggtggagggatagtgcgggtggaggtggtggagtcggtggagggatagtgcgggtggaggtggtggagtcggtggagggatagtgcgggtggaggtggtggagtcggtggagggatagtgatggtggaggtggtggagtcggtggagggatagtgatggtggaggtggtggagtcggtggagggatagtgatggtggaggtggtggagtcggtggagggatagtgatggtggaggtggtggagtcggtggagggatagtgatggtggaggtggtggagtcggtggagggatagtgatggtggaggtggtggagtcggtggagggatagtgatggtggaggtggtggagtcggtggatggatagtgcgggtggaggtggtggagtcggtggagggatagtgatggtggaggtggtggagtcggtggagggatagtgcgggtggaggtggtggagtcggtggagggatagtgcgggtggaggtggtggagtcggtggatggatagtgcgggtggaggtggtggagtcggtggagggatagtgatggtggaggtggtggagtcggtggagggatagtgatggtggaggtggtggagtcggtggaggaatagtgatggtggaggtggtggagtcggtggagggatagtgatggtggaggtggtggagtcggtggagggatagtgagggtggaggtggtggagtcggtggagggatagtgttggtggaggtggtggagtcggtggagggatagtgagggtggaggtggtggagttggtggagggatagtgatggtggag

SEQ ID NO: 1702 - DNA, 831 bp, Artificial Sequence
  chemically treated genomic DNA (Homo sapiens) CpG-island No: 1702
ctccaccatcactatccctccaccaactccaccacctccaccctcactatccctccaccgactccaccacctccaccaacactatccctccaccgactccaccacctccaccctcactatccctccaccgactccaccacctccaccatcactatccctccaccgactccaccacctccaccatcactattcctccaccgactccaccacctccaccatcactatccctccaccgactccaccacctccaccatcactatccctccaccgactccaccacctccacccgcactatccatccaccgactccaccacctccacccgcactatccctccaccgactccaccacctccacccgcactatccctccaccgactccaccacctccaccatcactatccctccaccgactccaccacctccacccgcactatccatccaccgactccaccacctccaccatcactatccctccaccgactccaccacctccaccatcactatccctccaccgactccaccacctccaccatcactatccctccaccgactccaccacctccaccatcactatccctccaccgactccaccacctccaccatcactatccctccaccgactccaccacctccaccatcactatccctccaccgactccaccacctccaccatcactatccctccaccgactccaccacctccacccgcactatccctccaccgactccaccacctccacccgcactatccctccaccgactccaccacctccacccgcactatccctccaccgactccaccacctccaccatcactatccctccaccga

SEQ ID NO: 1703 - DNA, 831 bp, Artificial Sequence
  chemically treated genomic DNA (Homo sapiens) CpG-island No: 1703
ttttattattattgtttttttattaattttattatttttatttttattgtttttttatcgattttattatttttattaatattgtttttttatcgattttattatttttatttttattgtttttttatcgattttattatttttattattattgtttttttatcgattttattatttttattattattgtttttttatcgattttattatttttattattattgtttttttatcgattttattatttttattattattgtttttttatcgattttattatttttattcgtattgtttatttatcgattttattatttttattcgtattgtttttttatcgattttattatttttattcgtattgtttttttatcgattttattatttttattattattgtttttttatcgattttattatttttattcgtattgtttatttatcgattttattatttttattattattgtttttttatcgattttattatttttattattattgtttttttatcgattttattatttttattattattgtttttttatcgattttattatttttattattattgtttttttatcgattttattatttttattattattgtttttttatcgattttattatttttattattattgtttttttatcgattttattatttttattattattgtttttttatcgattttattatttttattcgtattgtttttttatcgattttattatttttattcgtattgtttttttatcgattttattatttttattcgtattgtttttttatcgattttattatttttattattattgtttttttatcga

SEQ ID NO: 1704 - DNA, 831 bp, Artificial Sequence
  chemically treated genomic DNA (Homo sapiens) CpG-island No: 1704
tcgataaaaaaacaataataataaaaataataaaatcgataaaaaaacaatacgaataaaaataataaaatcgataaaaaaacaatacgaataaaaataataaaatcgataaaaaaacaatacgaataaaaataataaaatcgataaaaaaacaataataataaaaataataaaatcgataaaaaaacaataataataaaaataataaaatcgataaaaaaacaataataataaaaataataaaatcgataaaaaaacaataataataaaaataataaaatcgataaaaaaacaataataataaaaataataaaatcgataaaaaaacaataataataaaaataataaaatcgataaaaaaacaataataataaaaataataaaatcgataaataaacaatacgaataaaaataataaaatcgataaaaaaacaataataataaaaataataaaatcgataaaaaaacaatacgaataaaaataataaaatcgataaaaaaacaatacgaataaaaataataaaatcgataaataaacaatacgaataaaaataataaaatcgataaaaaaacaataataataaaaataataaaatcgataaaaaaacaataataataaaaataataaaatcgataaaaaaacaataataataaaaataataaaatcgataaaaaaacaataataataaaaataataaaatcgataaaaaaacaataaaaataaaaataataaaatcgataaaaaaacaatattaataaaaataataaaatcgataaaaaaacaataaaaataaaaataataaaattaataaaaaaacaataataataaaa

SEQ ID NO: 1705 - DNA, 952 bp, Artificial Sequence
  chemically treated genomic DNA (Homo sapiens) CpG-island No: 1705
tagagtcgcgggatttcggttcggaaatcgcgttatcggcgttcgtatacgttaggtcggggagtttagaggtttagtcggttatgtttcggcgatttttcggagcgagggatagggaaggagtcggtttttattagtgtttcgtatacgggattttgggtttggtttcgtacggagtttgttcgtttttaatatggcggtagcgtttgttttagggggcggggttacgtgggggcggcggttaatgggttttcgggttgcgttgtcggtagggagcgggaggcggaagtgtcgcgggttgtcgttttcgtttcggttgcggtttttgtcggttatataattcgttgcgggtttcgcgcggttttatttttcggtttttttcgtttttaggatgcgttgagttttataatatttttagcggtcgtcggtttttttacgaggtgaggtggcggggggcggtcgtcggggttcggatttgcggcggggcgtcgagggggcggggtaggcggggaggtcgcgtcggggttaggggggttagcgtttatcgggtacgagcgcgttggtgaggtaggttcggtcgcgttcgcgttttcggcgtacggttttttcgggagtcggtttcggggacggcggcggggagtgggcgttggttagggacgagggttgaggaggtcgcggtttttatgttgggtgggagtcgggttttttgtttgggggttgcgttagtgttcgatttcgcgatgagtggtcgggataatttgtaattagagggtggtttttatgggtattttgtggggtgtcgcgcgaggtgaagggttaggttattttcgtcgggttagcgattttcgttttcgtttcgttttcgtttggtttgattagggtttgttttggtatttgttgcgtcgattggagttatttgcgatttgtttgtttttttttgaatttttgaaag

SEQ ID NO: 1706 - DNA, 952 bp, Artificial Sequence
  chemically treated genomic DNA (Homo sapiens) CpG-island No: 1706
ctttcaaaaattcaaaaaaaaacaaacaaatcgcaaataactccaatcgacgcaacaaataccaaaacaaaccctaatcaaaccaaacgaaaacgaaacgaaaacgaaaatcgctaacccgacgaaaataacctaacccttcacctcgcgcgacaccccacaaaatacccataaaaaccaccctctaattacaaattatcccgaccactcatcgcgaaatcgaacactaacgcaacccccaaacaaaaaacccgactcccacccaacataaaaaccgcgacctcctcaaccctcgtccctaaccaacgcccactccccgccgccgtccccgaaaccgactcccgaaaaaaccgtacgccgaaaacgcgaacgcgaccgaacctacctcaccaacgcgctcgtacccgataaacgctaacccccctaaccccgacgcgacctccccgcctaccccgccccctcgacgccccgccgcaaatccgaaccccgacgaccgccccccgccacctcacctcgtaaaaaaaccgacgaccgctaaaaatattataaaactcaacgcatcctaaaaacgaaaaaaaccgaaaaataaaaccgcgcgaaacccgcaacgaattatataaccgacaaaaaccgcaaccgaaacgaaaacgacaacccgcgacacttccgcctcccgctccctaccgacaacgcaacccgaaaacccattaaccgccgcccccacgtaaccccgccccctaaaacaaacgctaccgccatattaaaaacgaacaaactccgtacgaaaccaaacccaaaatcccgtatacgaaacactaataaaaaccgactccttccctatccctcgctccgaaaaatcgccgaaacataaccgactaaacctctaaactccccgacctaacgtatacgaacgccgataacgcgatttccgaaccgaaatcccgcgactcta

SEQ ID NO: 1707 - DNA, 952 bp, Artificial Sequence
  chemically treated genomic DNA (Homo sapiens) CpG-island No: 1707
tttttaggagtttagaggagggtaaataagtcgtagatgattttaatcggcgtaataagtattaaaataggttttgattaggttaggcgagagcggggcgaaggcggaaatcgttgattcgacggaaatggtttggttttttatttcgcgcgatattttatagggtatttatgaggattattttttagttgtaaattgtttcgattatttatcgcggggtcggatattgacgtaatttttaggtagaaggttcgatttttatttagtatgagagtcgcgatttttttaattttcgtttttggttagcgtttatttttcgtcgtcgttttcgaaatcggttttcgggaggatcgtgcgtcgggggcgcgggcgcggtcgggtttgttttattagcgcgttcgtattcggtgggcgttggtttttttgatttcggcgcggttttttcgtttatttcgttttttcggcgtttcgtcgtaggttcgagtttcggcggtcgtttttcgttattttatttcgtgggggagtcggcggtcgttgggggtgttgtagggtttagcgtattttggaggcgaagggagtcgggaagtgggatcgcgcggagttcgtaacgagttatgtaatcggtaggggtcgtagtcgggacggaggcggtagttcgcggtattttcgtttttcgttttttgtcggtagcgtagttcggaagtttattggtcgtcgtttttacgtggtttcgttttttgaggtaggcgttgtcgttatgttgggagcgggtaggtttcgtgcgaagttaggtttaggatttcgtatgcggggtattggtgagggtcggttttttttttgtttttcgtttcgggaggtcgtcgagatatggtcggttagatttttgggtttttcggtttagcgtgtgcggacgtcggtggcgcggttttcgggtcgaggtttcgcggtttta

SEQ ID NO: 1708 - DNA, 952 bp, Artificial Sequence
  chemically treated genomic DNA (Homo sapiens) CpG-island No: 1708
taaaaccgcgaaacctcgacccgaaaaccgcgccaccgacgtccgcacacgctaaaccgaaaaacccaaaaatctaaccgaccatatctcgacgacctcccgaaacgaaaaacaaaaaaaaaaccgaccctcaccaataccccgcatacgaaatcctaaacctaacttcgcacgaaacctacccgctcccaacataacgacaacgcctacctcaaaaaacgaaaccacgtaaaaacgacgaccaataaacttccgaactacgctaccgacaaaaaacgaaaaacgaaaataccgcgaactaccgcctccgtcccgactacgacccctaccgattacataactcgttacgaactccgcgcgatcccacttcccgactcccttcgcctccaaaatacgctaaaccctacaacacccccaacgaccgccgactcccccacgaaataaaataacgaaaaacgaccgccgaaactcgaacctacgacgaaacgccgaaaaaacgaaataaacgaaaaaaccgcgccgaaatcaaaaaaaccaacgcccaccgaatacgaacgcgctaataaaacaaacccgaccgcgcccgcgcccccgacgcacgatcctcccgaaaaccgatttcgaaaacgacgacgaaaaataaacgctaaccaaaaacgaaaattaaaaaaatcgcgactctcatactaaataaaaatcgaaccttctacctaaaaattacgtcaatatccgaccccgcgataaataatcgaaacaatttacaactaaaaaataatcctcataaataccctataaaatatcgcgcgaaataaaaaaccaaaccatttccgtcgaatcaacgatttccgccttcgccccgctctcgcctaacctaatcaaaacctattttaatacttattacgccgattaaaatcatctacgacttatttaccctcctctaaactcctaaaaa

SEQ ID NO: 1709 - DNA, 511 bp, Artificial Sequence
  chemically treated genomic DNA (Homo sapiens) CpG-island No: 1709
tcggaagcgggggcgaggacgtagatcgggggtcgacgttaagaaagaaggcgggaagaggataaggtcgggagaggaggaggaggggagcgaggacgtagagaaggaggggaaagaggacggagaggagcgaggacggaggggggacgggaacgaagaggggcgaggacgtttagtatttattgcgatagcgataaataggatatcgttaggttttcggcggaggtagcgtttaagattttcgttgtcgagtaatcgaagtatggcggtggggcggggtcggagtttgcgtattttcgttttcgttcgttcggttggtcggaagtgacgttagggggcggggttagcggcgcggtcgggtgagaggtcgcggcggtaggtgagtgagcgcggtttcgtattcgcgcgtgtacgtcgtaggggcgtcgtaggtcgttttttcgttttgggatttcggtttttaggttttttagtttttcggtttttggaggatttcgtcgtgttgtttttt

SEQ ID NO: 1710 - DNA, 511 bp, Artificial Sequence
  chemically treated genomic DNA (Homo sapiens) CpG-island No: 1710
aaaaaacaacacgacgaaatcctccaaaaaccgaaaaactaaaaaacctaaaaaccgaaatcccaaaacgaaaaaacgacctacgacgcccctacgacgtacacgcgcgaatacgaaaccgcgctcactcacctaccgccgcgacctctcacccgaccgcgccgctaaccccgccccctaacgtcacttccgaccaaccgaacgaacgaaaacgaaaatacgcaaactccgaccccgccccaccgccatacttcgattactcgacaacgaaaatcttaaacgctacctccgccgaaaacctaacgatatcctatttatcgctatcgcaataaatactaaacgtcctcgcccctcttcgttcccgtcccccctccgtcctcgctcctctccgtcctctttcccctccttctctacgtcctcgctcccctcctcctcctctcccgaccttatcctcttcccgccttctttcttaacgtcgacccccgatctacgtcctcgcccccgcttccga

SEQ ID NO: 1711 - DNA, 511 bp, Artificial Sequence
  chemically treated genomic DNA (Homo sapiens) CpG-island No: 1711
agggggtagtacggcggggttttttaggggtcgagggattggggaatttgggggtcggggttttagagcgaaggggcggtttgcggcgtttttgcggcgtgtacgcgcgagtacgaggtcgcgtttatttatttgtcgtcgcggttttttattcgatcgcgtcgttggtttcgttttttggcgttattttcgattagtcgggcgggcgggggcggaaatgcgtaggtttcgatttcgttttatcgttatgtttcggttgttcggtaacggggattttgggcgttgttttcgtcgggaatttggcggtgttttgtttgtcgttgtcgtaatggatgttgaacgttttcgttttttttcgttttcgtttttttttcgttttcgttttttttcgtttttttttttttttttttttgcgttttcgttttttttttttttttttttcgattttgtttttttttcgtttttttttttgacgtcgattttcgatttgcgttttcgttttcgttttcgg

SEQ ID NO: 1712 - DNA, 511 bp, Artificial Sequence
  chemically treated genomic DNA (Homo sapiens) CpG-island No: 1712
ccgaaaacgaaaacgaaaacgcaaatcgaaaatcgacgtcaaaaaaaaaaacgaaaaaaaaacaaaatcgaaaaaaaaaaaaaaaaaaaacgaaaacgcaaaaaaaaaaaaaaaaaaaaacgaaaaaaaacgaaaacgaaaaaaaaacgaaaacgaaaaaaaacgaaaacgttcaacatccattacgacaacgacaaacaaaacaccgccaaattcccgacgaaaacaacgcccaaaatccccgttaccgaacaaccgaaacataacgataaaacgaaatcgaaacctacgcatttccgcccccgcccgcccgactaatcgaaaataacgccaaaaaacgaaaccaacgacgcgatcgaataaaaaaccgcgacgacaaataaataaacgcgacctcgtactcgcgcgtacacgccgcaaaaacgccgcaaaccgccccttcgctctaaaaccccgacccccaaattccccaatccctcgacccctaaaaaaccccgccgtactaccccct

SEQ ID NO: 1713 - DNA, 726 bp, Artificial Sequence
  chemically treated genomic DNA (Homo sapiens) CpG-island No: 1713
taaaggtcgtagatacgggaattgttttttttttagcgtcgtttttatattttcgcgtggatattgatattcgttttattttaggaatgcgtatagttaggcgtagtcggttagcgtgggtcgggggcggcggggttattttttttattttcgcgcgtaaggttcgtcgtttttgataacgcgatttaaggttacggaggttttatttttaggttcgatcgtttacgagacgggtagtatttcgttacgcgttcgagtaggtagttgttcggatagttcggcgttcgtcgtgacgttatcgtttcgcgttcgaggaagtttcgtttcgcgtagtttcgtttcgtttttttttatcgtgtacggtttcgcgtggttgcgcgcggcgttttgggagtacgatatggcgcgcgagttgcgggcgttgttgttgtggggtcgtcgtttgcggtttttgttgcgggcgtcggcgttggcggtcgtgtcgggaggtgagggcgttttggttggacgggtagcgggcgggtcgggttacggagacggtagggacgtttttgtgtttcggggagcgaggcgtcggtatttgttttataggcgtgggaggttcggcgaggttaagcgcggtagacgcgtttattttcgtttcgtttttcgttagttttagtttggttgtttttttttcggttggatttttttcgttattcgtttatgggagttttgaaggaggtt

SEQ ID NO: 1714 - DNA, 726 bp, Artificial Sequence
  chemically treated genomic DNA (Homo sapiens) CpG-island No: 1714
aacctccttcaaaactcccataaacgaataacgaaaaaaatccaaccgaaaaaaaaacaaccaaactaaaactaacgaaaaacgaaacgaaaataaacgcgtctaccgcgcttaacctcgccgaacctcccacgcctataaaacaaataccgacgcctcgctccccgaaacacaaaaacgtccctaccgtctccgtaacccgacccgcccgctacccgtccaaccaaaacgccctcacctcccgacacgaccgccaacgccgacgcccgcaacaaaaaccgcaaacgacgaccccacaacaacaacgcccgcaactcgcgcgccatatcgtactcccaaaacgccgcgcgcaaccacgcgaaaccgtacacgataaaaaaaaacgaaacgaaactacgcgaaacgaaacttcctcgaacgcgaaacgataacgtcacgacgaacgccgaactatccgaacaactacctactcgaacgcgtaacgaaatactacccgtctcgtaaacgatcgaacctaaaaataaaacctccgtaaccttaaatcgcgttatcaaaaacgacgaaccttacgcgcgaaaataaaaaaaataaccccgccgcccccgacccacgctaaccgactacgcctaactatacgcattcctaaaataaaacgaatatcaatatccacgcgaaaatataaaaacgacgctaaaaaaaaaacaattcccgtatctacgaccttta

SEQ ID NO: 1715 - DNA, 726 bp, Artificial Sequence
  chemically treated genomic DNA (Homo sapiens) CpG-island No: 1715
agttttttttagggtttttatgggcgggtggcgaggggagtttagtcgaggaaaaggtagttaagttggagttggcgaggagcggagcgaaagtaaacgcgtttgtcgcgtttggtttcgtcggattttttacgtttgtgaagtaggtgtcggcgtttcgtttttcggagtatagggacgtttttgtcgttttcgtggttcggttcgttcgttgttcgtttagttaggacgtttttatttttcggtacggtcgttagcgtcggcgttcgtagtaaaggtcgtaggcggcggttttatagtagtagcgttcgtagttcgcgcgttatgtcgtatttttagagcgtcgcgcgtagttacgcgggatcgtatacgatgggaaggggcgggacggggttgcgcggggcggggttttttcgggcgcggggcggtgacgttacggcgggcgtcgggttgttcgggtagttgtttgttcgggcgcgtggcggggtattattcgtttcgtggacggtcgggtttgggggtgggattttcgtgattttggatcgcgttgttaagggcgacgggttttgcgcgcggaggtgggggaggtggtttcgtcgttttcggtttacgttggtcggttgcgtttagttgtgcgtatttttggaatggggcggatgttagtatttacgcgagggtgtggaggcgacgttggggaagaagtagttttcgtgtttgcgatttttg

SEQ ID NO: 1716 - DNA, 726 bp, Artificial Sequence
  chemically treated genomic DNA (Homo sapiens) CpG-island No: 1716
caaaaatcgcaaacacgaaaactacttcttccccaacgtcgcctccacaccctcgcgtaaatactaacatccgccccattccaaaaatacgcacaactaaacgcaaccgaccaacgtaaaccgaaaacgacgaaaccacctcccccacctccgcgcgcaaaacccgtcgcccttaacaacgcgatccaaaatcacgaaaatcccacccccaaacccgaccgtccacgaaacgaataataccccgccacgcgcccgaacaaacaactacccgaacaacccgacgcccgccgtaacgtcaccgccccgcgcccgaaaaaaccccgccccgcgcaaccccgtcccgccccttcccatcgtatacgatcccgcgtaactacgcgcgacgctctaaaaatacgacataacgcgcgaactacgaacgctactactataaaaccgccgcctacgacctttactacgaacgccgacgctaacgaccgtaccgaaaaataaaaacgtcctaactaaacgaacaacgaacgaaccgaaccacgaaaacgacaaaaacgtccctatactccgaaaaacgaaacgccgacacctacttcacaaacgtaaaaaatccgacgaaaccaaacgcgacaaacgcgtttactttcgctccgctcctcgccaactccaacttaactaccttttcctcgactaaactcccctcgccacccgcccataaaaaccctaaaaaaaact

SEQ ID NO: 1717 - DNA, 882 bp, Artificial Sequence
  chemically treated genomic DNA (Homo sapiens) CpG-island No: 1717
gtcgttttttttttcgttagttttcggtatcggttcgggaggagacgggtttgttaggtttggggcgggcggggaggtttcggggaagggggggttcgttttttaggcgtcgaggtttcgaggtttcggtttttcgtttttgggcgatgggcgatttgtgaggtcggtttttatcgttgggggcgcgtgtgggaggaggcggtcgttcgagtgatcgggagtcgggtcgcggttttttttcgttcgtttcggttttttttatttttttgtttcggggtcgttatcgttcgggcgtcggatttggtttcgtgttcgcggtgtcgtcgttttttgggtttagttcgtttagttcggcgagcggcggtagtgggagtcgcgttcgtcgtattcgtttcgattcggtgtcggtttttggttttttttttatgattgcggcgtttttgttgttatcgttcgttcggtcgtcgttcgtcgtaggatggatgcggatcgtgcggcgttaattttcgtggtttagttttcgaatcgttcgttttcgagtttttttcgtgagtcgtagtagtttcggtgttagttttcgtcgtagttgggtttagcggttcgtttgtttttcgttgcggtttgtcggtgttgagtgaggcgtcgttcgggtcggcgcgaattcgttcggtcgcggttttttgtagatttttgcgcgggcggttcggttttttacgtttttttcgtttacgaattcgagttcgttcgtttttttttagcgaatcgattatgtttggcggcgtcgtagagaagtagagtagtattttcggttttttgtttttttcgtcgtcggtttttgtttttaagaatggttttagtttcgattttttcgtgggggagaaa

SEQ ID NO: 1718 - DNA, 882 bp, Artificial Sequence
  chemically treated genomic DNA (Homo sapiens) CpG-island No: 1718
tttctcccccacgaaaaaatcgaaactaaaaccattcttaaaaacaaaaaccgacgacgaaaaaaacaaaaaaccgaaaatactactctacttctctacgacgccgccaaacataatcgattcgctaaaaaaaaacgaacgaactcgaattcgtaaacgaaaaaaacgtaaaaaaccgaaccgcccgcgcaaaaatctacaaaaaaccgcgaccgaacgaattcgcgccgacccgaacgacgcctcactcaacaccgacaaaccgcaacgaaaaacaaacgaaccgctaaacccaactacgacgaaaactaacaccgaaactactacgactcacgaaaaaaactcgaaaacgaacgattcgaaaactaaaccacgaaaattaacgccgcacgatccgcatccatcctacgacgaacgacgaccgaacgaacgataacaacaaaaacgccgcaatcataaaaaaaaaaccaaaaaccgacaccgaatcgaaacgaatacgacgaacgcgactcccactaccgccgctcgccgaactaaacgaactaaacccaaaaaacgacgacaccgcgaacacgaaaccaaatccgacgcccgaacgataacgaccccgaaacaaaaaaataaaaaaaaccgaaacgaacgaaaaaaaaccgcgacccgactcccgatcactcgaacgaccgcctcctcccacacgcgcccccaacgataaaaaccgacctcacaaatcgcccatcgcccaaaaacgaaaaaccgaaacctcgaaacctcgacgcctaaaaaacgaacccccccttccccgaaacctccccgcccgccccaaacctaacaaacccgtctcctcccgaaccgataccgaaaactaacgaaaaaaaaaacgac

SEQ ID NO: 1719 - DNA, 882 bp, Artificial Sequence
  chemically treated genomic DNA (Homo sapiens) CpG-island No: 1719
ttttttttttacggaggaatcggagttggagttatttttgggggtaggagtcggcggcgagaggaatagggaatcgggagtgttgttttgtttttttgcggcgtcgttagatatggtcggttcgttggagagaggcgagcgggttcggattcgtgaacgaaaagggcgtgaagggtcgagtcgttcgcgtagaggtttgtagggaatcgcggtcgggcgggttcgcgtcgattcggacgacgttttatttagtatcgataagtcgtaacgagggataggcggatcgttgggtttagttgcggcgggggttggtatcgaggttgttgcggtttacgaggagggttcgaaggcgggcgattcgggagttgagttacgggggttagcgtcgtacggttcgtatttattttgcggcgagcggcggtcgggcgggcggtggtagtagaggcgtcgtagttatgaggggagggttaggggtcggtatcgagtcgaggcggatgcggcggacgcggtttttattgtcgtcgttcgtcgagttgggcgggttaggtttagagggcggcggtatcgcgagtacgggattaggttcgacgttcgggcggtggcggtttcggggtagaggagtgggaggggtcgaggcgggcgagggaaggtcgcggttcggttttcggttattcgggcggtcgtttttttttatacgcgtttttagcgatggggatcggttttataggtcgtttatcgtttagaggcgaagggtcggagtttcggagtttcggcgtttgaggagcgggttttttttttttcgaggttttttcgttcgttttaggtttggtaaattcgttttttttcgggtcggtgtcgggggttgacggaggagggaacggt

SEQ ID NO: 1720 - DNA, 882 bp, Artificial Sequence
  chemically treated genomic DNA (Homo sapiens) CpG-island No: 1720
accgttccctcctccgtcaacccccgacaccgacccgaaaaaaaacgaatttaccaaacctaaaacgaacgaaaaaacctcgaaaaaaaaaaaacccgctcctcaaacgccgaaactccgaaactccgacccttcgcctctaaacgataaacgacctataaaaccgatccccatcgctaaaaacgcgtataaaaaaaaacgaccgcccgaataaccgaaaaccgaaccgcgaccttccctcgcccgcctcgacccctcccactcctctaccccgaaaccgccaccgcccgaacgtcgaacctaatcccgtactcgcgataccgccgccctctaaacctaacccgcccaactcgacgaacgacgacaataaaaaccgcgtccgccgcatccgcctcgactcgataccgacccctaaccctcccctcataactacgacgcctctactaccaccgcccgcccgaccgccgctcgccgcaaaataaatacgaaccgtacgacgctaacccccgtaactcaactcccgaatcgcccgccttcgaaccctcctcgtaaaccgcaacaacctcgataccaacccccgccgcaactaaacccaacgatccgcctatccctcgttacgacttatcgatactaaataaaacgtcgtccgaatcgacgcgaacccgcccgaccgcgattccctacaaacctctacgcgaacgactcgacccttcacgcccttttcgttcacgaatccgaacccgctcgcctctctccaacgaaccgaccatatctaacgacgccgcaaaaaaacaaaacaacactcccgattccctattcctctcgccgccgactcctacccccaaaaataactccaactccgattcctccgtaaaaaaaaaa

SEQ ID NO: 1721 - DNA, 665 bp, Artificial Sequence
  chemically treated genomic DNA (Homo sapiens) CpG-island No: 1721
gtcgtcgtatcgggcgtcgcgttttttttcgttttgtgtttcggatgtaacgtttcgtcgcggaaagcggggtagcgggcgggatgggcgtcgtcgtttggggtataggatttacgggtaattgagggatttatttacgtgtagtcgttattcgcgtcgtttttagggtaagtatttagttagggtttttcgttgcgcgttttagatcgcgttcgtttttatttaagttttttttttagggtttaaatcggagtagtgtttcggatcgcgtaggtttcgtagtatcgtgatgttgacgaacgttttttcggggacggcggtttagacggagggcgagtttttgtagtttacgatggtcgcgttttgataggtttcgttcgttatgaggttgtcgatgtaggcgttttattcggttatggcgttgttattggggttgttttcggcgttgttgttggggtcgcggattgggttcgagttgtttcggttggcgggcggggggaggcggagagttcggggtacgcgttgtcgttcggatcgcggtttcgttcgttgtgtagtagttttcgtatcgttattttttgttttttttttttttcgtttcgttagatttttatttgtaaaggacggtaggggcggggtttattttttattttttttttttttta

SEQ ID NO: 1722 - DNA, 665 bp, Artificial Sequence
  chemically treated genomic DNA (Homo sapiens) CpG-island No: 1722
taaaaaaaaaaaaaaataaaaaataaaccccgcccctaccgtcctttacaaataaaaatctaacgaaacgaaaaaaaaaaaaaacaaaaaataacgatacgaaaactactacacaacgaacgaaaccgcgatccgaacgacaacgcgtaccccgaactctccgcctccccccgcccgccaaccgaaacaactcgaacccaatccgcgaccccaacaacaacgccgaaaacaaccccaataacaacgccataaccgaataaaacgcctacatcgacaacctcataacgaacgaaacctatcaaaacgcgaccatcgtaaactacaaaaactcgccctccgtctaaaccgccgtccccgaaaaaacgttcgtcaacatcacgatactacgaaacctacgcgatccgaaacactactccgatttaaaccctaaaaaaaaaacttaaataaaaacgaacgcgatctaaaacgcgcaacgaaaaaccctaactaaatacttaccctaaaaacgacgcgaataacgactacacgtaaataaatccctcaattacccgtaaatcctataccccaaacgacgacgcccatcccgcccgctaccccgctttccgcgacgaaacgttacatccgaaacacaaaacgaaaaaaaacgcgacgcccgatacgacgac

SEQ ID NO: 1723 - DNA, 665 bp, Artificial Sequence
  chemically treated genomic DNA (Homo sapiens) CpG-island No: 1723
tgggggagggagggaatggggagtaggtttcgtttttatcgttttttgtaaataaaaatttagcggggcggggggggggaggagtaggaagtggcggtgcgagggttgttgtatagcgagcggagtcgcggttcggacggtagcgcgtgtttcgagtttttcgttttttttcgttcgttagtcgaggtagttcgagtttagttcgcggttttagtagtagcgtcgagagtagttttagtagtagcgttatggtcgggtggaacgtttatatcgataattttatggcggacgggatttgttaggacgcggttatcgtgggttataaggattcgtttttcgtttgggtcgtcgttttcgggaaaacgttcgttaatattacggtattgcgaggtttgcgcggttcggggtattgtttcggtttggattttgagggagggatttgggtgggggcgggcgcggtttagggcgcgtagcgagaggttttgattgggtgtttgttttggaagcggcgcgaatggcggttgtacgtgagtgggttttttagttgttcgtaggttttatgttttaggcggcggcgtttatttcgttcgttatttcgtttttcgcgacggggcgttatattcggggtatagggcggggaggggcgcggcgttcggtgcggcggt

SEQ ID NO: 1724 - DNA, 665 bp, Artificial Sequence
  chemically treated genomic DNA (Homo sapiens) CpG-island No: 1724
accgccgcaccgaacgccgcgcccctccccgccctataccccgaatataacgccccgtcgcgaaaaacgaaataacgaacgaaataaacgccgccgcctaaaacataaaacctacgaacaactaaaaaacccactcacgtacaaccgccattcgcgccgcttccaaaacaaacacccaatcaaaacctctcgctacgcgccctaaaccgcgcccgcccccacccaaatccctccctcaaaatccaaaccgaaacaataccccgaaccgcgcaaacctcgcaataccgtaatattaacgaacgttttcccgaaaacgacgacccaaacgaaaaacgaatccttataacccacgataaccgcgtcctaacaaatcccgtccgccataaaattatcgatataaacgttccacccgaccataacgctactactaaaactactctcgacgctactactaaaaccgcgaactaaactcgaactacctcgactaacgaacgaaaaaaaacgaaaaactcgaaacacgcgctaccgtccgaaccgcgactccgctcgctatacaacaaccctcgcaccgccacttcctactcctccccccccccgccccgctaaatttttatttacaaaaaacgataaaaacgaaacctactccccattccctccctccccca

SEQ ID NO: 1725 - DNA, 999 bp, Artificial Sequence
  chemically treated genomic DNA (Homo sapiens) CpG-island No: 1725
ggcggtcgaatttgagggttaggcggggatagagcgttcgagtagtcgcgttacggtcggtcgtatttggttttagtatttgaagtagttgcgcggcgaattttagaattcggcggggcggggaggagagagacggcgattcgagtcgcgggaggagtcggcgggcggtgttcgtttgagggcggggtttgagcggagttattttttgggcgggtttcggtaggaggtttcgttttttggacgcgtttttaacggcggcgacgggaattgggtcggggtttgggtgttttcgcgggttagttttcgacgtttttttgttttttaggcgtttgtaatttttttgggttgcggcgtttgttcgtttttttgcgttcgtagttcggtttttacgttttcgttcgttgggttttataggttaggagcgttgtttttttaataagagtagttcgggtcgttttcggttttttttcgggatcgcgcgtattcgttttttcgcgcgcgttcgcgcgtttttcgtttttcgttttcgttttagttcgcgttgttcgggcgggcgtcggtcgttggcgtcgttattgttgtcgttttcggggcgcgagttcgtcgttcgtcgttcgggtattcggcgaggggcgggggtagtttcgaatcggttttagatttttttcgttttcgttttacgtttttcggaaagtttgttttttttcgtcgagttgtttcgggagtttcgtcgcgtcgaggtgagggttggggaagggggagggaagggacgttcgcggaggaatgtgtcgggttggggggcggggagtcggggttcggcggcgcgatttaggtttaagagtcgggattatgtgttgtttgtttcgcggaggcgtagagaggtgttaggttcgggcggtcgtcggttggttggataggaggacgggttcgtatggtcgttttgagaggtcgggcggggatttgtgtgagaatcgtcgggtgggtaaggtgtaggtggtt

SEQ ID NO: 1726 - DNA, 999 bp, Artificial Sequence
  chemically treated genomic DNA (Homo sapiens) CpG-island No: 1726
aaccacctacaccttacccacccgacgattctcacacaaatccccgcccgacctctcaaaacgaccatacgaacccgtcctcctatccaaccaaccgacgaccgcccgaacctaacacctctctacgcctccgcgaaacaaacaacacataatcccgactcttaaacctaaatcgcgccgccgaaccccgactccccgccccccaacccgacacattcctccgcgaacgtcccttccctcccccttccccaaccctcacctcgacgcgacgaaactcccgaaacaactcgacgaaaaaaaacaaactttccgaaaaacgtaaaacgaaaacgaaaaaaatctaaaaccgattcgaaactacccccgcccctcgccgaatacccgaacgacgaacgacgaactcgcgccccgaaaacgacaacaataacgacgccaacgaccgacgcccgcccgaacaacgcgaactaaaacgaaaacgaaaaacgaaaaacgcgcgaacgcgcgcgaaaaaacgaatacgcgcgatcccgaaaaaaaaccgaaaacgacccgaactactcttattaaaaaaacaacgctcctaacctataaaacccaacgaacgaaaacgtaaaaaccgaactacgaacgcaaaaaaacgaacaaacgccgcaacccaaaaaaattacaaacgcctaaaaaacaaaaaaacgtcgaaaactaacccgcgaaaacacccaaaccccgacccaattcccgtcgccgccgttaaaaacgcgtccaaaaaacgaaacctcctaccgaaacccgcccaaaaaataactccgctcaaaccccgccctcaaacgaacaccgcccgccgactcctcccgcgactcgaatcgccgtctctctcctccccgccccgccgaattctaaaattcgccgcgcaactacttcaaatactaaaaccaaatacgaccgaccgtaacgcgactactcgaacgctctatccccgcctaaccctcaaattcgaccgcc

SEQ ID NO: 1727 - DNA, 999 bp, Artificial Sequence
  chemically treated genomic DNA (Homo sapiens) CpG-island No: 1727
ggttatttgtattttgtttattcggcggtttttatataggttttcgttcggttttttagggcggttatgcggattcgtttttttgtttagttagtcggcggtcgttcgggtttggtatttttttgcgttttcgcggaataaatagtatatgatttcgatttttgagtttagatcgcgtcgtcggatttcggtttttcgttttttaattcggtatattttttcgcgggcgtttttttttttttttttttttagtttttatttcggcgcggcggggttttcggagtagttcggcggagagggataagtttttcgggaagcgtgaggcggaagcgggaaggatttggggtcggttcggagttgttttcgtttttcgtcgggtgttcgggcggcgggcggcggattcgcgtttcgggggcggtagtagtagcggcgttagcggtcggcgttcgttcgggtagcgcgagttggggcgggagcgaggggcgggggacgcgcgagcgcgcgcggaggggcgggtacgcgcggtttcgggaaggagtcgggagcgattcgggttatttttgttaaaggggtaacgtttttggtttgtggggtttagcgagcgggaacgtggggatcgagttgcggacgtagaagggcgagtagacgtcgtaatttaggagggttgtagacgtttgaagaatagggaaacgtcgggggttgattcgcgggggtatttaggtttcggtttagttttcgtcgtcgtcgttggaggcgcgtttagggggcggagttttttgtcgaggttcgtttagaaggtggtttcgtttaggtttcgtttttagacgagtatcgttcgtcggtttttttcgcggttcgaatcgtcgtttttttttttttcgtttcgtcgagttttagaattcgtcgcgtagttgttttaggtgttggggttaaatgcggtcggtcgtggcgcggttattcgggcgttttgttttcgtttggtttttaagttcggtcgtt

SEQ ID NO: 1728 - DNA, 999 bp, Artificial Sequence
  chemically treated genomic DNA (Homo sapiens) CpG-island No: 1728
aacgaccgaacttaaaaaccaaacgaaaacaaaacgcccgaataaccgcgccacgaccgaccgcatttaaccccaacacctaaaacaactacgcgacgaattctaaaactcgacgaaacgaaaaaaaaaaaaacgacgattcgaaccgcgaaaaaaaccgacgaacgatactcgtctaaaaacgaaacctaaacgaaaccaccttctaaacgaacctcgacaaaaaactccgccccctaaacgcgcctccaacgacgacgacgaaaactaaaccgaaacctaaatacccccgcgaatcaacccccgacgtttccctattcttcaaacgtctacaaccctcctaaattacgacgtctactcgcccttctacgtccgcaactcgatccccacgttcccgctcgctaaaccccacaaaccaaaaacgttacccctttaacaaaaataacccgaatcgctcccgactccttcccgaaaccgcgcgtacccgcccctccgcgcgcgctcgcgcgtcccccgcccctcgctcccgccccaactcgcgctacccgaacgaacgccgaccgctaacgccgctactactaccgcccccgaaacgcgaatccgccgcccgccgcccgaacacccgacgaaaaacgaaaacaactccgaaccgaccccaaatccttcccgcttccgcctcacgcttcccgaaaaacttatccctctccgccgaactactccgaaaaccccgccgcgccgaaataaaaactaaaaaaaaaaaaaaaaaaaaacgcccgcgaaaaaatataccgaattaaaaaacgaaaaaccgaaatccgacgacgcgatctaaactcaaaaatcgaaatcatatactatttattccgcgaaaacgcaaaaaaataccaaacccgaacgaccgccgactaactaaacaaaaaaacgaatccgcataaccgccctaaaaaaccgaacgaaaacctatataaaaaccgccgaataaacaaaatacaaataacc

SEQ ID NO: 1729 - DNA, 659 bp, Artificial Sequence
  chemically treated genomic DNA (Homo sapiens) CpG-island No: 1729
gtcgtcgtcgtcgtcgtcgtcgtagtcgtattcgtagtagagtttttcggttatggtaggcgcgtattattttttgtattgtttgtattcggcggcggcggcggtagcggtcggttcgtattattattattattattagtattattattacggttcgttttacgcgtcgggcggagggaatttttataattatcgttcgttcgtcgtttatttttatatgagttattcgtagtatagtttttatttttagttttattataatagtagcgtagtcgtttagacgcgaggggacgatataggtgagaggtcgttggggtagttcgtttttttcgtttttcgattgttttttatttcgttcgttcgtttattttttcgacgttcgggttttcgtcggtttttttttttaggcggtttcgcgcgtttttggtcgggtttcgtgcgcgttcgttcgtttggcgtttgtttgtcggttttttttagtcgggttttttttcgtcgtcgcggatttttagttttcgacgcgtagttcgggttgagtttcgggttcggcgtaggtttcgttcgacgagttagtttatattgcgttttttagttttttgggtttgtgcgtttttttttttgttttttttttttaggttgtaatttacgtttgattcggt

SEQ ID NO: 1730 - DNA, 659 bp, Artificial Sequence
  chemically treated genomic DNA (Homo sapiens) CpG-island No: 1730
accgaatcaaacgtaaattacaacctaaaaaaaaaaaacaaaaaaaaaaacgcacaaacccaaaaaactaaaaaacgcaatataaactaactcgtcgaacgaaacctacgccgaacccgaaactcaacccgaactacgcgtcgaaaactaaaaatccgcgacgacgaaaaaaaacccgactaaaaaaaaccgacaaacaaacgccaaacgaacgaacgcgcacgaaacccgaccaaaaacgcgcgaaaccgcctaaaaaaaaaaaccgacgaaaacccgaacgtcgaaaaaataaacgaacgaacgaaataaaaaacaatcgaaaaacgaaaaaaacgaactaccccaacgacctctcacctatatcgtcccctcgcgtctaaacgactacgctactattataataaaactaaaaataaaaactatactacgaataactcatataaaaataaacgacgaacgaacgataattataaaaattccctccgcccgacgcgtaaaacgaaccgtaataataatactaataataataataataatacgaaccgaccgctaccgccgccgccgccgaatacaaacaatacaaaaaataatacgcgcctaccataaccgaaaaactctactacgaatacgactacgacgacgacgacgacgacgac

SEQ ID NO: 1731 - DNA, 659 bp, Artificial Sequence
  chemically treated genomic DNA (Homo sapiens) CpG-island No: 1731
gtcgggttaaacgtgggttatagtttggagggaaggagtaaggaaaagggcgtatagatttaggaggttggagagcgtagtgtggattaattcgtcgaacgaagtttgcgtcgggttcgggatttagttcgaattgcgcgtcggaagttgagggttcgcggcggcgggaaggggttcggttgggagaggtcggtaggtaggcgttaggcgagcgggcgcgtacggggttcggttaagggcgcgcggggtcgtttgggggagggggtcggcggaggttcgggcgtcgaggaagtgagcgggcgggcggggtagggggtagtcgggaggcgggagaagcgagttgttttagcggttttttatttgtgtcgttttttcgcgtttgggcggttgcgttgttgttgtggtaggattggaggtaagggttgtgttgcgagtggtttatgtaggggtaggcggcgagcgagcggtggttgtaggagtttttttcgttcgacgcgtagggcgagtcgtggtggtggtgttggtggtggtggtggtggtgcgagtcggtcgttgtcgtcgtcgtcgtcgagtgtaggtagtgtagagggtagtgcgcgtttgttatggtcggggagttttgttgcgagtgcggttgcggcggcggcggcggcggcggt

SEQ ID NO: 1732 - DNA, 659 bp, Artificial Sequence
  chemically treated genomic DNA (Homo sapiens) CpG-island No: 1732
accgccgccgccgccgccgccgcaaccgcactcgcaacaaaactccccgaccataacaaacgcgcactaccctctacactacctacactcgacgacgacgacgacaacgaccgactcgcaccaccaccaccaccaccaacaccaccaccacgactcgccctacgcgtcgaacgaaaaaaactcctacaaccaccgctcgctcgccgcctacccctacataaaccactcgcaacacaacccttacctccaatcctaccacaacaacaacgcaaccgcccaaacgcgaaaaaacgacacaaataaaaaaccgctaaaacaactcgcttctcccgcctcccgactaccccctaccccgcccgcccgctcacttcctcgacgcccgaacctccgccgaccccctcccccaaacgaccccgcgcgcccttaaccgaaccccgtacgcgcccgctcgcctaacgcctacctaccgacctctcccaaccgaaccccttcccgccgccgcgaaccctcaacttccgacgcgcaattcgaactaaatcccgaacccgacgcaaacttcgttcgacgaattaatccacactacgctctccaacctcctaaatctatacgcccttttccttactccttccctccaaactataacccacgtttaacccgac

SEQ ID NO: 1733 - DNA, 672 bp, Artificial Sequence
  chemically treated genomic DNA (Homo sapiens) CpG-island No: 1733
tgcgcgcggattcggtttatagtttttttttcgtagttttcggcggtttcgagtcgcgtacgtagtcgtcggggatagatttttttttttatttagattgggattacgtgcgtgtggtttggggcggttcgggtttcgtttcgttcgacgttgttttttgtatattttcgcggtttcggttcgcggttgtagttcgtagtgggtcgtagttaatagaggtttcggggatttcgggattattgaataggtaggttatttcgttgttgtacgcgttggcggtcgaggcggaggtcgcggcgtaggttgtcgagtcgtttagttcgtcggtttcgagggtcgtttatcgttagcggttttagggcgcgtagcggcgagtgtttcgggagacgtcgttttagcgtaaggagtttcgtatgagtttgttcgttcgtttgcggtttattgttttagcgcggttttcggcgatttattcgcgtttcgtttcgtttagttattcgggcggggagggggagtcggcgcgttttcgggttttcgcgttaggaattgtcggtcggggttttttcgttaattagtagcggaagtggtgttttttagagttaggaaagttggatcgtgtgggtcggggcggtgggtcggcgcgggaatgtttgggtgaggtttgttttagttttg

SEQ ID NO: 1734 - DNA, 672 bp, Artificial Sequence
  chemically treated genomic DNA (Homo sapiens) CpG-island No: 1734
caaaactaaaacaaacctcacccaaacattcccgcgccgacccaccgccccgacccacacgatccaactttcctaactctaaaaaacaccacttccgctactaattaacgaaaaaaccccgaccgacaattcctaacgcgaaaacccgaaaacgcgccgactccccctccccgcccgaataactaaacgaaacgaaacgcgaataaatcgccgaaaaccgcgctaaaacaataaaccgcaaacgaacgaacaaactcatacgaaactccttacgctaaaacgacgtctcccgaaacactcgccgctacgcgccctaaaaccgctaacgataaacgaccctcgaaaccgacgaactaaacgactcgacaacctacgccgcgacctccgcctcgaccgccaacgcgtacaacaacgaaataacctacctattcaataatcccgaaatccccgaaacctctattaactacgacccactacgaactacaaccgcgaaccgaaaccgcgaaaatatacaaaaaacaacgtcgaacgaaacgaaacccgaaccgccccaaaccacacgcacgtaatcccaatctaaataaaaaaaaaaatctatccccgacgactacgtacgcgactcgaaaccgccgaaaactacgaaaaaaaaactataaaccgaatccgcgcgca

SEQ ID NO: 1735 - DNA, 672 bp, Artificial Sequence
  chemically treated genomic DNA (Homo sapiens) CpG-island No: 1735
tagagttggagtaggttttatttaggtattttcgcgtcggtttatcgtttcgatttatacgatttagtttttttggttttgagaagtattattttcgttgttggttggcgaggggatttcggtcggtagtttttggcgcgggagttcgggagcgcgtcggtttttttttttcgttcgggtggttgagcgaggcggagcgcgggtgagtcgtcgggggtcgcgttgggatagtgggtcgtagacgggcgggtaggtttatgcggagttttttgcgttggaacgacgtttttcggagtattcgtcgttgcgcgttttgaagtcgttggcggtaggcggttttcgaggtcggcgggttgggcggttcggtagtttgcgtcgcggttttcgtttcggtcgttagcgcgtatagtagcggggtggtttgtttgtttagtggtttcggggttttcgggatttttgttggttgcggtttattgcgggttgtaatcgcgggtcggggtcgcggggatgtgtaaagggtagcgtcgggcggggcggggttcgggtcgttttaaattatacgtacgtagttttagtttaggtaaggaaggaggtttgttttcggcgattgcgtgcgcggttcggggtcgtcggaggttgcggagaaagagttgtaggtcgagttcgcgcgta

SEQ ID NO: 1736 - DNA, 672 bp, Artificial Sequence
  chemically treated genomic DNA (Homo sapiens) CpG-island No: 1736
tacgcgcgaactcgacctacaactctttctccgcaacctccgacgaccccgaaccgcgcacgcaatcgccgaaaacaaacctccttccttacctaaactaaaactacgtacgtataatttaaaacgacccgaaccccgccccgcccgacgctaccctttacacatccccgcgaccccgacccgcgattacaacccgcaataaaccgcaaccaacaaaaatcccgaaaaccccgaaaccactaaacaaacaaaccaccccgctactatacgcgctaacgaccgaaacgaaaaccgcgacgcaaactaccgaaccgcccaacccgccgacctcgaaaaccgcctaccgccaacgacttcaaaacgcgcaacgacgaatactccgaaaaacgtcgttccaacgcaaaaaactccgcataaacctacccgcccgtctacgacccactatcccaacgcgacccccgacgactcacccgcgctccgcctcgctcaaccacccgaacgaaaaaaaaaaaccgacgcgctcccgaactcccgcgccaaaaactaccgaccgaaatcccctcgccaaccaacaacgaaaataatacttctcaaaaccaaaaaaactaaatcgtataaatcgaaacgataaaccgacgcgaaaatacctaaataaaacctactccaactcta

SEQ ID NO: 1737 - DNA, 948 bp, Artificial Sequence
  chemically treated genomic DNA (Homo sapiens) CpG-island No: 1737
tcgtaggtttggatcgttaagaaggcggcgtagcgcgtacgaggagtcgggtcgtaggtattggtaggcgcgacgttcgttgtgattacgtacgtgtatttgggtatttagacgtattattagtagtacggtagcgttttcgtggtcgtgtagtgtagttaggtgtagcggcgtgtagtcgtcgtgggagcgtgcgtttacgtcgattggtgcgttattgcgtcgcgcgatttttattagttgtagcgttatttcgtcgtcgtcgtttttggcggtttaatgtagggtcgtgaagttagatatgaagtcgcgtttggtcgttaagtcgcggtcgcgtagtagtagttcgtgtagttggtgggtttagcggttttcggtagttcgtacgagttattcgtgttcggacggttttaggggtatcgcggacggcggcggcgcggcgggtaatttttcggcgttagggtttagtagacgcgggtcggcgcgcgataggcgttttaggtgcggggagcggttcgggtttaggtcgaggtttagatcggatttttttatcgagagtcgttttagtagtagaggggagtttcgcgggttcggttttttcgatagttgtcggcgtaggtcgggttttttcgttcggaggcggagcgtggcgggggtcgggacgtagcgtatcggtagtatatagggtttttgttgcggcggttttttcgttgtttcgggttcgggtttcgcgtttggcggattagagtagggcgatgtcgttttagaaggggttttaggcggtggggtcgcgtttgcggagggtttttcggtggtttgggttagtttaagggttggaagcggtgggtcggcggatcgtttttcgggcggttgagcgggttcggaggtcggttttttcggggtgttttgtggttttgttggtagatttaggttttttggcggttttat

SEQ ID NO: 1738 - DNA, 948 bp, Artificial Sequence
  chemically treated genomic DNA (Homo sapiens) CpG-island No: 1738
ataaaaccgccaaaaaacctaaatctaccaacaaaaccacaaaacaccccgaaaaaaccgacctccgaacccgctcaaccgcccgaaaaacgatccgccgacccaccgcttccaacccttaaactaacccaaaccaccgaaaaaccctccgcaaacgcgaccccaccgcctaaaaccccttctaaaacgacatcgccctactctaatccgccaaacgcgaaacccgaacccgaaacaacgaaaaaaccgccgcaacaaaaaccctatatactaccgatacgctacgtcccgacccccgccacgctccgcctccgaacgaaaaaacccgacctacgccgacaactatcgaaaaaaccgaacccgcgaaactcccctctactactaaaacgactctcgataaaaaaatccgatctaaacctcgacctaaacccgaaccgctccccgcacctaaaacgcctatcgcgcgccgacccgcgtctactaaaccctaacgccgaaaaattacccgccgcgccgccgccgtccgcgatacccctaaaaccgtccgaacacgaataactcgtacgaactaccgaaaaccgctaaacccaccaactacacgaactactactacgcgaccgcgacttaacgaccaaacgcgacttcatatctaacttcacgaccctacattaaaccgccaaaaacgacgacgacgaaataacgctacaactaataaaaatcgcgcgacgcaataacgcaccaatcgacgtaaacgcacgctcccacgacgactacacgccgctacacctaactacactacacgaccacgaaaacgctaccgtactactaataatacgtctaaatacccaaatacacgtacgtaatcacaacgaacgtcgcgcctaccaatacctacgacccgactcctcgtacgcgctacgccgccttcttaacgatccaaacctacga

SEQ ID NO: 1739 - DNA, 948 bp, Artificial Sequence
  chemically treated genomic DNA (Homo sapiens) CpG-island No: 1739
gtggagtcgttaggggatttgggtttgttaatagagttataggatatttcgggggggtcggttttcgagttcgtttagtcgttcggggagcggttcgtcgatttatcgtttttagtttttgagttagtttaggttatcgagagatttttcgtagacgcggttttatcgtttagggttttttttgaggcggtatcgttttgttttgattcgttagacgcggagttcgggttcggggtagcgaaagggtcgtcgtagtagaagttttgtatgttgtcggtgcgttgcgtttcggttttcgttacgtttcgttttcgggcggaggagttcggtttgcgtcggtagttgtcggaggagtcgagttcgcggagtttttttttgttgttgaggcggttttcggtggaagagttcggtttgggtttcggtttgggttcgggtcgtttttcgtatttgaggcgtttgtcgcgcgtcggttcgcgtttgttgagttttgacgtcgaggagttgttcgtcgcgtcgtcgtcgttcgcggtgtttttggagtcgttcgagtacgagtggttcgtgcggattgtcgggggtcgttggatttattagttgtacgggttgttgttgcgcgatcgcggtttggcggttaagcgcgattttatgtttggttttacggttttgtattgggtcgttaagagcggcgacggcgagatggcgttgtagttggtggaggtcgcgcggcgtagtggcgtattagtcgacgtgaacgtacgtttttacggcggttatacgtcgttgtatttggttgtattgtacggttacgaggacgttgtcgtgttgttggtggtgcgtttgggtgtttaggtgtacgtgcgtgattatagcgggcgtcgcgtttattagtatttgcggttcggtttttcgtacgcgttgcgtcgtttttttggcgatttaggtttgcga

SEQ ID NO: 1740 - DNA, 948 bp, Artificial Sequence
  chemically treated genomic DNA (Homo sapiens) CpG-island No: 1740
tcgcaaacctaaatcgccaaaaaaacgacgcaacgcgtacgaaaaaccgaaccgcaaatactaataaacgcgacgcccgctataatcacgcacgtacacctaaacacccaaacgcaccaccaacaacacgacaacgtcctcgtaaccgtacaatacaaccaaatacaacgacgtataaccgccgtaaaaacgtacgttcacgtcgactaatacgccactacgccgcgcgacctccaccaactacaacgccatctcgccgtcgccgctcttaacgacccaatacaaaaccgtaaaaccaaacataaaatcgcgcttaaccgccaaaccgcgatcgcgcaacaacaacccgtacaactaataaatccaacgacccccgacaatccgcacgaaccactcgtactcgaacgactccaaaaacaccgcgaacgacgacgacgcgacgaacaactcctcgacgtcaaaactcaacaaacgcgaaccgacgcgcgacaaacgcctcaaatacgaaaaacgacccgaacccaaaccgaaacccaaaccgaactcttccaccgaaaaccgcctcaacaacaaaaaaaaactccgcgaactcgactcctccgacaactaccgacgcaaaccgaactcctccgcccgaaaacgaaacgtaacgaaaaccgaaacgcaacgcaccgacaacatacaaaacttctactacgacgaccctttcgctaccccgaacccgaactccgcgtctaacgaatcaaaacaaaacgataccgcctcaaaaaaaaccctaaacgataaaaccgcgtctacgaaaaatctctcgataacctaaactaactcaaaaactaaaaacgataaatcgacgaaccgctccccgaacgactaaacgaactcgaaaaccgacccccccgaaatatcctataactctattaacaaacccaaatcccctaacgactccac

SEQ ID NO: 1741 - DNA, 839 bp, Artificial Sequence
  chemically treated genomic DNA (Homo sapiens) CpG-island No: 1741
ttcgcggtaagatcgtcgaagtgggtttcgacggttgggtcgttgttttcggggggtcgaagggtgcgggttcgggtttcgggggtcggggttttttttttagtattacgaatttgacgtcgtcgagtttttttattatcgttacgttgttgacgaattgtttgaagcggtttttgcgggcggcgcggtttcgcgggtcgtcggtatcgagtagcggtttgaagcggtttagtagttcggagttgcgtattttttcgtcgtgtttttgtaggaagtttagtatcgtcgtttggtttatttcggtagtcgtagcggcggcggcggcggttagcgttatggtggggttttgggtttttggttttcggggcgggtgggcgtcgcgtcgtcgcgggacgcgcgggagcggggtttcgggaggcgcggtcgcgtttatttggtgtttttttcgcggttagtcgggcgtgttttcgaagttggatttcggtcgcgttagtgtcgttgggtcggggcgtttcggggcgaagggcgtcgggggtcgcggggagcgtttatttttagcgtttcgtcgggtttcggttttcggggtaggtttttgtttttgtattttgtttaatgggcgtttgtttttatttttcgcgtcgcgttcgttttataggtgatagttgttttcgcgatgtagagggaatcggagtagaaattttcgtcgtttttcgttcgttttagaattaaaggcgtagcgttttagttttggtttcggttgttaggtgggtgtgttttttagggacgtcgcggttcgttaaggaggaatggatttttatttttttaataaatatttaatt

SEQ ID NO: 1742 - DNA, 839 bp, Artificial Sequence
  chemically treated genomic DNA (Homo sapiens) CpG-island No: 1742
aattaaatatttattaaaaaaataaaaatccattcctccttaacgaaccgcgacgtccctaaaaaacacacccacctaacaaccgaaaccaaaactaaaacgctacgcctttaattctaaaacgaacgaaaaacgacgaaaatttctactccgattccctctacatcgcgaaaacaactatcacctataaaacgaacgcgacgcgaaaaataaaaacaaacgcccattaaacaaaatacaaaaacaaaaacctaccccgaaaaccgaaacccgacgaaacgctaaaaataaacgctccccgcgacccccgacgcccttcgccccgaaacgccccgacccaacgacactaacgcgaccgaaatccaacttcgaaaacacgcccgactaaccgcgaaaaaaacaccaaataaacgcgaccgcgcctcccgaaaccccgctcccgcgcgtcccgcgacgacgcgacgcccacccgccccgaaaaccaaaaacccaaaaccccaccataacgctaaccgccgccgccgccgctacgactaccgaaataaaccaaacgacgatactaaacttcctacaaaaacacgacgaaaaaatacgcaactccgaactactaaaccgcttcaaaccgctactcgataccgacgacccgcgaaaccgcgccgcccgcaaaaaccgcttcaaacaattcgtcaacaacgtaacgataataaaaaaactcgacgacgtcaaattcgtaatactaaaaaaaaaaccccgacccccgaaacccgaacccgcacccttcgaccccccgaaaacaacgacccaaccgtcgaaacccacttcgacgatcttaccgcgaa

SEQ ID NO: 1743 - DNA, 839 bp, Artificial Sequence
  chemically treated genomic DNA (Homo sapiens) CpG-island No: 1743
ggttaaatgtttattaaaggaataaaaatttatttttttttggcggatcgcggcgtttttagggaatatatttatttagtaatcgagattagagttggagcgttgcgtttttaattttggggcgggcggggggcggcgggaatttttgtttcggttttttttgtatcgcgggggtagttgttatttgtaaggcgagcgcggcgcgggggatggaagtaggcgtttattggatagaatataaaggtagaaatttatttcgaaggtcggggttcggcggggcgttgggggtgggcgtttttcgcggttttcggcgtttttcgtttcgagacgtttcggtttagcggtattggcgcgatcgaggtttagtttcggggatacgttcggttggtcgcggggaaggtattaggtgagcgcggtcgcgtttttcggaatttcgttttcgcgcgtttcgcggcgacgcggcgtttattcgtttcgggagttaggaatttagggttttattatggcgttggtcgtcgtcgtcgtcgttgcggttgtcggggtgagttaggcggcggtgttgggttttttgtaggagtacggcgggaaggtgcgtaatttcgagttgttgagtcgttttaagtcgttgttcgatgtcggcgattcgcggggtcgcgtcgttcgtagggatcgttttaagtagttcgttaataacgtggcggtggtgaaggagttcgacggcgttaagttcgtggtgttgaggaagaagtttcggttttcggagttcgagttcgtatttttcggtttttcgggggtagcggtttagtcgtcgaaatttatttcgacggttttgtcgcgga

SEQ ID NO: 1744 - DNA, 839 bp, Artificial Sequence
  chemically treated genomic DNA (Homo sapiens) CpG-island No: 1744
tccgcgacaaaaccgtcgaaataaatttcgacgactaaaccgctacccccgaaaaaccgaaaaatacgaactcgaactccgaaaaccgaaacttcttcctcaacaccacgaacttaacgccgtcgaactccttcaccaccgccacgttattaacgaactacttaaaacgatccctacgaacgacgcgaccccgcgaatcgccgacatcgaacaacgacttaaaacgactcaacaactcgaaattacgcaccttcccgccgtactcctacaaaaaacccaacaccgccgcctaactcaccccgacaaccgcaacgacgacgacgacgaccaacgccataataaaaccctaaattcctaactcccgaaacgaataaacgccgcgtcgccgcgaaacgcgcgaaaacgaaattccgaaaaacgcgaccgcgctcacctaataccttccccgcgaccaaccgaacgtatccccgaaactaaacctcgatcgcgccaataccgctaaaccgaaacgtctcgaaacgaaaaacgccgaaaaccgcgaaaaacgcccacccccaacgccccgccgaaccccgaccttcgaaataaatttctacctttatattctatccaataaacgcctacttccatcccccgcgccgcgctcgccttacaaataacaactacccccgcgatacaaaaaaaaccgaaacaaaaattcccgccgccccccgcccgccccaaaattaaaaacgcaacgctccaactctaatctcgattactaaataaatatattccctaaaaacgccgcgatccgccaaaaaaaaataaatttttattcctttaataaacatttaacc

SEQ ID NO: 1745 - DNA, 759 bp, Artificial Sequence
  chemically treated genomic DNA (Homo sapiens) CpG-island No: 1745
ttttttaacgcgcggattataagttttagtagttttcgtagttggtatttttcgtttcgtcgcggagattttcggtcgtttaagcggcggggtttcggttgcgttcgtggtcgggtcgggcggggaggtcggtttcgcgggcgggggtaggggcggtttcgcggtttttttcgtcgtcgtcgttaaggggagtttttaggaagtggttatattggatttatttagtcgtagtcgttcgggcggagcgcgtttcgtagtcggttggtttttgtcgttgtttttgcgttcgttttagtttattcgttcggtgcggagttcgttatggcggttatcgatttggagcgtttttcggtgagggtttcgttgggttacggcgcgcgcgggaggcgcggggcgtaggaggggtcgttttgtagttggcggggggcgcgaagcgggttgttagcgttttacggtcgggtttcgatatcgggttagttcgaggatttcggcgcgggttttcggtcgcgttatcggggggtttcggagcgtcgggcggtttgttttgtcgggcggttggtcggggtcgttttttggggcgtaggtaaggttaatttttttcgcgggaaggagtaaagattcgtttggtttcgggtaggtgcgaagatagagtggcgttcgcggggtcgtaggtgagggttcgggatatttcggattttatcgtttagggtgtttttttttgtatatttggggaagagttttagtcgtataggtgttgcg

SEQ ID NO: 1746 - DNA, 759 bp, Artificial Sequence
  chemically treated genomic DNA (Homo sapiens) CpG-island No: 1746
cgcaacacctatacgactaaaactcttccccaaatatacaaaaaaaaacaccctaaacgataaaatccgaaatatcccgaaccctcacctacgaccccgcgaacgccactctatcttcgcacctacccgaaaccaaacgaatctttactccttcccgcgaaaaaaattaaccttacctacgccccaaaaaacgaccccgaccaaccgcccgacaaaacaaaccgcccgacgctccgaaaccccccgataacgcgaccgaaaacccgcgccgaaatcctcgaactaacccgatatcgaaacccgaccgtaaaacgctaacaacccgcttcgcgccccccgccaactacaaaacgacccctcctacgccccgcgcctcccgcgcgcgccgtaacccaacgaaaccctcaccgaaaaacgctccaaatcgataaccgccataacgaactccgcaccgaacgaataaactaaaacgaacgcaaaaacaacgacaaaaaccaaccgactacgaaacgcgctccgcccgaacgactacgactaaataaatccaatataaccacttcctaaaaactccccttaacgacgacgacgaaaaaaaccgcgaaaccgcccctacccccgcccgcgaaaccgacctccccgcccgacccgaccacgaacgcaaccgaaaccccgccgcttaaacgaccgaaaatctccgcgacgaaacgaaaaataccaactacgaaaactactaaaacttataatccgcgcgttaaaaaa

SEQ ID NO: 1747 - DNA, 759 bp, Artificial Sequence
  chemically treated genomic DNA (Homo sapiens) CpG-island No: 1747
cgtagtatttgtgcggttaggatttttttttaagtgtgtagaaagaaatattttgggcgatagggttcggagtgtttcggatttttatttgcggtttcgcgggcgttattttattttcgtatttgttcggagttaggcgggtttttgttttttttcgcgaaaggggttagttttgtttgcgttttaggaagcgatttcgattagtcgttcggtaaggtaggtcgttcgacgtttcgggatttttcgatagcgcggtcgagagttcgcgtcggggttttcgagttggttcggtgtcgaggttcggtcgtgaggcgttgatagttcgtttcgcgtttttcgttagttgtagggcggttttttttgcgtttcgcgtttttcgcgcgcgtcgtggtttagcggggtttttatcgagaagcgttttaggtcggtggtcgttatggcgagtttcgtatcgggcgggtgggttgggacgagcgtaggggtagcgatagggattagtcggttgcgggacgcgtttcgttcgggcggttgcggttgaatggatttaatatggttattttttggaaattttttttggcggcggcggcgggagaagtcgcggagtcgtttttgttttcgttcgcgggatcggttttttcgttcggttcggttacgagcgtagtcggagtttcgtcgtttggacggtcgggggttttcgcggcgaggcgggaggtgttagttgcggggattgttgggatttgtagttcgcgcgttggggga

SEQ ID NO: 1748 - DNA, 759 bp, Artificial Sequence
  chemically treated genomic DNA (Homo sapiens) CpG-island No: 1748
tcccccaacgcgcgaactacaaatcccaacaatccccgcaactaacacctcccgcctcgccgcgaaaacccccgaccgtccaaacgacgaaactccgactacgctcgtaaccgaaccgaacgaaaaaaccgatcccgcgaacgaaaacaaaaacgactccgcgacttctcccgccgccgccgccaaaaaaaatttccaaaaaataaccatattaaatccattcaaccgcaaccgcccgaacgaaacgcgtcccgcaaccgactaatccctatcgctacccctacgctcgtcccaacccacccgcccgatacgaaactcgccataacgaccaccgacctaaaacgcttctcgataaaaaccccgctaaaccacgacgcgcgcgaaaaacgcgaaacgcaaaaaaaaccgccctacaactaacgaaaaacgcgaaacgaactatcaacgcctcacgaccgaacctcgacaccgaaccaactcgaaaaccccgacgcgaactctcgaccgcgctatcgaaaaatcccgaaacgtcgaacgacctaccttaccgaacgactaatcgaaatcgcttcctaaaacgcaaacaaaactaacccctttcgcgaaaaaaaacaaaaacccgcctaactccgaacaaatacgaaaataaaataacgcccgcgaaaccgcaaataaaaatccgaaacactccgaaccctatcgcccaaaatatttctttctacacacttaaaaaaaaatcctaaccgcacaaatactacg

SEQ ID NO: 1749 - DNA, 1189 bp, Artificial Sequence
  chemically treated genomic DNA (Homo sapiens) CpG-island No: 1749
aatataggcgcgttgttatttgtgtttattataatgatggtgatttgtgcgttttttgagcgggtaggtagttcgtcgtttcgagttgtaagtattagtaggtgggtggcgcgttgttcgcgatttagtgttttttttaatattaatttcgggtattcgttgtcgttaattcgcgattttatgtttaggcgaaagtgttgattggggtttaggttgtagtttagtattttattgtttttttcgtcgttattttgggtattcgggagagtaaagcgggtttcgggcgttaggaattcggggatgtgtagttgtacgtcgtcggtaggaaagagaggtgagttgttattggtgtttaggacgtgaattcgaattttgtgtagttttagcgggttttcgagtattaggtcgtaggttaagacgtaggtagttttggttttgtatagttgttcgcggttcgtcggttttttgattattaaattgtcgttgggtagatttatttcgaagtagagttcgcggtggttggaaaggaagcgaaagtttcgcgaggatatagcggtcgttggtagttttaagttcgcggagagattgtttacggttacgtttcgtttcgtttttttcggtattgagtattcgagttgtttcgttgtagcgtcgtaggaaatttataaatataaaattgttattttatagtttattattttttttttaggcgtttacgttttattaatacgttatattaacggtgatttaggattatgtttcggatttttggagagtacgagtcgcggggaagagtacgtttttgtcggtcgttattgttgcgggttggatatttagcgatcgtcgacgttgcgtttttcgaacgtcggtattgtcggggttggttagttgggagtcgggtttgttaggttggaggttgggtagtcgtttgggaaagcggagtcggtcgggtgttgaggagcgtagcgtcgtttaggggtgtagagacgaggtcgttcgttcgggcgcgagaggtgttgtttttagtagtagcgggttggggtttcgattataacgttggttgcgggcgtagggcggagtttgggagacgtttcgagatattaatatttttttttttaaacggtgttttttaggataacgttttgaggttgtttagattttaatttttatattttttgttcgtagattg

SEQ ID NO: 1750 - DNA, 1189 bp, Artificial Sequence
  chemically treated genomic DNA (Homo sapiens) CpG-island No: 1750
caatctacgaacaaaaaatataaaaattaaaatctaaacaacctcaaaacgttatcctaaaaaacaccgtttaaaaaaaaaaatattaatatctcgaaacgtctcccaaactccgccctacgcccgcaaccaacgttataatcgaaaccccaacccgctactactaaaaacaacacctctcgcgcccgaacgaacgacctcgtctctacacccctaaacgacgctacgctcctcaacacccgaccgactccgctttcccaaacgactacccaacctccaacctaacaaacccgactcccaactaaccaaccccgacaataccgacgttcgaaaaacgcaacgtcgacgatcgctaaatatccaacccgcaacaataacgaccgacaaaaacgtactcttccccgcgactcgtactctccaaaaatccgaaacataatcctaaatcaccgttaatataacgtattaataaaacgtaaacgcctaaaaaaaaaataataaactataaaataacaattttatatttataaatttcctacgacgctacaacgaaacaactcgaatactcaataccgaaaaaaacgaaacgaaacgtaaccgtaaacaatctctccgcgaacttaaaactaccaacgaccgctatatcctcgcgaaactttcgcttcctttccaaccaccgcgaactctacttcgaaataaatctacccaacgacaatttaataatcaaaaaaccgacgaaccgcgaacaactatacaaaaccaaaactacctacgtcttaacctacgacctaatactcgaaaacccgctaaaactacacaaaattcgaattcacgtcctaaacaccaataacaactcacctctctttcctaccgacgacgtacaactacacatccccgaattcctaacgcccgaaacccgctttactctcccgaatacccaaaataacgacgaaaaaaacaataaaatactaaactacaacctaaaccccaatcaacactttcgcctaaacataaaatcgcgaattaacgacaacgaatacccgaaattaatattaaaaaaaacactaaatcgcgaacaacgcgccacccacctactaatacttacaactcgaaacgacgaactacctacccgctcaaaaaacgcacaaatcaccatcattataataaacacaaataacaacgcgcctatatt

SEQ ID NO: 1751 - DNA, 1189 bp, Artificial Sequence
  chemically treated genomic DNA (Homo sapiens) CpG-island No: 1751
taatttgcgggtagaggatgtggaggttaagatttgggtagttttagggcgttgttttagaaaatatcgtttaaggagagaagtgttagtgtttcggggcgttttttaggtttcgttttgcgttcgtagttagcgttgtggtcgagattttagttcgttgttattggagatagtatttttcgcgttcgggcgggcggtttcgtttttgtatttttaggcggcgttgcgttttttaatattcggtcggtttcgtttttttagacggttgtttagtttttagtttagtaagttcggtttttagttggttagtttcggtaatgtcggcgttcgggaggcgtaacgtcggcggtcgttgagtatttagttcgtagtagtgacggtcggtaggagcgtgttttttttcgcggttcgtgttttttaggagttcggagtatggttttgggttatcgttggtgtagcgtgttggtggaacgtggacgtttagagggaggatggtgggttgtggggtggtagttttatgtttgtgggttttttgcggcgttgtagcgggatagttcgagtatttagtgtcggaggagacggagcggggcgtagtcgtaggtaattttttcgcggatttgaggttgttagcggtcgttatgttttcgcggaattttcgttttttttttagttatcgcgagttttatttcggggtggatttatttagcggtaatttggtggttagagagtcggcggatcgcgaatagttgtgtagggttaaagttgtttgcgttttgatttacgatttggtgttcgaggattcgttggagttgtataagattcggatttacgttttggatattaatgataatttattttttttttttgtcggcgacgtgtagttgtatattttcgagtttttgacgttcggagttcgttttattttttcgaatgtttaagatgacgacgagggaagtaatgggatattaagttatagtttaagttttagttagtattttcgtttggatatgggatcgcgggttgacggtagcgaatattcggagttggtgttggagaaagtattggatcgcgaatagcgcgttatttatttgttggtgtttatagttcgggacggcgggttatttgttcgtttaggagacgtataagttattattattgtggtggatataaatgataacgcgtttgtatt

SEQ ID NO: 1752 - DNA, 1189 bp, Artificial Sequence
  chemically treated genomic DNA (Homo sapiens) CpG-island No: 1752
aatacaaacgcgttatcatttatatccaccacaataataataacttatacgtctcctaaacgaacaaataacccgccgtcccgaactataaacaccaacaaataaataacgcgctattcgcgatccaatactttctccaacaccaactccgaatattcgctaccgtcaacccgcgatcccatatccaaacgaaaatactaactaaaacttaaactataacttaatatcccattacttccctcgtcgtcatcttaaacattcgaaaaaataaaacgaactccgaacgtcaaaaactcgaaaatatacaactacacgtcgccgacaaaaaaaaaaaataaattatcattaatatccaaaacgtaaatccgaatcttatacaactccaacgaatcctcgaacaccaaatcgtaaatcaaaacgcaaacaactttaaccctacacaactattcgcgatccgccgactctctaaccaccaaattaccgctaaataaatccaccccgaaataaaactcgcgataactaaaaaaaaaacgaaaattccgcgaaaacataacgaccgctaacaacctcaaatccgcgaaaaaattacctacgactacgccccgctccgtctcctccgacactaaatactcgaactatcccgctacaacgccgcaaaaaacccacaaacataaaactaccaccccacaacccaccatcctccctctaaacgtccacgttccaccaacacgctacaccaacgataacccaaaaccatactccgaactcctaaaaaacacgaaccgcgaaaaaaaacacgctcctaccgaccgtcactactacgaactaaatactcaacgaccgccgacgttacgcctcccgaacgccgacattaccgaaactaaccaactaaaaaccgaacttactaaactaaaaactaaacaaccgtctaaaaaaacgaaaccgaccgaatattaaaaaacgcaacgccgcctaaaaatacaaaaacgaaaccgcccgcccgaacgcgaaaaatactatctccaataacaacgaactaaaatctcgaccacaacgctaactacgaacgcaaaacgaaacctaaaaaacgccccgaaacactaacacttctctccttaaacgatattttctaaaacaacgccctaaaactacccaaatcttaacctccacatcctctacccgcaaatta

SEQ ID NO: 1753 - DNA, 738 bp, Artificial Sequence
  chemically treated genomic DNA (Homo sapiens) CpG-island No: 1753
tatcgttttataacgtgcgtagacgtcgttttttcgtacggatgttcgcggttcgggtcggggtgggaaggggtttttttacgttttcgtttaggtttggtcgttatttttcggagcgttttttttcgcgagtgttgtagtttcggattttaggcgttcgttagttatagaggttaatttttaattcgcgcggttcgaatttcgggggttttatcgtttgtcggtcgattcgtttatgtcggaggtacggcgggggcggggtttggcggggggcggggttagtattgcggtcgttgtagttgcgtaacggcgttcgttttttcggtcgttttaggggcgcgcgtcgtttttcgtttcgtttaattcgcgcgcgagtttgggcggggagggggagttaggaagttgcgagcgcgttggggagcgtagttgtaggcgttggggcggtaggagtcgcggagtcggcgttgagaggggttgcggtcggagcgggcggttgagataaaggcgacggtgagtgtaatgttagttttagtcgcgcgtcggtcgttacgtttcgttttttcggttttttgggcggggtttcgaagtttcgaattttcgtttttgagggttttggggtgagcgcggttcggttttgttagtcgcgcgttgcgggttgtgggttgagtttgcgttttttattttaggtttgggcgaggtttttatgttttaggattttgtttttggttttttttttgt

SEQ ID NO: 1754 - DNA, 738 bp, Artificial Sequence
  chemically treated genomic DNA (Homo sapiens) CpG-island No: 1754
acaaaaaaaaaaccaaaaacaaaatcctaaaacataaaaacctcgcccaaacctaaaataaaaaacgcaaactcaacccacaacccgcaacgcgcgactaacaaaaccgaaccgcgctcaccccaaaaccctcaaaaacgaaaattcgaaacttcgaaaccccgcccaaaaaaccgaaaaaacgaaacgtaacgaccgacgcgcgactaaaactaacattacactcaccgtcgcctttatctcaaccgcccgctccgaccgcaacccctctcaacgccgactccgcgactcctaccgccccaacgcctacaactacgctccccaacgcgctcgcaacttcctaactccccctccccgcccaaactcgcgcgcgaattaaacgaaacgaaaaacgacgcgcgcccctaaaacgaccgaaaaaacgaacgccgttacgcaactacaacgaccgcaatactaaccccgccccccgccaaaccccgcccccgccgtacctccgacataaacgaatcgaccgacaaacgataaaacccccgaaattcgaaccgcgcgaattaaaaattaacctctataactaacgaacgcctaaaatccgaaactacaacactcgcgaaaaaaaacgctccgaaaaataacgaccaaacctaaacgaaaacgtaaaaaaaccccttcccaccccgacccgaaccgcgaacatccgtacgaaaaaacgacgtctacgcacgttataaaacgata

SEQ ID NO: 1755 - DNA, 738 bp, Artificial Sequence
  chemically treated genomic DNA (Homo sapiens) CpG-island No: 1755
atagaagaaaaattaaaggtagggttttagggtatgaggatttcgtttaaatttgaaatggaagacgtaggtttagtttatagttcgtagcgcgcggttggtaaggtcgggtcgcgtttattttagagtttttagggacgagggttcggggtttcgggatttcgtttaagggatcgagagggcgaggcgtggcggtcgacgcgcgattggggttggtattgtatttatcgtcgtttttgttttagtcgttcgtttcggtcgtagttttttttagcgtcggtttcgcggtttttgtcgttttaacgtttgtagttgcgttttttagcgcgttcgtagttttttggtttttttttttcgtttaggttcgcgcgcgggttgggcggagcgagaggcggcgcgcgtttttagagcggtcggaggggcgggcgtcgttgcgtagttgtagcgatcgtagtgttggtttcgtttttcgttaggtttcgttttcgtcgtattttcggtatgggcgaatcggtcggtaggcgatgggattttcgggattcgagtcgcgcgggttaggaattggtttttgtagttaacggacgtttgagattcgggattgtagtattcgcgggaaaggacgtttcgaaagatggcgattaaatttgggcgggagcgtgggggagtttttttttatttcggttcgggtcgcggatattcgtgcggaggagcgacgtttgcgtacgttgtggggcggtg

SEQ ID NO: 1756 - DNA, 738 bp, Artificial Sequence
  chemically treated genomic DNA (Homo sapiens) CpG-island No: 1756
caccgccccacaacgtacgcaaacgtcgctcctccgcacgaatatccgcgacccgaaccgaaataaaaaaaaactcccccacgctcccgcccaaatttaatcgccatctttcgaaacgtcctttcccgcgaatactacaatcccgaatctcaaacgtccgttaactacaaaaaccaattcctaacccgcgcgactcgaatcccgaaaatcccatcgcctaccgaccgattcgcccataccgaaaatacgacgaaaacgaaacctaacgaaaaacgaaaccaacactacgatcgctacaactacgcaacgacgcccgcccctccgaccgctctaaaaacgcgcgccgcctctcgctccgcccaacccgcgcgcgaacctaaacgaaaaaaaaaaaccaaaaaactacgaacgcgctaaaaaacgcaactacaaacgttaaaacgacaaaaaccgcgaaaccgacgctaaaaaaaactacgaccgaaacgaacgactaaaacaaaaacgacgataaatacaataccaaccccaatcgcgcgtcgaccgccacgcctcgccctctcgatcccttaaacgaaatcccgaaaccccgaaccctcgtccctaaaaactctaaaataaacgcgacccgaccttaccaaccgcgcgctacgaactataaactaaacctacgtcttccatttcaaatttaaacgaaatcctcataccctaaaaccctacctttaatttttcttctat

SEQ ID NO: 1757 - DNA, 535 bp, Artificial Sequence
  chemically treated genomic DNA (Homo sapiens) CpG-island No: 1757
gcgaaggttagtggcgcggtttgggttggggtcgtttcgatcgttttcgatcgacgttatttaggagggtttggggaaggggacgcgaggagttgggaatacgtagcgtcgttttagcgggacgggcgggttcgggttggcgtcgaattcgcgttcgagagtttagttcgcggttaggtcgtcgttttcggagttcgttggggttcggagtttcggttttttacgtttggtcgttattagaataaaagttgtggtttagttcggagtttaggcgtttcgtaggtttggttcgcgtcgggtcgttagtttttttacgtttggcggtcgcgtttttagtttttcggttcgagtacgttcggtttttttcgttacggtcggcgtaggtggagggggcggggcgggggtcgtgcgtggtgacgtcgcgggggggtgacgtatcggcgtgtttcgtttttatttttttttcgtttaggttttggaaagagaagaaaaaaaatttttttttttttttaattgaggaattaatagtcgttat

SEQ ID NO: 1758 - DNA, 535 bp, Artificial Sequence
  chemically treated genomic DNA (Homo sapiens) CpG-island No: 1758
ataacgactattaattcctcaattaaaaaaaaaaaaaaattttttttcttctctttccaaaacctaaacgaaaaaaaaataaaaacgaaacacgccgatacgtcacccccccgcgacgtcaccacgcacgacccccgccccgccccctccacctacgccgaccgtaacgaaaaaaaccgaacgtactcgaaccgaaaaactaaaaacgcgaccgccaaacgtaaaaaaactaacgacccgacgcgaaccaaacctacgaaacgcctaaactccgaactaaaccacaacttttattctaataacgaccaaacgtaaaaaaccgaaactccgaaccccaacgaactccgaaaacgacgacctaaccgcgaactaaactctcgaacgcgaattcgacgccaacccgaacccgcccgtcccgctaaaacgacgctacgtattcccaactcctcgcgtccccttccccaaaccctcctaaataacgtcgatcgaaaacgatcgaaacgaccccaacccaaaccgcgccactaaccttcgc

SEQ ID NO: 1759 - DNA, 535 bp, Artificial Sequence
  chemically treated genomic DNA (Homo sapiens) CpG-island No: 1759
atggcggttgttgattttttaattaaaaaaaaaagaaagtttttttttttttttttttagagtttgaacggggagggggtgggggcggggtacgtcggtgcgttattttttcgcggcgttattacgtacggttttcgtttcgttttttttatttgcgtcggtcgtggcggaaagagtcgagcgtgttcgggtcgaagggttgaaggcgcggtcgttaagcgtagggaagttggcggttcggcgcgggttaggtttgcggggcgtttgggtttcgggttgagttatagtttttgttttgatggcgattaggcgtagagggtcggggtttcgggttttagcgggtttcgggagcggcggtttggtcgcgggttgggttttcgggcgcggattcgacgttagttcgggttcgttcgtttcgttggggcggcgttgcgtgtttttagtttttcgcgtttttttttttagatttttttaggtggcgtcggtcgggaacggtcggggcgattttagtttaggtcgcgttattagttttcgt

SEQ ID NO: 1760 - DNA, 535 bp, Artificial Sequence
  chemically treated genomic DNA (Homo sapiens) CpG-island No: 1760
acgaaaactaataacgcgacctaaactaaaatcgccccgaccgttcccgaccgacgccacctaaaaaaatctaaaaaaaaaaacgcgaaaaactaaaaacacgcaacgccgccccaacgaaacgaacgaacccgaactaacgtcgaatccgcgcccgaaaacccaacccgcgaccaaaccgccgctcccgaaacccgctaaaacccgaaaccccgaccctctacgcctaatcgccatcaaaacaaaaactataactcaacccgaaacccaaacgccccgcaaacctaacccgcgccgaaccgccaacttccctacgcttaacgaccgcgccttcaacccttcgacccgaacacgctcgactctttccgccacgaccgacgcaaataaaaaaaacgaaacgaaaaccgtacgtaataacgccgcgaaaaaataacgcaccgacgtaccccgcccccaccccctccccgttcaaactctaaaaaaaaaaaaaaaaaaactttcttttttttttaattaaaaaatcaacaaccgccat

SEQ ID NO: 1761 - DNA, 1273 bp, Artificial Sequence
  chemically treated genomic DNA (Homo sapiens) CpG-island No: 1761
ttcgtcggtttcgggttttataatcgttcgcgtatttcgtttcgttcggtcggttcgtttcgttcggttttcggcgttcgtttcggcggtttcgttcgtttttcggttcggtttttcggagttcggcggcggcggcggcggtagcggcggcggcggcggcggaacggggggtgggggggtcgcggcggcggcggcgatttcgttcggcgtattgtttttttttacggcggcggcggcggcgggtcgcgggtcgggagcggagttcggagttttttcgtcgtcgggtcgcgagcgaatttattaagtggggcgcggggggggagcgaggcggcggcggcggcggtattatgttttcggggattgtttgagtcgttcggtcgggcgtcgtcgttgttagtcgggttcgggggggcggtcgggtcgtcggggcgtttttatcgcggagtgtcgcgttcgggaggcgggtaggggatgagggggtcgcggtcggcggcggcggcggcggtcgggggcgggcggtgagcgttgcggggcgttgttgttgtggttgagatttggtcgtcgttttttttattcggtttgcgttttttttttttttcggcgttcgttcgttcgttcgcggttcgcgttcgtttttttttttcgtagtcggtagggttttcgattttcgttcgggttttcgtcggttcggtcgttcgtgttcggggttgttttcgcgagtaggtgaaaatggttgagaatttgttggacggatcgtttaattttaaaagagttaaatttagttcgttcggtttttcggcgaatgatagtataggtgaggagggggttcggggcggcgggggttcggggcgcgttgttatttttatttgaaagagagcgttcgggggtcgtggtcgcggatatcgatcgagtcgggagttcggagtaggtttcgtagttcgtttttttcgtttcgcgcgggagggtggaagttcgtcgtaggattgttattgggttcgagttggttagtatacgttcggtgtattcggttttttcgtattcgattagtttttttcgcggggattttagtggtattttaggagggaagaagtaaagtgtagcgtgtgggtttgtttggtaatgttttacgtatttattcgcggtcgtgtttatacgcgtggtcgtttagaggaatgatagcggagggtatttttgatgtttagagaaagtaagatcgcggttaaaggtagggtagtgtgttttttggattggcgatatattgattaggttgtat

SEQ ID NO: 1762 - DNA, 1273 bp, Artificial Sequence
  chemically treated genomic DNA (Homo sapiens) CpG-island No: 1762
atacaacctaatcaatatatcgccaatccaaaaaacacactaccctacctttaaccgcgatcttactttctctaaacatcaaaaataccctccgctatcattcctctaaacgaccacgcgtataaacacgaccgcgaataaatacgtaaaacattaccaaacaaacccacacgctacactttacttcttccctcctaaaataccactaaaatccccgcgaaaaaaactaatcgaatacgaaaaaaccgaatacaccgaacgtatactaaccaactcgaacccaataacaatcctacgacgaacttccaccctcccgcgcgaaacgaaaaaaacgaactacgaaacctactccgaactcccgactcgatcgatatccgcgaccacgacccccgaacgctctctttcaaataaaaataacaacgcgccccgaacccccgccgccccgaaccccctcctcacctatactatcattcgccgaaaaaccgaacgaactaaatttaactcttttaaaattaaacgatccgtccaacaaattctcaaccattttcacctactcgcgaaaacaaccccgaacacgaacgaccgaaccgacgaaaacccgaacgaaaatcgaaaaccctaccgactacgaaaaaaaaaaacgaacgcgaaccgcgaacgaacgaacgaacgccgaaaaaaaaaaaaaacgcaaaccgaataaaaaaaacgacgaccaaatctcaaccacaacaacaacgccccgcaacgctcaccgcccgcccccgaccgccgccgccgccgccgaccgcgaccccctcatcccctacccgcctcccgaacgcgacactccgcgataaaaacgccccgacgacccgaccgcccccccgaacccgactaacaacgacgacgcccgaccgaacgactcaaacaatccccgaaaacataataccgccgccgccgccgcctcgctccccccccgcgccccacttaataaattcgctcgcgacccgacgacgaaaaaactccgaactccgctcccgacccgcgacccgccgccgccgccgccgtaaaaaaaaacaatacgccgaacgaaatcgccgccgccgccgcgacccccccaccccccgttccgccgccgccgccgccgctaccgccgccgccgccgccgaactccgaaaaaccgaaccgaaaaacgaacgaaaccgccgaaacgaacgccgaaaaccgaacgaaacgaaccgaccgaacgaaacgaaatacgcgaacgattataaaacccgaaaccgacgaa

SEQ ID NO: 1763 - DNA, 1273 bp, Artificial Sequence
  chemically treated genomic DNA (Homo sapiens) CpG-island No: 1763
atgtagtttggttaatgtgtcgttaatttagaaaatatattgttttatttttggtcgcgattttgttttttttaagtattaaaggtatttttcgttgttatttttttggacggttacgcgtgtggatacggtcgcggatggatgcgtaggatattattaaataaatttatacgttgtattttatttttttttttttggagtgttattagggttttcgcgaggagggttgatcgggtgcggggaggtcgagtgtatcgggcgtgtgttgattaattcgggtttagtgatagttttgcgacgaatttttattttttcgcgcggggcgaggggaacgggttgcggggtttgtttcgagttttcggttcgatcggtattcgcgattacgattttcggacgtttttttttaggtgggggtgatagcgcgtttcgggttttcgtcgtttcggattttttttttatttgtgttgttattcgtcgagaaatcgggcgagttgagtttggtttttttggggttgggcggttcgtttagtaagtttttagttatttttatttgttcgcgaaaatagtttcgggtacgggcggtcgggtcggcgagggttcggacgggggtcgggggttttgtcggttgcgagggagaggagcgagcgcgggtcgcgagcgggcgggcgggcgtcgagggagagggagggcgtaggtcgggtgggggaggcggcggttaaattttagttatagtaatagcgtttcgtagcgtttatcgttcgttttcggtcgtcgtcgtcgtcgtcggtcgcggtttttttattttttgttcgtttttcgagcgcgatatttcgcggtgggggcgtttcggcggttcggtcgttttttcgggttcggttggtagcgacggcgttcggtcgggcggtttaggtagttttcgagaatatggtgtcgtcgtcgtcgtcgtttcgtttttttttcgcgttttatttaatgaattcgttcgcggttcgacgacgagggggtttcgggtttcgttttcggttcgcggttcgtcgtcgtcgtcgtcgtgaggaaaaataatgcgtcgagcggggtcgtcgtcgtcgtcgcggtttttttatttttcgtttcgtcgtcgtcgtcgtcgttgtcgtcgtcgtcgtcgtcgggtttcgggaggtcgagtcgagaggcgagcggggtcgtcggggcgggcgtcgagggtcgggcggagcgggtcggtcgggcggagcggggtgcgcgggcggttgtggggttcgggatcggcggg

SEQ ID NO: 1764 - DNA, 1273 bp, Artificial Sequence
  chemically treated genomic DNA (Homo sapiens) CpG-island No: 1764
cccgccgatcccgaaccccacaaccgcccgcgcaccccgctccgcccgaccgacccgctccgcccgaccctcgacgcccgccccgacgaccccgctcgcctctcgactcgacctcccgaaacccgacgacgacgacgacgacaacgacgacgacgacgacgaaacgaaaaataaaaaaaccgcgacgacgacgacgaccccgctcgacgcattatttttcctcacgacgacgacgacgacgaaccgcgaaccgaaaacgaaacccgaaaccccctcgtcgtcgaaccgcgaacgaattcattaaataaaacgcgaaaaaaaaacgaaacgacgacgacgacgacaccatattctcgaaaactacctaaaccgcccgaccgaacgccgtcgctaccaaccgaacccgaaaaaacgaccgaaccgccgaaacgcccccaccgcgaaatatcgcgctcgaaaaacgaacaaaaaataaaaaaaccgcgaccgacgacgacgacgacgaccgaaaacgaacgataaacgctacgaaacgctattactataactaaaatttaaccgccgcctcccccacccgacctacgccctccctctccctcgacgcccgcccgcccgctcgcgacccgcgctcgctcctctccctcgcaaccgacaaaacccccgacccccgtccgaaccctcgccgacccgaccgcccgtacccgaaactattttcgcgaacaaataaaaataactaaaaacttactaaacgaaccgcccaaccccaaaaaaaccaaactcaactcgcccgatttctcgacgaataacaacacaaataaaaaaaaaatccgaaacgacgaaaacccgaaacgcgctatcacccccacctaaaaaaaaacgtccgaaaatcgtaatcgcgaataccgatcgaaccgaaaactcgaaacaaaccccgcaacccgttcccctcgccccgcgcgaaaaaataaaaattcgtcgcaaaactatcactaaacccgaattaatcaacacacgcccgatacactcgacctccccgcacccgatcaaccctcctcgcgaaaaccctaataacactccaaaaaaaaaaaaataaaatacaacgtataaatttatttaataatatcctacgcatccatccgcgaccgtatccacacgcgtaaccgtccaaaaaaataacaacgaaaaatacctttaatacttaaaaaaaacaaaatcgcgaccaaaaataaaacaatatattttctaaattaacgacacattaaccaaactacat

SEQ ID NO: 1765 - DNA, 543 bp, Artificial Sequence
  chemically treated genomic DNA (Homo sapiens) CpG-island No: 1765
tgacgcgtaggtcgatttttaagggaatttatttattagttttcgtatagttcgttttttttatttttcgagaagggattttttttttttttttgagcggagtcgattgcggttggagaaattcgtttcgacgtttttaatttattgtggttagagtatttacggtcggtaacgtagaatacgggtaatttgtttatatagcgcgcgaaaggttgattttttaatttgcgcgggttttttgcggtttcgtttagaggatgtgacgttaacgcgtatttcgtaattcggtttcgttttttgcggtttttaattcgtagggttgcgttttgagtttttcgtttcgttgggtagatagcggtttattgttatacgattttagtcgttgttgtcggttcgaatttcgtgcggttttttgagggcgcgagtggtattggcgttgatggtcgatggtgagtatcgtttcggaagttgggagcgtttatattcgtcggggttgttgggcgttgtagtttttttttggttgtagttttagttttggaggtt

SEQ ID NO: 1766 - DNA, 543 bp, Artificial Sequence
  chemically treated genomic DNA (Homo sapiens) CpG-island No: 1766
aacctccaaaactaaaactacaaccaaaaaaaaactacaacgcccaacaaccccgacgaatataaacgctcccaacttccgaaacgatactcaccatcgaccatcaacgccaataccactcgcgccctcaaaaaaccgcacgaaattcgaaccgacaacaacgactaaaatcgtataacaataaaccgctatctacccaacgaaacgaaaaactcaaaacgcaaccctacgaattaaaaaccgcaaaaaacgaaaccgaattacgaaatacgcgttaacgtcacatcctctaaacgaaaccgcaaaaaacccgcgcaaattaaaaaatcaacctttcgcgcgctatataaacaaattacccgtattctacgttaccgaccgtaaatactctaaccacaataaattaaaaacgtcgaaacgaatttctccaaccgcaatcgactccgctcaaaaaaaaaaaaaaaatcccttctcgaaaaataaaaaaaacgaactatacgaaaactaataaataaattcccttaaaaatcgacctacgcgtca

SEQ ID NO: 1767 - DNA, 543 bp, Artificial Sequence
  chemically treated genomic DNA (Homo sapiens) CpG-island No: 1767
agtttttagaattggggttgtagttaggagggaattataacgtttagtagtttcggcgggtgtaaacgtttttaattttcgaggcggtgtttattatcggttattagcgttagtgttattcgcgtttttaagaagtcgtacggagttcgggtcggtagtagcggttggagtcgtatggtagtgagtcgttgtttatttagcgagacggagagtttaggacgtaattttacgagttggaagtcgtaggaggcggaatcgggttgcgggatacgcgttgacgttatattttttgggcggggtcgtaaggaattcgcgtaaattgaaaggttagtttttcgcgcgttgtgtaggtaagttgttcgtgttttgcgttgtcggtcgtgggtgttttggttatagtgagttaggggcgtcggagcgggtttttttaatcgtaatcggtttcgtttaaggggaggaggagagttttttttcggaaggtgagaggagcgggttgtgcggaggttaatgggtgggtttttttgggggtcgatttgcgcgtta

SEQ ID NO: 1768 - DNA, 543 bp, Artificial Sequence
  chemically treated genomic DNA (Homo sapiens) CpG-island No: 1768
taacgcgcaaatcgacccccaaaaaaacccacccattaacctccgcacaacccgctcctctcaccttccgaaaaaaaactctcctcctccccttaaacgaaaccgattacgattaaaaaaacccgctccgacgcccctaactcactataaccaaaacacccacgaccgacaacgcaaaacacgaacaacttacctacacaacgcgcgaaaaactaacctttcaatttacgcgaattccttacgaccccgcccaaaaaatataacgtcaacgcgtatcccgcaacccgattccgcctcctacgacttccaactcgtaaaattacgtcctaaactctccgtctcgctaaataaacaacgactcactaccatacgactccaaccgctactaccgacccgaactccgtacgacttcttaaaaacgcgaataacactaacgctaataaccgataataaacaccgcctcgaaaattaaaaacgtttacacccgccgaaactactaaacgttataattccctcctaactacaaccccaattctaaaaact

SEQ ID NO: 1769 - DNA, 640 bp, Artificial Sequence
  chemically treated genomic DNA (Homo sapiens) CpG-island No: 1769
gtacgcgggtaattgagattttcggtaacgttttttgtttttttaagttcgtttttagttatttagagttcgacgtaggtttagttaaatttcgttttcgatttcgtttcgagtcgttaagacgttttcggtggttcgtttttagattgaggtaatgcgtatgtttagcgtcgtatcgcgtacgcgttttttgcggttttttttgatttttgattcgtcgattacgtttgattttcggtcgcggggttaggaagtcggagtttgagtttcggaggtagagcggttgttatggtgagtttcgagtcgggcgttatcggggaggggaagtcgagtcgggtcgggggtcgggggtcgggcggcgagtttcgggttgggcggcgggcgtcgtgcgttttttgcgtgttcggcgggaagtatggtttgggggcgttgtattcgggggaatcgaggtcggtagcggcggtatcggcggttttagggttagggaaaatcgtttgtttggaagaggtcgggtaaacgtggtcgcgttgtgtttagttcgcgtgtgagcgagtagtcgtgggtagcggtggagtatgagtttggttggtgagcgttttttttgttttggaattttatagcgttgtagagtcgatgttgt

SEQ ID NO: 1770 - DNA, 640 bp, Artificial Sequence
  chemically treated genomic DNA (Homo sapiens) CpG-island No: 1770
acaacatcgactctacaacgctataaaattccaaaacaaaaaaaacgctcaccaaccaaactcatactccaccgctacccacgactactcgctcacacgcgaactaaacacaacgcgaccacgtttacccgacctcttccaaacaaacgattttccctaaccctaaaaccgccgataccgccgctaccgacctcgattcccccgaatacaacgcccccaaaccatacttcccgccgaacacgcaaaaaacgcacgacgcccgccgcccaacccgaaactcgccgcccgacccccgacccccgacccgactcgacttcccctccccgataacgcccgactcgaaactcaccataacaaccgctctacctccgaaactcaaactccgacttcctaaccccgcgaccgaaaatcaaacgtaatcgacgaatcaaaaatcaaaaaaaaccgcaaaaaacgcgtacgcgatacgacgctaaacatacgcattacctcaatctaaaaacgaaccaccgaaaacgtcttaacgactcgaaacgaaatcgaaaacgaaatttaactaaacctacgtcgaactctaaataactaaaaacgaacttaaaaaaacaaaaaacgttaccgaaaatctcaattacccgcgtac

SEQ ID NO: 1771 - DNA, 640 bp, Artificial Sequence
  chemically treated genomic DNA (Homo sapiens) CpG-island No: 1771
gtaatatcgattttgtagcgttgtaaggttttagggtaggggaggcgtttattagttagatttatgttttatcgttgtttacggttgttcgtttatacgcgggttaggtatagcgcgattacgtttgttcggttttttttaggtagacggttttttttggttttgaggtcgtcggtgtcgtcgttgtcggtttcgattttttcgggtgtaacgtttttagattatgtttttcgtcgggtacgtagggggcgtacggcgttcgtcgtttagttcggagttcgtcgttcggttttcggttttcggttcgattcggtttttttttttcggtagcgttcgattcggggtttattatggtagtcgttttgttttcggggtttaaatttcgattttttggtttcgcggtcggggattaagcgtggtcggcgggttagaggttaaggaaagtcgtagagagcgcgtgcgcgatacggcgttgggtatgcgtattgttttagtttaagggcgggttatcgggagcgttttagcggttcggggcggggtcggaggcggggtttgattgagtttgcgtcgggttttggataattgggggcgggtttgggagggtaaggggcgttatcgggagttttaattgttcgcgtgt

SEQ ID NO: 1772 - DNA, 640 bp, Artificial Sequence
  chemically treated genomic DNA (Homo sapiens) CpG-island No: 1772
acacgcgaacaattaaaactcccgataacgccccttaccctcccaaacccgcccccaattatccaaaacccgacgcaaactcaatcaaaccccgcctccgaccccgccccgaaccgctaaaacgctcccgataacccgcccttaaactaaaacaatacgcatacccaacgccgtatcgcgcacgcgctctctacgactttccttaacctctaacccgccgaccacgcttaatccccgaccgcgaaaccaaaaaatcgaaatttaaaccccgaaaacaaaacgactaccataataaaccccgaatcgaacgctaccgaaaaaaaaaaaccgaatcgaaccgaaaaccgaaaaccgaacgacgaactccgaactaaacgacgaacgccgtacgccccctacgtacccgacgaaaaacataatctaaaaacgttacacccgaaaaaatcgaaaccgacaacgacgacaccgacgacctcaaaaccaaaaaaaaccgtctacctaaaaaaaaccgaacaaacgtaatcgcgctatacctaacccgcgtataaacgaacaaccgtaaacaacgataaaacataaatctaactaataaacgcctcccctaccctaaaaccttacaacgctacaaaatcgatattac

SEQ ID NO: 1773 - DNA, 766 bp, Artificial Sequence
  chemically treated genomic DNA (Homo sapiens) CpG-island No: 1773
cgcgtagggcgcgtcgcgtttttttttgattttcgatttcgacgagattatcgtggacgaaaatagcgacgattcgatcgtgcgcgtcgcgtcgggttagcggttttcggagagtttgcgagttatttatcgcgagggtttttataacgagtatatgtagcgcgtttttaagtatttgggcgagtagggcgtgcggtcgcgggatttgagcgttatttacgaagttatttttttgtcgttaggtatgagcgatttgttgtagtttgtggtaaaatagggcgtttgtttcgaggtgatttttattttcgatgttaatatttttggcgtggagagttcgttgcgcgtcgtcggttattatagtttgtttcgtcgtatttttagtaattcgtcggggtcggatgcgcggggattgttggttttgcggtcgttttatatatatagttgcgcgcgttgtttcgttaatatgtgtaagtataaggtgtttagcgattatttgcgcgagcgggtttacgacggcgtgtatttcgagcgttttttttacgtgggcgacggcgttaacgatttttgttttatggggttgttggcgggcggcgacgtggttttttcgcgtcgcggttattttatgtatcgttttatttaggaggtttagaaggtcgagtttagttcgtttcgcgttagcgtggtgttttgggaaacggttgtagatgtgcgtttttatttgtaataggtgttgaagtcgtgttgagtttggtcgtttgtagggggg

SEQ ID NO: 1774 - DNA, 766 bp, Artificial Sequence
  chemically treated genomic DNA (Homo sapiens) CpG-island No: 1774
cccccctacaaacgaccaaactcaacacgacttcaacacctattacaaataaaaacgcacatctacaaccgtttcccaaaacaccacgctaacgcgaaacgaactaaactcgaccttctaaacctcctaaataaaacgatacataaaataaccgcgacgcgaaaaaaccacgtcgccgcccgccaacaaccccataaaacaaaaatcgttaacgccgtcgcccacgtaaaaaaaacgctcgaaatacacgccgtcgtaaacccgctcgcgcaaataatcgctaaacaccttatacttacacatattaacgaaacaacgcgcgcaactatatatataaaacgaccgcaaaaccaacaatccccgcgcatccgaccccgacgaattactaaaaatacgacgaaacaaactataataaccgacgacgcgcaacgaactctccacgccaaaaatattaacatcgaaaataaaaatcacctcgaaacaaacgccctattttaccacaaactacaacaaatcgctcatacctaacgacaaaaaaataacttcgtaaataacgctcaaatcccgcgaccgcacgccctactcgcccaaatacttaaaaacgcgctacatatactcgttataaaaaccctcgcgataaataactcgcaaactctccgaaaaccgctaacccgacgcgacgcgcacgatcgaatcgtcgctattttcgtccacgataatctcgtcgaaatcgaaaatcaaaaaaaaacgcgacgcgccctacgcg

SEQ ID NO: 1775 - DNA, 766 bp, Artificial Sequence
  chemically treated genomic DNA (Homo sapiens) CpG-island No: 1775
tttttttgtaggcggttagatttagtacgattttagtatttgttgtaggtggaggcgtatatttgtagtcgttttttagggtattacgttggcgcggaacgagttgggttcggttttttgggttttttgaatgaggcggtgtatggggtagtcgcggcgcgggaaggttacgtcgtcgttcgttagtagttttatggggtagaagtcgttggcgtcgtcgtttacgtagaagaggcgttcgaagtgtacgtcgtcgtgggttcgttcgcgtaggtagtcgttgagtattttgtgtttgtatatgttggcggggtagcgcgcgtagttgtgtgtgtggaacggtcgtagagttagtagttttcgcgtattcggtttcgacgggttgttgaggatgcggcggaataggttgtggtggtcggcggcgcgtagcgagttttttacgttaaaggtgttggtatcggagatgagaattatttcgaagtaggcgttttgttttgttataaattgtagtaggtcgtttatgtttggcgataaagggatggtttcgtagatggcgtttaggtttcgcggtcgtacgttttgttcgtttaggtatttgaagacgcgttgtatgtattcgttgtagaagttttcgcggtaggtggttcgtaggtttttcgggagtcgttggttcggcgcggcgcgtacgatcgaatcgtcgttgttttcgtttacgatagtttcgtcgaagtcgaaggttaggaggaagcgcggcgcgttttgcgcg

SEQ ID NO: 1776 - DNA, 766 bp, Artificial Sequence
  chemically treated genomic DNA (Homo sapiens) CpG-island No: 1776
cgcgcaaaacgcgccgcgcttcctcctaaccttcgacttcgacgaaactatcgtaaacgaaaacaacgacgattcgatcgtacgcgccgcgccgaaccaacgactcccgaaaaacctacgaaccacctaccgcgaaaacttctacaacgaatacatacaacgcgtcttcaaatacctaaacgaacaaaacgtacgaccgcgaaacctaaacgccatctacgaaaccatccctttatcgccaaacataaacgacctactacaatttataacaaaacaaaacgcctacttcgaaataattctcatctccgataccaacacctttaacgtaaaaaactcgctacgcgccgccgaccaccacaacctattccgccgcatcctcaacaacccgtcgaaaccgaatacgcgaaaactactaactctacgaccgttccacacacacaactacgcgcgctaccccgccaacatatacaaacacaaaatactcaacgactacctacgcgaacgaacccacgacgacgtacacttcgaacgcctcttctacgtaaacgacgacgccaacgacttctaccccataaaactactaacgaacgacgacgtaaccttcccgcgccgcgactaccccatacaccgcctcattcaaaaaacccaaaaaaccgaacccaactcgttccgcgccaacgtaataccctaaaaaacgactacaaatatacgcctccacctacaacaaatactaaaatcgtactaaatctaaccgcctacaaaaaaa

SEQ ID NO: 1777 - DNA, 598 bp, Artificial Sequence
  chemically treated genomic DNA (Homo sapiens) CpG-island No: 1777
ttggcgcggtcggcgtttagtataaagcgcgtttttttcgtggggcggggtcgggagtcgggaaggggagggggacgggggaggggagggttcggttcggagattttcgcgcgcgtttagacgtcgtagtttagacgtcgtagttaggggcgggggttttttgtttgggcgcgtttttcgtaggtttcgcgtatcgttttcgtttttttggcgtcgttttttatcgtcgggggtttcgggggttttaggtttgcgcgagcggttggcggggttcgggggtcgcgttttttttttttcgggtttgcggcggtgacggtttcgtttttttttttcgggtggttgcggtcggttcggggggcgttatcgagacgggggcggaggcgggggcgggggttggggtttcggggtttttgattgttttcgtgttttttacggtttttcgtcggtttcgattgttttcgtttcgcgttttcgttcgttttttcgcggagttcgtcgttcgttggtgcgcgtttttatggcgaggtttttagggcgttcggagtatcggagataaaagagttgggggagggggattggggggtttttcggtgttttt

SEQ ID NO: 1778 - DNA, 598 bp, Artificial Sequence
  chemically treated genomic DNA (Homo sapiens) CpG-island No: 1778
aaaaacaccgaaaaaccccccaatccccctcccccaactcttttatctccgatactccgaacgccctaaaaacctcgccataaaaacgcgcaccaacgaacgacgaactccgcgaaaaaacgaacgaaaacgcgaaacgaaaacaatcgaaaccgacgaaaaaccgtaaaaaacacgaaaacaatcaaaaaccccgaaaccccaacccccgcccccgcctccgcccccgtctcgataacgccccccgaaccgaccgcaaccacccgaaaaaaaaaaacgaaaccgtcaccgccgcaaacccgaaaaaaaaaaaacgcgacccccgaaccccgccaaccgctcgcgcaaacctaaaacccccgaaacccccgacgataaaaaacgacgccaaaaaaacgaaaacgatacgcgaaacctacgaaaaacgcgcccaaacaaaaaacccccgcccctaactacgacgtctaaactacgacgtctaaacgcgcgcgaaaatctccgaaccgaaccctcccctcccccgtccccctccccttcccgactcccgaccccgccccacgaaaaaaacgcgctttatactaaacgccgaccgcgccaa

SEQ ID NO: 1779 - DNA, 598 bp, Artificial Sequence
  chemically treated genomic DNA (Homo sapiens) CpG-island No: 1779
ggaggtatcgggagattttttagttttttttttttagtttttttgttttcgatgtttcgggcgttttgggagtttcgttatggaaacgcgtattagcgagcggcgggtttcgcggaggggcgggcggaggcgcggggcgggggtagtcggagtcggcgagagatcgtgagagatacggagatagttagagatttcgaaattttaattttcgttttcgttttcgttttcgtttcgatggcgtttttcgggtcgatcgtagttattcgggaggggaggacgggatcgttatcgtcgtaggttcgaagggaggaggacgcgattttcgagtttcgttagtcgttcgcgtagatttgagattttcgagattttcggcggtgggaggcggcgttagggaggcggggacggtgcgcggggtttgcggaggacgcgtttagataaagagttttcgtttttggttgcggcgtttgggttgcggcgtttgggcgcgcgcgggggttttcgggtcggatttttttttttttcgtttttttttttttttcggttttcggtttcgttttacggaggagacgcgttttgtgttgggcgtcggtcgcgttag

SEQ ID NO: 1780 - DNA, 598 bp, Artificial Sequence
  chemically treated genomic DNA (Homo sapiens) CpG-island No: 1780
ctaacgcgaccgacgcccaacacaaaacgcgtctcctccgtaaaacgaaaccgaaaaccgaaaaaaaaaaaaaaacgaaaaaaaaaaaaatccgacccgaaaacccccgcgcgcgcccaaacgccgcaacccaaacgccgcaaccaaaaacgaaaactctttatctaaacgcgtcctccgcaaaccccgcgcaccgtccccgcctccctaacgccgcctcccaccgccgaaaatctcgaaaatctcaaatctacgcgaacgactaacgaaactcgaaaatcgcgtcctcctcccttcgaacctacgacgataacgatcccgtcctcccctcccgaataactacgatcgacccgaaaaacgccatcgaaacgaaaacgaaaacgaaaacgaaaattaaaatttcgaaatctctaactatctccgtatctctcacgatctctcgccgactccgactacccccgccccgcgcctccgcccgcccctccgcgaaacccgccgctcgctaatacgcgtttccataacgaaactcccaaaacgcccgaaacatcgaaaacaaaaaaactaaaaaaaaaaaactaaaaaatctcccgatacctcc

SEQ ID NO: 1781 - DNA, 1018 bp, Artificial Sequence
  chemically treated genomic DNA (Homo sapiens) CpG-island No: 1781
cgttcgtcgattcgtttagttgtcggaggttaaataaatagttttcgaagtagcgtttggtatagcgtagggtcggaacgtggatattaattttcgtttacgtttttcgcgttttggcgggattattatagatacgacgtttattgttggggttttcggcgatgttcgtgtgcgtagtttcgcgagttttaggttagaagattattaatttcgcggtcgcgttttacgaagttaaggggtaaaaaattagtttttttgggataaagcgtttttttagtagttagggtcgatttcggcgttgttttcgcggcgtttggttgtttcgggcgtaacgggttacgagaagtagggggtggggcgtcgtttaggtttgggaagatacgaagcggtttttcgggtttttagcgtttattttttacggtaagtaggaggagataagcgttattttgcgttcgcggagtcgatttcggtttttttttttcgtggtcgtaggggtcgtgtgtgtgtgtgtgtgagtgtgtgtgtgtgtgtagggacgtttcgcgtttattattttgtttcggtgttaatcgatcgtcgtggcgtcgatttttttcgttttttagttttttattcgcgtgtttcggaaggcgttcggaggttttcgggtcgtcgcgttacgttttcgggaggttgagggaaagggaggtagtcgagtcgggagttcggggaggcgcgttgcgtttcgcggcggggttgggggcggggttaggtgtttcgcgtagggggcggggcgcggtgacgtcgcgggcgtttgggtcgtgttgtggcggcggcggcggcggtagtggcggcggcggcggtgtttgggcggtagtagtagtagtagcggtagttttgaggacggtgagacggtcgcggcggcggcgatagcgcggaagtcgcgcgggatttagagttttttttttgtcgttagtgttgaggttttcgttttttttatttagttttttgtttacggttcgggttgggttgggtaggg

SEQ ID NO: 1782 - DNA, 1018 bp, Artificial Sequence
  chemically treated genomic DNA (Homo sapiens) CpG-island No: 1782
ccctacccaacccaacccgaaccgtaaacaaaaaactaaataaaaaaaacgaaaacctcaacactaacgacaaaaaaaaaactctaaatcccgcgcgacttccgcgctatcgccgccgccgcgaccgtctcaccgtcctcaaaactaccgctactactactactaccgcccaaacaccgccgccgccgccactaccgccgccgccgccgccacaacacgacccaaacgcccgcgacgtcaccgcgccccgccccctacgcgaaacacctaaccccgcccccaaccccgccgcgaaacgcaacgcgcctccccgaactcccgactcgactacctccctttccctcaacctcccgaaaacgtaacgcgacgacccgaaaacctccgaacgccttccgaaacacgcgaataaaaaactaaaaaacgaaaaaaatcgacgccacgacgatcgattaacaccgaaacaaaataataaacgcgaaacgtccctacacacacacacacactcacacacacacacacacgacccctacgaccacgaaaaaaaaaaaccgaaatcgactccgcgaacgcaaaataacgcttatctcctcctacttaccgtaaaaaataaacgctaaaaacccgaaaaaccgcttcgtatcttcccaaacctaaacgacgccccaccccctacttctcgtaacccgttacgcccgaaacaaccaaacgccgcgaaaacaacgccgaaatcgaccctaactactaaaaaaacgctttatcccaaaaaaactaattttttaccccttaacttcgtaaaacgcgaccgcgaaattaataatcttctaacctaaaactcgcgaaactacgcacacgaacatcgccgaaaaccccaacaataaacgtcgtatctataataatcccgccaaaacgcgaaaaacgtaaacgaaaattaatatccacgttccgaccctacgctataccaaacgctacttcgaaaactatttatttaacctccgacaactaaacgaatcgacgaacg

SEQ ID NO: 1783 - DNA, 1018 bp, Artificial Sequence
  chemically treated genomic DNA (Homo sapiens) CpG-island No: 1783
ttttgtttagtttagttcgggtcgtgagtaagaagttgggtaggaaaggcgaaagttttagtattagcgataggggggaagttttgggtttcgcgcgattttcgcgttgtcgtcgtcgtcgcggtcgttttatcgtttttagggttgtcgttattgttgttgttgtcgtttaggtatcgtcgtcgtcgttattatcgtcgtcgtcgtcgttatagtacggtttaggcgttcgcgacgttatcgcgtttcgttttttgcgcgagatatttagtttcgtttttagtttcgtcgcggggcgtagcgcgttttttcgggttttcggttcggttgttttttttttttttagtttttcgggagcgtgacgcggcggttcgggggttttcgggcgtttttcggggtacgcgggtgaggaattgggaagcgggggaaatcggcgttacggcggtcgattagtatcgaaatagagtgatgggcgcggagcgtttttgtatatatatatatatttatatatatatatatacgatttttgcggttacgggaggggagagtcggggtcggtttcgcgagcgtagggtggcgtttgtttttttttgtttgtcgtaggaagtggacgttggaagttcgaggagtcgtttcgtgtttttttaaatttaagcggcgttttattttttatttttcgtggttcgttacgttcggggtagttaagcgtcgcgggagtagcgtcgggatcgattttggttgttggggggacgttttgttttaagaaagttggttttttgttttttagtttcgtggaacgcggtcgcgaaattagtggttttttgatttgagattcgcggggttgcgtatacgggtatcgtcgaggattttagtaatggacgtcgtgtttgtggtgatttcgttaggacgcggggagcgtgggcggaaattagtgtttacgtttcgattttgcgttgtgttaaacgttgtttcgggagttgtttatttagttttcgatagttaagcgaatcggcgggcg

SEQ ID NO: 1784 - DNA, 1018 bp, Artificial Sequence
  chemically treated genomic DNA (Homo sapiens) CpG-island No: 1784
cgcccgccgattcgcttaactatcgaaaactaaataaacaactcccgaaacaacgtttaacacaacgcaaaatcgaaacgtaaacactaatttccgcccacgctccccgcgtcctaacgaaatcaccacaaacacgacgtccattactaaaatcctcgacgatacccgtatacgcaaccccgcgaatctcaaatcaaaaaaccactaatttcgcgaccgcgttccacgaaactaaaaaacaaaaaaccaactttcttaaaacaaaacgtccccccaacaaccaaaatcgatcccgacgctactcccgcgacgcttaactaccccgaacgtaacgaaccacgaaaaataaaaaataaaacgccgcttaaatttaaaaaaacacgaaacgactcctcgaacttccaacgtccacttcctacgacaaacaaaaaaaaacaaacgccaccctacgctcgcgaaaccgaccccgactctcccctcccgtaaccgcaaaaatcgtatatatatatatataaatatatatatatatacaaaaacgctccgcgcccatcactctatttcgatactaatcgaccgccgtaacgccgatttcccccgcttcccaattcctcacccgcgtaccccgaaaaacgcccgaaaacccccgaaccgccgcgtcacgctcccgaaaaactaaaaaaaaaaaaaacaaccgaaccgaaaacccgaaaaaacgcgctacgccccgcgacgaaactaaaaacgaaactaaatatctcgcgcaaaaaacgaaacgcgataacgtcgcgaacgcctaaaccgtactataacgacgacgacgacgataataacgacgacgacgatacctaaacgacaacaacaacaataacgacaaccctaaaaacgataaaacgaccgcgacgacgacgacaacgcgaaaatcgcgcgaaacccaaaacttcccccctatcgctaatactaaaactttcgcctttcctacccaacttcttactcacgacccgaactaaactaaacaaaa

SEQ ID NO: 1785 - DNA, 641 bp, Artificial Sequence
  chemically treated genomic DNA (Homo sapiens) CpG-island No: 1785
gggtgtacgttgaattcgattagagtttcgagtcgcggggttgggcggcgcggtttacggagaagtggggttgtcgttagtatcgcgttattcgggcggtgggaggtggagcggtttcgttatttggaagacgaaggtcgtcgaagttaggtttttatgtttttcgagttttttcggttcggtttttcggtttaaatgtaattgaacgtttttagagttttggcgggtatatttcgaggtcggaatttcgggatacgttagtagcgtttcgagttcgggcggggggtcggttttcggcgtcgtcgtttgtagaggcgttcgtagaaaaagtatagaaagtaatagtttagtttagaaatggcgacgcgcggagtttttgttttttcgtaaaaggggtcggggcggttacgggcgaggggttcgggtcgggaggagggacgcgagggatacgggggtttcggatttgggtcggttttgcgcgtagattgagttttcgttagcgttgtgggttttttagcgcggattcgcggtagggaggggaaaaggggagggggaagagaagtaggaggagaggatggggcggaggagaggcggggggcgggggagggtaagcggggggcgtcgttatttttttattttat

SEQ ID NO: 1786 - DNA, 641 bp, Artificial Sequence
  chemically treated genomic DNA (Homo sapiens) CpG-island No: 1786
ataaaataaaaaaataacgacgccccccgcttaccctcccccgccccccgcctctcctccgccccatcctctcctcctacttctcttccccctccccttttcccctccctaccgcgaatccgcgctaaaaaacccacaacgctaacgaaaactcaatctacgcgcaaaaccgacccaaatccgaaacccccgtatccctcgcgtccctcctcccgacccgaacccctcgcccgtaaccgccccgaccccttttacgaaaaaacaaaaactccgcgcgtcgccatttctaaactaaactattactttctatactttttctacgaacgcctctacaaacgacgacgccgaaaaccgaccccccgcccgaactcgaaacgctactaacgtatcccgaaattccgacctcgaaatatacccgccaaaactctaaaaacgttcaattacatttaaaccgaaaaaccgaaccgaaaaaactcgaaaaacataaaaacctaacttcgacgaccttcgtcttccaaataacgaaaccgctccacctcccaccgcccgaataacgcgatactaacgacaaccccacttctccgtaaaccgcgccgcccaaccccgcgactcgaaactctaatcgaattcaacgtacaccc

SEQ ID NO: 1787 - DNA, 641 bp, Artificial Sequence
  chemically treated genomic DNA (Homo sapiens) CpG-island No: 1787
gtgggatgaaagggtagcggcgtttttcgtttgttttttttcgtttttcgtttttttttcgttttattttttttttttatttttttttttttttttttttttttttttttgtcgcgggttcgcgttaaggggtttatagcgttggcggaggtttagtttgcgcgtaggatcggtttaagttcggggttttcgtgtttttcgcgttttttttttcggttcgggtttttcgttcgtggtcgtttcggttttttttgcggagaggtagagatttcgcgcgtcgttatttttggattaggttgttgttttttgtgttttttttgcgggcgtttttgtaaacggcggcgtcggggatcgatttttcgttcgggttcggggcgttgttggcgtgtttcggggtttcggtttcgaggtgtgttcgttagggttttggaggcgtttagttgtatttgggtcgggggatcgggtcggaggggttcggaggatatgagagtttggtttcggcggttttcgttttttaggtaacggggtcgttttattttttatcgttcgggtagcgcggtgttaacggtagttttattttttcgtgggtcgcgtcgtttagtttcgcggttcgaggttttggtcgggtttagcgtgtattt

SEQ ID NO: 1788 - DNA, 641 bp, Artificial Sequence
  chemically treated genomic DNA (Homo sapiens) CpG-island No: 1788
aaatacacgctaaacccgaccaaaacctcgaaccgcgaaactaaacgacgcgacccacgaaaaaataaaactaccgttaacaccgcgctacccgaacgataaaaaataaaacgaccccgttacctaaaaaacgaaaaccgccgaaaccaaactctcatatcctccgaacccctccgacccgatcccccgacccaaatacaactaaacgcctccaaaaccctaacgaacacacctcgaaaccgaaaccccgaaacacgccaacaacgccccgaacccgaacgaaaaatcgatccccgacgccgccgtttacaaaaacgcccgcaaaaaaaacacaaaaaacaacaacctaatccaaaaataacgacgcgcgaaatctctacctctccgcaaaaaaaaccgaaacgaccacgaacgaaaaacccgaaccgaaaaaaaaaacgcgaaaaacacgaaaaccccgaacttaaaccgatcctacgcgcaaactaaacctccgccaacgctataaaccccttaacgcgaacccgcgacaaaaaaaaaaaaaaaaaaaaaaaaaaaaaaataaaaaaaaaaaataaaacgaaaaaaaaacgaaaaacgaaaaaaaacaaacgaaaaacgccgctaccctttcatcccac

SEQ ID NO: 1789 - DNA, 1428 bp, Artificial Sequence
  chemically treated genomic DNA (Homo sapiens) CpG-island No: 1789
ttttcgcgcgtatttatacgtcgatttatatttataatcgcgatagcgacgcgattttcggggggtatttgtttttttttcgttttcgttattgtcgttattcggataagttttttttttgggtttttcgttaattcggttatcgcgttggggagggggtttcggcgtagggcgcgtaaggttgttcggttaagtttttcggaacgttgggcgtcgggttcgtcgttttttttcgcgtcggtttttagcgcgtttcgaaatagtcggtttgttaattttaaagggtcgtttcgtatattaaagcgcgcggttcgttcggtcgtttcggtttcggtatttattattgattttcgcgcgcgttcggcggcgagatttcgtaggcgtttttggtaggggttcggtttcggttttcggttcggttcgcggcggtagtttcgggttttttcgggtcggtcgcggcgtcggggaatatggggagtcgtgcggcgggggagggggtgcgggaaataataatttcgggtttagagcgaaagttatcggtcggggagggggaacggcgcgtttcgtcgttttttttatgtaaaagattcgagcgggttttcgttttcgttcggttcggtttttaacgtaggttttgtttttagtagttattcggcgtattaaatgtttttcgggcgtttttaataaaaattgcgttgtggatttaattgtgtattttaaaggcgcgagtcgagcgtacggttttgaaagggaggtacgcgtcggtcgcgtttcgggtcgtttttcgtagtttcgttatcgtttcgtagggtcgtttcgttcgcgtttttttttaggttcggttttcgtttggtcgggttttttttcgtttttcgcgtttacgtcgcggttcggcgcgatttcgttttttgtaagaggggggttttttttgaagcggtttcgttggggtcgagtttttatttttattttttatagtagggttttcggcgggcgtttcggtcgtcgggcggtttcgaaatttatcgttttgaggggttatttttatttttcggttttcgggttgttattgagttgttaggattttattaaagcgtagtcggttttagtcgattttttcgggttaggttcgcggagttagtgatttcgtcgcgttaattatagtcgcgttcggtcggttcgcgtcgttcgttttaaagggatagcgtttcgcgttcgtttcgtttcgtttcggttcgttttcgtcgtacgtttcgttttcgcgttaattttttttcggtttttttttcgttttttgttagtttttcgcggtttcgagggcgtttttagttcgagttttgatttttttttttaagtttttcggtttttttgttttcgttttttttttttgtttgttttcgtttttttcggttttggaatgtaatagttttt

SEQ ID NO: 1790 - DNA, 1428 bp, Artificial Sequence
  chemically treated genomic DNA (Homo sapiens) CpG-island No: 1790
aaaaactattacattccaaaaccgaaaaaaacgaaaacaaacaaaaaaaaaaaacgaaaacaaaaaaaccgaaaaacttaaaaaaaaaaatcaaaactcgaactaaaaacgccctcgaaaccgcgaaaaactaacaaaaaacgaaaaaaaaaccgaaaaaaaattaacgcgaaaacgaaacgtacgacgaaaacgaaccgaaacgaaacgaaacgaacgcgaaacgctatccctttaaaacgaacgacgcgaaccgaccgaacgcgactataattaacgcgacgaaatcactaactccgcgaacctaacccgaaaaaatcgactaaaaccgactacgctttaataaaatcctaacaactcaataacaacccgaaaaccgaaaaataaaaataacccctcaaaacgataaatttcgaaaccgcccgacgaccgaaacgcccgccgaaaaccctactataaaaaataaaaataaaaactcgaccccaacgaaaccgcttcaaaaaaaacccccctcttacaaaaaacgaaatcgcgccgaaccgcgacgtaaacgcgaaaaacgaaaaaaaacccgaccaaacgaaaaccgaacctaaaaaaaaacgcgaacgaaacgaccctacgaaacgataacgaaactacgaaaaacgacccgaaacgcgaccgacgcgtacctccctttcaaaaccgtacgctcgactcgcgcctttaaaatacacaattaaatccacaacgcaatttttattaaaaacgcccgaaaaacatttaatacgccgaataactactaaaaacaaaacctacgttaaaaaccgaaccgaacgaaaacgaaaacccgctcgaatcttttacataaaaaaaacgacgaaacgcgccgttccccctccccgaccgataactttcgctctaaacccgaaattattatttcccgcaccccctcccccgccgcacgactccccatattccccgacgccgcgaccgacccgaaaaaacccgaaactaccgccgcgaaccgaaccgaaaaccgaaaccgaacccctaccaaaaacgcctacgaaatctcgccgccgaacgcgcgcgaaaatcaataataaataccgaaaccgaaacgaccgaacgaaccgcgcgctttaatatacgaaacgaccctttaaaattaacaaaccgactatttcgaaacgcgctaaaaaccgacgcgaaaaaaaacgacgaacccgacgcccaacgttccgaaaaacttaaccgaacaaccttacgcgccctacgccgaaaccccctccccaacgcgataaccgaattaacgaaaaacccaaaaaaaaaacttatccgaataacgacaataacgaaaacgaaaaaaaaacaaataccccccgaaaatcgcgtcgctatcgcgattataaatataaatcgacgtataaatacgcgcgaaaa

SEQ ID NO: 1791 - DNA, 1428 bp, Artificial Sequence
  chemically treated genomic DNA (Homo sapiens) CpG-island No: 1791
agaaattgttgtattttagagtcggggagagcgagggtaggtagggggaggaggcgggagtaaagaggtcggagaatttaaaagaagaaattagaattcgggttgagaacgttttcggggtcgcggggggttggtagggggcggaggagaggtcggggaagggttaacgcgggagcggagcgtgcggcgggggcgggtcggggcggggcggggcgggcgcggggcgttgtttttttaaggcgggcggcgcgggtcggtcgagcgcggttgtgattggcgcggcgggattattggtttcgcgagtttggttcgggggagtcggttggagtcggttgcgttttgataaggttttggtaatttagtaatagttcgagagtcgggaaataaaaataattttttagagcgatggatttcggggtcgttcggcggtcgaggcgttcgtcgaaggttttgttgtaaaaggtgggggtggaagttcggttttagcggagtcgttttaaagaaagttttttttttatagggggcgaggtcgcgtcgagtcgcggcgtgggcgcggggggcgggagggggttcggttaggcggaggtcgggtttggaggggggcgcgggcggggcggttttgcggagcggtggcggggttgcggggggcggttcggggcgcggtcggcgcgtattttttttttaggatcgtgcgttcggttcgcgtttttgaagtgtatagttaaatttatagcgtagtttttgttggaagcgttcggaggatatttggtgcgtcgagtgattgttggaaataggatttgcgttgaaagtcgggtcgggcgggggcggaggttcgttcggattttttgtataaaaggggcggcggggcgcgtcgtttttttttttcggtcggtggttttcgttttgaattcgggattgttgtttttcgtattttttttttcgtcgtacgattttttatgtttttcgacgtcgcggtcggttcgggggggttcggggttgtcgtcgcgagtcgagtcgggggtcggggtcgggtttttgttaggggcgtttgcgaggtttcgtcgtcgagcgcgcgcggggattaatggtgagtgtcgaggtcgaggcggtcgggcggatcgcgcgttttgatgtgcggggcggttttttgaagttggtaggtcggttatttcggggcgcgttaggggtcggcgcggaggggagcggcggattcggcgtttagcgtttcggggggtttggtcgggtagttttgcgcgttttgcgtcggagttttttttttagcgcggtgatcgggttggcggggggtttagagaggagatttattcgagtggcggtagtggcgggggcggagagggggtagatatttttcgggggtcgcgtcgttgtcgcggttatggatgtgagtcggcgtgtgagtgcgcgcgggag

SEQ ID NO: 1792 - DNA, 1428 bp, Artificial Sequence
  chemically treated genomic DNA (Homo sapiens) CpG-island No: 1792
ctcccgcgcgcactcacacgccgactcacatccataaccgcgacaacgacgcgacccccgaaaaatatctaccccctctccgcccccgccactaccgccactcgaataaatctcctctctaaaccccccgccaacccgatcaccgcgctaaaaaaaaaactccgacgcaaaacgcgcaaaactacccgaccaaaccccccgaaacgctaaacgccgaatccgccgctcccctccgcgccgacccctaacgcgccccgaaataaccgacctaccaacttcaaaaaaccgccccgcacatcaaaacgcgcgatccgcccgaccgcctcgacctcgacactcaccattaatccccgcgcgcgctcgacgacgaaacctcgcaaacgcccctaacaaaaacccgaccccgacccccgactcgactcgcgacgacaaccccgaacccccccgaaccgaccgcgacgtcgaaaaacataaaaaatcgtacgacgaaaaaaaaaatacgaaaaacaacaatcccgaattcaaaacgaaaaccaccgaccgaaaaaaaaaaacgacgcgccccgccgccccttttatacaaaaaatccgaacgaacctccgcccccgcccgacccgactttcaacgcaaatcctatttccaacaatcactcgacgcaccaaatatcctccgaacgcttccaacaaaaactacgctataaatttaactatacacttcaaaaacgcgaaccgaacgcacgatcctaaaaaaaaaatacgcgccgaccgcgccccgaaccgccccccgcaaccccgccaccgctccgcaaaaccgccccgcccgcgcccccctccaaacccgacctccgcctaaccgaaccccctcccgccccccgcgcccacgccgcgactcgacgcgacctcgccccctataaaaaaaaaactttctttaaaacgactccgctaaaaccgaacttccacccccaccttttacaacaaaaccttcgacgaacgcctcgaccgccgaacgaccccgaaatccatcgctctaaaaaattatttttatttcccgactctcgaactattactaaattaccaaaaccttatcaaaacgcaaccgactccaaccgactcccccgaaccaaactcgcgaaaccaataatcccgccgcgccaatcacaaccgcgctcgaccgacccgcgccgcccgccttaaaaaaacaacgccccgcgcccgccccgccccgccccgacccgcccccgccgcacgctccgctcccgcgttaacccttccccgacctctcctccgccccctaccaaccccccgcgaccccgaaaacgttctcaacccgaattctaatttcttcttttaaattctccgacctctttactcccgcctcctccccctacctaccctcgctctccccgactctaaaatacaacaatttct

SEQ ID NO: 1793 - DNA, 1036 bp, Artificial Sequence
  chemically treated genomic DNA (Homo sapiens) CpG-island No: 1793
gcgttttaattttttttcggcgcggttcggagtttttcggcgtatttttggggtttagatcgtcgggttgtttcgttcgttcgtttcgtacgggtcggtattttttcgttcgtttgtcgtttcgaggttttcgcgggtcgcgttcggtagggttcgcgtcgttttcggtcgttgcggtttttatcgttgtcgtcgatgatgagtagtttgaagaggtggtcgtagtttcgggttatggcgggcgggggcggtgcgcgcgggcgggcggggtcggtattggtttcgcgattcgtagtttttttcgggttgtttcggtagcggcggatttatttttcgaataaatagtcggaattgatagaaatattttttttcgttttttttttttttttttagtagtcgtcgtcgttattatcgtttttttttttttcgtttcgttttattattgcgtaggcgtagcgtttggtatcgttttgcgtagtcgtagtttgagtcggtcgcgttcgggtcgcgtacgcgttttgacggagttttagtaagcgcgggttcgtttttttcgcgttttttcggggagcgtcgtcgtcgttattttgggcgttgagagtttgcggagtcgagtcgttgtcgagttttagcggaaagaagtttaaggtgtcggagaagttcggtcgtggacgttgttgtttttttattttcgagattcgtacgttttgcggagaggaaatgataggtacgtcgcgatcgtggggcggggttcgtacgagtttcgggtttttagaggtaggggtcggggtcgtagaaggtagagtcgcgcggggaaggttcggtatttcgtttttttcgtatcgatttttttttcgcggagttggtttcggtttcgggtttgtggagtggacgtcgagggcggcgggcggttttcgagttggatagaacgggagttgtcggcgggagtagagttgcgaggaggtggtttttgagggtagcgcggggtcgaaattttattttagcgttgtgattttttggagtttatattgttttt

SEQ ID NO: 1794 - DNA, 1036 bp, Artificial Sequence
  chemically treated genomic DNA (Homo sapiens) CpG-island No: 1794
aaaaacaatataaactccaaaaaatcacaacgctaaaataaaatttcgaccccgcgctaccctcaaaaaccacctcctcgcaactctactcccgccgacaactcccgttctatccaactcgaaaaccgcccgccgccctcgacgtccactccacaaacccgaaaccgaaaccaactccgcgaaaaaaaaatcgatacgaaaaaaacgaaataccgaaccttccccgcgcgactctaccttctacgaccccgacccctacctctaaaaacccgaaactcgtacgaaccccgccccacgatcgcgacgtacctatcatttcctctccgcaaaacgtacgaatctcgaaaataaaaaaacaacaacgtccacgaccgaacttctccgacaccttaaacttctttccgctaaaactcgacaacgactcgactccgcaaactctcaacgcccaaaataacgacgacgacgctccccgaaaaaacgcgaaaaaaacgaacccgcgcttactaaaactccgtcaaaacgcgtacgcgacccgaacgcgaccgactcaaactacgactacgcaaaacgataccaaacgctacgcctacgcaataataaaacgaaacgaaaaaaaaaaaaacgataataacgacgacgactactaaaaaaaaaaaaaaaaaacgaaaaaaaatatttctatcaattccgactatttattcgaaaaataaatccgccgctaccgaaacaacccgaaaaaaactacgaatcgcgaaaccaataccgaccccgcccgcccgcgcgcaccgcccccgcccgccataacccgaaactacgaccacctcttcaaactactcatcatcgacgacaacgataaaaaccgcaacgaccgaaaacgacgcgaaccctaccgaacgcgacccgcgaaaacctcgaaacgacaaacgaacgaaaaaataccgacccgtacgaaacgaacgaacgaaacaacccgacgatctaaaccccaaaaatacgccgaaaaactccgaaccgcgccgaaaaaaaattaaaacgc

SEQ ID NO: 1795 - DNA, 1036 bp, Artificial Sequence
  chemically treated genomic DNA (Homo sapiens) CpG-island No: 1795
agaggtaatgtgggttttaagaggttatagcgttgggatgggatttcgatttcgcgttgtttttaaaggttattttttcgtagttttgttttcgtcggtagttttcgttttgtttaattcggaagtcgttcgtcgttttcggcgtttattttataggttcggggtcggggttagtttcgcgggggaggggtcggtgcggaaggggcggggtatcgggtttttttcgcgcgattttgttttttacggtttcggtttttgtttttggaaattcggagttcgtgcgagtttcgttttacggtcgcggcgtgtttgttatttttttttcgtagggcgtgcgggtttcgaagatgagggagtaataacgtttacgatcgggttttttcggtattttgggttttttttcgttgggattcgatagcggttcggtttcgtaagtttttagcgtttagggtggcggcgacgacgtttttcgaggagacgcgaggaagacgggttcgcgtttgttgggatttcgttagggcgcgtgcgcgattcgggcgcggtcggtttaggttgcggttgcgtaaggcggtgttagacgttgcgtttgcgtagtggtggggcggggcgggaaggagggaggcggtggtagcggcggcggttgttgaggaggaggagggggagcggagggaggtgtttttgttagtttcggttgtttgttcgggaagtggattcgtcgttgtcggagtagttcgaagggagttgcggatcgcgaggttagtatcgatttcgttcgttcgcgcgtatcgttttcgttcgttatggttcgggattacgattatttttttaagttgtttattatcggcgatagcggtgagggtcgtagcggtcggaggcggcgcgggttttgtcgggcgcggttcgcgggggtttcggggcggtaggcgggcggggaggtgtcggttcgtgcggggcgggcgggcggggtagttcggcggtttgggttttaggggtgcgtcgaggggtttcggatcgcgtcgaggggaggttggggcgt

SEQ ID NO: 1796 - DNA, 1036 bp, Artificial Sequence
  chemically treated genomic DNA (Homo sapiens) CpG-island No: 1796
acgccccaacctcccctcgacgcgatccgaaacccctcgacgcacccctaaaacccaaaccgccgaactaccccgcccgcccgccccgcacgaaccgacacctccccgcccgcctaccgccccgaaacccccgcgaaccgcgcccgacaaaacccgcgccgcctccgaccgctacgaccctcaccgctatcgccgataataaacaacttaaaaaaataatcgtaatcccgaaccataacgaacgaaaacgatacgcgcgaacgaacgaaatcgatactaacctcgcgatccgcaactcccttcgaactactccgacaacgacgaatccacttcccgaacaaacaaccgaaactaacaaaaacacctccctccgctccccctcctcctcctcaacaaccgccgccgctaccaccgcctccctccttcccgccccgccccaccactacgcaaacgcaacgtctaacaccgccttacgcaaccgcaacctaaaccgaccgcgcccgaatcgcgcacgcgccctaacgaaatcccaacaaacgcgaacccgtcttcctcgcgtctcctcgaaaaacgtcgtcgccgccaccctaaacgctaaaaacttacgaaaccgaaccgctatcgaatcccaacgaaaaaaaacccaaaataccgaaaaaacccgatcgtaaacgttattactccctcatcttcgaaacccgcacgccctacgaaaaaaaaataacaaacacgccgcgaccgtaaaacgaaactcgcacgaactccgaatttccaaaaacaaaaaccgaaaccgtaaaaaacaaaatcgcgcgaaaaaaacccgataccccgccccttccgcaccgacccctcccccgcgaaactaaccccgaccccgaacctataaaataaacgccgaaaacgacgaacgacttccgaattaaacaaaacgaaaactaccgacgaaaacaaaactacgaaaaaataacctttaaaaacaacgcgaaatcgaaatcccatcccaacgctataacctcttaaaacccacattacctct

SEQ ID NO: 1797 - DNA, 1007 bp, Artificial Sequence
  chemically treated genomic DNA (Homo sapiens) CpG-island No: 1797
tcgcggcgttatttttattttttttcgggatcgcgtttatttttaaagttatacgtcgacgaattaatttatgttttaaatttttttttttagtttcgtgagttcgcggcgatattgggtcgtggggtggttgggaacggttttttttttcggaaaaattagagaacggtttggagagttgaaacgagcgttcgcgagtaggttcgtgtagaatcgggttttaggatcgttgagtttcgtagggcgtttttgggggacgttaggtcgtcggtttttttgttttcgttgagatggataacgtttcgttttcggagttttggttcgttaacgtatcgggttcggattcggcgttgagttgttttaacgcgtcgattttggcgtcgttgtcggcgtcgttggcggtggttgtattagttgtttacgcggtgatttgcgtcgtgggtttggcgggtaatttcgtcgtgttgtacgtgttgttgcgggcgtttcgtatgaagatcgttattaatttgtttatttttaatttggttatcgtcgacgagttttttacgttggtgttgtttattaatatcgtcgattttttgttgcggtagtggtttttcggggagtttatgtgtaagtttatcgtggttatcgattagtataatattttttttagtttttatttttttatcgttatgagcgtcgatcgttatttggtggtgttggttattgcggagtcgcgtcgggtggtcggtcgtatttatagcgtcgcgcgcgcggtgagtttggtcgtgtgggggatcgttatattcgtcgtgttgtttttcgtagttttcgttcggttagacgacgagtagggtcggcgttagtgcgtgttagttttttcgtagttcgaggttttttggtggcgcgcgagtcgtttttatacgttcgtgttgggtttcgttattttcgtgtttattatttgtgttttttatattattttgttgtgtcggttgtatgttatgcggttggatagttacgtt

SEQ ID NO: 1798 - DNA, 1007 bp, Artificial Sequence
  chemically treated genomic DNA (Homo sapiens) CpG-island No: 1798
aacgtaactatccaaccgcataacatacaaccgacacaacaaaataatataaaaaacacaaataataaacacgaaaataacgaaacccaacacgaacgtataaaaacgactcgcgcgccaccaaaaaacctcgaactacgaaaaaactaacacgcactaacgccgaccctactcgtcgtctaaccgaacgaaaactacgaaaaacaacacgacgaatataacgatcccccacacgaccaaactcaccgcgcgcgcgacgctataaatacgaccgaccacccgacgcgactccgcaataaccaacaccaccaaataacgatcgacgctcataacgataaaaaaataaaaactaaaaaaaatattatactaatcgataaccacgataaacttacacataaactccccgaaaaaccactaccgcaacaaaaaatcgacgatattaataaacaacaccaacgtaaaaaactcgtcgacgataaccaaattaaaaataaacaaattaataacgatcttcatacgaaacgcccgcaacaacacgtacaacacgacgaaattacccgccaaacccacgacgcaaatcaccgcgtaaacaactaatacaaccaccgccaacgacgccgacaacgacgccaaaatcgacgcgttaaaacaactcaacgccgaatccgaacccgatacgttaacgaaccaaaactccgaaaacgaaacgttatccatctcaacgaaaacaaaaaaaccgacgacctaacgtcccccaaaaacgccctacgaaactcaacgatcctaaaacccgattctacacgaacctactcgcgaacgctcgtttcaactctccaaaccgttctctaatttttccgaaaaaaaaaaccgttcccaaccaccccacgacccaatatcgccgcgaactcacgaaactaaaaaaaaaaatttaaaacataaattaattcgtcgacgtataactttaaaaataaacgcgatcccgaaaaaaaataaaaataacgccgcga

SEQ ID NO: 1799 - DNA, 1007 bp, Artificial Sequence
  chemically treated genomic DNA (Homo sapiens) CpG-island No: 1799
ggcgtggttgtttagtcgtatggtatgtagtcggtatagtagggtggtatagaggatatagatggtggatacggggatggcgaagtttagtacgagcgtgtagaggcggttcgcgcgttattagaaggtttcgggttgcggaaagattagtacgtattggcgtcggttttgttcgtcgtttagtcgggcgaagattgcgaagggtagtacgacgagtgtgacgattttttatacggttaggtttatcgcgcgcgcggcgttgtaggtgcggtcggttattcggcgcgatttcgtagtggttaatattattaggtagcggtcggcgtttatgacggtgaggaagtagaggttggagaaggtgttgtattggtcgatagttacgatgagtttgtatatgagtttttcgaagggttattgtcgtagtaggaagtcggcgatgttgatgggtagtattagcgtgaagagttcgtcggcgatggttaggttgaggatgaataggttggtgacggtttttatgcggggcgttcgtagtaatacgtatagtacggcggagttgttcgttagatttacggcgtagattatcgcgtagataattggtatagttatcgttagcggcgtcggtagcggcgttagagtcgacgcgttggagtagtttagcgtcgggttcgggttcgatgcgttggcgggttagggtttcgagaacgaggcgttgtttattttaacgagggtagaggagtcggcgatttggcgttttttaaggacgttttacggagtttagcggttttgaagttcggttttgtacggatttgttcgcggacgttcgttttagttttttaagtcgttttttggttttttcggaggaggggatcgtttttagttattttacggtttaatgtcgtcgcggatttacggggttggaaagaggaatttaaagtataggttagttcgtcgacgtgtaattttagaaataggcgcggtttcgaggaggggtgggggtggcgtcgcgg

SEQ ID NO: 1800 - DNA, 1007 bp, Artificial Sequence
  chemically treated genomic DNA (Homo sapiens) CpG-island No: 1800
ccgcgacgccacccccacccctcctcgaaaccgcgcctatttctaaaattacacgtcgacgaactaacctatactttaaattcctctttccaaccccgtaaatccgcgacgacattaaaccgtaaaataactaaaaacgatcccctcctccgaaaaaaccaaaaaacgacttaaaaaactaaaacgaacgtccgcgaacaaatccgtacaaaaccgaacttcaaaaccgctaaactccgtaaaacgtccttaaaaaacgccaaatcgccgactcctctaccctcgttaaaataaacaacgcctcgttctcgaaaccctaacccgccaacgcatcgaacccgaacccgacgctaaactactccaacgcgtcgactctaacgccgctaccgacgccgctaacgataactataccaattatctacgcgataatctacgccgtaaatctaacgaacaactccgccgtactatacgtattactacgaacgccccgcataaaaaccgtcaccaacctattcatcctcaacctaaccatcgccgacgaactcttcacgctaatactacccatcaacatcgccgacttcctactacgacaataacccttcgaaaaactcatatacaaactcatcgtaactatcgaccaatacaacaccttctccaacctctacttcctcaccgtcataaacgccgaccgctacctaataatattaaccactacgaaatcgcgccgaataaccgaccgcacctacaacgccgcgcgcgcgataaacctaaccgtataaaaaatcgtcacactcgtcgtactacccttcgcaatcttcgcccgactaaacgacgaacaaaaccgacgccaatacgtactaatctttccgcaacccgaaaccttctaataacgcgcgaaccgcctctacacgctcgtactaaacttcgccatccccgtatccaccatctatatcctctataccaccctactataccgactacataccatacgactaaacaaccacgcc

SEQ ID NO: 1801 - DNA, 788 bp, Artificial Sequence
  chemically treated genomic DNA (Homo sapiens) CpG-island No: 1801
ttgtcgttgtcgttgttgttgttgttgtcgtcgtcgggcgggtagcgttttacggggcgggttgcgtttcgttgtcgtcgcgacgttttttgttgttgttgttgttgtcggcggtcgttttttgtagtcgtattttatgattttcggtttcgcggtagttttagtagtagcggcggcgacggcggttgttgttgttgtaggggtcgaggcggcggttttatatcgcgcgtcgcgtaattcggcgagtttttttttgtttttttcggtttttttcggtttatcgggtcggtagcgtttcgtttcgggttttcggtcgcgttttttcgtttcgttttttgtcggcgtttgacgcgcgcgggtatttgttcgtttcgttcgcgcgggattcgtcggttcgcgggtttttttagcgacgtttaggtggcgtcggcggttttaatttttgttttgttttacgttttgcgggcggttgcgcgcgtcgtttgcggaggcggttggcgtattttttacggttttggttgttttatcgcgcggttacgtttttagttttgtatttatttcggggtgcggtttcgtttttagtttcgtttagagttggggtgtggttacgtttttagttttcgtatttcggggtgtggtttcgtattcggtttcgtttttatttcggacggagcgcggtttcgtttatcgtttgttgtttatttttaggcgcggtttcgtttttagttatttggaagtcggggcgcgttttagagttttgttgtcgtatttttggtggtgtttggggt

SEQ ID NO: 1802 - DNA, 788 bp, Artificial Sequence
  chemically treated genomic DNA (Homo sapiens) CpG-island No: 1802
accccaaacaccaccaaaaatacgacaacaaaactctaaaacgcgccccgacttccaaataactaaaaacgaaaccgcgcctaaaaataaacaacaaacgataaacgaaaccgcgctccgtccgaaataaaaacgaaaccgaatacgaaaccacaccccgaaatacgaaaactaaaaacgtaaccacaccccaactctaaacgaaactaaaaacgaaaccgcaccccgaaataaatacaaaactaaaaacgtaaccgcgcgataaaacaaccaaaaccgtaaaaaatacgccaaccgcctccgcaaacgacgcgcgcaaccgcccgcaaaacgtaaaacaaaacaaaaattaaaaccgccgacgccacctaaacgtcgctaaaaaaacccgcgaaccgacgaatcccgcgcgaacgaaacgaacaaatacccgcgcgcgtcaaacgccgacaaaaaacgaaacgaaaaaacgcgaccgaaaacccgaaacgaaacgctaccgacccgataaaccgaaaaaaaccgaaaaaaacaaaaaaaaactcgccgaattacgcgacgcgcgatataaaaccgccgcctcgacccctacaacaacaacaaccgccgtcgccgccgctactactaaaactaccgcgaaaccgaaaatcataaaatacgactacaaaaaacgaccgccgacaacaacaacaacaacaaaaaacgtcgcgacgacaacgaaacgcaacccgccccgtaaaacgctacccgcccgacgacgacaacaacaacaacaacgacaacgacaa

SEQ ID NO: 1803 - DNA, 788 bp, Artificial Sequence
  chemically treated genomic DNA (Homo sapiens) CpG-island No: 1803
gttttagatattattagagatgcggtaatagaattttgaggcgcgtttcggtttttaagtagttgggggcggggtcgcgtttggaggtgagtagtaggcggtgggcggggtcgcgtttcgttcgaggtgagagcgaggtcgggtgcgaggttatatttcgaggtacgagagttgagggcgtggttatattttagttttgagcgaggttgagggcggaatcgtatttcgaagtgggtgtaaggttgggggcgtggtcgcgcggtgaggtagttaggatcgtgagggatgcgttagtcgttttcgtaggcggcgcgcgtagtcgttcgtagggcgtgaggtagagtaggggttaaggtcgtcggcgttatttgggcgtcgttgaggagattcgcgagtcggcgaatttcgcgcgggcggggcgaataggtgttcgcgcgcgttaggcgtcggtaaggggcggggcgaggggacgcggtcggaagttcggggcggggcgttgtcggttcggtgagtcgggaggagtcggggaaggtaggaaggagttcgtcgggttgcgcggcgcgcgatgtggagtcgtcgtttcggtttttgtagtagtagtagtcgtcgtcgtcgtcgttgttgttggggttgtcgcggagtcgggggttatggagtgcggttgtagagagcggtcgtcggtaatagtagtagtagtaggaagcgtcgcggcgatagcggagcgtagttcgtttcgtgaggcgttgttcgttcggcggcggtagtagtagtagtagcggtagcggtaa

SEQ ID NO: 1804 - DNA, 788 bp, Artificial Sequence
  chemically treated genomic DNA (Homo sapiens) CpG-island No: 1804
ttaccgctaccgctactactactactaccgccgccgaacgaacaacgcctcacgaaacgaactacgctccgctatcgccgcgacgcttcctactactactactattaccgacgaccgctctctacaaccgcactccataacccccgactccgcgacaaccccaacaacaacgacgacgacgacgactactactactacaaaaaccgaaacgacgactccacatcgcgcgccgcgcaacccgacgaactccttcctaccttccccgactcctcccgactcaccgaaccgacaacgccccgccccgaacttccgaccgcgtcccctcgccccgccccttaccgacgcctaacgcgcgcgaacacctattcgccccgcccgcgcgaaattcgccgactcgcgaatctcctcaacgacgcccaaataacgccgacgaccttaacccctactctacctcacgccctacgaacgactacgcgcgccgcctacgaaaacgactaacgcatccctcacgatcctaactacctcaccgcgcgaccacgcccccaaccttacacccacttcgaaatacgattccgccctcaacctcgctcaaaactaaaatataaccacgccctcaactctcgtacctcgaaatataacctcgcacccgacctcgctctcacctcgaacgaaacgcgaccccgcccaccgcctactactcacctccaaacgcgaccccgcccccaactacttaaaaaccgaaacgcgcctcaaaattctattaccgcatctctaataatatctaaaac

SEQ ID NO: 1805 - DNA, 562 bp, Artificial Sequence
  chemically treated genomic DNA (Homo sapiens) CpG-island No: 1805
tcgggtagttttcgggtattagttaagttcggacgcggtaaacggaagggttttatattttttgaagtatgcgtatcggggtcgggtcgtacgtttgcgggttttcgagcgcgggttatgttcgttttttgtttgggtttggtggcgacgttttagaattagcgaagtcggatagcgtttgttgtatgggatttgttcgcgcgggtcggggacgttagtcgggagttttcgtcgtcgtcgtcgtttttattttttttcgggggtttcggggagttagaattggcgttagaggaggagttggcgttgttggcggtcggggagcggtcgttcgatttcggggaatattttttaggtcgagtttgggtttttggtcgagggggtcggatcgtagtcgtcgtttttttaggatttcgagttgttgtcggtgattcgatagaaggagaaggatttggtgttggcggttcggttgggtaaggcgttgttcgagaggaattaggatatgagtcggtagtacgagtagatgtataaggagttgatagataagttcgaggtgaggattttt

SEQ ID NO: 1806 - DNA, 562 bp, Artificial Sequence
  chemically treated genomic DNA (Homo sapiens) CpG-island No: 1806
aaaaatcctcacctcgaacttatctatcaactccttatacatctactcgtactaccgactcatatcctaattcctctcgaacaacgccttacccaaccgaaccgccaacaccaaatccttctccttctatcgaatcaccgacaacaactcgaaatcctaaaaaaacgacgactacgatccgaccccctcgaccaaaaacccaaactcgacctaaaaaatattccccgaaatcgaacgaccgctccccgaccgccaacaacgccaactcctcctctaacgccaattctaactccccgaaacccccgaaaaaaaataaaaacgacgacgacgacgaaaactcccgactaacgtccccgacccgcgcgaacaaatcccatacaacaaacgctatccgacttcgctaattctaaaacgtcgccaccaaacccaaacaaaaaacgaacataacccgcgctcgaaaacccgcaaacgtacgacccgaccccgatacgcatacttcaaaaaatataaaacccttccgtttaccgcgtccgaacttaactaatacccgaaaactacccga

SEQ ID NO: 1807 - DNA, 562 bp, Artificial Sequence
  chemically treated genomic DNA (Homo sapiens) CpG-island No: 1807
ggaggtttttatttcgagtttgtttgttagttttttatgtatttgttcgtattgtcggtttatgttttggtttttttcgagtagcgttttatttagtcgggtcgttaatattagatttttttttttttgtcggattatcgatagtagttcggggttttgggagggcggcggttgcggttcggttttttcggttagagatttaggttcggtttggagggtgtttttcggggtcggacggtcgtttttcggtcgttagtagcgttagttttttttttaacgttagttttagtttttcggagttttcgggggaagatgaaggcggcggcggcggcgaggattttcgattggcgttttcggttcgcgcgggtaagttttatgtagtaggcgttgttcggtttcgttggttttgaagcgtcgttattaagtttaggtagaaagcggatatggttcgcgttcgggaattcgtagacgtgcggttcggtttcggtgcgtatgttttagggggtatggggttttttcgtttgtcgcgttcgggtttggttggtgttcgaaggttgttcgg

SEQ ID NO: 1808 - DNA, 562 bp, Artificial Sequence
  chemically treated genomic DNA (Homo sapiens) CpG-island No: 1808
ccgaacaaccttcgaacaccaaccaaacccgaacgcgacaaacgaaaaaaccccataccccctaaaacatacgcaccgaaaccgaaccgcacgtctacgaattcccgaacgcgaaccatatccgctttctacctaaacttaataacgacgcttcaaaaccaacgaaaccgaacaacgcctactacataaaacttacccgcgcgaaccgaaaacgccaatcgaaaatcctcgccgccgccgccgccttcatcttcccccgaaaactccgaaaaactaaaactaacgttaaaaaaaaaactaacgctactaacgaccgaaaaacgaccgtccgaccccgaaaaacaccctccaaaccgaacctaaatctctaaccgaaaaaaccgaaccgcaaccgccgccctcccaaaaccccgaactactatcgataatccgacaaaaaaaaaaaaatctaatattaacgacccgactaaataaaacgctactcgaaaaaaaccaaaacataaaccgacaatacgaacaaatacataaaaaactaacaaacaaactcgaaataaaaacctcc

SEQ ID NO: 1809 - DNA, 730 bp, Artificial Sequence
  chemically treated genomic DNA (Homo sapiens) CpG-island No: 1809
gtgaagggaaggaggaaaggaggcggggagggagagacggaggaagagagggtgggaagaaggaaggagagagagagggcgaagaggggagagaggggcgaacgagagagatgtggggagaggggagaggagagggacggggtaggggaggggagagcgagggaagagagaaaaagagagaacgtaagggggtcggggagaagagagaggagagcgagagagagcgggaggagagggggagggagagagacgggggagagcgagatagagcgtggggagacggggagaggggagagcgagagagttaggggagacgaggagcgagcgagaggagaggggaagagagagagaagggggaaagtaagagagtggggggaaagcgagagagagagaggggagagatagagggcgggggagagcgagcgcgagcgaggggaggggagagagagaggcgcgcgttggttgttttcgcgaaattttaagtttcgttagcgttattgtttttttcgttgttagtttcgcgtttacgtggggaaattgttttttttgtgtcgggaagaaacgatttatcgttttgtagaggcgcggaagttgtgcgcgggacgttacggtttcgaagtcgcgagtgatcgtagtttcgatttttcggcgggaggtttgttcgagcgtgggagtcgagtttagggtttttttttcgtattggttgcggatttaattttttttgggtttt

SEQ ID NO: 1810 - DNA, 730 bp, Artificial Sequence
  chemically treated genomic DNA (Homo sapiens) CpG-island No: 1810
aaaacccaaaaaaaattaaatccgcaaccaatacgaaaaaaaaaccctaaactcgactcccacgctcgaacaaacctcccgccgaaaaatcgaaactacgatcactcgcgacttcgaaaccgtaacgtcccgcgcacaacttccgcgcctctacaaaacgataaatcgtttcttcccgacacaaaaaaaacaatttccccacgtaaacgcgaaactaacaacgaaaaaaacaataacgctaacgaaacttaaaatttcgcgaaaacaaccaacgcgcgcctctctctctcccctcccctcgctcgcgctcgctctcccccgccctctatctctcccctctctctctctcgctttccccccactctcttactttcccccttctctctctcttcccctctcctctcgctcgctcctcgtctcccctaactctctcgctctcccctctccccgtctccccacgctctatctcgctctcccccgtctctctccctccccctctcctcccgctctctctcgctctcctctctcttctccccgacccccttacgttctctctttttctctcttccctcgctctcccctcccctaccccgtccctctcctctcccctctccccacatctctctcgttcgcccctctctcccctcttcgccctctctctctccttccttcttcccaccctctcttcctccgtctctccctccccgcctcctttcctccttcccttcac

SEQ ID NO: 1811 - DNA, 730 bp, Artificial Sequence
  chemically treated genomic DNA (Homo sapiens) CpG-island No: 1811
ggggtttaggaagggttaggttcgtagttagtgcggagaaagggttttgggttcggtttttacgttcgggtaggtttttcgtcgggggatcggagttgcggttattcgcggtttcggggtcgtggcgtttcgcgtatagttttcgcgtttttgtaaggcggtgagtcgttttttttcggtataggagggatagtttttttacgtggacgcggggttggtagcgggaggggtaatagcgttggcggagtttagggtttcgcgggagtaattagcgcgcgtttttttttttttttttttttcgttcgcgttcgttttttttcgttttttgttttttttttttttttttttcgttttttttttatttttttgttttttttttttttttttttttttttttttttttcgttcgtttttcgttttttttggttttttcgttttttttttttttcgtttttttacgttttgtttcgttttttttcgttttttttttttttttttttttttcgttttttttcgtttttttttttttttttttcgatttttttgcgtttttttttttttttttttttttcgttttttttttttttgtttcgtttttttttttttttttttttttatatttttttcgttcgtttttttttttttttttcgttttttttttttttttttttttttttatttttttttttttcgttttttttttttcgtttttttttttttttttttttat

SEQ ID NO: 1812 - DNA, 730 bp, Artificial Sequence
  chemically treated genomic DNA (Homo sapiens) CpG-island No: 1812
ataaaaaaaaaaaaaaaaaaaaacgaaaaaaaaaaaacgaaaaaaaaaaaaataaaaaaaaaaaaaaaaaaaaaaaaaacgaaaaaaaaaaaaaaaaacgaacgaaaaaaatataaaaaaaaaaaaaaaaaaaaaaacgaaacaaaaaaaaaaaaaacgaaaaaaaaaaaaaaaaaaaaaaacgcaaaaaaatcgaaaaaaaaaaaaaaaaaaacgaaaaaaaacgaaaaaaaaaaaaaaaaaaaaaaaacgaaaaaaaacgaaacaaaacgtaaaaaaacgaaaaaaaaaaaaaacgaaaaaaccaaaaaaaacgaaaaacgaacgaaaaaaaaaaaaaaaaaaaaaaaaaaaaaaaaaacaaaaaaataaaaaaaaaacgaaaaaaaaaaaaaaaaaaaacaaaaaacgaaaaaaaacgaacgcgaacgaaaaaaaaaaaaaaaaaaaaacgcgcgctaattactcccgcgaaaccctaaactccgccaacgctattacccctcccgctaccaaccccgcgtccacgtaaaaaaactatccctcctataccgaaaaaaaacgactcaccgccttacaaaaacgcgaaaactatacgcgaaacgccacgaccccgaaaccgcgaataaccgcaactccgatcccccgacgaaaaacctacccgaacgtaaaaaccgaacccaaaaccctttctccgcactaactacgaacctaacccttcctaaacccc

SEQ ID NO: 1813 - DNA, 1298 bp, Artificial Sequence
  chemically treated genomic DNA (Homo sapiens) CpG-island No: 1813
gagttgcggcgggttagtgggcgggaagagtgggtcgatttgggtttgagaatgatagagttcgtaatgggggagggtacggtgcgacggcggcgtagggggtgagagggatttgcgagacggttagttaggttgttttaattacggcggaggaatcggggattgggcggtcgtagttaatgggaaggtagcgggcgcggggcggggcgggcgtggggcggagttttttggggttcgtagggttggggcggagttaggttcgcgttaggtggtttcggcgagttggcggtgcggggggcggggtacggtacggcgcggagaggagagcggcggtcggttggtagcggcgggtatcggttgcgcgagtaggtatcggcggtagaggtgacgaggtcgttttcgggggggcgagcgggtaggcggggattcggttcgttgcgtttttaggttgcgcgaagagttcgcgttcggcgtttttttcgtatcgcggtaatagcgtcggcgagtcggtttttttagttttgttagttcgggttttatttgcggtcgtcgtcgttgggggggggtttttttagttttgcggaggcgtatgaataataggcggcggcggtttttgcgggcggcggcggtttcgtattttatggatcggtcgttttatggagttttttagagcgtttttcggttgtttagcgagcgtcgtcgttgtcgtttcgtcgggggaggatggagtaggggtcggggtcgaggaggaggaggaggaggaggaggaggcggcggcggcggtgggtttcggggagttgggttgcgacgcgtcgttgttttattggacggtcgtgttcgagtacgaggcggcgggcgaggacgagttgattttgcggttgggcgacgtggtggaggtgttgtttaaggattcgtaggtgttcggcgacgagggttggtggatcgggtagttgaattagcgggtgggtattttttttagtaattacgtgatttcgcgtagcgttttttttagtcgttgttagttcggcggcgaggattttagttgttattcgtttatttagtgtaaggcgaaggcggggtcgggcggggagggggaatgacggaggtttggggggcggtcggggaaggggggagtattgcgcgagggttgggatgagggcggggggtggggaggacgattgatttgggtgtgggtggcgcgcgtttaggttgttcgggttttgtttgttggataagttcgagacgttttaggttttgttcgtattttagacgtttgggtttttttatttttagttggt

SEQ ID NO: 1814 - DNA, 1298 bp, Artificial Sequence
  chemically treated genomic DNA (Homo sapiens) CpG-island No: 1814
accaactaaaaataaaaaaacccaaacgtctaaaatacgaacaaaacctaaaacgtctcgaacttatccaacaaacaaaacccgaacaacctaaacgcgcgccacccacacccaaatcaatcgtcctccccaccccccgccctcatcccaaccctcgcgcaatactccccccttccccgaccgccccccaaacctccgtcattccccctccccgcccgaccccgccttcgccttacactaaataaacgaataacaactaaaatcctcgccgccgaactaacaacgactaaaaaaaacgctacgcgaaatcacgtaattactaaaaaaaatacccacccgctaattcaactacccgatccaccaaccctcgtcgccgaacacctacgaatccttaaacaacacctccaccacgtcgcccaaccgcaaaatcaactcgtcctcgcccgccgcctcgtactcgaacacgaccgtccaataaaacaacgacgcgtcgcaacccaactccccgaaacccaccgccgccgccgcctcctcctcctcctcctcctcctcctcgaccccgacccctactccatcctcccccgacgaaacgacaacgacgacgctcgctaaacaaccgaaaaacgctctaaaaaactccataaaacgaccgatccataaaatacgaaaccgccgccgcccgcaaaaaccgccgccgcctattattcatacgcctccgcaaaactaaaaaaacccccccccaacgacgacgaccgcaaataaaacccgaactaacaaaactaaaaaaaccgactcgccgacgctattaccgcgatacgaaaaaaacgccgaacgcgaactcttcgcgcaacctaaaaacgcaacgaaccgaatccccgcctacccgctcgcccccccgaaaacgacctcgtcacctctaccgccgatacctactcgcgcaaccgatacccgccgctaccaaccgaccgccgctctcctctccgcgccgtaccgtaccccgccccccgcaccgccaactcgccgaaaccacctaacgcgaacctaactccgccccaaccctacgaaccccaaaaaactccgccccacgcccgccccgccccgcgcccgctaccttcccattaactacgaccgcccaatccccgattcctccgccgtaattaaaacaacctaactaaccgtctcgcaaatccctctcaccccctacgccgccgtcgcaccgtaccctcccccattacgaactctatcattctcaaacccaaatcgacccactcttcccgcccactaacccgccgcaactc

SEQ ID NO: 1815 - DNA, 1298 bp, Artificial Sequence
  chemically treated genomic DNA (Homo sapiens) CpG-island No: 1815
gttaattgaaggtgaagaagtttaagcgtttgaagtgcgggtagggtttgaggcgtttcgagtttatttagtaagtaaagttcgggtagtttaagcgcgcgttatttatatttaggttaatcgttttttttatttttcgtttttattttagttttcgcgtagtgtttttttttttttcgatcgttttttaggttttcgttatttttttttttcgttcggtttcgttttcgttttatattgaatgggcgggtagtaattggggttttcgtcgtcgggttggtagcggttggagaaggcgttgcgcggggttacgtagttgttggggaagatgtttattcgttggtttagttgttcggtttattagttttcgtcgtcggatatttgcgagtttttggatagtatttttattacgtcgtttagtcgtagggttagttcgttttcgttcgtcgtttcgtattcgaatacggtcgtttagtagggtagcggcgcgtcgtagtttagtttttcggggtttatcgtcgtcgtcgtttttttttttttttttttttttttttcggtttcggtttttgttttattttttttcggcggggcggtagcggcggcgttcgttaggtagtcgagaagcgttttggagggttttatggagcggtcgatttatagggtgcggggtcgtcgtcgttcgtaggagtcgtcgtcgtttattgtttatgcgttttcgtagagttgggaggatttttttttaacgacggcggtcgtaggtagggttcgggttggtagggttgggagagtcggttcgtcggcgttgttatcgcggtacgagaagagcgtcgagcgcgagtttttcgcgtagtttaggggcgtagcgggtcgagttttcgtttgttcgttcgttttttcgggggcggtttcgttatttttgtcgtcggtatttgttcgcgtagtcggtgttcgtcgttgttagtcggtcgtcgttttttttttcgcgtcgtgtcgtgtttcgtttttcgtatcgttagttcgtcgggattatttgacgcgggtttggtttcgttttagttttgcggattttagggggtttcgttttacgttcgtttcgtttcgcgttcgttgtttttttattggttgcggtcgtttagttttcggttttttcgtcgtggttggggtagtttagttggtcgtttcgtaggttttttttattttttgcgtcgtcgtcgtatcgtgtttttttttattgcgggttttgttatttttaaatttaggtcgatttatttttttcgtttattggttcgtcgtagttt

SEQ ID NO: 1816 - DNA, 1298 bp, Artificial Sequence
  chemically treated genomic DNA (Homo sapiens) CpG-island No: 1816
aaactacgacgaaccaataaacgaaaaaaataaatcgacctaaatttaaaaataacaaaacccgcaataaaaaaaaacacgatacgacgacgacgcaaaaaataaaaaaaacctacgaaacgaccaactaaactaccccaaccacgacgaaaaaaccgaaaactaaacgaccgcaaccaataaaaaaacaacgaacgcgaaacgaaacgaacgtaaaacgaaaccccctaaaatccgcaaaactaaaacgaaaccaaacccgcgtcaaataatcccgacgaactaacgatacgaaaaacgaaacacgacacgacgcgaaaaaaaaaacgacgaccgactaacaacgacgaacaccgactacgcgaacaaataccgacgacaaaaataacgaaaccgcccccgaaaaaacgaacgaacaaacgaaaactcgacccgctacgcccctaaactacgcgaaaaactcgcgctcgacgctcttctcgtaccgcgataacaacgccgacgaaccgactctcccaaccctaccaacccgaaccctacctacgaccgccgtcgttaaaaaaaaatcctcccaactctacgaaaacgcataaacaataaacgacgacgactcctacgaacgacgacgaccccgcaccctataaatcgaccgctccataaaaccctccaaaacgcttctcgactacctaacgaacgccgccgctaccgccccgccgaaaaaaaataaaacaaaaaccgaaaccgaaaaaaaaaaaaaaaaaaaaaaaaaaacgacgacgacgataaaccccgaaaaactaaactacgacgcgccgctaccctactaaacgaccgtattcgaatacgaaacgacgaacgaaaacgaactaaccctacgactaaacgacgtaataaaaatactatccaaaaactcgcaaatatccgacgacgaaaactaataaaccgaacaactaaaccaacgaataaacatcttccccaacaactacgtaaccccgcgcaacgccttctccaaccgctaccaacccgacgacgaaaaccccaattactacccgcccattcaatataaaacgaaaacgaaaccgaacgaaaaaaaaaaataacgaaaacctaaaaaacgatcgaaaaaaaaaaaaacactacgcgaaaactaaaataaaaacgaaaaataaaaaaaacgattaacctaaatataaataacgcgcgcttaaactacccgaactttacttactaaataaactcgaaacgcctcaaaccctacccgcacttcaaacgcttaaacttcttcaccttcaattaac

SEQ ID NO: 1817 - DNA, 530 bp, Artificial Sequence
  chemically treated genomic DNA (Homo sapiens) CpG-island No: 1817
cgaggaagcgggttcgcgtagcgttcgcgcggttgggagagacgggtaggtgaatgcggtgagcgcgggcggaggcgtggagcgcggagaggtgaggagtatagtaggagtgcgtggtgggagagatgaggggagacgattagaagtagatgagtgcgcgttgatcgtgggatggacggtgcgagagaggtcgcggcgttgagcgtgtttcggcggagcgggtagggaggcgtgtatcgaggggtgtgggtgggcgcgcgggaggatgaggtggagtggtggtggaggtgggagagggtgacgtggtgcgagtggggcggaggtggtatgcggatggtgagggtgacgggagggggacggcggcgtagtagtgtggggaggcgggggggaggcgagcgttcgggcgggcgcgttgaggcgtcgggttgaggtggaggggcgtgggtaagcggttgggcggtgttagagcggggttggaaggtcgggtgggggtagtggaggaggtagggcggaatatatgaatcggggcg

SEQ ID NO: 1818 - DNA, 530 bp, Artificial Sequence
  chemically treated genomic DNA (Homo sapiens) CpG-island No: 1818
cgccccgattcatatattccgccctacctcctccactacccccacccgaccttccaaccccgctctaacaccgcccaaccgcttacccacgcccctccacctcaacccgacgcctcaacgcgcccgcccgaacgctcgcctcccccccgcctccccacactactacgccgccgtccccctcccgtcaccctcaccatccgcataccacctccgccccactcgcaccacgtcaccctctcccacctccaccaccactccacctcatcctcccgcgcgcccacccacacccctcgatacacgcctccctacccgctccgccgaaacacgctcaacgccgcgacctctctcgcaccgtccatcccacgatcaacgcgcactcatctacttctaatcgtctcccctcatctctcccaccacgcactcctactatactcctcacctctccgcgctccacgcctccgcccgcgctcaccgcattcacctacccgtctctcccaaccgcgcgaacgctacgcgaacccgcttcctcg

SEQ ID NO: 1819 - DNA, 530 bp, Artificial Sequence
  chemically treated genomic DNA (Homo sapiens) CpG-island No: 1819
cgtttcggtttatatgtttcgttttgttttttttattgtttttattcggttttttagtttcgttttagtatcgtttagtcgtttgtttacgtttttttattttagttcgacgttttagcgcgttcgttcgagcgttcgtttttttttcgtttttttatattgttacgtcgtcgtttttttttcgttatttttattattcgtatgttattttcgttttattcgtattacgttatttttttttatttttattattattttattttattttttcgcgcgtttatttatatttttcggtatacgtttttttattcgtttcgtcgagatacgtttagcgtcgcgatttttttcgtatcgtttattttacgattaacgcgtatttatttgtttttgatcgtttttttttattttttttattacgtatttttgttatattttttattttttcgcgttttacgttttcgttcgcgtttatcgtatttatttgttcgttttttttagtcgcgcgagcgttgcgcggattcgttttttcg

SEQ ID NO: 1820 - DNA, 530 bp, Artificial Sequence
  chemically treated genomic DNA (Homo sapiens) CpG-island No: 1820
cgaaaaaacgaatccgcgcaacgctcgcgcgactaaaaaaaacgaacaaataaatacgataaacgcgaacgaaaacgtaaaacgcgaaaaaataaaaaatataacaaaaatacgtaataaaaaaaataaaaaaaaacgatcaaaaacaaataaatacgcgttaatcgtaaaataaacgatacgaaaaaaatcgcgacgctaaacgtatctcgacgaaacgaataaaaaaacgtataccgaaaaatataaataaacgcgcgaaaaaataaaataaaataataataaaaataaaaaaaaataacgtaatacgaataaaacgaaaataacatacgaataataaaaataacgaaaaaaaaacgacgacgtaacaatataaaaaaacgaaaaaaaaacgaacgctcgaacgaacgcgctaaaacgtcgaactaaaataaaaaaacgtaaacaaacgactaaacgatactaaaacgaaactaaaaaaccgaataaaaacaataaaaaaaacaaaacgaaacatataaaccgaaacg

SEQ ID NO: 1821 - DNA, 624 bp, Artificial Sequence
  chemically treated genomic DNA (Homo sapiens) CpG-island No: 1821
gcggggcgcggggaatattgagaagcgtgtaggcggcgatttcgattcgttttgggcgcgggcgggcgtggacgcgtcgcggttgcggaggttggggtaggggtcggttttgcggcggcggaagttggttgcggcggcggatggcggcggcggttttttaagttttgcgcgttgggatttttcgcgatttttcggattcgtttttatttgaagggtttggaacggtacgggttcgttttcgtcgtgacgtatatggttatatatgggaagtaggaagttttaatatggtaggatcggtcgggaggattcggagtgacgtgaagttttttattcgatagcgttcggtatttttattttgtattttagggttcgcgttcgcgttcgtattttaggcgtttaggtttcggggaagtttagagttttagtcgtcgtcggggttttcgggattcgcgtagtttcggagttttcgcgttgttttttttttcgtttttttttttttttttagagtcggaagcggtcgggttatatcgggttattttaaataaggtgttgtttaaataagggttgtttcggcgggggattttttttgttttttatatggtattttcgggtcgtagttggttg

SEQ ID NO: 1822 - DNA, 624 bp, Artificial Sequence
  chemically treated genomic DNA (Homo sapiens) CpG-island No: 1822
caaccaactacgacccgaaaataccatataaaaaacaaaaaaaatcccccgccgaaacaacccttatttaaacaacaccttatttaaaataacccgatataacccgaccgcttccgactctaaaaaaaaaaaaaaaaacgaaaaaaaaaacaacgcgaaaactccgaaactacgcgaatcccgaaaaccccgacgacgactaaaactctaaacttccccgaaacctaaacgcctaaaatacgaacgcgaacgcgaaccctaaaatacaaaataaaaataccgaacgctatcgaataaaaaacttcacgtcactccgaatcctcccgaccgatcctaccatattaaaacttcctacttcccatatataaccatatacgtcacgacgaaaacgaacccgtaccgttccaaacccttcaaataaaaacgaatccgaaaaatcgcgaaaaatcccaacgcgcaaaacttaaaaaaccgccgccgccatccgccgccgcaaccaacttccgccgccgcaaaaccgacccctaccccaacctccgcaaccgcgacgcgtccacgcccgcccgcgcccaaaacgaatcgaaatcgccgcctacacgcttctcaatattccccgcgccccgc

SEQ ID NO: 1823 - DNA, 624 bp, Artificial Sequence
  chemically treated genomic DNA (Homo sapiens) CpG-island No: 1823
taattagttgcgattcggaaatgttatataaggagtaggaaggatttttcgtcggaataatttttatttgggtagtattttatttggagtggttcgatatggttcggtcgttttcggttttgggaggagggaagaaggcggagggaggggtaacgcgggaatttcggagttgcgcgggtttcggaggtttcggcggcggttagagttttaggttttttcgaagtttgggcgtttgggatgcgggcgcgggcgcgggttttagggtgtaggatggaggtgtcgggcgttgtcggatggggggttttacgttatttcgggttttttcggtcggttttgttatattagggttttttgttttttatatatggttatgtacgttacgacggaggcggattcgtgtcgttttagattttttaaatagaggcggattcggggagtcgcgagagattttagcgcgtagaatttggggagtcgtcgtcgttattcgtcgtcgtagttagttttcgtcgtcgtaggatcggtttttgttttagttttcgtagtcgcggcgcgtttacgttcgttcgcgtttagggcgagtcggggtcgtcgtttgtacgttttttagtgtttttcgcgtttcgt

SEQ ID NO: 1824 - DNA, 624 bp, Artificial Sequence
  chemically treated genomic DNA (Homo sapiens) CpG-island No: 1824
acgaaacgcgaaaaacactaaaaaacgtacaaacgacgaccccgactcgccctaaacgcgaacgaacgtaaacgcgccgcgactacgaaaactaaaacaaaaaccgatcctacgacgacgaaaactaactacgacgacgaataacgacgacgactccccaaattctacgcgctaaaatctctcgcgactccccgaatccgcctctatttaaaaaatctaaaacgacacgaatccgcctccgtcgtaacgtacataaccatatataaaaaacaaaaaaccctaatataacaaaaccgaccgaaaaaacccgaaataacgtaaaaccccccatccgacaacgcccgacacctccatcctacaccctaaaacccgcgcccgcgcccgcatcccaaacgcccaaacttcgaaaaaacctaaaactctaaccgccgccgaaacctccgaaacccgcgcaactccgaaattcccgcgttacccctccctccgccttcttccctcctcccaaaaccgaaaacgaccgaaccatatcgaaccactccaaataaaatactacccaaataaaaattattccgacgaaaaatccttcctactccttatataacatttccgaatcgcaactaatta

SEQ ID NO: 1825 - DNA, 535 bp, Artificial Sequence
  chemically treated genomic DNA (Homo sapiens) CpG-island No: 1825
tcggtttcgagtgttcgattcggtcgttatttatcgttaggttttggggtatcgtttcgtttatggttcgtatcgtgtcggttcgttaggttcgagtgcgtagcgtaggtttcggattttcgttcgtcgttgtcgtcgcgggagtcgaggtcgaggttgaggtcgtagtgttcgcgaatagtagtagtagtcgtttgtttatcggggaggtcgtcgcgttcgttatcgtcggggtcggtttgattcgcgttttcgttcgtcgttttttattattttcgtcgttaagcgttcgattcgttcgtaaggttttttttcgtattattcgcggtcgtcgtttttttttattttttttaatagttattattaattatcggcgtagcgtagcgtttttcgtggtcgggagcggagtcgtagtttgggtttcgtatagcgtttttcgcgttttggagcggggcgatagtttttggtttttcgtagcgtttcgttttaattttttcggggtttgtagtgttttttgcggtttggaggggaattg

SEQ ID NO: 1826 - DNA, 535 bp, Artificial Sequence
  chemically treated genomic DNA (Homo sapiens) CpG-island No: 1826
caattcccctccaaaccgcaaaaaacactacaaaccccgaaaaaattaaaacgaaacgctacgaaaaaccaaaaactatcgccccgctccaaaacgcgaaaaacgctatacgaaacccaaactacgactccgctcccgaccacgaaaaacgctacgctacgccgataattaataataactattaaaaaaaataaaaaaaaacgacgaccgcgaataatacgaaaaaaaaccttacgaacgaatcgaacgcttaacgacgaaaataataaaaaacgacgaacgaaaacgcgaatcaaaccgaccccgacgataacgaacgcgacgacctccccgataaacaaacgactactactactattcgcgaacactacgacctcaacctcgacctcgactcccgcgacgacaacgacgaacgaaaatccgaaacctacgctacgcactcgaacctaacgaaccgacacgatacgaaccataaacgaaacgataccccaaaacctaacgataaataacgaccgaatcgaacactcgaaaccga

SEQ ID NO: 1827 - DNA, 535 bp, Artificial Sequence
  chemically treated genomic DNA (Homo sapiens) CpG-island No: 1827
taatttttttttagatcgtagggggtattgtaggtttcggggagattggggcggagcgttgcgaggggttaggagttgtcgtttcgttttagagcgcggggggcgttgtgcggggtttaggttgcggtttcgttttcggttacggggggcgttgcgttgcgtcggtggttggtggtggttgttggggggggtgggggggaacggcggtcgcgggtggtgcggagggaggttttgcgggcggatcgggcgtttggcggcggaggtggtgggaggcggcgggcgggagcgcgggttaggtcggtttcggcgatggcggacgcggcggttttttcggtgggtaagcggttgttgttgttgttcgcggatattgcggttttagtttcggtttcggttttcgcggcggtagcggcgagcggagattcggggtttgcgttgcgtattcgagtttggcgggtcggtacggtgcgggttatgagcggggcggtgttttaggatttagcggtgagtggcggtcgagtcgggtattcgaggtcgg

SEQ ID NO: 1828 - DNA, 535 bp, Artificial Sequence
  chemically treated genomic DNA (Homo sapiens) CpG-island No: 1828
ccgacctcgaatacccgactcgaccgccactcaccgctaaatcctaaaacaccgccccgctcataacccgcaccgtaccgacccgccaaactcgaatacgcaacgcaaaccccgaatctccgctcgccgctaccgccgcgaaaaccgaaaccgaaactaaaaccgcaatatccgcgaacaacaacaacaaccgcttacccaccgaaaaaaccgccgcgtccgccatcgccgaaaccgacctaacccgcgctcccgcccgccgcctcccaccacctccgccgccaaacgcccgatccgcccgcaaaacctccctccgcaccacccgcgaccgccgttcccccccaccccccccaacaaccaccaccaaccaccgacgcaacgcaacgccccccgtaaccgaaaacgaaaccgcaacctaaaccccgcacaacgccccccgcgctctaaaacgaaacgacaactcctaacccctcgcaacgctccgccccaatctccccgaaacctacaataccccctacgatctaaaaaaaaatta

SEQ ID NO: 1829 - DNA, 729 bp, Artificial Sequence
  chemically treated genomic DNA (Homo sapiens) CpG-island No: 1829
cgtgcgggtttcggtcgtttttttttcgtcgcgggttcgggcgcgcgttttaatcgttaatcgttcgcgcggtgttcggggtcgggtaggtcgcgggtcgcgcgtttcgtatcgagtttttttgttgcgcggaggcggaggtaatgatttagttcgcggtttgcgtcggttcggtcgtcgggagggagcgtgacgcgaggcggttttcggttggaacgcgcgtcgtgtcgcgtcgttgagttcgtcggtttcggttttgcgtttattcgtttattttgatttttatttacgacgcgttttttggtgtgttcgggttcggtgatgattacggtcgcgtcgttcgttttgtttgttgtcgtcggtcgcgtcgcgcgtttgttttcgtcgggggtttcgtcgagttttaggtcgttttcgtcgtcgttgttgtcgtcgtcgttgttgttattgtagcgttcgggtcgttcgcgttttttgttcgtcgggtcgtcgcgttttttgggttcggcgcgggtagtgtcgttgttcgagttcggttttttttaggtcgtcgtcgtcgttttttttttgggtatggtcgcggttggagggagatacggggtagcggcgtataatggacgggttataaattgcgcggggggaggggagcggagacgagttattcggtttttatttttttttttgttttttttaaagtggcggtcgtagggtgggcggagagggggcgag

SEQ ID NO: 1830 - DNA, 729 bp, Artificial Sequence
  chemically treated genomic DNA (Homo sapiens) CpG-island No: 1830
ctcgccccctctccgcccaccctacgaccgccactttaaaaaaaacaaaaaaaaaaataaaaaccgaataactcgtctccgctcccctccccccgcgcaatttataacccgtccattatacgccgctaccccgtatctccctccaaccgcgaccatacccaaaaaaaaaacgacgacgacgacctaaaaaaaaccgaactcgaacaacgacactacccgcgccgaacccaaaaaacgcgacgacccgacgaacaaaaaacgcgaacgacccgaacgctacaataacaacaacgacgacgacaacaacgacgacgaaaacgacctaaaactcgacgaaacccccgacgaaaacaaacgcgcgacgcgaccgacgacaacaaacaaaacgaacgacgcgaccgtaatcatcaccgaacccgaacacaccaaaaaacgcgtcgtaaataaaaatcaaaataaacgaataaacgcaaaaccgaaaccgacgaactcaacgacgcgacacgacgcgcgttccaaccgaaaaccgcctcgcgtcacgctccctcccgacgaccgaaccgacgcaaaccgcgaactaaatcattacctccgcctccgcgcaacaaaaaaactcgatacgaaacgcgcgacccgcgacctacccgaccccgaacaccgcgcgaacgattaacgattaaaacgcgcgcccgaacccgcgacgaaaaaaaaacgaccgaaacccgcacg

SEQ ID NO: 1831 - DNA, 729 bp, Artificial Sequence
  chemically treated genomic DNA (Homo sapiens) CpG-island No: 1831
ttcgtttttttttcgtttattttgcggtcgttattttggggagggtagaggaggaagtggaggtcgggtggttcgttttcgttttttttttttcgcgtagtttataattcgtttattgtgcgtcgttgtttcgtgtttttttttagtcgcgattatgtttaggaagaaggcggcggcggcggtttgggaggagtcgagttcgggtaacggtattgttcgcgtcgggtttaggaaacgcggcggttcggcgggtaggaagcgcgagcggttcgagcgttgtagtagtagtagcggcggcggtagtagcggcgacgaggacggtttggagttcgacggggttttcggcgggggtaagcgcgcggcgcggtcggcgatagtaggtaaggcgggcggcgcggtcgtggttattatcgaattcgagtatattaaggagcgcgtcgtgagtgagggttagggtagacgggtgggcgtagggtcggggtcggcgggtttagcgacgcggtacggcgcgcgttttagtcgggggtcgtttcgcgttacgttttttttcggcggtcgggtcggcgtaggtcgcgggttgaattattgttttcgttttcgcgtaataaaagggttcggtacggggcgcgcggttcgcggtttattcgatttcgggtatcgcgcgggcggttggcggttggggcgcgcgttcgggttcgcggcgggggaggggcggtcgaagttcgtacg

SEQ ID NO: 1832 - DNA, 729 bp, Artificial Sequence
  chemically treated genomic DNA (Homo sapiens) CpG-island No: 1832
cgtacgaacttcgaccgcccctcccccgccgcgaacccgaacgcgcgccccaaccgccaaccgcccgcgcgatacccgaaatcgaataaaccgcgaaccgcgcgccccgtaccgaacccttttattacgcgaaaacgaaaacaataattcaacccgcgacctacgccgacccgaccgccgaaaaaaaacgtaacgcgaaacgacccccgactaaaacgcgcgccgtaccgcgtcgctaaacccgccgaccccgaccctacgcccacccgtctaccctaaccctcactcacgacgcgctccttaatatactcgaattcgataataaccacgaccgcgccgcccgccttacctactatcgccgaccgcgccgcgcgcttacccccgccgaaaaccccgtcgaactccaaaccgtcctcgtcgccgctactaccgccgccgctactactactacaacgctcgaaccgctcgcgcttcctacccgccgaaccgccgcgtttcctaaacccgacgcgaacaataccgttacccgaactcgactcctcccaaaccgccgccgccgccttcttcctaaacataatcgcgactaaaaaaaaacacgaaacaacgacgcacaataaacgaattataaactacgcgaaaaaaaaaaaacgaaaacgaaccacccgacctccacttcctcctctaccctccccaaaataacgaccgcaaaataaacgaaaaaaaaacgaa

SEQ ID NO: 1833 - DNA, 666 bp, Artificial Sequence
  chemically treated genomic DNA (Homo sapiens) CpG-island No: 1833
gaatcgttgcgaagtataataacggttttttagaggtaggagggtttcgagtcgggtttttagttattatttaggatttttggaggacgagttcggacgatttttatatatattcggagtagagtcgtacggtttttcgcgttttcggggtttcgtacgcggattagcggcgaggcggcgggcggtttttttcgggagtttcggacgagggtcgcggcgggggcgggtagtgtcggatgtcgggcgttcgaggaatttagcgtgttaaggatggatgcggcgttttttaaagtcgtagagcgttcggcgtttgttatatagttttacgggcggggggtttcggcggggacggtttagtcgagtggtcgtaggagggaatttcgagaaggggtttaggacgttgtcgttttttagtgagcgggcgggggcggtcggcgcgggttgtcgtgggttcgttgttcgtgttattttcgaaattaggaaagtttcgaagagaggagtgggagtacgtagtgggggcggggagttttatatcgagagggtggcggttttcgggggacgagatttcgtggaagaggaagagggcgcgattttagtatttttttatcggttcgcggggaaggagttattcgtttttcgtttttatatttattatgtagagggtga

SEQ ID NO: 1834 - DNA, 666 bp, Artificial Sequence
  chemically treated genomic DNA (Homo sapiens) CpG-island No: 1834
tcaccctctacataataaatataaaaacgaaaaacgaataactccttccccgcgaaccgataaaaaaatactaaaatcgcgccctcttcctcttccacgaaatctcgtcccccgaaaaccgccaccctctcgatataaaactccccgcccccactacgtactcccactcctctcttcgaaactttcctaatttcgaaaataacacgaacaacgaacccacgacaacccgcgccgaccgcccccgcccgctcactaaaaaacgacaacgtcctaaaccccttctcgaaattccctcctacgaccactcgactaaaccgtccccgccgaaaccccccgcccgtaaaactatataacaaacgccgaacgctctacgactttaaaaaacgccgcatccatccttaacacgctaaattcctcgaacgcccgacatccgacactacccgcccccgccgcgaccctcgtccgaaactcccgaaaaaaaccgcccgccgcctcgccgctaatccgcgtacgaaaccccgaaaacgcgaaaaaccgtacgactctactccgaatatatataaaaatcgtccgaactcgtcctccaaaaatcctaaataataactaaaaacccgactcgaaaccctcctacctctaaaaaaccgttattatacttcgcaacgattc

SEQ ID NO: 1835 - DNA, 666 bp, Artificial Sequence
  chemically treated genomic DNA (Homo sapiens) CpG-island No: 1835
ttattttttatatggtgagtgtgggggcggggagcgggtggtttttttttcgcgagtcggtggggagatgttggggtcgcgtttttttttttttttacggggtttcgtttttcgggggtcgttattttttcggtgtgaggtttttcgtttttattgcgtgtttttattttttttttcggggtttttttggtttcggaggtgatacgagtaacgagtttacggtaattcgcgtcggtcgttttcgttcgtttattgggaagcggtagcgttttaggttttttttcggggtttttttttgcggttattcggttaggtcgttttcgtcggggtttttcgttcgtggggttgtgtggtaggcgtcgagcgttttgcggttttaggggacgtcgtatttatttttggtacgttgggtttttcgggcgttcggtattcggtattgttcgttttcgtcgcggttttcgttcggggttttcgggagaggtcgttcgtcgtttcgtcgttaattcgcgtgcggagtttcgggagcgcgggggatcgtgcggttttgtttcgagtgtgtgtgggggtcgttcgggttcgttttttaggggttttgggtggtggttgaaaattcggttcggaatttttttgtttttaaaaaatcgttgttgtgtttcgtagcggttt

SEQ ID NO: 1836 - DNA, 666 bp, Artificial Sequence
  chemically treated genomic DNA (Homo sapiens) CpG-island No: 1836
aaaccgctacgaaacacaacaacgattttttaaaaacaaaaaaattccgaaccgaattttcaaccaccacccaaaacccctaaaaaacgaacccgaacgacccccacacacactcgaaacaaaaccgcacgatcccccgcgctcccgaaactccgcacgcgaattaacgacgaaacgacgaacgacctctcccgaaaaccccgaacgaaaaccgcgacgaaaacgaacaataccgaataccgaacgcccgaaaaacccaacgtaccaaaaataaatacgacgtcccctaaaaccgcaaaacgctcgacgcctaccacacaaccccacgaacgaaaaaccccgacgaaaacgacctaaccgaataaccgcaaaaaaaaaccccgaaaaaaaacctaaaacgctaccgcttcccaataaacgaacgaaaacgaccgacgcgaattaccgtaaactcgttactcgtatcacctccgaaaccaaaaaaaccccgaaaaaaaaaataaaaacacgcaataaaaacgaaaaacctcacaccgaaaaaataacgacccccgaaaaacgaaaccccgtaaaaaaaaaaaaaaacgcgaccccaacatctccccaccgactcgcgaaaaaaaaaccacccgctccccgcccccacactcaccatataaaaaataa

SEQ ID NO: 1837 - DNA, 688 bp, Artificial Sequence
  chemically treated genomic DNA (Homo sapiens) CpG-island No: 1837
cgttgagcgcggtttatattttttgtcggaggatttgtagcgtttgcgattttatttttattcggcgtcgtcgtcgtcgtcgtcgtcgtcgtcgtcgttttcgtttcggttttagttcggtttcggtcgtcggagtttgtagttgtttcgtttatttattttcggagtttcgggtgagcgagtcggcgtttcggcggtcgttggtgttgttgtaggaggaggaggaggtagtaaacgaggaggaggagattcgagaggaggaggcggcgagcggcggggcggaggacggcggagaggaggagatcggttttttgagagtcgtcgttattttgttttttaatattcggagtcgcggttcggttttcgttattcgcggttcgttagcgtttttattgtcgtcgtcgcgattttcgtcggtcgttagttttgggttaggtagagaaagaggttcggcgttagggagcgatcgagaggaagtcgcgttttttttagtttttttttttcgtttttttcgttttttgggtcggttacggtgcgcgtcgcgtttggttcgtcgcgggcgttttttgtcgacgttcgggagaagcgcgcgttaacgcggtcggggtttagggtttcgggggttgcggaggtggttgagacgcggttggttggttcggaggattttattttgtttttggtaggtttt

SEQ ID NO: 1838 - DNA, 688 bp, Artificial Sequence
  chemically treated genomic DNA (Homo sapiens) CpG-island No: 1838
aaaacctaccaaaaacaaaataaaatcctccgaaccaaccaaccgcgtctcaaccacctccgcaacccccgaaaccctaaaccccgaccgcgttaacgcgcgcttctcccgaacgtcgacaaaaaacgcccgcgacgaaccaaacgcgacgcgcaccgtaaccgacccaaaaaacgaaaaaaacgaaaaaaaaaaactaaaaaaaacgcgacttcctctcgatcgctccctaacgccgaacctctttctctacctaacccaaaactaacgaccgacgaaaatcgcgacgacgacaataaaaacgctaacgaaccgcgaataacgaaaaccgaaccgcgactccgaatattaaaaaacaaaataacgacgactctcaaaaaaccgatctcctcctctccgccgtcctccgccccgccgctcgccgcctcctcctctcgaatctcctcctcctcgtttactacctcctcctcctcctacaacaacaccaacgaccgccgaaacgccgactcgctcacccgaaactccgaaaataaataaacgaaacaactacaaactccgacgaccgaaaccgaactaaaaccgaaacgaaaacgacgacgacgacgacgacgacgacgacgacgccgaataaaaataaaatcgcaaacgctacaaatcctccgacaaaaaatataaaccgcgctcaacg

SEQ ID NO: 1839 - DNA, 688 bp, Artificial Sequence
  chemically treated genomic DNA (Homo sapiens) CpG-island No: 1839
ggggtttattaggggtagaatggggtttttcggattagttagtcgcgttttagttattttcgtagttttcggggttttgaatttcggtcgcgttgacgcgcgtttttttcggacgtcggtaggaggcgttcgcggcggattaggcgcggcgcgtatcgtagtcggtttagggggcggagggagcggagaggaggagttggagggggcgcggttttttttcggtcgttttttggcgtcgggtttttttttttgtttggtttagggttggcggtcggcgggggtcgcggcggcggtagtgggggcgttggcgggtcgcgggtggcgggggtcgggtcgcggtttcgggtgttaggagataagatggcggcggtttttagaaggtcggttttttttttttcgtcgtttttcgtttcgtcgttcgtcgtttttttttttcgggttttttttttttcgtttgttgtttttttttttttttgtagtagtattagcgatcgtcgaagcgtcggttcgtttattcggagtttcggaggtggatagacggggtagttgtaggtttcggcgatcgaggtcgagttggggtcggggcggggacggcggcggcggcggcggcgacggcggcggcgtcgggtggggatggggtcgtagacgttgtagatttttcgatagggggtgtgggtcgcgtttagcg

SEQ ID NO: 1840 - DNA, 688 bp, Artificial Sequence
  chemically treated genomic DNA (Homo sapiens) CpG-island No: 1840
cgctaaacgcgacccacaccccctatcgaaaaatctacaacgtctacgaccccatccccacccgacgccgccgccgtcgccgccgccgccgccgccgtccccgccccgaccccaactcgacctcgatcgccgaaacctacaactaccccgtctatccacctccgaaactccgaataaacgaaccgacgcttcgacgatcgctaatactactacaaaaaaaaaaaaaaacaacaaacgaaaaaaaaaaaacccgaaaaaaaaaaacgacgaacgacgaaacgaaaaacgacgaaaaaaaaaaaaccgaccttctaaaaaccgccgccatcttatctcctaacacccgaaaccgcgacccgacccccgccacccgcgacccgccaacgcccccactaccgccgccgcgacccccgccgaccgccaaccctaaaccaaacaaaaaaaaaaacccgacgccaaaaaacgaccgaaaaaaaaccgcgccccctccaactcctcctctccgctccctccgccccctaaaccgactacgatacgcgccgcgcctaatccgccgcgaacgcctcctaccgacgtccgaaaaaaacgcgcgtcaacgcgaccgaaattcaaaaccccgaaaactacgaaaataactaaaacgcgactaactaatccgaaaaaccccattctacccctaataaacccc

SEQ ID NO: 1841 - DNA, 517 bp, Artificial Sequence
  chemically treated genomic DNA (Homo sapiens) CpG-island No: 1841
tggcgtgggtaggtggcgggggaggcgatgggggtggtgcgttggtgaggggagcgagtgggggtatgggcggggagtggcgtagagagagggcggtgggtgtgtgtgaggggggtggggggcgagagagggttgggggcggggggtgtgtggtgcgtgatgagagggtggtgcgtgggtgcgtggagggaggggggagttgggagagatggatcgcgggaggaggagggtggggtggatggcgagggtgggcggagagagggagttgagtgtatacggggtagggaggggcggtgtggggcgggtggtttcgacgcggggtggtggtggtgtgcgggagaagggagcgacggtgacgggtggtgtgtgtggggtgtaggggggagtggcgggggggcgggggttgaggtgaggatggtggggtgtttaggtgagggttggcggaggatgtggatcggtggggggtagatgggatgtgatgagagggggagatgggtcggggttagttgggaggttg

SEQ ID NO: 1842 - DNA, 517 bp, Artificial Sequence
  chemically treated genomic DNA (Homo sapiens) CpG-island No: 1842
caacctcccaactaaccccgacccatctccccctctcatcacatcccatctaccccccaccgatccacatcctccgccaaccctcacctaaacaccccaccatcctcacctcaacccccgcccccccgccactcccccctacaccccacacacaccacccgtcaccgtcgctcccttctcccgcacaccaccaccaccccgcgtcgaaaccacccgccccacaccgcccctccctaccccgtatacactcaactccctctctccgcccaccctcgccatccaccccaccctcctcctcccgcgatccatctctcccaactcccccctccctccacgcacccacgcaccaccctctcatcacgcaccacacaccccccgcccccaaccctctctcgccccccacccccctcacacacacccaccgccctctctctacgccactccccgcccatacccccactcgctcccctcaccaacgcaccacccccatcgcctcccccgccacctacccacgcca

SEQ ID NO: 1843 - DNA, 517 bp, Artificial Sequence
  chemically treated genomic DNA (Homo sapiens) CpG-island No: 1843
taattttttaattagtttcgatttattttttttttttattatattttatttattttttatcgatttatatttttcgttaatttttatttagatattttattatttttattttaattttcgttttttcgttatttttttttatattttatatatattattcgttatcgtcgtttttttttttcgtatattattattatttcgcgtcgaagttattcgttttatatcgtttttttttgtttcgtatgtatttaatttttttttttcgtttattttcgttatttattttattttttttttttcgcgatttattttttttagtttttttttttttttacgtatttacgtattatttttttattacgtattatatatttttcgtttttaattttttttcgttttttattttttttatatatatttatcgttttttttttacgttatttttcgtttatatttttattcgttttttttattaacgtattatttttatcgtttttttcgttatttatttacgtta

SEQ ID NO: 1844 - DNA, 517 bp, Artificial Sequence
  chemically treated genomic DNA (Homo sapiens) CpG-island No: 1844
taacgtaaataaataacgaaaaaaacgataaaaataatacgttaataaaaaaaacgaataaaaatataaacgaaaaataacgtaaaaaaaaaacgataaatatatataaaaaaaataaaaaacgaaaaaaaattaaaaacgaaaaatatataatacgtaataaaaaaataatacgtaaatacgtaaaaaaaaaaaaaaactaaaaaaaataaatcgcgaaaaaaaaaaaataaaataaataacgaaaataaacgaaaaaaaaaaattaaatacatacgaaacaaaaaaaaacgatataaaacgaataacttcgacgcgaaataataataatatacgaaaaaaaaaaacgacgataacgaataatatatataaaatataaaaaaaaataacgaaaaaacgaaaattaaaataaaaataataaaatatctaaataaaaattaacgaaaaatataaatcgataaaaaataaataaaatataataaaaaaaaaaaataaatcgaaactaattaaaaaatta

SEQ ID NO: 1845 - DNA, 509 bp, Artificial Sequence
  chemically treated genomic DNA (Homo sapiens) CpG-island No: 1845
cgtagtagcgattcgggttttgtaggaattcggttagtttgtcgtcggtcgagagtttttacgtgaggggtattatcggttcgaagtagtggaaggaggattcgaataagcgggcggggtcgcggagtatcgtgatgaagatggcgttggtcggtattaggtcgcgtatttcgtcgtagtggaagcgtatgtggttgtagatgatgttgaagtaggtttcgggtcgatagttttgtattaggttgcgggcgaagaaggtcgggtagtcgaagttattgcggtcgttagggaaggcgaatttgagtcggtgtttttggtcgaagcggaataggatgttgagtagggtgttgttggtcgttttgtgcgtttttaagaatacgatgttgcgtcgcggttggtattttttcgtcgagtcgttggttcggattattcgttttggttcgagtgtaggtggagagtaggacgttgcggttttcggggttttgttggggatagagaggtggggagag

SEQ ID NO: 1846 - DNA, 509 bp, Artificial Sequence
  chemically treated genomic DNA (Homo sapiens) CpG-island No: 1846
ctctccccacctctctatccccaacaaaaccccgaaaaccgcaacgtcctactctccacctacactcgaaccaaaacgaataatccgaaccaacgactcgacgaaaaaataccaaccgcgacgcaacatcgtattcttaaaaacgcacaaaacgaccaacaacaccctactcaacatcctattccgcttcgaccaaaaacaccgactcaaattcgccttccctaacgaccgcaataacttcgactacccgaccttcttcgcccgcaacctaatacaaaactatcgacccgaaacctacttcaacatcatctacaaccacatacgcttccactacgacgaaatacgcgacctaataccgaccaacgccatcttcatcacgatactccgcgaccccgcccgcttattcgaatcctccttccactacttcgaaccgataatacccctcacgtaaaaactctcgaccgacgacaaactaaccgaattcctacaaaacccgaatcgctactacg

SEQ ID NO: 1847 - DNA, 509 bp, Artificial Sequence
  chemically treated genomic DNA (Homo sapiens) CpG-island No: 1847
ttttttttatttttttgtttttagtaggatttcggaggtcgtagcgttttgttttttatttgtattcgagttagagcgagtgattcgggttaacggttcggcgggggagtgttagtcgcggcgtaatatcgtgtttttgaagacgtataagacggttagtagtattttgtttaatattttgtttcgtttcggttagaagtatcggtttaagttcgttttttttaacggtcgtaatgatttcgattattcgatttttttcgttcgtagtttggtgtaggattatcggttcggggtttgttttaatattatttgtaattatatgcgtttttattacgacgaggtgcgcggtttggtgtcgattaacgttatttttattacggtgtttcgcgatttcgttcgtttgttcgagttttttttttattatttcgggtcggtggtgttttttacgtggaagttttcggtcggcgataagttgatcgagtttttgtaagattcggatcgttattacg

SEQ ID NO: 1848 - DNA, 509 bp, Artificial Sequence
  chemically treated genomic DNA (Homo sapiens) CpG-island No: 1848
cgtaataacgatccgaatcttacaaaaactcgatcaacttatcgccgaccgaaaacttccacgtaaaaaacaccaccgacccgaaataataaaaaaaaaactcgaacaaacgaacgaaatcgcgaaacaccgtaataaaaataacgttaatcgacaccaaaccgcgcacctcgtcgtaataaaaacgcatataattacaaataatattaaaacaaaccccgaaccgataatcctacaccaaactacgaacgaaaaaaatcgaataatcgaaatcattacgaccgttaaaaaaaacgaacttaaaccgatacttctaaccgaaacgaaacaaaatattaaacaaaatactactaaccgtcttatacgtcttcaaaaacacgatattacgccgcgactaacactcccccgccgaaccgttaacccgaatcactcgctctaactcgaatacaaataaaaaacaaaacgctacgacctccgaaatcctactaaaaacaaaaaaataaaaaaaa

SEQ ID NO: 1849 - DNA, 565 bp, Artificial Sequence
  chemically treated genomic DNA (Homo sapiens) CpG-island No: 1849
ttcgcggtttgagttttcgttttattgttttcgcggtaagttcggcgttaggtttggataagagaggtcgatagggtgagacgttcgtttttgttggtcgttatttgggatcgggggagttcggacgggttcggagcggaggattcgcggattttgggtagtcgacgcgaataggtttcgtcgggcgcgggcggaggacggaagtttagagggagcggttgatagatttcggaagtggatacggcgtttgcgcgttgcgatcgcgcggacggttcgcgtatgcgtatagttcgggcgcgtagttcggggttaggtaggttgtagtggaggagggtacgtcgttttattggcgtggtattgtcggcggttttttagaggagatgttgttttacggaacgtttggtaagtgttggcgaagcggtatgggcgttttatttcgttttttaattaatttttttataatcgcgagtcgaagtgtggcgttttggtagtttcgtaaggttttttgttaggagatgagttattgaggattgggggtttttggagtttttggatttgaagaacg

SEQ ID NO: 1850 - DNA, 565 bp, Artificial Sequence
  chemically treated genomic DNA (Homo sapiens) CpG-island No: 1850
cgttcttcaaatccaaaaactccaaaaacccccaatcctcaataactcatctcctaacaaaaaaccttacgaaactaccaaaacgccacacttcgactcgcgattataaaaaaattaattaaaaaacgaaataaaacgcccataccgcttcgccaacacttaccaaacgttccgtaaaacaacatctcctctaaaaaaccgccgacaataccacgccaataaaacgacgtaccctcctccactacaacctacctaaccccgaactacgcgcccgaactatacgcatacgcgaaccgtccgcgcgatcgcaacgcgcaaacgccgtatccacttccgaaatctatcaaccgctccctctaaacttccgtcctccgcccgcgcccgacgaaacctattcgcgtcgactacccaaaatccgcgaatcctccgctccgaacccgtccgaactcccccgatcccaaataacgaccaacaaaaacgaacgtctcaccctatcgacctctcttatccaaacctaacgccgaacttaccgcgaaaacaataaaacgaaaactcaaaccgcgaa

SEQ ID NO: 1851 - DNA, 565 bp, Artificial Sequence
  chemically treated genomic DNA (Homo sapiens) CpG-island No: 1851
cgttttttaggtttaagagttttaaagatttttaatttttagtaatttattttttgataaaagattttgcgaaattgttaaagcgttatatttcggttcgcgattgtgaggaaattggttgaggaacggagtgggacgtttatgtcgtttcgttagtatttgttaggcgtttcgtggggtagtattttttttgaagggtcgtcgatagtattacgttaatggaacggcgtatttttttttattgtagtttgtttaatttcggattgcgcgttcgagttgtgcgtatgcgcggatcgttcgcgcggtcgtaacgcgtaggcgtcgtgtttattttcgggatttgttagtcgttttttttgggttttcgtttttcgttcgcgttcgacggagtttgttcgcgtcgattgtttagagttcgcgaatttttcgtttcgagttcgttcggattttttcgattttaggtaacggttagtaggggcgagcgttttattttgtcggttttttttgtttaggtttggcgtcggatttgtcgcgggggtagtgagacgggggtttaggtcgcggg

SEQ ID NO: 1852 - DNA, 565 bp, Artificial Sequence
  chemically treated genomic DNA (Homo sapiens) CpG-island No: 1852
cccgcgacctaaacccccgtctcactacccccgcgacaaatccgacgccaaacctaaacaaaaaaaaccgacaaaataaaacgctcgcccctactaaccgttacctaaaatcgaaaaaatccgaacgaactcgaaacgaaaaattcgcgaactctaaacaatcgacgcgaacaaactccgtcgaacgcgaacgaaaaacgaaaacccaaaaaaaacgactaacaaatcccgaaaataaacacgacgcctacgcgttacgaccgcgcgaacgatccgcgcatacgcacaactcgaacgcgcaatccgaaattaaacaaactacaataaaaaaaaatacgccgttccattaacgtaatactatcgacgacccttcaaaaaaaatactaccccacgaaacgcctaacaaatactaacgaaacgacataaacgtcccactccgttcctcaaccaatttcctcacaatcgcgaaccgaaatataacgctttaacaatttcgcaaaatcttttatcaaaaaataaattactaaaaattaaaaatctttaaaactcttaaacctaaaaaacg

SEQ ID NO: 1853 - DNA, 825 bp, Artificial Sequence
  chemically treated genomic DNA (Homo sapiens) CpG-island No: 1853
ttttcggttagtttttggtcgtcgtcgaatttcgcgcgttattcgttcgtttagagggaggagaaagtggcgagtttcggatttttgtttagcgcggtttaatttttattttagagattatggttgtcgaggatgtggtggcgattggcgtcgatttaagcgatttggagagcggcgggttgttgtatgagatttttacgtcgtcgtttaatttgttgttgtttggtttttgtatttttttgttttataagatcgtgcgcggggattagtcggcggttagcggcgatagcgacgacgacgagtcgttttttttgtttcgttttaagcggcgcgattttattttcgtcgagttgcggcgtttcgacggcgtttaggattcgcgtatatttatggttattaacggtaaggtgttcgatgtgattaaaggtcgtaaattttacgggttcggtacgcggtcggcgaggggggtttggagataaaagaagggggtttcggtacggggttgggcgggagagaggcgaggcgggagcggggcgtttttgagtggagggaggaatggcggcgagttagggtaggcgggtaggcgggtaggcggagagtcgggaggttttcggggcgggtagggaataagaggcgttttagaggggttgcgggttagttagggacgcggattttcggttcgcgttgatagcgttgggagggggttagagaaagaaggttgaggcgtttaagtcgggggtgggtgggattacgaagttcgaaggcgttgaggggggatatattaaagtttaggttgttggggtagttttcgaaggttttgggttt

SEQ ID NO: 1854 - DNA, 825 bp, Artificial Sequence
  chemically treated genomic DNA (Homo sapiens) CpG-island No: 1854
aaacccaaaaccttcgaaaactaccccaacaacctaaactttaatatatcccccctcaacgccttcgaacttcgtaatcccacccacccccgacttaaacgcctcaaccttctttctctaaccccctcccaacgctatcaacgcgaaccgaaaatccgcgtccctaactaacccgcaacccctctaaaacgcctcttattccctacccgccccgaaaacctcccgactctccgcctacccgcctacccgcctaccctaactcgccgccattcctccctccactcaaaaacgccccgctcccgcctcgcctctctcccgcccaaccccgtaccgaaacccccttcttttatctccaaacccccctcgccgaccgcgtaccgaacccgtaaaatttacgacctttaatcacatcgaacaccttaccgttaataaccataaatatacgcgaatcctaaacgccgtcgaaacgccgcaactcgacgaaaataaaatcgcgccgcttaaaacgaaacaaaaaaaacgactcgtcgtcgtcgctatcgccgctaaccgccgactaatccccgcgcacgatcttataaaacaaaaaaatacaaaaaccaaacaacaacaaattaaacgacgacgtaaaaatctcatacaacaacccgccgctctccaaatcgcttaaatcgacgccaatcgccaccacatcctcgacaaccataatctctaaaataaaaattaaaccgcgctaaacaaaaatccgaaactcgccactttctcctccctctaaacgaacgaataacgcgcgaaattcgacgacgaccaaaaactaaccgaaaa

SEQ ID NO: 1855 - DNA, 825 bp, Artificial Sequence
  chemically treated genomic DNA (Homo sapiens) CpG-island No: 1855
aagtttaggattttcgaaaattattttaatagtttgggttttgatgtgtttttttttaacgttttcgagtttcgtggttttatttattttcggtttaagcgttttagttttttttttttaatttttttttagcgttgttagcgcgggtcggggattcgcgtttttgattggttcgtagtttttttagagcgttttttgttttttgttcgtttcgggagtttttcggtttttcgtttgttcgtttattcgtttattttagttcgtcgttatttttttttttatttaggggcgtttcgttttcgtttcgtttttttttcgtttagtttcgtgtcggggttttttttttttgtttttaagtttttttcgtcggtcgcgtatcgggttcgtagaatttgcggtttttggttatatcgaatattttgtcgttgatggttatgagtatgcgcgggttttggacgtcgtcgaagcgtcgtagttcggcgggggtgaagtcgcgtcgtttgaggcggggtagagggggcggttcgtcgtcgtcgttgtcgtcgttggtcgtcggttggttttcgcgtacgattttgtagagtaggaagatgtagaggttaagtagtagtaggttgagcggcgacgtgaaaattttatgtagtagttcgtcgttttttagatcgtttgggtcggcgttagtcgttattatattttcggtagttatgatttttggagtaaaggttgggtcgcgttaggtagggattcggaattcgttatttttttttttttttgagcgagcgagtggcgcgcggggttcggcggcggttaaagattagtcgggga

SEQ ID NO: 1856 - DNA, 825 bp, Artificial Sequence
  chemically treated genomic DNA (Homo sapiens) CpG-island No: 1856
tccccgactaatctttaaccgccgccgaaccccgcgcgccactcgctcgctcaaaaaaaaaaaaaaataacgaattccgaatccctacctaacgcgacccaacctttactccaaaaatcataactaccgaaaatataataacgactaacgccgacccaaacgatctaaaaaacgacgaactactacataaaattttcacgtcgccgctcaacctactactacttaacctctacatcttcctactctacaaaatcgtacgcgaaaaccaaccgacgaccaacgacgacaacgacgacgacgaaccgccccctctaccccgcctcaaacgacgcgacttcacccccgccgaactacgacgcttcgacgacgtccaaaacccgcgcatactcataaccatcaacgacaaaatattcgatataaccaaaaaccgcaaattctacgaacccgatacgcgaccgacgaaaaaaacttaaaaacaaaaaaaaaaaaccccgacacgaaactaaacgaaaaaaaaacgaaacgaaaacgaaacgcccctaaataaaaaaaaaaataacgacgaactaaaataaacgaataaacgaacaaacgaaaaaccgaaaaactcccgaaacgaacaaaaaacaaaaaacgctctaaaaaaactacgaaccaatcaaaaacgcgaatccccgacccgcgctaacaacgctaaaaaaaaattaaaaaaaaaaaactaaaacgcttaaaccgaaaataaataaaaccacgaaactcgaaaacgttaaaaaaaaacacatcaaaacccaaactattaaaataattttcgaaaatcctaaactt

SEQ ID NO: 1857 - DNA, 584 bp, Artificial Sequence
  chemically treated genomic DNA (Homo sapiens) CpG-island No: 1857
gcggggattgcggcggtagcgggttgttttaggtcgcgggtatcgttcgggcgggaatttgggcgtcgtggacgaaaggtgcggggtgattttcggacgaggttaattgagatcggttgtcgggcgtaggggattttttcgtagtcgtttattttcgggggtttattcgttttatagcggcgaacgcggtgtttcggattttagtcgggtttatttcgtagttcgttttcgggtagaacgtgggatgtgtaatttcggtagttcgaattcgcgttagggtttcggttcgtcgtcgttcggatatattttcgtcgtcgttcgggtggttttagttttttttcgggcggttcgagcgggtatcgtttatttgtatcgcgagttagttcgtcgtttcgagggtttcggaagtcgcggttgcgtggtttcggtcggagggtattcggtttttgtcgtttggaaggtttcgcgtcgggagcggtcgaaggaggagtttgacgggtggcgggggagtttgggcggttggaggaggaggaggaggaggaggagaaggaggaggaggatttcgacgttttgttttggggaga

SEQ ID NO: 1858 - DNA, 584 bp, Artificial Sequence
  chemically treated genomic DNA (Homo sapiens) CpG-island No: 1858
tctccccaaaacaaaacgtcgaaatcctcctcctccttctcctcctcctcctcctcctcctccaaccgcccaaactcccccgccacccgtcaaactcctccttcgaccgctcccgacgcgaaaccttccaaacgacaaaaaccgaataccctccgaccgaaaccacgcaaccgcgacttccgaaaccctcgaaacgacgaactaactcgcgatacaaataaacgatacccgctcgaaccgcccgaaaaaaaactaaaaccacccgaacgacgacgaaaatatatccgaacgacgacgaaccgaaaccctaacgcgaattcgaactaccgaaattacacatcccacgttctacccgaaaacgaactacgaaataaacccgactaaaatccgaaacaccgcgttcgccgctataaaacgaataaacccccgaaaataaacgactacgaaaaaatcccctacgcccgacaaccgatctcaattaacctcgtccgaaaatcaccccgcacctttcgtccacgacgcccaaattcccgcccgaacgatacccgcgacctaaaacaacccgctaccgccgcaatccccgc

SEQ ID NO: 1859 - DNA, 584 bp, Artificial Sequence
  chemically treated genomic DNA (Homo sapiens) CpG-island No: 1859
tttttttagagtaaagcgtcggagtttttttttttttttttttttttttttttttttttttttagtcgtttaggttttttcgttattcgttagatttttttttcgatcgttttcggcgcggggttttttaggcgataaggatcgagtatttttcggtcggagttacgtagtcgcggttttcggagttttcggggcggcggattggttcgcggtgtaggtgagcgatgttcgttcgggtcgttcggggagggattggggttattcgggcggcggcgggggtgtgttcgggcggcggcgggtcgaggttttgacgcgggttcgggttgtcgagattgtatattttacgttttgttcggggacgagttgcgagatgagttcggttggaattcggggtatcgcgttcgtcgttgtggggcgagtgagttttcgagagtgagcggttgcggagaggttttttgcgttcggtagtcggttttagttggtttcgttcgaaggttatttcgtatttttcgtttacggcgtttaagttttcgttcgggcggtgttcgcgatttggggtaattcgttgtcgtcgtagttttcgt

SEQ ID NO: 1860 - DNA, 584 bp, Artificial Sequence
  chemically treated genomic DNA (Homo sapiens) CpG-island No: 1860
acgaaaactacgacgacaacgaattaccccaaatcgcgaacaccgcccgaacgaaaacttaaacgccgtaaacgaaaaatacgaaataaccttcgaacgaaaccaactaaaaccgactaccgaacgcaaaaaacctctccgcaaccgctcactctcgaaaactcactcgccccacaacgacgaacgcgataccccgaattccaaccgaactcatctcgcaactcgtccccgaacaaaacgtaaaatatacaatctcgacaacccgaacccgcgtcaaaacctcgacccgccgccgcccgaacacacccccgccgccgcccgaataaccccaatccctccccgaacgacccgaacgaacatcgctcacctacaccgcgaaccaatccgccgccccgaaaactccgaaaaccgcgactacgtaactccgaccgaaaaatactcgatccttatcgcctaaaaaaccccgcgccgaaaacgatcgaaaaaaaaatctaacgaataacgaaaaaacctaaacgactaaaaaaaaaaaaaaaaaaaaaaaaaaaaaaaaaaaaaaactccgacgctttactctaaaaaaa

SEQ ID NO: 1861 - DNA, 916 bp, Artificial Sequence
  chemically treated genomic DNA (Homo sapiens) CpG-island No: 1861
atcgcgttcggtcgtttttcgtttttgtaaattgtgtgttagggttttaggcgggttcgggtagtagcggcggcgcgcgtacgcgtatttcgcggtttcgcgcggttttttaatatttaattttacgtgttgtttgttgtaggcgttataggttttttatttgcgttcgggcgttcgggcggtttcgttattgtcggcgggttttggggaatcgttgggtcggcgcgttcggggttggcggagtaatttttgaggcgtttaagtttatttttaacgttaatttcgtttatttagtttcggcggttttttttttttttttttttaattttttttcgtttttgttcgtttttttcgttttggtggtaggaaatatttttgaatttaattcgacgtgttcggaaagttttggttagtttttttttcgttttgcggtcgttgtagttagtttcgcggtttttttagattcgcgggcgtagtcgtcgggggtgaggcgtttggggatcgcgggtcgagcggcggggattttcgagtattatgttggattcgttttttagcgaagaggagtcggacgaggggttggaagaggaaagtcgcgatgtgttggtggtagtcggtagttcgtagcgagtttttttagtttcgattcgggaagggcggcgggacgtcggggcgcgcgggcggcggcggcgcggttagatttgtgagttcgagtttttttgtgtttagcgaggggcgagacgagtttagcggtagttggacgatgagtaggagcggaggatgcgtttgtagttttacgttttcgtcgtgaggtgtatcgcgtatttttttaacgttaagtagtttatcgatatggttcggaggtagtagaaggtgagttgcgggagtcgggcgttttttattattatttttttttggg

SEQ ID NO: 1862 - DNA, 916 bp, Artificial Sequence
  chemically treated genomic DNA (Homo sapiens) CpG-island No: 1862
cccaaaaaaaaataataataaaaaacgcccgactcccgcaactcaccttctactacctccgaaccatatcgataaactacttaacgttaaaaaaatacgcgatacacctcacgacgaaaacgtaaaactacaaacgcatcctccgctcctactcatcgtccaactaccgctaaactcgtctcgcccctcgctaaacacaaaaaaactcgaactcacaaatctaaccgcgccgccgccgcccgcgcgccccgacgtcccgccgcccttcccgaatcgaaactaaaaaaactcgctacgaactaccgactaccaccaacacatcgcgactttcctcttccaacccctcgtccgactcctcttcgctaaaaaacgaatccaacataatactcgaaaatccccgccgctcgacccgcgatccccaaacgcctcacccccgacgactacgcccgcgaatctaaaaaaaccgcgaaactaactacaacgaccgcaaaacgaaaaaaaaactaaccaaaactttccgaacacgtcgaattaaattcaaaaatatttcctaccaccaaaacgaaaaaaacgaacaaaaacgaaaaaaaattaaaaaaaaaaaaaaaaaaaaccgccgaaactaaataaacgaaattaacgttaaaaataaacttaaacgcctcaaaaattactccgccaaccccgaacgcgccgacccaacgattccccaaaacccgccgacaataacgaaaccgcccgaacgcccgaacgcaaataaaaaacctataacgcctacaacaaacaacacgtaaaattaaatattaaaaaaccgcgcgaaaccgcgaaatacgcgtacgcgcgccgccgctactacccgaacccgcctaaaaccctaacacacaatttacaaaaacgaaaaacgaccgaacgcgat

SEQ ID NO: 1863 - DNA, 916 bp, Artificial Sequence
  chemically treated genomic DNA (Homo sapiens) CpG-island No: 1863
tttagggagaagtggtggtaggaggcgttcggttttcgtaatttattttttgttgttttcgggttatgtcggtgggttgtttggcgttgaaggggtacgcgatgtattttacgacgaagacgtagagttgtaggcgtatttttcgtttttgtttatcgtttagttgtcgttgggttcgtttcgtttttcgttgagtatagaggggttcgggtttatagatttggtcgcgtcgtcgtcgttcgcgcgtttcggcgtttcgtcgtttttttcgagtcggggttggaggagttcgttgcgagttgtcggttgttattagtatatcgcggttttttttttttagtttttcgttcgattttttttcgttggaagacgggtttagtatggtgttcggggattttcgtcgttcggttcgcggtttttaagcgttttattttcggcggttgcgttcgcgggtttgagggagtcgcggggttggttgtagcggtcgtagaacgaaaggaaaattggttagggtttttcggatacgtcgagttagatttaggagtgttttttattattagggcgaaaggggcgggtaggagcgggagaggattgggaggggggagagggggagtcgtcgggattgaataggcggagttagcgttgggggtgagtttgggcgttttaggaattgtttcgttagtttcgggcgcgtcgatttagcggttttttagagttcgtcggtagtagcggagtcgttcgagcgttcggacgtaggtggggaatttgtggcgtttataataagtaatacgtggaattgaatgttgaagagtcgcgcggggtcgcggagtgcgcgtgcgcgcgtcgtcgttgttgttcgggttcgtttggagttttagtatatagtttgtaaaggcggggagcggtcgagcgcgat

SEQ ID NO: 1864 - DNA, 916 bp, Artificial Sequence
  chemically treated genomic DNA (Homo sapiens) CpG-island No: 1864
atcgcgctcgaccgctccccgcctttacaaactatatactaaaactccaaacgaacccgaacaacaacgacgacgcgcgcacgcgcactccgcgaccccgcgcgactcttcaacattcaattccacgtattacttattataaacgccacaaattccccacctacgtccgaacgctcgaacgactccgctactaccgacgaactctaaaaaaccgctaaatcgacgcgcccgaaactaacgaaacaattcctaaaacgcccaaactcacccccaacgctaactccgcctattcaatcccgacgactccccctctcccccctcccaatcctctcccgctcctacccgcccctttcgccctaataataaaaaacactcctaaatctaactcgacgtatccgaaaaaccctaaccaattttcctttcgttctacgaccgctacaaccaaccccgcgactccctcaaacccgcgaacgcaaccgccgaaaataaaacgcttaaaaaccgcgaaccgaacgacgaaaatccccgaacaccatactaaacccgtcttccaacgaaaaaaaatcgaacgaaaaactaaaaaaaaaaaaccgcgatatactaataacaaccgacaactcgcaacgaactcctccaaccccgactcgaaaaaaacgacgaaacgccgaaacgcgcgaacgacgacgacgcgaccaaatctataaacccgaacccctctatactcaacgaaaaacgaaacgaacccaacgacaactaaacgataaacaaaaacgaaaaatacgcctacaactctacgtcttcgtcgtaaaatacatcgcgtaccccttcaacgccaaacaacccaccgacataacccgaaaacaacaaaaaataaattacgaaaaccgaacgcctcctaccaccacttctccctaaa

SEQ ID NO: 1865 - DNA, 507 bp, Artificial Sequence
  chemically treated genomic DNA (Homo sapiens) CpG-island No: 1865
cgtcgtttgtgattttagtcgggacggattcgcgggcgggagtttgcggggcgtgaggcggggtggggttttggtttttttttttcgtttagtcgcggcgtttgacgtttcgcgcgtcggcggtcgcggagtagcgtagggagttaggcgggttgtcggcgggtaagggtttttgcgattcggggattcgtggggcgtaggtcgcggagggagagcgtcgttgtttggtttggagaatttcgcggagttggtttggttcgattcggttcggttcggttcgcggcgcggtggtcgagggttcgcggcgttttttgggagcgggagggtcgggaagtcgggcgttggtggagggaggcgttgggtttttgtcgtcgcgaagttggcggaaaaggtagtggttagcgagtcgtttcgttagtttttacgatttttagggaggtggcgatattcgtttttcgggttattttttttttttttttgatcggggttcgtgtttgtttttttagg

SEQ ID NO: 1866 - DNA, 507 bp, Artificial Sequence
  chemically treated genomic DNA (Homo sapiens) CpG-island No: 1866
cctaaaaaaacaaacacgaaccccgatcaaaaaaaaaaaaaaaataacccgaaaaacgaatatcgccacctccctaaaaatcgtaaaaactaacgaaacgactcgctaaccactaccttttccgccaacttcgcgacgacaaaaacccaacgcctccctccaccaacgcccgacttcccgaccctcccgctcccaaaaaacgccgcgaaccctcgaccaccgcgccgcgaaccgaaccgaaccgaatcgaaccaaaccaactccgcgaaattctccaaaccaaacaacgacgctctccctccgcgacctacgccccacgaatccccgaatcgcaaaaacccttacccgccgacaacccgcctaactccctacgctactccgcgaccgccgacgcgcgaaacgtcaaacgccgcgactaaacgaaaaaaaaaaaccaaaaccccaccccgcctcacgccccgcaaactcccgcccgcgaatccgtcccgactaaaatcacaaacgacg

SEQ ID NO: 1867 - DNA, 507 bp, Artificial Sequence
  chemically treated genomic DNA (Homo sapiens) CpG-island No: 1867
tttgggaaggtaagtacggatttcggttaggaaggggaaaagggtggttcgggaagcgggtgtcgttatttttttgggagtcgtgggaattggcgaggcggttcgttggttattgtttttttcgttagtttcgcggcgatagaagtttaacgtttttttttattaacgttcggtttttcggttttttcgtttttagaaggcgtcgcgggttttcgattatcgcgtcgcggatcgggtcgggtcgggtcgggttaggttagtttcgcggggttttttagattaggtagcggcgtttttttttcgcggtttacgttttacgggttttcgggtcgtagaagtttttattcgtcggtagttcgtttggttttttgcgttgtttcgcggtcgtcgacgcgcgggacgttagacgtcgcggttgggcgggggaggggagttagggttttatttcgttttacgtttcgtaggttttcgttcgcgggttcgtttcggttgaggttataggcggcg

SEQ ID NO: 1868 - DNA, 507 bp, Artificial Sequence
  chemically treated genomic DNA (Homo sapiens) CpG-island No: 1868
cgccgcctataacctcaaccgaaacgaacccgcgaacgaaaacctacgaaacgtaaaacgaaataaaaccctaactcccctcccccgcccaaccgcgacgtctaacgtcccgcgcgtcgacgaccgcgaaacaacgcaaaaaaccaaacgaactaccgacgaataaaaacttctacgacccgaaaacccgtaaaacgtaaaccgcgaaaaaaaaacgccgctacctaatctaaaaaaccccgcgaaactaacctaacccgacccgacccgacccgatccgcgacgcgataatcgaaaacccgcgacgccttctaaaaacgaaaaaaccgaaaaaccgaacgttaataaaaaaaaacgttaaacttctatcgccgcgaaactaacgaaaaaaacaataaccaacgaaccgcctcgccaattcccacgactcccaaaaaaataacgacacccgcttcccgaaccacccttttccccttcctaaccgaaatccgtacttaccttcccaaa

SEQ ID NO: 1869 - DNA, 1065 bp, Artificial Sequence
  chemically treated genomic DNA (Homo sapiens) CpG-island No: 1869
gatagcgtaggcgtcgcgtatttttatttgtatacgtttttttttaggtcgtatacggggtcgtcgttgtttacgttcgggtcggatagggatagggagtttacggtcgatttcgatgtcgacgagtttttggataagttttttagtgttggcgtgaagtagagcgatttttttagaaaggagacggagtagtcgtttgcgtcggggagtatggaggagagcgtgagaggttacgattggttttcgcgcgacgttcgcgtagtttagattagggtcggtagtaggcggagcggaggagcgtgttgcggggtttttgcgttaattttagtttggttttttttattaaggagcgcgtattcgacgatatttttaattcggagttgagttatttgatcgtggacgatcggtacggggttatttattgttacgtgtttaaggtggtttgtattaattggaagcgcgtgatgatcgtgttgagcggaagtttgttgtatcgcggtgcgttttatcgcgattcgttgcgtatttcgcgcgagtacgtgtataacgttagcgcgtatttgatttttaataagttttggcgtcgttacgggaagttttttcgttattttatgaaggttaagtttaagaagtatattaagttttttttcgtgcgcgattttttcgtgcgtttgattttcgtttttcgtagtaagttcgagttggagaacgaggagttttatcgtaagttcgtcgtgtttatgttgcggttgtacgttaattatattagtttgttcgtttcggcgcgcgaggtttttcgcgttggttttaaggtgtttttcgttaattttatttagtatttgttggattcgtatacggagaagttggcgttttttaacgagtattggcggtaggtgtatcgtttttgttattcgtgttagatcgattacgatttcgtggggaagttggagattttggacgaggacgtcgcgtagttgttgtagttattttaggtggatcggtagtttcgttttttttcgagttatcggaataggatcgttagtagttgggaggaggattggttcg

SEQ ID NO: 1870 - DNA, 1065 bp, Artificial Sequence
  chemically treated genomic DNA (Homo sapiens) CpG-island No: 1870
cgaaccaatcctcctcccaactactaacgatcctattccgataactcgaaaaaaaacgaaactaccgatccacctaaaataactacaacaactacgcgacgtcctcgtccaaaatctccaacttccccacgaaatcgtaatcgatctaacacgaataacaaaaacgatacacctaccgccaatactcgttaaaaaacgccaacttctccgtatacgaatccaacaaatactaaataaaattaacgaaaaacaccttaaaaccaacgcgaaaaacctcgcgcgccgaaacgaacaaactaatataattaacgtacaaccgcaacataaacacgacgaacttacgataaaactcctcgttctccaactcgaacttactacgaaaaacgaaaatcaaacgcacgaaaaaatcgcgcacgaaaaaaaacttaatatacttcttaaacttaaccttcataaaataacgaaaaaacttcccgtaacgacgccaaaacttattaaaaatcaaatacgcgctaacgttatacacgtactcgcgcgaaatacgcaacgaatcgcgataaaacgcaccgcgatacaacaaacttccgctcaacacgatcatcacgcgcttccaattaatacaaaccaccttaaacacgtaacaataaataaccccgtaccgatcgtccacgatcaaataactcaactccgaattaaaaatatcgtcgaatacgcgctccttaataaaaaaaaccaaactaaaattaacgcaaaaaccccgcaacacgctcctccgctccgcctactaccgaccctaatctaaactacgcgaacgtcgcgcgaaaaccaatcgtaacctctcacgctctcctccatactccccgacgcaaacgactactccgtctcctttctaaaaaaatcgctctacttcacgccaacactaaaaaacttatccaaaaactcgtcgacatcgaaatcgaccgtaaactccctatccctatccgacccgaacgtaaacaacgacgaccccgtatacgacctaaaaaaaaacgtatacaaataaaaatacgcgacgcctacgctatc

SEQ ID NO: 1871 - DNA, 1065 bp, Artificial Sequence
  chemically treated genomic DNA (Homo sapiens) CpG-island No: 1871
cgaattagttttttttttagttgttggcggttttgtttcggtagttcggggggaagcggagttgtcggtttatttggagtagttgtagtagttgcgcggcgttttcgtttagagtttttagtttttttacgaagtcgtagtcgatttggtacgggtggtagaggcggtatatttgtcgttagtgttcgttgaagggcgttagttttttcgtgtgcgggtttagtaggtattggatgaagttggcgaaggatattttgaggttagcgcggaaggtttcgcgcgtcgaggcgggtaggttggtgtggttggcgtatagtcgtagtatgggtacggcgaatttgcggtagaatttttcgttttttagttcgaatttgttgcggaaggcggagattaggcgtacgaaggggtcgcgtacgaagaggaatttggtgtattttttgagtttgatttttatgaggtggcgggagagtttttcgtagcggcgttagaatttgttgaaggttaggtgcgcgttggcgttgtgtacgtgttcgcgcgggatgcgtagcgggtcgcggtagggcgtatcgcggtgtagtaggttttcgtttagtacgattattacgcgtttttagttggtgtaggttattttgggtacgtagtagtagatggtttcgtgtcggtcgtttacgattaggtggtttagtttcgagttggggatgtcgtcgaatgcgcgttttttggtggggaaggttaggttggagttggcgtagaagtttcgtagtacgttttttcgtttcgtttgttgtcggttttggtttgggttgcgcgggcgtcgcgcggggattagtcgtagttttttacgtttttttttatgtttttcggcgtaggcggttgtttcgttttttttttgggaaggtcgttttgttttacgttagtattgagaaatttgtttagaaattcgtcgatatcggagtcggtcgtgagttttttgtttttgttcggttcgggcgtgggtagcggcggtttcgtgtgcggtttagagaaggacgtgtgtaagtagaagtgcgcggcgtttgcgttgtt

SEQ ID NO: 1872 - DNA, 1065 bp, Artificial Sequence
  chemically treated genomic DNA (Homo sapiens) CpG-island No: 1872
aacaacgcaaacgccgcgcacttctacttacacacgtccttctctaaaccgcacacgaaaccgccgctacccacgcccgaaccgaacaaaaacaaaaaactcacgaccgactccgatatcgacgaatttctaaacaaatttctcaatactaacgtaaaacaaaacgaccttcccaaaaaaaaaacgaaacaaccgcctacgccgaaaaacataaaaaaaaacgtaaaaaactacgactaatccccgcgcgacgcccgcgcaacccaaaccaaaaccgacaacaaacgaaacgaaaaaacgtactacgaaacttctacgccaactccaacctaaccttccccaccaaaaaacgcgcattcgacgacatccccaactcgaaactaaaccacctaatcgtaaacgaccgacacgaaaccatctactactacgtacccaaaataacctacaccaactaaaaacgcgtaataatcgtactaaacgaaaacctactacaccgcgatacgccctaccgcgacccgctacgcatcccgcgcgaacacgtacacaacgccaacgcgcacctaaccttcaacaaattctaacgccgctacgaaaaactctcccgccacctcataaaaatcaaactcaaaaaatacaccaaattcctcttcgtacgcgaccccttcgtacgcctaatctccgccttccgcaacaaattcgaactaaaaaacgaaaaattctaccgcaaattcgccgtacccatactacgactatacgccaaccacaccaacctacccgcctcgacgcgcgaaaccttccgcgctaacctcaaaatatccttcgccaacttcatccaatacctactaaacccgcacacgaaaaaactaacgcccttcaacgaacactaacgacaaatataccgcctctaccacccgtaccaaatcgactacgacttcgtaaaaaaactaaaaactctaaacgaaaacgccgcgcaactactacaactactccaaataaaccgacaactccgcttccccccgaactaccgaaacaaaaccgccaacaactaaaaaaaaaactaattcg

SEQ ID NO: 1873 - DNA, 814 bp, Artificial Sequence
  chemically treated genomic DNA (Homo sapiens) CpG-island No: 1873
aggttggttaacgggatcgtgtttggttgtaacgtggagttttcgggtcgaacggcgagatagttgcgcgttttcgagtcgtcgcgcgttcggttcgtcggggcggtgttaacgtcgcggattggttgttgagaaaggggcgtggttcgtggcggtcggtgggcggagtcgatttttggtcgtaaatacggcgttatatggtattggttcgcgagggcgggggcgggcgggttggtcgggcgtaggcgcgttgagggcgggcgttttcggttttcgtggttttttcggcggtcgcgacgtttcgcgagaagacgatcggtagaaggggtttttgcgtcgggggcgggtcggcgagggttgtttttggggggttcgttagtcgcggggcggcggcggcggttgcgggcgcgaggtgaggggcgcgaggtgagggtcgcgaggtgaggggcgcggcgggcggcgggttcggggcgcggtttttttttttttcggttagtgttgggtttttagggttcgggcgggggtttcgggtcgcgttgaggggcgcgggtcggttttttttaatttggtttggcgggcgcggtttgggtttgggttcgagttttcgcgtcggcgcgtagtgtgattttggttttgcgcgcgttttttttgagtttcgttcgtcgttttcggttagggggatttagttttggggttttgattagcgcgttttgcggtttttcggggtttggacgagaaatttgtggttttgatttagcgatagtagaggttgtagcggtttcgtcggtttttaggagtttttttgttcggtatt

SEQ ID NO: 1874 - DNA, 814 bp, Artificial Sequence
  chemically treated genomic DNA (Homo sapiens) CpG-island No: 1874
aataccgaacaaaaaaactcctaaaaaccgacgaaaccgctacaacctctactatcgctaaatcaaaaccacaaatttctcgtccaaaccccgaaaaaccgcaaaacgcgctaatcaaaaccccaaaactaaatccccctaaccgaaaacgacgaacgaaactcaaaaaaaacgcgcgcaaaaccaaaatcacactacgcgccgacgcgaaaactcgaacccaaacccaaaccgcgcccgccaaaccaaattaaaaaaaaccgacccgcgcccctcaacgcgacccgaaacccccgcccgaaccctaaaaacccaacactaaccgaaaaaaaaaaaaaccgcgccccgaacccgccgcccgccgcgcccctcacctcgcgaccctcacctcgcgcccctcacctcgcgcccgcaaccgccgccgccgccccgcgactaacgaaccccccaaaaacaaccctcgccgacccgcccccgacgcaaaaaccccttctaccgatcgtcttctcgcgaaacgtcgcgaccgccgaaaaaaccacgaaaaccgaaaacgcccgccctcaacgcgcctacgcccgaccaacccgcccgcccccgccctcgcgaaccaataccatataacgccgtatttacgaccaaaaatcgactccgcccaccgaccgccacgaaccacgcccctttctcaacaaccaatccgcgacgttaacaccgccccgacgaaccgaacgcgcgacgactcgaaaacgcgcaactatctcgccgttcgacccgaaaactccacgttacaaccaaacacgatcccgttaaccaacct

SEQ ID NO: 1875 - DNA, 814 bp, Artificial Sequence
  chemically treated genomic DNA (Homo sapiens) CpG-island No: 1875
gatgtcgggtagggggatttttgggggtcggcggggtcgttgtagtttttgttgtcgttgaattagaattatagatttttcgtttagatttcgaggagtcgtagaacgcgttgattagggttttagggttgggtttttttggtcgaggacgacgagcggggtttagagagggcgcgcgtagggttaaggttatattgcgcgtcggcgcgggaattcgaatttaggtttaagtcgcgttcgttaggttaggttaaggagagtcgattcgcgttttttagcgcggttcgggattttcgttcgggttttgggagtttagtattggtcgagagagagggagatcgcgtttcgagttcgtcgttcgtcgcgttttttatttcgcgatttttatttcgcgttttttatttcgcgttcgtagtcgtcgtcgtcgtttcgcgattagcggattttttagaggtagttttcgtcggttcgttttcggcgtaggagttttttttatcggtcgttttttcgcgagacgtcgcggtcgtcggaggggttacggaggtcgagggcgttcgtttttagcgcgtttgcgttcggttagttcgttcgttttcgttttcgcgagttagtgttatgtggcgtcgtatttacggttagagatcgatttcgtttatcggtcgttacgagttacgttttttttttagtagttaattcgcggcgttgatatcgtttcggcggatcgggcgcgcggcggttcggggacgcgtagttgtttcgtcgttcgattcgggagttttacgttgtagttaaatacgatttcgttaattaattt

SEQ ID NO: 1876 - DNA, 814 bp, Artificial Sequence
  chemically treated genomic DNA (Homo sapiens) CpG-island No: 1876
aaattaattaacgaaatcgtatttaactacaacgtaaaactcccgaatcgaacgacgaaacaactacgcgtccccgaaccgccgcgcgcccgatccgccgaaacgatatcaacgccgcgaattaactactaaaaaaaaaacgtaactcgtaacgaccgataaacgaaatcgatctctaaccgtaaatacgacgccacataacactaactcgcgaaaacgaaaacgaacgaactaaccgaacgcaaacgcgctaaaaacgaacgccctcgacctccgtaacccctccgacgaccgcgacgtctcgcgaaaaaacgaccgataaaaaaaactcctacgccgaaaacgaaccgacgaaaactacctctaaaaaatccgctaatcgcgaaacgacgacgacgactacgaacgcgaaataaaaaacgcgaaataaaaatcgcgaaataaaaaacgcgacgaacgacgaactcgaaacgcgatctccctctctctcgaccaatactaaactcccaaaacccgaacgaaaatcccgaaccgcgctaaaaaacgcgaatcgactctccttaacctaacctaacgaacgcgacttaaacctaaattcgaattcccgcgccgacgcgcaatataaccttaaccctacgcgcgccctctctaaaccccgctcgtcgtcctcgaccaaaaaaacccaaccctaaaaccctaatcaacgcgttctacgactcctcgaaatctaaacgaaaaatctataattctaattcaacgacaacaaaaactacaacgaccccgccgacccccaaaaatccccctacccgacatc

SEQ ID NO: 1877 - DNA, 769 bp, Artificial Sequence
  chemically treated genomic DNA (Homo sapiens) CpG-island No: 1877
cgtcgtatttagattatatcggttttttatatttacgtgtcgcgtattttatttttcgattgacgttattcgatacgattgttacgttatttttattttagtttttgcgtttttattttatttttttattatacgtattttatttttttcgtttttagttatatcgttattcgcgtttttattcgtatattttattatgttaattgcgttttatattgttagttatcgtaacgtttagttcgattatgtagttatttcgtagcgatatttatattttattcgtgttattattcgattttttttatatagacgacgatagatattagttatttgatttattttttgtatatatttgatttcgtatttttgcgtaagttttttttgatagtattatatattttacgtatatacgagaattgttttatttagattgtattttacgcggcgttgtcgtttatcgcgtttagtaataatatagagatttattataagcgtagcgttacggttttgtttttttgtttattttattattttattcgatattatagatatttgttatttttgagattgcgcgacgtttttatagttaatgaattcgcgcgatcgacgtttatatttttgtcgttttttatcgttgcgattattacgtatttattttttttcgtcgtatacgcgtcgacgtcgttcgatagtagtatacgatttattcgttatttatttttcgtcgttttattatagtagtcgcgtattttttattatttttacgcgt

SEQ ID NO: 1878 - DNA, 769 bp, Artificial Sequence
  chemically treated genomic DNA (Homo sapiens) CpG-island No: 1878
acgcgtaaaaataataaaaaatacgcgactactataataaaacgacgaaaaataaataacgaataaatcgtatactactatcgaacgacgtcgacgcgtatacgacgaaaaaaaataaatacgtaataatcgcaacgataaaaaacgacaaaaatataaacgtcgatcgcgcgaattcattaactataaaaacgtcgcgcaatctcaaaaataacaaatatctataatatcgaataaaataataaaataaacaaaaaaacaaaaccgtaacgctacgcttataataaatctctatattattactaaacgcgataaacgacaacgccgcgtaaaatacaatctaaataaaacaattctcgtatatacgtaaaatatataatactatcaaaaaaaacttacgcaaaaatacgaaatcaaatatatacaaaaaataaatcaaataactaatatctatcgtcgtctatataaaaaaaatcgaataataacacgaataaaatataaatatcgctacgaaataactacataatcgaactaaacgttacgataactaacaatataaaacgcaattaacataataaaatatacgaataaaaacgcgaataacgatataactaaaaacgaaaaaaataaaatacgtataataaaaaaataaaataaaaacgcaaaaactaaaataaaaataacgtaacaatcgtatcgaataacgtcaatcgaaaaataaaatacgcgacacgtaaatataaaaaaccgatataatctaaatacgacg

SEQ ID NO: 1879 - DNA, 769 bp, Artificial Sequence
  chemically treated genomic DNA (Homo sapiens) CpG-island No: 1879
gcgcgtgaggatagtggaagatgcgcggttgttgtgatgaggcggcgaggaatgagtagcgagtgagtcgtatgttgttgtcgagcggcgtcgacgcgtatgcggcgagagagagtgagtgcgtagtggtcgtagcggtaggagacgatagaggtgtggacgtcgatcgcgcgagtttattgattgtagaggcgtcgcgtagttttaggagtgataggtatttgtagtatcgagtagagtggtgagatagatagagaggtaggatcgtgacgttgcgtttgtgatgagtttttgtgttgttattgagcgcggtgagcgatagcgtcgcgtggagtgtagtttagatggagtagttttcgtgtgtgcgtgagatatatggtgttgttaggagaggtttgcgtaggagtgcgagattagatatgtgtagaggatgagttaggtggttagtgtttgtcgtcgtttgtgtagaggagatcggatgatgatacgagtgagatgtaggtgtcgttgcggaatgattgtatagtcgagttgggcgttgcggtagttggtagtgtgagacgtagttggtatggtagagtatgcggatagagacgcggatggcgatgtggttgaggacgaagaggatgagatgcgtgtagtgagaaggtggagtgaaagcgtaagagttaggatggaggtggcgtgatagtcgtatcgaatggcgttagtcgaggggtaggatgcgcgatacgtggatgtgaagaatcggtgtggtttgagtgcggcg

SEQ ID NO: 1880 - DNA, 769 bp, Artificial Sequence
  chemically treated genomic DNA (Homo sapiens) CpG-island No: 1880
cgccgcactcaaaccacaccgattcttcacatccacgtatcgcgcatcctacccctcgactaacgccattcgatacgactatcacgccacctccatcctaactcttacgctttcactccaccttctcactacacgcatctcatcctcttcgtcctcaaccacatcgccatccgcgtctctatccgcatactctaccataccaactacgtctcacactaccaactaccgcaacgcccaactcgactatacaatcattccgcaacgacacctacatctcactcgtatcatcatccgatctcctctacacaaacgacgacaaacactaaccacctaactcatcctctacacatatctaatctcgcactcctacgcaaacctctcctaacaacaccatatatctcacgcacacacgaaaactactccatctaaactacactccacgcgacgctatcgctcaccgcgctcaataacaacacaaaaactcatcacaaacgcaacgtcacgatcctacctctctatctatctcaccactctactcgatactacaaatacctatcactcctaaaactacgcgacgcctctacaatcaataaactcgcgcgatcgacgtccacacctctatcgtctcctaccgctacgaccactacgcactcactctctctcgccgcatacgcgtcgacgccgctcgacaacaacatacgactcactcgctactcattcctcgccgcctcatcacaacaaccgcgcatcttccactatcctcacgcgc

SEQ ID NO: 1881 - DNA, 520 bp, Artificial Sequence
  chemically treated genomic DNA (Homo sapiens) CpG-island No: 1881
tggtttcgtttacggcgagagtatcgtttataggttgaagattttgtttttttaggacggtcgagaacgcgtttgttttgtattatttttatttcgtttcgcgttttttaggagagtcggaaacgtttttatttttatttcgtttttgtacggtcgcgagaacgtatttgtttagttttttgttcgtttcgtttatttagcgcgcgcgggagcgcgcgcgggagtagttttaatttttttaatttgtcgttatttttacggcggtcgattttttagtttgtttcgcgtttagggaggcggacgttaggtttttgaaaaggggacggggggcgggggacgggggacgggggtcggcgggaggggacgcggtcggtagatggcgaaggaggggcgcgaggaggcggttattgttgaggggcggggcgtttcgtcgagagtttgggtgcggtgcggttttttttttttttgtgttttattttattttttgagttatagggaattcgttttttagtattttttt

SEQ ID NO: 1882 - DNA, 520 bp, Artificial Sequence
  chemically treated genomic DNA (Homo sapiens) CpG-island No: 1882
aaaaaaatactaaaaaacgaattccctataactcaaaaaataaaataaaacacaaaaaaaaaaaaaaccgcaccgcacccaaactctcgacgaaacgccccgcccctcaacaataaccgcctcctcgcgcccctccttcgccatctaccgaccgcgtcccctcccgccgacccccgtcccccgtcccccgccccccgtccccttttcaaaaacctaacgtccgcctccctaaacgcgaaacaaactaaaaaatcgaccgccgtaaaaataacgacaaattaaaaaaattaaaactactcccgcgcgcgctcccgcgcgcgctaaataaacgaaacgaacaaaaaactaaacaaatacgttctcgcgaccgtacaaaaacgaaataaaaataaaaacgtttccgactctcctaaaaaacgcgaaacgaaataaaaataatacaaaacaaacgcgttctcgaccgtcctaaaaaaacaaaatcttcaacctataaacgatactctcgccgtaaacgaaacca

SEQ ID NO: 1883 - DNA, 520 bp, Artificial Sequence
  chemically treated genomic DNA (Homo sapiens) CpG-island No: 1883
agagaagtattagaaaacggattttttgtggtttagggaataaagtgggatataagaaaaaagaaaatcgtatcgtatttagattttcggcgggacgtttcgttttttaatagtggtcgttttttcgcgtttttttttcgttatttgtcggtcgcgttttttttcgtcggttttcgtttttcgtttttcgtttttcgttttttttttagagatttgacgttcgtttttttggacgcgaggtaggttgggaagtcggtcgtcgtaaagatggcggtaaattgaaaaagttggagttgttttcgcgcgcgttttcgcgcgcgttgagtgggcggagcgaatagggggttggataggtgcgttttcgcggtcgtgtagaagcgaagtaggggtaggagcgttttcggtttttttgaaggacgcggggcggggtgggggtggtgtaaggtaggcgcgttttcggtcgttttgaaggggtaggatttttagtttgtgggcggtgttttcgtcgtgagcggggtta

SEQ ID NO: 1884 - DNA, 520 bp, Artificial Sequence
  chemically treated genomic DNA (Homo sapiens) CpG-island No: 1884
taaccccgctcacgacgaaaacaccgcccacaaactaaaaatcctaccccttcaaaacgaccgaaaacgcgcctaccttacaccacccccaccccgccccgcgtccttcaaaaaaaccgaaaacgctcctacccctacttcgcttctacacgaccgcgaaaacgcacctatccaaccccctattcgctccgcccactcaacgcgcgcgaaaacgcgcgcgaaaacaactccaactttttcaatttaccgccatctttacgacgaccgacttcccaacctacctcgcgtccaaaaaaacgaacgtcaaatctctaaaaaaaaaacgaaaaacgaaaaacgaaaaacgaaaaccgacgaaaaaaaacgcgaccgacaaataacgaaaaaaaaacgcgaaaaaacgaccactattaaaaaacgaaacgtcccgccgaaaatctaaatacgatacgattttcttttttcttatatcccactttattccctaaaccacaaaaaatccgttttctaatacttctct

SEQ ID NO: 1885 - DNA, 2092 bp, Artificial Sequence
  chemically treated genomic DNA (Homo sapiens) CpG-island No: 1885
tatcgacgttttggtttttttgttgttcgttgggaattcgggtgggacgttttttaaagtttggattttacggtatatttttttttcggaaaggtataatcggttcggcgtgttagtttagttggatttacgtcggtgcggggtcgtagtttcggttttcgttgggcggttgcggagggttgggcgatttttttagcgtcgcgaggcgattcgggtagtagtaaattttttcgtttttttttttcgggacgcggtattttttttgtttttgagtatttcgtaggaatttttttcggtttcggttttcgtttcgaaataatcgagttagtttttcgtacgttttcgtcgttttttttcggttgcggtcgcgcgttcgtcgttatcgttattatcgcgcgtgtttttacggggttttagtttttttcgttttcgtagtcgtttgcgtgttttttaatagtttttttcgttcggtcgtcgcggagaggagcggggagcgcgcgtcggcgttagagacgtgcgcgagacgtacggtttcgcgtcgagcgtcggaagtagtcgagtttgggtttcgcgcgtcgcgcgcgtttttttttttttcgttagtcgtcgcggtttcgcgcgcgcgtattgaggcgtcgtcgtcgtcgcggttgttgtaggaggcggcgttggttggcggttgcgttcgttttagtcggcgagcggagtagcgagcgagcgtgtgtgtgttttttaaagatggtcggagcggcggcggcggtggtcgcgggagtagtagttggagtcgtcgcggtagtcgtgtcggtggcggttttcggtcgggtttcggcgttttcgtcgttttcgttcgtgtattgtgtgtgtcggtagtcgtacgacgtgaatcgttttatgatcgagtgcgatatttgtaaggattggttttacggtaggtaaataaattttttttagtttcgtagtcgttatcgtcggttatcgattaatcgtcgtcgtcgtcggtcgttcgcgtttttttcgggtcgggtcgtcgcgtcgcgtttagtttttagggggtttcggtgtttagtttttcggtcgggtagtggggcgcgcggtgtttcgggttcgtcgggcgggttttagaggggagtcggtgggttcgtttggttcgggcgaagagtcgttataataaatacgaataaagagggtcggcggataagttggtagggggagtttggggcgaggggacgcggtcgggcgggcgcggcgggggcgtcgggcggagcgtcggtcgggttcgtagtttttcgttagttcgggtcgtcgtcgtttcgtttcgtttcgtcgcgttcggggtttcggtcggagtcgtcggtcgtttcgtcgttttgttcggtcggtcgacgcgtttgtttttttttcgggcggcgatggggtcgtttcggtttcgcgtttttttcgcgtcgcgggtttttgtcgcgttttttttttcgtttttattaaattttttgggttagtgggacgggggtagcggcgggtcggagaggcgatcgcgttagttagttcggcggggtttcgcggagtaaatagagtaatagatgaggtattcgttttcggggatttgaaaggtgtcggggaagttggggtcgggttttcggcgggcggtaggttgattcgggtcgcggttttgggttttcgtatatattcgggtcgtcgggattggggtagatggagtgggttgcggcggttcgaagggaacgttttttcggattttttgcgttgttttcgcgtcgcggtttaaattttataaagagtgtagttgttatcgttcgaagttggcgatatcgggatcgtttgcggttgtgttcgggcgtcggtgtcggcgaatttgagtcggtcgggcggacgttgcggggtcggttggcggcggcggcggacgttgttttttgatttagtcgtcgtcgcgtttcgggtttgacgtttgagagttcgggtcgttttcgtagttaggtcgtcgattcgtgtgttttgtaattaaagtgtgaggttaataaagggcggcgttatagttttttgatttcggcgtgggagggatttataggtatttaaataa

SEQ ID NO: 1886 - DNA, 2092 bp, Artificial Sequence
  chemically treated genomic DNA (Homo sapiens) CpG-island No: 1886
ttatttaaatacctataaatccctcccacgccgaaatcaaaaaactataacgccgccctttattaacctcacactttaattacaaaacacacgaatcgacgacctaactacgaaaacgacccgaactctcaaacgtcaaacccgaaacgcgacgacgactaaatcaaaaaacaacgtccgccgccgccgccaaccgaccccgcaacgtccgcccgaccgactcaaattcgccgacaccgacgcccgaacacaaccgcaaacgatcccgatatcgccaacttcgaacgataacaactacactctttataaaatttaaaccgcgacgcgaaaacaacgcaaaaaatccgaaaaaacgttcccttcgaaccgccgcaacccactccatctaccccaatcccgacgacccgaatatatacgaaaacccaaaaccgcgacccgaatcaacctaccgcccgccgaaaacccgaccccaacttccccgacacctttcaaatccccgaaaacgaatacctcatctattactctatttactccgcgaaaccccgccgaactaactaacgcgatcgcctctccgacccgccgctacccccgtcccactaacccaaaaaatttaataaaaacgaaaaaaaaaacgcgacaaaaacccgcgacgcgaaaaaaacgcgaaaccgaaacgaccccatcgccgcccgaaaaaaaaacaaacgcgtcgaccgaccgaacaaaacgacgaaacgaccgacgactccgaccgaaaccccgaacgcgacgaaacgaaacgaaacgacgacgacccgaactaacgaaaaactacgaacccgaccgacgctccgcccgacgcccccgccgcgcccgcccgaccgcgtcccctcgccccaaactccccctaccaacttatccgccgaccctctttattcgtatttattataacgactcttcgcccgaaccaaacgaacccaccgactcccctctaaaacccgcccgacgaacccgaaacaccgcgcgccccactacccgaccgaaaaactaaacaccgaaaccccctaaaaactaaacgcgacgcgacgacccgacccgaaaaaaacgcgaacgaccgacgacgacgacgattaatcgataaccgacgataacgactacgaaactaaaaaaaatttatttacctaccgtaaaaccaatccttacaaatatcgcactcgatcataaaacgattcacgtcgtacgactaccgacacacacaatacacgaacgaaaacgacgaaaacgccgaaacccgaccgaaaaccgccaccgacacgactaccgcgacgactccaactactactcccgcgaccaccgccgccgccgctccgaccatctttaaaaaacacacacacgctcgctcgctactccgctcgccgactaaaacgaacgcaaccgccaaccaacgccgcctcctacaacaaccgcgacgacgacgacgcctcaatacgcgcgcgcgaaaccgcgacgactaacgaaaaaaaaaaaaacgcgcgcgacgcgcgaaacccaaactcgactacttccgacgctcgacgcgaaaccgtacgtctcgcgcacgtctctaacgccgacgcgcgctccccgctcctctccgcgacgaccgaacgaaaaaaactattaaaaaacacgcaaacgactacgaaaacgaaaaaaactaaaaccccgtaaaaacacgcgcgataataacgataacgacgaacgcgcgaccgcaaccgaaaaaaaacgacgaaaacgtacgaaaaactaactcgattatttcgaaacgaaaaccgaaaccgaaaaaaattcctacgaaatactcaaaaacaaaaaaaataccgcgtcccgaaaaaaaaaaacgaaaaaatttactactacccgaatcgcctcgcgacgctaaaaaaatcgcccaaccctccgcaaccgcccaacgaaaaccgaaactacgaccccgcaccgacgtaaatccaactaaactaacacgccgaaccgattatacctttccgaaaaaaaaatataccgtaaaatccaaactttaaaaaacgtcccacccgaattcccaacgaacaacaaaaaaaccaaaacgtcgata

SEQ ID NO: 1887 - DNA, 2092 bp, Artificial Sequence
  chemically treated genomic DNA (Homo sapiens) CpG-island No: 1887
ttgtttaaatgtttgtgaattttttttacgtcggagttaagaggttgtggcgtcgttttttattagttttatattttgattataaaatatacgagtcggcggtttggttgcggaggcggttcgagtttttaaacgttaaattcggagcgcggcggcggttgaattagagggtagcgttcgtcgtcgtcgttagtcggtttcgtagcgttcgttcggtcgatttaagttcgtcggtatcggcgttcgggtatagtcgtaggcggtttcggtgtcgttagtttcgagcgatggtaattgtattttttgtaaagtttaagtcgcggcgcgagggtaacgtagggggttcggagaagcgtttttttcgggtcgtcgtaatttattttatttgttttagtttcggcgattcgggtgtgtgcgggggtttaggatcgcgattcgggttaatttgtcgttcgtcgggggttcggttttaattttttcggtattttttaagttttcgagagcgagtgttttatttgttgttttgtttatttcgcggagtttcgtcgagttggttggcgcggtcgttttttcggttcgtcgttgttttcgttttattggtttaggaagtttgataaagacggggaagggggcgcgatagggattcgcggcgcggaggagacgcggggtcggggcgattttatcgtcgttcggaaggaaggtaggcgcgtcggtcggtcgggtagagcggcggggcggtcggcgatttcggtcggagtttcgggcgcggcggggcggggcggggcggcggcggttcgggttggcgaggggttgcggattcggtcggcgtttcgttcgacgttttcgtcgcgttcgttcggtcgcgttttttcgttttaggttttttttgttaatttattcgtcggttttttttgttcgtgtttgttgtggcgatttttcgttcgggttaggcgagtttatcggtttttttttggagttcgttcggcgaattcggggtatcgcgcgttttattgttcggtcggggggttaggtatcggggttttttgaaagttgggcgcggcgcggcggttcggttcgagggaggcgcgggcggtcggcggcggcggcggttggtcggtggtcggcggtggcggttgcggggttggagggggtttatttatttgtcgtggaattagtttttgtagatatcgtattcgattatgaagcggtttacgtcgtacggttgtcggtatatatagtatacgggcgggggcggcggaggcgtcgaggttcggtcgggagtcgttatcgatacggttgtcgcggcggttttagttgttgttttcgcggttatcgtcgtcgtcgtttcggttatttttaaaaaatatatatacgttcgttcgttatttcgttcgtcgattggagcgagcgtagtcgttagttagcgtcgttttttgtagtagtcgcggcggcggcggcgttttagtgcgcgcgcgcgaggtcgcggcggttggcggagggggaggaggcgcgcgcgacgcgcgaggtttagattcggttgttttcggcgttcggcgcggggtcgtgcgtttcgcgtacgtttttggcgtcggcgcgcgtttttcgttttttttcgcgacggtcgggcggagggagttgttgaagggtacgtaggcggttgcgggggcggagggagttgaggtttcgtgaggatacgcgcggtggtggcggtggcggcgggcgcgcggtcgtagtcggaggaggacggcgggagcgtgcgaggagttggttcggttatttcggagcgagagtcgaggtcgggggaagtttttgcggagtgtttaagggtagaagaggtgtcgcgtttcgaagaggggaagcggagaagtttgttgttgttcgggtcgtttcgcgacgttgagagaatcgtttagtttttcgtagtcgtttagcgagaatcggagttgcggtttcgtatcggcgtgagtttagttgagttgatacgtcgagtcggttgtgttttttcgagggaggaatgtgtcgtggaatttaaattttggaaaacgttttattcgaatttttagcgagtagtaaggagattagagcgtcgatg

SEQ ID NO: 1888 - DNA, 2092 bp, Artificial Sequence
  chemically treated genomic DNA (Homo sapiens) CpG-island No: 1888
catcgacgctctaatctccttactactcgctaaaaattcgaataaaacgttttccaaaatttaaattccacgacacattcctccctcgaaaaaacacaaccgactcgacgtatcaactcaactaaactcacgccgatacgaaaccgcaactccgattctcgctaaacgactacgaaaaactaaacgattctctcaacgtcgcgaaacgacccgaacaacaacaaacttctccgcttcccctcttcgaaacgcgacacctcttctacccttaaacactccgcaaaaacttcccccgacctcgactctcgctccgaaataaccgaaccaactcctcgcacgctcccgccgtcctcctccgactacgaccgcgcgcccgccgccaccgccaccaccgcgcgtatcctcacgaaacctcaactccctccgcccccgcaaccgcctacgtacccttcaacaactccctccgcccgaccgtcgcgaaaaaaaacgaaaaacgcgcgccgacgccaaaaacgtacgcgaaacgcacgaccccgcgccgaacgccgaaaacaaccgaatctaaacctcgcgcgtcgcgcgcgcctcctccccctccgccaaccgccgcgacctcgcgcgcgcgcactaaaacgccgccgccgccgcgactactacaaaaaacgacgctaactaacgactacgctcgctccaatcgacgaacgaaataacgaacgaacgtatatatattttttaaaaataaccgaaacgacgacgacgataaccgcgaaaacaacaactaaaaccgccgcgacaaccgtatcgataacgactcccgaccgaacctcgacgcctccgccgcccccgcccgtatactatatataccgacaaccgtacgacgtaaaccgcttcataatcgaatacgatatctacaaaaactaattccacgacaaataaataaaccccctccaaccccgcaaccgccaccgccgaccaccgaccaaccgccgccgccgccgaccgcccgcgcctccctcgaaccgaaccgccgcgccgcgcccaactttcaaaaaaccccgatacctaaccccccgaccgaacaataaaacgcgcgataccccgaattcgccgaacgaactccaaaaaaaaaccgataaactcgcctaacccgaacgaaaaatcgccacaacaaacacgaacaaaaaaaaccgacgaataaattaacaaaaaaaacctaaaacgaaaaaacgcgaccgaacgaacgcgacgaaaacgtcgaacgaaacgccgaccgaatccgcaacccctcgccaacccgaaccgccgccgccccgccccgccccgccgcgcccgaaactccgaccgaaatcgccgaccgccccgccgctctacccgaccgaccgacgcgcctaccttccttccgaacgacgataaaatcgccccgaccccgcgtctcctccgcgccgcgaatccctatcgcgcccccttccccgtctttatcaaacttcctaaaccaataaaacgaaaacaacgacgaaccgaaaaaacgaccgcgccaaccaactcgacgaaactccgcgaaataaacaaaacaacaaataaaacactcgctctcgaaaacttaaaaaataccgaaaaaattaaaaccgaacccccgacgaacgacaaattaacccgaatcgcgatcctaaacccccgcacacacccgaatcgccgaaactaaaacaaataaaataaattacgacgacccgaaaaaaacgcttctccgaaccccctacgttaccctcgcgccgcgacttaaactttacaaaaaatacaattaccatcgctcgaaactaacgacaccgaaaccgcctacgactatacccgaacgccgataccgacgaacttaaatcgaccgaacgaacgctacgaaaccgactaacgacgacgacgaacgctaccctctaattcaaccgccgccgcgctccgaatttaacgtttaaaaactcgaaccgcctccgcaaccaaaccgccgactcgtatattttataatcaaaatataaaactaataaaaaacgacgccacaacctcttaactccgacgtaaaaaaaattcacaaacatttaaacaa

SEQ ID NO: 1889 - DNA, 766 bp, Artificial Sequence
  chemically treated genomic DNA (Homo sapiens) CpG-island No: 1889
tcgcgagtcgttatagttatagttcgcgtttcgggtcgaacgttcgagtttaagagttttcgagttttcgtcgggcggcggttttatagttgggggttttgaggcggaaggcgtagtcgtttagttgcggatcgggggcgtggcgagggcgtataggttttgtttttcgtcggttcggggtcgttttcggtttcgtttttcgtcggcgtttttattttgcgagagtcgttcgttagttagcgttcgtcgtcgttcgcgtcgcgttattcgcggttcgacgggagtaggtttagcggttatggtttaggtcggcgtcgtcggtgaggttatttaggtgttgtgcgcggtcgggggcgttttggagttgttcgagttgcggcgtcgtttgcggatgggtttgagcgtcgacgcgttggagcggttgttgcggtagcgtgggcgtttcgtggtggcggtgcgggcgggcggcgtagtcgcggtttcggagcgcgtggtgttggtcgtttcgtcgttgcgtttgtgtcgcgcgtattagggttttaagtcgggttgcgtggggttttgcgcgtagttttatttttgtaggtttatggtttacggcgtttgtaagtttttgagagtcgggtaaggcgtcgcgtcgggagcgacggcgggcggaggttttgcgcgtttttacgtatttttagttcgtttgggggttttatttgaagtttgagtagataattcggtggttttgttttgatttcgtatcgttatttattaaagt

SEQ ID NO: 1890 - DNA, 766 bp, Artificial Sequence
  chemically treated genomic DNA (Homo sapiens) CpG-island No: 1890
actttaataaataacgatacgaaatcaaaacaaaaccaccgaattatctactcaaacttcaaataaaacccccaaacgaactaaaaatacgtaaaaacgcgcaaaacctccgcccgccgtcgctcccgacgcgacgccttacccgactctcaaaaacttacaaacgccgtaaaccataaacctacaaaaataaaactacgcgcaaaaccccacgcaacccgacttaaaaccctaatacgcgcgacacaaacgcaacgacgaaacgaccaacaccacgcgctccgaaaccgcgactacgccgcccgcccgcaccgccaccacgaaacgcccacgctaccgcaacaaccgctccaacgcgtcgacgctcaaacccatccgcaaacgacgccgcaactcgaacaactccaaaacgcccccgaccgcgcacaacacctaaataacctcaccgacgacgccgacctaaaccataaccgctaaacctactcccgtcgaaccgcgaataacgcgacgcgaacgacgacgaacgctaactaacgaacgactctcgcaaaataaaaacgccgacgaaaaacgaaaccgaaaacgaccccgaaccgacgaaaaacaaaacctatacgccctcgccacgcccccgatccgcaactaaacgactacgccttccgcctcaaaacccccaactataaaaccgccgcccgacgaaaactcgaaaactcttaaactcgaacgttcgacccgaaacgcgaactataactataacgactcgcga

SEQ ID NO: 1891 - DNA, 766 bp, Artificial Sequence
  chemically treated genomic DNA (Homo sapiens) CpG-island No: 1891
gttttagtgaatgacggtgcgaggttagggtagagttatcgaattgtttgtttaaattttaagtaggatttttaagcgggttggaagtgcgtgagggcgcgtaggattttcgttcgtcgtcgttttcggcgcggcgttttattcggtttttaggaatttgtaggcgtcgtagattatgaatttgtagaggtggagttgcgcgtagagttttacgtagttcggtttggagttttggtgcgcgcgatataggcgtagcggcgaggcggttagtattacgcgtttcggggtcgcggttgcgtcgttcgttcgtatcgttattacgaagcgtttacgttgtcgtagtagtcgttttagcgcgtcggcgtttaagtttattcgtaagcggcgtcgtagttcgggtaattttagggcgttttcggtcgcgtatagtatttgggtgattttatcgacgacgtcggtttgggttatggtcgttgggtttgttttcgtcggatcgcgggtggcgcgacgcggacggcggcggacgttggttggcgggcggttttcgtagggtggagacgtcggcgggaaacgaaatcgaaagcggtttcgggtcggcgaaaaatagaatttgtgcgttttcgttacgttttcggttcgtagttgagcggttgcgtttttcgttttagggtttttagttgtgaggtcgtcgttcgacggaagttcgggagtttttgagttcgggcgttcggttcggagcgcgggttgtggttgtggcggttcgcgg

SEQ ID NO: 1892 - DNA, 766 bp, Artificial Sequence
  chemically treated genomic DNA (Homo sapiens) CpG-island No: 1892
ccgcgaaccgccacaaccacaacccgcgctccgaaccgaacgcccgaactcaaaaactcccgaacttccgtcgaacgacgacctcacaactaaaaaccctaaaacgaaaaacgcaaccgctcaactacgaaccgaaaacgtaacgaaaacgcacaaattctatttttcgccgacccgaaaccgctttcgatttcgtttcccgccgacgtctccaccctacgaaaaccgcccgccaaccaacgtccgccgccgtccgcgtcgcgccacccgcgatccgacgaaaacaaacccaacgaccataacccaaaccgacgtcgtcgataaaatcacccaaatactatacgcgaccgaaaacgccctaaaattacccgaactacgacgccgcttacgaataaacttaaacgccgacgcgctaaaacgactactacgacaacgtaaacgcttcgtaataacgatacgaacgaacgacgcaaccgcgaccccgaaacgcgtaatactaaccgcctcgccgctacgcctatatcgcgcgcaccaaaactccaaaccgaactacgtaaaactctacgcgcaactccacctctacaaattcataatctacgacgcctacaaattcctaaaaaccgaataaaacgccgcgccgaaaacgacgacgaacgaaaatcctacgcgccctcacgcacttccaacccgcttaaaaatcctacttaaaatttaaacaaacaattcgataactctaccctaacctcgcaccgtcattcactaaaac

SEQ ID NO: 1893 - DNA, 559 bp, Artificial Sequence
  chemically treated genomic DNA (Homo sapiens) CpG-island No: 1893
ggggttgcggtttcgtcgttcgtagcggtcgttttaggatttgtcgtttggttttttttggttgttgcgaggtaggtttcggcggttatagcgcgttatttgtattcgtagttcgcgttcgtttagtatcgtttagtttatggcggtttcggcgttttgcgcgtcgtttcggtagtgaaatcggacgaaggcgaagtttcggggcgttttggtgtggggttttcgcgggatgtatacgtcgtttacgcgttcgtatttttcgaatacgcgttttaagtagtcgggagaggtgcggtaggttaggttgtttattttgagggtgattatgttatttacgtcgggaggggggcggtcgtagtttatggtttcgagagtagtttcggttcggaaattggcgttgtattgggcgttggcggggcgatttgcgtttttttttcgcggttgcgtttcgcgtggggacgtcgggagagatttgggggagaggcgggcggtcgatttcgtagggagcgttttagagtagtaatttttaaatttttaattttaggttaaatattttagg

SEQ ID NO: 1894 - DNA, 559 bp, Artificial Sequence
  chemically treated genomic DNA (Homo sapiens) CpG-island No: 1894
cctaaaatatttaacctaaaattaaaaatttaaaaattactactctaaaacgctccctacgaaatcgaccgcccgcctctcccccaaatctctcccgacgtccccacgcgaaacgcaaccgcgaaaaaaaaacgcaaatcgccccgccaacgcccaatacaacgccaatttccgaaccgaaactactctcgaaaccataaactacgaccgcccccctcccgacgtaaataacataatcaccctcaaaataaacaacctaacctaccgcacctctcccgactacttaaaacgcgtattcgaaaaatacgaacgcgtaaacgacgtatacatcccgcgaaaaccccacaccaaaacgccccgaaacttcgccttcgtccgatttcactaccgaaacgacgcgcaaaacgccgaaaccgccataaactaaacgatactaaacgaacgcgaactacgaatacaaataacgcgctataaccgccgaaacctacctcgcaacaaccaaaaaaaaccaaacgacaaatcctaaaacgaccgctacgaacgacgaaaccgcaacccc

SEQ ID NO: 1895 - DNA, 559 bp, Artificial Sequence
  chemically treated genomic DNA (Homo sapiens) CpG-island No: 1895
tttggagtatttggtttgaaattgggaatttgggaattgttgttttagagcgttttttgcggagtcggtcgttcgttttttttttaggtttttttcgacgtttttacgcggggcgtaatcgcgagagaggaacgtaggtcgtttcgttagcgtttagtgtagcgttagttttcgggtcggggttgttttcggagttatgagttgcggtcgtttttttttcgacgtggatggtatgattatttttaaggtggataatttgatttatcgtatttttttcgattgtttgaggcgcgtgttcgagaagtacgggcgcgtgggcgacgtgtatatttcgcgggagttttatattaaggcgtttcggggtttcgttttcgttcggttttattatcggagcgacgcgtaagacgtcgaggtcgttatggattgggcggtgttggacggacgcgagttgcgggtgtagatggcgcgttatggtcgtcgggatttgtttcgtagtagttaggaagagttaagcggtaggttttggggcggtcgttacggacggcggagtcgtagtttt

SEQ ID NO: 1896 - DNA, 559 bp, Artificial Sequence
  chemically treated genomic DNA (Homo sapiens) CpG-island No: 1896
aaaactacgactccgccgtccgtaacgaccgccccaaaacctaccgcttaactcttcctaactactacgaaacaaatcccgacgaccataacgcgccatctacacccgcaactcgcgtccgtccaacaccgcccaatccataacgacctcgacgtcttacgcgtcgctccgataataaaaccgaacgaaaacgaaaccccgaaacgccttaatataaaactcccgcgaaatatacacgtcgcccacgcgcccgtacttctcgaacacgcgcctcaaacaatcgaaaaaaatacgataaatcaaattatccaccttaaaaataatcataccatccacgtcgaaaaaaaaacgaccgcaactcataactccgaaaacaaccccgacccgaaaactaacgctacactaaacgctaacgaaacgacctacgttcctctctcgcgattacgccccgcgtaaaaacgtcgaaaaaaacctaaaaaaaaaacgaacgaccgactccgcaaaaaacgctctaaaacaacaattcccaaattcccaatttcaaaccaaatactccaaa

SEQ ID NO: 1897 - DNA, 603 bp, Artificial Sequence
  chemically treated genomic DNA (Homo sapiens) CpG-island No: 1897
ggcgtagcgcgtttattacgtcgtttagttttattagttcgtttacgtttacggtatattcgtacggtagtttttcgttggtcgggtttaggtttattatcgttacgcgtcggtttagcgcgcgtaggaatttatttatgtttaggtagtacgtggttttttttgagttcggcgggtcgattatcgtttgttcgaaggtcgtggtcggagcggtttttgttattggcggttcgcggttcggagtaggttaatttatagggaaaacggggtaggtagtcgcgtcggagacgagattgagggcgagggttttagtacgtatatttcgttggcggttagcgttattcgttttaggcggaatagttgagatcgtgtcgcgtaaaaggagataataggtcgatattaattagattaattcgattttcggatagcgtcggaaacggcgagttaacgagaggaagtttcgtttttacggcggggacgaagttagacgtcgaggggcgggcggcgtagtcgtatttttttcgcgggtagtgggtcgaatgtggggtttttgcgggaaaatcgttttcggaatttttttaatttttagattcgaattagaaa

SEQ ID NO: 1898 - DNA, 603 bp, Artificial Sequence
  chemically treated genomic DNA (Homo sapiens) CpG-island No: 1898
tttctaattcgaatctaaaaattaaaaaaattccgaaaacgattttcccgcaaaaaccccacattcgacccactacccgcgaaaaaaatacgactacgccgcccgcccctcgacgtctaacttcgtccccgccgtaaaaacgaaacttcctctcgttaactcgccgtttccgacgctatccgaaaatcgaattaatctaattaatatcgacctattatctccttttacgcgacacgatctcaactattccgcctaaaacgaataacgctaaccgccaacgaaatatacgtactaaaaccctcgccctcaatctcgtctccgacgcgactacctaccccgttttccctataaattaacctactccgaaccgcgaaccgccaataacaaaaaccgctccgaccacgaccttcgaacaaacgataatcgacccgccgaactcaaaaaaaaccacgtactacctaaacataaataaattcctacgcgcgctaaaccgacgcgtaacgataataaacctaaacccgaccaacgaaaaactaccgtacgaatataccgtaaacgtaaacgaactaataaaactaaacgacgtaataaacgcgctacgcc

SEQ ID NO: 1899 - DNA, 603 bp, Artificial Sequence
  chemically treated genomic DNA (Homo sapiens) CpG-island No: 1899
tttttaattcgagtttgaaggttagagaaatttcgagagcgattttttcgtaaagattttatattcgatttattattcgcgagagaaatgcggttgcgtcgttcgtttttcggcgtttagtttcgttttcgtcgtgagggcgggattttttttcgttggttcgtcgttttcgacgttgttcggaagtcgagttagtttagttagtatcggtttgttatttttttttgcgcgatacggttttagttgtttcgtttgaggcgagtgacgttggtcgttaacgaggtatacgtattgggattttcgtttttagtttcgttttcggcgcggttatttgtttcgttttttttgtgagttgatttgtttcgggtcgcgggtcgttaatggtaggggtcgtttcgattacggttttcgggtaggcggtgatcggttcgtcgggtttagggaagattacgtattgtttgggtatgagtgagtttttgcgcgcgttgggtcggcgcgtggcggtggtgaatttggattcggttaacgaggggttgtcgtacgagtgtgtcgtggacgtgggcgagttggtggggttgggcgacgtgatggacgcgttgcgtt

SEQ ID NO: 1900 - DNA, 603 bp, Artificial Sequence
  chemically treated genomic DNA (Homo sapiens) CpG-island No: 1900
aacgcaacgcgtccatcacgtcgcccaaccccaccaactcgcccacgtccacgacacactcgtacgacaacccctcgttaaccgaatccaaattcaccaccgccacgcgccgacccaacgcgcgcaaaaactcactcatacccaaacaatacgtaatcttccctaaacccgacgaaccgatcaccgcctacccgaaaaccgtaatcgaaacgacccctaccattaacgacccgcgacccgaaacaaatcaactcacaaaaaaaacgaaacaaataaccgcgccgaaaacgaaactaaaaacgaaaatcccaatacgtatacctcgttaacgaccaacgtcactcgcctcaaacgaaacaactaaaaccgtatcgcgcaaaaaaaaataacaaaccgatactaactaaactaactcgacttccgaacaacgtcgaaaacgacgaaccaacgaaaaaaaatcccgccctcacgacgaaaacgaaactaaacgccgaaaaacgaacgacgcaaccgcatttctctcgcgaataataaatcgaatataaaatctttacgaaaaaatcgctctcgaaatttctctaaccttcaaactcgaattaaaaa

SEQ ID NO: 1901 - DNA, 510 bp, Artificial Sequence
  chemically treated genomic DNA (Homo sapiens) CpG-island No: 1901
agatagcgattcggtagttaagtttcgtgagaatttagttatcggcggttcgagtatatgcgaataagtttttgagtttgagttaatttttttatcgagatgacgtagtagtaggtgcgggtttggattggagtagagtttcgagtggagagaggtcggatatcggtggtcgaagtttgagagagaagttggtttttagcggttgggtcggtaggaattagggtagagttaggagcggtttgcggaggggttcgtttaggtcgatgtcggtagtggaaatagaggaagttatcgtcgcgtttttttcggaattggttaaaatagtttcgtaaatgggtcgagcgtaatacggaggggatatcgtttattattaggtaaattgtcgttttttttttcgtttcgtcgggtatcgttattttggattgttatatgattagttagaattaagtttcgcgagaatatcgcgagtaacgttttagtttttgcgttgcgagattgtgaaaattttaa

SEQ ID NO: 1902 - DNA, 510 bp, Artificial Sequence
  chemically treated genomic DNA (Homo sapiens) CpG-island No: 1902
ttaaaattttcacaatctcgcaacgcaaaaactaaaacgttactcgcgatattctcgcgaaacttaattctaactaatcatataacaatccaaaataacgatacccgacgaaacgaaaaaaaaaacgacaatttacctaataataaacgatatcccctccgtattacgctcgacccatttacgaaactattttaaccaattccgaaaaaaacgcgacgataacttcctctatttccactaccgacatcgacctaaacgaacccctccgcaaaccgctcctaactctaccctaattcctaccgacccaaccgctaaaaaccaacttctctctcaaacttcgaccaccgatatccgacctctctccactcgaaactctactccaatccaaacccgcacctactactacgtcatctcgataaaaaaattaactcaaactcaaaaacttattcgcatatactcgaaccgccgataactaaattctcacgaaacttaactaccgaatcgctatct

SEQ ID NO: 1903 - DNA, 510 bp, Artificial Sequence
  chemically treated genomic DNA (Homo sapiens) CpG-island No: 1903
ttagaatttttataatttcgtaacgtaggggttggaacgttgttcgcggtgttttcgcgagatttggttttagttgattatgtgataatttaagatggcggtgttcggcgaggcggaggaggaggcgatagtttatttggtagtgagcggtatttttttcgtgttgcgttcggtttatttacggagttattttagttagtttcgagaagagcgcggcggtggttttttttgtttttattatcggtatcggtttgagcgggttttttcgtaggtcgtttttaattttgttttaatttttatcgatttagtcgttgagggttagttttttttttagatttcggttatcgatgttcggtttttttttattcgagattttattttaatttagattcgtatttgttgttgcgttatttcggtaagggggttggtttaagtttagaggtttattcgtatgtattcgggtcgtcggtggttggatttttacgggatttggttatcgggtcgttgttt

SEQ ID NO: 1904 - DNA, 510 bp, Artificial Sequence
  chemically treated genomic DNA (Homo sapiens) CpG-island No: 1904
aaacaacgacccgataaccaaatcccgtaaaaatccaaccaccgacgacccgaatacatacgaataaacctctaaacttaaaccaacccccttaccgaaataacgcaacaacaaatacgaatctaaattaaaataaaatctcgaataaaaaaaaaccgaacatcgataaccgaaatctaaaaaaaaaactaaccctcaacgactaaatcgataaaaattaaaacaaaattaaaaacgacctacgaaaaaacccgctcaaaccgataccgataataaaaacaaaaaaaaccaccgccgcgctcttctcgaaactaactaaaataactccgtaaataaaccgaacgcaacacgaaaaaaataccgctcactaccaaataaactatcgcctcctcctccgcctcgccgaacaccgccatcttaaattatcacataatcaactaaaaccaaatctcgcgaaaacaccgcgaacaacgttccaacccctacgttacgaaattataaaaattctaa

SEQ ID NO: 1905 - DNA, 518 bp, Artificial Sequence
  chemically treated genomic DNA (Homo sapiens) CpG-island No: 1905
tcgtttatcgtttcgtggacgcgtttgttgattggtttcgaatgtcgattaatggtcggcgaagcgggttgtttgtcgtacggttaatggtcgtaaatcgggaggaaggcgggaagagaggaggtggaggcgggtttgggtagtcgcgcgcgtgcgtgttttcggtttcgttgcggaaggcggacgattagagtcgttgggttcggcgcgattcgtaggagcgtagagagcgcgggattagagtgtagagtttcgggacgtggatcggagtcggcgcgatgggcggagagtaggaggaggagcggttcgacggtatgttgttggttatggtttagtagtacgagggcggcgtgtaggaggtaacggttcgcgcggcgtcggtttattcggcggttttggttacgtttttttcgtttttttttgttttcgagggttgagatttattttagcggttcgcgggtttttgggatgtttttatatttttattgcgtttagttttcggtttggttattcgttag

SEQ ID NO: 1906 - DNA, 518 bp, Artificial Sequence
  chemically treated genomic DNA (Homo sapiens) CpG-island No: 1906
ctaacgaataaccaaaccgaaaactaaacgcaataaaaatataaaaacatcccaaaaacccgcgaaccgctaaaataaatctcaaccctcgaaaacaaaaaaaaacgaaaaaaacgtaaccaaaaccgccgaataaaccgacgccgcgcgaaccgttacctcctacacgccgccctcgtactactaaaccataaccaacaacataccgtcgaaccgctcctcctcctactctccgcccatcgcgccgactccgatccacgtcccgaaactctacactctaatcccgcgctctctacgctcctacgaatcgcgccgaacccaacgactctaatcgtccgccttccgcaacgaaaccgaaaacacgcacgcgcgcgactacccaaacccgcctccacctcctctcttcccgccttcctcccgatttacgaccattaaccgtacgacaaacaacccgcttcgccgaccattaatcgacattcgaaaccaatcaacaaacgcgtccacgaaacgataaacga

SEQ ID NO: 1907 - DNA, 518 bp, Artificial Sequence
  chemically treated genomic DNA (Homo sapiens) CpG-island No: 1907
ttggcgggtggttaggtcggaagttgggcgtagtgagaatgtaggggtattttagaagttcgcgagtcgttggggtgggttttagttttcgaaggtagagaagggcggaaggagcgtggttaaggtcgtcgggtgggtcgacgtcgcgcgggtcgttattttttgtacgtcgttttcgtgttgttgagttatggttagtaatatgtcgtcgaatcgtttttttttttgtttttcgtttatcgcgtcggtttcgatttacgtttcggagttttgtattttagtttcgcgttttttacgtttttgcgggtcgcgtcgggtttaacgattttagtcgttcgtttttcgtagcggagtcggaaatacgtacgcgcgcggttgtttaggttcgtttttatttttttttttttcgtttttttttcggtttgcggttattgatcgtgcggtaagtaattcgtttcgtcgattattggtcgatattcggagttaattaataagcgcgtttacgaagcggtaggcgg

SEQ ID NO: 1908 - DNA, 518 bp, Artificial Sequence
  chemically treated genomic DNA (Homo sapiens) CpG-island No: 1908
ccgcctaccgcttcgtaaacgcgcttattaattaactccgaatatcgaccaataatcgacgaaacgaattacttaccgcacgatcaataaccgcaaaccgaaaaaaaaacgaaaaaaaaaaaaataaaaacgaacctaaacaaccgcgcgcgtacgtatttccgactccgctacgaaaaacgaacgactaaaatcgttaaacccgacgcgacccgcaaaaacgtaaaaaacgcgaaactaaaatacaaaactccgaaacgtaaatcgaaaccgacgcgataaacgaaaaacaaaaaaaaaaacgattcgacgacatattactaaccataactcaacaacacgaaaacgacgtacaaaaaataacgacccgcgcgacgtcgacccacccgacgaccttaaccacgctccttccgcccttctctaccttcgaaaactaaaacccaccccaacgactcgcgaacttctaaaatacccctacattctcactacgcccaacttccgacctaaccacccgccaa

SEQ ID NO: 1909 - DNA, 1185 bp, Artificial Sequence
  chemically treated genomic DNA (Homo sapiens) CpG-island No: 1909
ggaggggggcgtcggcgcgcgcgcgcggcgggggcgcgcgggggcgggatcgggaagggtagttacgggcgtcggagtagtacgtgttcgatgtaattttttagttttttttgtttttgtagtcggcgttttttcgttttcgtttttttttgcgcgcgtcgcgtttgggtttttcggtcgggatagtggcgcgaaggcggtaaggcgtggtggtagtggcggcggcgtaaggtcgagggcggttgtagtgttcgcggtcggatgtagttggggaaagggtggtacggttttggcgggtatatttcgtttttttttcgattttagggcgggagtatttcgttttagttcggtagttcgtttcgtgcgggagcgggggcggggggcgggggttgcggggagcggacgtgggtgggggcgggggcggtacgggggggcggtacgggttcgggaggggcgtttttttttcgttttcgttttttttttattttttcgatgatgttgattacgtcgttcgttggtaggtggagtttggtggatagtttaatgaggttgtcgatcgtttgcggatttattttttcgtcgtttttttttttttcgtttttttttgttttttcggttttttttcgtcggtggttcggcgtttttttttgggagcgtttgttttcggcgtcggttttttcgtttttttttttcgcgaataggagcgcgttttgtcgcgtttttttcgtttttttcgtttttgttttcgtttcggtcgtttttttattttttttttttattttttttttttcgtcgcgttttttttgtttcgtttttttttttttttttgtattttttcgttttttcgtcgttttttgtagttttcgattttcgaggtcgcgttgtcgggtttcgttttgtagtaaatattggagtagtaggttcgaggcgaggtcggttagtcgttttttttgcgtcgcggtttgtcgcgtggttttcgtttgtcgtcgttcggtttttatttgcgttagtttttgttggagaaggcgttcgttcgtttcggagtcgtttaggagtgcgtttttcggtcggcgcgttttggggaacggggcggttacgttttggtacgttttggataggggtgttaatgtttcgtttaggtgtgttttgggggaggatatttttttttcgaatttgtgggtttcg

SEQ ID NO: 1910 - DNA, 1185 bp, Artificial Sequence
  chemically treated genomic DNA (Homo sapiens) CpG-island No: 1910
cgaaacccacaaattcgaaaaaaaaatatcctcccccaaaacacacctaaacgaaacattaacacccctatccaaaacgtaccaaaacgtaaccgccccgttccccaaaacgcgccgaccgaaaaacgcactcctaaacgactccgaaacgaacgaacgccttctccaacaaaaactaacgcaaataaaaaccgaacgacgacaaacgaaaaccacgcgacaaaccgcgacgcaaaaaaaacgactaaccgacctcgcctcgaacctactactccaatatttactacaaaacgaaacccgacaacgcgacctcgaaaatcgaaaactacaaaaaacgacgaaaaaacgaaaaaatacaaaaaaaaaaaaaaaaacgaaacaaaaaaaacgcgacgaaaaaaaaaaaataaaaaaaaaaaataaaaaaacgaccgaaacgaaaacaaaaacgaaaaaaacgaaaaaaacgcgacaaaacgcgctcctattcgcgaaaaaaaaaaacgaaaaaaccgacgccgaaaacaaacgctcccaaaaaaaaacgccgaaccaccgacgaaaaaaaaccgaaaaaacaaaaaaaaacgaaaaaaaaaaaaacgacgaaaaaataaatccgcaaacgatcgacaacctcattaaactatccaccaaactccacctaccaacgaacgacgtaatcaacatcatcgaaaaaataaaaaaaaaacgaaaacgaaaaaaaaacgcccctcccgaacccgtaccgcccccccgtaccgcccccgcccccacccacgtccgctccccgcaacccccgccccccgcccccgctcccgcacgaaacgaactaccgaactaaaacgaaatactcccgccctaaaatcgaaaaaaaaacgaaatatacccgccaaaaccgtaccaccctttccccaactacatccgaccgcgaacactacaaccgccctcgaccttacgccgccgccactaccaccacgccttaccgccttcgcgccactatcccgaccgaaaaacccaaacgcgacgcgcgcaaaaaaaaacgaaaacgaaaaaacgccgactacaaaaacaaaaaaaactaaaaaattacatcgaacacgtactactccgacgcccgtaactacccttcccgatcccgcccccgcgcgcccccgccgcgcgcgcgcgccgacgcccccctcc

SEQ ID NO: 1911 - DNA, 1185 bp, Artificial Sequence
  chemically treated genomic DNA (Homo sapiens) CpG-island No: 1911
cgaaatttataagttcggggaaggagtgtttttttttaaaatatatttaggcgaggtattggtatttttgtttaaggcgtattaaggcgtggtcgtttcgttttttaaggcgcgtcggtcggagagcgtatttttgggcggtttcgaggcgggcgagcgttttttttagtaagggttggcgtaggtggaggtcgggcggcggtaggcggaggttacgcggtaggtcgcggcgtaggaagagcggttggtcgatttcgtttcggatttgttgttttagtatttgttgtagggcggggttcggtagcgcggtttcgggggtcgggggttgtaggaggcggcggaggagcgagagagtgtaagggaggaggaggaggcggagtaggagagacgcggcggggaggagagggtgggggaagaggatgaggaggcggtcgaggcggaggtagaggcggaggaggcggagagggcgcggtagaacgcgtttttgttcgcggaggaggaggacggggaagtcggcgtcgaggataagcgtttttaggaggagacgtcgggttatcggcggaaggaggtcgaggggatagaggagggcggggaggaggaggacgacgaggagatggattcgtagacgatcgatagttttattgagttgtttattaaattttatttgttagcggacgacgtggttagtattatcgaggaggtggaggagaagcggaagcggaagaagaacgtttttttcgagttcgtgtcgttttttcgtgtcgttttcgtttttatttacgttcgtttttcgtagttttcgtttttcgttttcgttttcgtacgagacgagttgtcggattggaacgaggtgttttcgttttgggatcgggaggaggacgaggtgtattcgttagggtcgtattattttttttttaattatattcggtcgcggatattgtagtcgttttcggttttgcgtcgtcgttattattattacgttttgtcgttttcgcgttattatttcggtcgggaggtttaggcgcggcgcgcgtaggaggaggcggaggcggaggagcgtcggttgtaggagtaggaggagttggagaattatatcgagtacgtgttgtttcggcgttcgtgattgtttttttcggtttcgttttcgcgcgttttcgtcgcgcgcgcgcgtcggcgttttttttt

SEQ ID NO: 1912 - DNA, 1185 bp, Artificial Sequence
  chemically treated genomic DNA (Homo sapiens) CpG-island No: 1912
aaaaaaaaacgccgacgcgcgcgcgcgacgaaaacgcgcgaaaacgaaaccgaaaaaaacaatcacgaacgccgaaacaacacgtactcgatataattctccaactcctcctactcctacaaccgacgctcctccgcctccgcctcctcctacgcgcgccgcgcctaaacctcccgaccgaaataataacgcgaaaacgacaaaacgtaataataataacgacgacgcaaaaccgaaaacgactacaatatccgcgaccgaatataattaaaaaaaaaataatacgaccctaacgaatacacctcgtcctcctcccgatcccaaaacgaaaacacctcgttccaatccgacaactcgtctcgtacgaaaacgaaaacgaaaaacgaaaactacgaaaaacgaacgtaaataaaaacgaaaacgacacgaaaaaacgacacgaactcgaaaaaaacgttcttcttccgcttccgcttctcctccacctcctcgataatactaaccacgtcgtccgctaacaaataaaatttaataaacaactcaataaaactatcgatcgtctacgaatccatctcctcgtcgtcctcctcctccccgccctcctctatcccctcgacctccttccgccgataacccgacgtctcctcctaaaaacgcttatcctcgacgccgacttccccgtcctcctcctccgcgaacaaaaacgcgttctaccgcgccctctccgcctcctccgcctctacctccgcctcgaccgcctcctcatcctcttcccccaccctctcctccccgccgcgtctctcctactccgcctcctcctcctcccttacactctctcgctcctccgccgcctcctacaacccccgacccccgaaaccgcgctaccgaaccccgccctacaacaaatactaaaacaacaaatccgaaacgaaatcgaccaaccgctcttcctacgccgcgacctaccgcgtaacctccgcctaccgccgcccgacctccacctacgccaacccttactaaaaaaaacgctcgcccgcctcgaaaccgcccaaaaatacgctctccgaccgacgcgccttaaaaaacgaaacgaccacgccttaatacgccttaaacaaaaataccaatacctcgcctaaatatattttaaaaaaaaacactccttccccgaacttataaatttcg

SEQ ID NO: 1913 - DNA, 513 bp, Artificial Sequence
  chemically treated genomic DNA (Homo sapiens) CpG-island No: 1913
atagcggagtatttattagttggtgttacgacgcgagaggtggagaggagggtcggggtagggtggggataggggaagatcgggacgcgttcgtttcggtttcgagcggtggtcggggtaggagcgacggtcgaggtttggcgtttcgtgggttgggtttagttgggtcggcgcggtttcgggcggttagttcgtttcggttttagtacgttggatagcgttcgcgtttttatcgttttataaaggggagcgcgcggggttacgtgggcgcgtttcgttttattgacgttaatgtttatttatggggaagcgggcggtcgttcggaggaggaaggacgttcgacgattggagggtgtttgtttttttcggtttgcgtttgcgcgttggggttttcggttgaaggggtgtgcgttagcggagtttcgggaaatgaatgaatgaatgaatgaatgaaatgttgaagcgggtagggcggggggttatgaatgaatgaaggagggacgaggagaaaa

SEQ ID NO: 1914 - DNA, 513 bp, Artificial Sequence
  chemically treated genomic DNA (Homo sapiens) CpG-island No: 1914
ttttctcctcgtccctccttcattcattcataaccccccgccctacccgcttcaacatttcattcattcattcattcattcatttcccgaaactccgctaacgcacaccccttcaaccgaaaaccccaacgcgcaaacgcaaaccgaaaaaaacaaacaccctccaatcgtcgaacgtccttcctcctccgaacgaccgcccgcttccccataaataaacattaacgtcaataaaacgaaacgcgcccacgtaaccccgcgcgctcccctttataaaacgataaaaacgcgaacgctatccaacgtactaaaaccgaaacgaactaaccgcccgaaaccgcgccgacccaactaaacccaacccacgaaacgccaaacctcgaccgtcgctcctaccccgaccaccgctcgaaaccgaaacgaacgcgtcccgatcttcccctatccccaccctaccccgaccctcctctccacctctcgcgtcgtaacaccaactaataaatactccgctat

SEQ ID NO: 1915 - DNA, 513 bp, Artificial Sequence
  chemically treated genomic DNA (Homo sapiens) CpG-island No: 1915
tttttttttcgttttttttttatttatttatagtttttcgttttgttcgttttagtattttatttatttatttatttatttatttttcggagtttcgttagcgtatatttttttagtcgaaggttttagcgcgtaggcgtaggtcgggagaggtaggtattttttaatcgtcgggcgttttttttttttcgggcggtcgttcgtttttttatgaatgaatattgacgttaatggggcggggcgcgtttacgtgatttcgcgcgtttttttttataaggcggtggaggcgcgggcgttgtttagcgtgttgaagtcggagcgagttagtcgttcggagtcgcgtcgatttagttgagtttagtttacgggacgttagatttcgatcgtcgtttttatttcggttatcgttcggagtcgaggcggacgcgtttcgatttttttttgtttttattttgtttcgatttttttttttatttttcgcgtcgtgatattagttggtaaatatttcgttgt

SEQ ID NO: 1916 - DNA, 513 bp, Artificial Sequence
  chemically treated genomic DNA (Homo sapiens) CpG-island No: 1916
acaacgaaatatttaccaactaatatcacgacgcgaaaaataaaaaaaaaaatcgaaacaaaataaaaacaaaaaaaaatcgaaacgcgtccgcctcgactccgaacgataaccgaaataaaaacgacgatcgaaatctaacgtcccgtaaactaaactcaactaaatcgacgcgactccgaacgactaactcgctccgacttcaacacgctaaacaacgcccgcgcctccaccgccttataaaaaaaaacgcgcgaaatcacgtaaacgcgccccgccccattaacgtcaatattcattcataaaaaaacgaacgaccgcccgaaaaaaaaaaaacgcccgacgattaaaaaatacctacctctcccgacctacgcctacgcgctaaaaccttcgactaaaaaaatatacgctaacgaaactccgaaaaataaataaataaataaataaataaaatactaaaacgaacaaaacgaaaaactataaataaataaaaaaaaaacgaaaaaaaaa

SEQ ID NO: 1917 - DNA, 563 bp, Artificial Sequence
  chemically treated genomic DNA (Homo sapiens) CpG-island No: 1917
gcgtcgtcgttatcgaaggcgtcgatgttgagatagcgttaagtgtcgtttttttcgtgcgggatggggaaggggcgcgtgtatagcgtgagtacgcgcgggcgcgcgcggttgtttacgcgttattttaggtttttggtcgttagtaggcgtaggttgttttcgttaggtcggtagggttgttagttttggatgatggtttcgtttggaagtacgtcgcgttgtacggagggtgatagtaggaggcgtgttacgtcgtcgtttgtttcggatacggtttcggtgggtagcggcgagaaggtgttagaggttcgtagcgtcgttagtcgcgcgtttagttcggttagtagcgcggacgcgttgaatcggattaaaaggatgttttgcggggggtacgagtgagcgcggggagggggggcgtagtagggttggcgagttcggcgtttttcggtaggtatttttatttttacgtttacgtttacgggtttttatttgggtttttttggaggagcgatcgtgagggtttcgggtcgagtggggtatgggaaagtttgggttttaag

SEQ ID NO: 1918 - DNA, 563 bp, Artificial Sequence
  chemically treated genomic DNA (Homo sapiens) CpG-island No: 1918
cttaaaacccaaactttcccataccccactcgacccgaaaccctcacgatcgctcctccaaaaaaacccaaataaaaacccgtaaacgtaaacgtaaaaataaaaatacctaccgaaaaacgccgaactcgccaaccctactacgccccccctccccgcgctcactcgtaccccccgcaaaacatccttttaatccgattcaacgcgtccgcgctactaaccgaactaaacgcgcgactaacgacgctacgaacctctaacaccttctcgccgctacccaccgaaaccgtatccgaaacaaacgacgacgtaacacgcctcctactatcaccctccgtacaacgcgacgtacttccaaacgaaaccatcatccaaaactaacaaccctaccgacctaacgaaaacaacctacgcctactaacgaccaaaaacctaaaataacgcgtaaacaaccgcgcgcgcccgcgcgtactcacgctatacacgcgccccttccccatcccgcacgaaaaaaacgacacttaacgctatctcaacatcgacgccttcgataacgacgacgc

SEQ ID NO: 1919 - DNA, 563 bp, Artificial Sequence
  chemically treated genomic DNA (Homo sapiens) CpG-island No: 1919
tttgaaatttaggtttttttatattttattcggttcggagtttttacggtcgtttttttagagggatttaggtgggagttcgtgggcgtgaacgtgggagtgaagatgtttgtcgagaggcgtcgggttcgttagttttgttgcgtttttttttttcgcgtttattcgtgtttttcgtagggtatttttttggttcgatttaacgcgttcgcgttgttggtcgggttgggcgcgcggttggcggcgttgcggatttttggtattttttcgtcgttgtttatcgaggtcgtgttcgaggtaggcggcgacgtggtacgttttttgttgttatttttcgtgtagcgcgacgtgtttttaggcgggattattatttaggattggtagttttatcggtttagcgaaagtaatttgcgtttgttggcggttaagggtttggagtggcgcgtggatagtcgcgcgcgttcgcgcgtgtttacgttgtgtacgcgttttttttttatttcgtacggaggggacggtatttggcgttattttaatatcgacgttttcggtagcgacggcgt

SEQ ID NO: 1920 - DNA, 563 bp, Artificial Sequence
  chemically treated genomic DNA (Homo sapiens) CpG-island No: 1920
acgccgtcgctaccgaaaacgtcgatattaaaataacgccaaataccgtcccctccgtacgaaataaaaaaaaaacgcgtacacaacgtaaacacgcgcgaacgcgcgcgactatccacgcgccactccaaacccttaaccgccaacaaacgcaaattactttcgctaaaccgataaaactaccaatcctaaataataatcccgcctaaaaacacgtcgcgctacacgaaaaataacaacaaaaaacgtaccacgtcgccgcctacctcgaacacgacctcgataaacaacgacgaaaaaataccaaaaatccgcaacgccgccaaccgcgcgcccaacccgaccaacaacgcgaacgcgttaaatcgaaccaaaaaaataccctacgaaaaacacgaataaacgcgaaaaaaaaaaacgcaacaaaactaacgaacccgacgcctctcgacaaacatcttcactcccacgttcacgcccacgaactcccacctaaatccctctaaaaaaacgaccgtaaaaactccgaaccgaataaaatataaaaaaacctaaatttcaaa

SEQ ID NO: 1921 - DNA, 1397 bp, Artificial Sequence
  chemically treated genomic DNA (Homo sapiens) CpG-island No: 1921
gagcgggggcggcgttatttcggggggagcggattaggttggggtcgtaagggcggcgttcggggtcgcgtgggcggtttcgtcgtgaatgagttggtgtcgtattaggtgggttttgcggttgaagtttttttcgtattgcgggtaggagaaggggcgggagtttgtgtggatcgtttggtggcggattaggttggttttggagttgaagttgcgggcgtagacggcgtaggcgtgggggcggttgttagtgtgtatcgtttggtggcggtttaggtgcgatttgcggttgaagcggcggtcgtattgagcgtaggcgaaaggtttggcgtcgttgtgggttttggagtgggcgattagattaggtcgcgagtcgaagcggcggttatattgcgtgtaggcgaagggtcgttcgttcgtgtgtacgcgcgggtgtcgcgttaggtgttgtttatgggagaagtcgcgttcgtagttcgggtagaagaaggatcgttcgttcgagggggcgcgttggggtattacgggatcggattttgggtcgtagttcggttcgttaggcgcgttggttaggggtttggcggcgggggtatttacggtggcgtttagtgcgtatttatcgtatttaaaggggcgattttcgttgcggtgtagatattggtgcgtggcgaggttttttttttagtcgaagtttaagtcgtagtcggagtacgcgaaaggttttggttcgggaaaggatggggtcggggacggggtagtggaatgaggagaagcggacgagtcgggagagggtttggtcgggtcggtcgtttggtgtattttttggtgtcgtattaagtgttgtttgtgcgtgaagttgcgtgcgtattgtgcgtattggtagggtttttcgttcgtatggatgcgttggtgtcgaattaagtgcgtttttttgcgaaagcgtttttcgtatttcgtgtaggggaagggtcgttcgtcggtgtgggttttttggtgcgagtttaggtggattttttggttgaagcgtttgtcgtatttcgcgtacgggtagggtcgttcgttcgtgtgcgtgcgtaggtggcgggttagatgggtttttttgttgaagcgtttgtcgtattcggagtacgggaaaggtcgttcgtcgcggtggttgcgttgatgtagtagtatgtgggcgcgttgcgtgaagttgcggtcgtagttcgggtaggcgtaggggttttcgtttcggtgtagtcgttggtgtagtcgtaacgttagttggtttcggaagcgtcgtttatatttttcgtagtcgtagggttttttcggtatcggattttatttagatagcgcgagtttatttagtgttttcggggtttttggttttagtttgtacgcggtagttagatgtt

SEQ ID NO: 1922 - DNA, 1397 bp, Artificial Sequence
  chemically treated genomic DNA (Homo sapiens) CpG-island No: 1922
aacatctaactaccgcgtacaaactaaaaccaaaaaccccgaaaacactaaataaactcgcgctatctaaataaaatccgataccgaaaaaaccctacgactacgaaaaatataaacgacgcttccgaaaccaactaacgttacgactacaccaacgactacaccgaaacgaaaacccctacgcctacccgaactacgaccgcaacttcacgcaacgcgcccacatactactacatcaacgcaaccaccgcgacgaacgacctttcccgtactccgaatacgacaaacgcttcaacaaaaaaacccatctaacccgccacctacgcacgcacacgaacgaacgaccctacccgtacgcgaaatacgacaaacgcttcaaccaaaaaatccacctaaactcgcaccaaaaaacccacaccgacgaacgacccttcccctacacgaaatacgaaaaacgctttcgcaaaaaaacgcacttaattcgacaccaacgcatccatacgaacgaaaaaccctaccaatacgcacaatacgcacgcaacttcacgcacaaacaacacttaatacgacaccaaaaaatacaccaaacgaccgacccgaccaaaccctctcccgactcgtccgcttctcctcattccactaccccgtccccgaccccatcctttcccgaaccaaaacctttcgcgtactccgactacgacttaaacttcgactaaaaaaaaaacctcgccacgcaccaatatctacaccgcaacgaaaatcgcccctttaaatacgataaatacgcactaaacgccaccgtaaatacccccgccgccaaacccctaaccaacgcgcctaacgaaccgaactacgacccaaaatccgatcccgtaataccccaacgcgccccctcgaacgaacgatccttcttctacccgaactacgaacgcgacttctcccataaacaacacctaacgcgacacccgcgcgtacacacgaacgaacgacccttcgcctacacgcaatataaccgccgcttcgactcgcgacctaatctaatcgcccactccaaaacccacaacgacgccaaacctttcgcctacgctcaatacgaccgccgcttcaaccgcaaatcgcacctaaaccgccaccaaacgatacacactaacaaccgcccccacgcctacgccgtctacgcccgcaacttcaactccaaaaccaacctaatccgccaccaaacgatccacacaaactcccgccccttctcctacccgcaatacgaaaaaaacttcaaccgcaaaacccacctaatacgacaccaactcattcacgacgaaaccgcccacgcgaccccgaacgccgcccttacgaccccaacctaatccgctccccccgaaataacgccgcccccgctc

SEQ ID NO: 1923 - DNA, 1397 bp, Artificial Sequence
  chemically treated genomic DNA (Homo sapiens) CpG-island No: 1923
ggtatttggttgtcgcgtataaattggagttaggggtttcgggggtattgagtgggttcgcgttgtttgggtggggttcgatgtcggagaagttttacggttgcggggagtgtgagcggcgttttcgggattagttgacgttgcgattgtattagcggttgtatcggggcgagggtttttgcgtttgttcggattgcggtcgtagttttacgtagcgcgtttatatgttattgtattagcgtagttatcgcggcgagcggtttttttcgtgtttcgagtgcgataagcgttttagtaagaaggtttatttgattcgttatttgcgtacgtatacgggcgagcggttttattcgtgcgcggagtgcggtaagcgttttagttagaagatttatttgggttcgtattaaaagatttatatcggcgagcggttttttttttgtacggaatgcgagaagcgttttcgtaagaagacgtatttgattcggtattagcgtatttatacgggcgagaggttttattagtgcgtatagtgcgtacgtagttttacgtataagtagtatttggtgcggtattaaagggtgtattagacggtcggttcggttaggttttttttcgattcgttcgtttttttttattttattgtttcgttttcgattttattttttttcgggttaaagtttttcgcgtgtttcgattgcggtttgagtttcggttggaaaaagaatttcgttacgtattagtgtttgtatcgtagcgagggtcgtttttttgggtgcgatgagtgcgtattgggcgttatcgtggatgttttcgtcgttaagtttttggttagcgcgtttggcggatcgggttgcggtttaggattcgatttcgtggtgttttagcgcgttttttcgggcgagcggttttttttttgttcggattgcgggcgcggttttttttatgggtagtatttggcgcggtattcgcgcgtgtatacgggcgaacggtttttcgtttgtacgtagtgtgatcgtcgtttcggttcgcggtttaatttggtcgtttattttagggtttatagcggcgttaggtttttcgtttgcgtttagtgcggtcgtcgttttagtcgtaagtcgtatttgggtcgttattaggcggtgtatattggtagtcgtttttacgtttgcgtcgtttgcgttcgtagttttagttttaaaattaatttagttcgttattaggcgatttatataggttttcgtttttttttttgttcgtagtgcggaaagagttttagtcgtaagatttatttggtgcggtattagtttatttacggcgaagtcgtttacgcggtttcggacgtcgtttttgcggttttagtttggttcgtttttttcgaggtggcgtcgttttcgttt

SEQ ID NO: 1924 - DNA, 1397 bp, Artificial Sequence
  chemically treated genomic DNA (Homo sapiens) CpG-island No: 1924
aaacgaaaacgacgccacctcgaaaaaaacgaaccaaactaaaaccgcaaaaacgacgtccgaaaccgcgtaaacgacttcgccgtaaataaactaataccgcaccaaataaatcttacgactaaaactctttccgcactacgaacaaaaaaaaaaacgaaaacctatataaatcgcctaataacgaactaaattaattttaaaactaaaactacgaacgcaaacgacgcaaacgtaaaaacgactaccaatatacaccgcctaataacgacccaaatacgacttacgactaaaacgacgaccgcactaaacgcaaacgaaaaacctaacgccgctataaaccctaaaataaacgaccaaattaaaccgcgaaccgaaacgacgatcacactacgtacaaacgaaaaaccgttcgcccgtatacacgcgcgaataccgcgccaaatactacccataaaaaaaaccgcgcccgcaatccgaacaaaaaaaaaaccgctcgcccgaaaaaacgcgctaaaacaccacgaaatcgaatcctaaaccgcaacccgatccgccaaacgcgctaaccaaaaacttaacgacgaaaacatccacgataacgcccaatacgcactcatcgcacccaaaaaaacgaccctcgctacgatacaaacactaatacgtaacgaaattctttttccaaccgaaactcaaaccgcaatcgaaacacgcgaaaaactttaacccgaaaaaaaataaaatcgaaaacgaaacaataaaataaaaaaaaacgaacgaatcgaaaaaaaacctaaccgaaccgaccgtctaatacaccctttaataccgcaccaaatactacttatacgtaaaactacgtacgcactatacgcactaataaaacctctcgcccgtataaatacgctaataccgaatcaaatacgtcttcttacgaaaacgcttctcgcattccgtacaaaaaaaaaaccgctcgccgatataaatcttttaatacgaacccaaataaatcttctaactaaaacgcttaccgcactccgcgcacgaataaaaccgctcgcccgtatacgtacgcaaataacgaatcaaataaaccttcttactaaaacgcttatcgcactcgaaacacgaaaaaaaccgctcgccgcgataactacgctaatacaataacatataaacgcgctacgtaaaactacgaccgcaatccgaacaaacgcaaaaaccctcgccccgatacaaccgctaatacaatcgcaacgtcaactaatcccgaaaacgccgctcacactccccgcaaccgtaaaacttctccgacatcgaaccccacccaaacaacgcgaacccactcaatacccccgaaacccctaactccaatttatacgcgacaaccaaatacc

SEQ ID NO: 1925 - DNA, 890 bp, Artificial Sequence
  chemically treated genomic DNA (Homo sapiens) CpG-island No: 1925
cgaatattttttcgcgtttttttttttcgtcgcggcgttttttttttatttttgtttttttcggattttttattttttttaagtttttttttcgacgggatttttagttttatttttttgtttcgtcgtttttttaagtagtttcgatcgtcgattttattttaggtttcggttttttttttagtttcggggtttatttgttagcgtttttttttttcgtttttatcgagtggttcggtttttagcgttcgtttttttttttttttttttttcggtttttttttatattttttttttttttttttcggggttcgtcgtttttttttttatttgtttttcgttcgatttttttttagttttcgtttttttttttagttttttcggttttttttatttttatagtttttattttgttcgcgtcggttttgtttttttttttttttagttttcgattttttcggattcgcgttttttttttacgttcgtcgttcgcgtttttattttcggggttgttatttgcgcggagtcggtcgtgatttaatcgcggcgttgagggagacgcgggcggggtcgtttgtagaggagttttttcggtttttatttggttggtcggtcgtttcgttcgcgtcgcggggatttaggcgttcgggttttttgtttcgtcggttttgtttataatggcgttcgtcgtttgtagttcgggtgttgacggtttgaaagattgatagattgatagtttcgaaatttcgcggggaggagagggatagacgcgcggggagtcgaagtcgggaaacggcgtttgtaagggaggagggatcgagggagcgggcggagagtttcggcgtatcgggttgggggaggtaggggtagggggttttaggagtggggtt

SEQ ID NO: 1926 - DNA, 890 bp, Artificial Sequence
  chemically treated genomic DNA (Homo sapiens) CpG-island No: 1926
aaccccactcctaaaaccccctacccctacctcccccaacccgatacgccgaaactctccgcccgctccctcgatccctcctcccttacaaacgccgtttcccgacttcgactccccgcgcgtctatccctctcctccccgcgaaatttcgaaactatcaatctatcaatctttcaaaccgtcaacacccgaactacaaacgacgaacgccattataaacaaaaccgacgaaacaaaaaacccgaacgcctaaatccccgcgacgcgaacgaaacgaccgaccaaccaaataaaaaccgaaaaaactcctctacaaacgaccccgcccgcgtctccctcaacgccgcgattaaatcacgaccgactccgcgcaaataacaaccccgaaaataaaaacgcgaacgacgaacgtaaaaaaaaaacgcgaatccgaaaaaatcgaaaactaaaaaaaaaaaaaaacaaaaccgacgcgaacaaaataaaaactataaaaataaaaaaaaccgaaaaaactaaaaaaaaaaacgaaaactaaaaaaaaatcgaacgaaaaacaaataaaaaaaaaaacgacgaaccccgaaaaaaaaaaaaaaaaaatataaaaaaaaaccgaaaaaaaaaaaaaaaaaaaaacgaacgctaaaaaccgaaccactcgataaaaacgaaaaaaaaaaacgctaacaaataaaccccgaaactaaaaaaaaaaccgaaacctaaaataaaatcgacgatcgaaactacttaaaaaaacgacgaaacaaaaaaataaaactaaaaatcccgtcgaaaaaaaaacttaaaaaaaataaaaaatccgaaaaaaacaaaaataaaaaaaaaacgccgcgacgaaaaaaaaaaacgcgaaaaaatattcg

SEQ ID NO: 1927 - DNA, 890 bp, Artificial Sequence
  chemically treated genomic DNA (Homo sapiens) CpG-island No: 1927
gattttatttttgaaattttttgtttttgttttttttagttcggtgcgtcggggtttttcgttcgttttttcggtttttttttttttgtaggcgtcgtttttcggtttcgatttttcgcgcgtttatttttttttttttcgcgaagtttcggggttgttagtttgttagttttttaggtcgttagtattcgagttgtaggcggcgagcgttattgtgagtagagtcggcggggtaggaggttcgggcgtttgggttttcgcggcgcgggcggagcggtcggttagttaggtaagggtcggggaggtttttttgtaggcggtttcgttcgcgttttttttagcgtcgcggttgggttacggtcggtttcgcgtaggtgatagtttcgggggtaggggcgcggacggcgggcgtgggggaggggcgcgggttcggggaggtcgggggttggggggaagggagggtaaggtcggcgcgggtagggtgagggttgtgggggtagaggagatcgggggggttggagggaagggcgggggttgggagggggtcgggcgggaggtaggtgggaagggggacgacgggtttcgaggggaggagagagggagtgtgggagggggtcgagggggaaggggaggaagaagcgggcgttggggatcgggttattcggtaggggcgggagaggagggcgttgataggtgagtttcggagttggggagggggtcgggatttggaatgaagtcggcgatcggagttgtttgggagggcggcggggtagggaggtggagttgagggtttcgtcgggaggaaaatttgggaggggtgagaagttcgaggggagtagaaatagggagggggcgtcgcggcggagaagagaggcgcggaggggtgttcg

SEQ ID NO: 1928 - DNA, 890 bp, Artificial Sequence
  chemically treated genomic DNA (Homo sapiens) CpG-island No: 1928
cgaacacccctccgcgcctctcttctccgccgcgacgccccctccctatttctactcccctcgaacttctcacccctcccaaattttcctcccgacgaaaccctcaactccacctccctaccccgccgccctcccaaacaactccgatcgccgacttcattccaaatcccgaccccctccccaactccgaaactcacctatcaacgccctcctctcccgcccctaccgaataacccgatccccaacgcccgcttcttcctccccttccccctcgaccccctcccacactccctctctcctcccctcgaaacccgtcgtcccccttcccacctacctcccgcccgaccccctcccaacccccgcccttccctccaacccccccgatctcctctacccccacaaccctcaccctacccgcgccgaccttaccctcccttccccccaacccccgacctccccgaacccgcgcccctcccccacgcccgccgtccgcgcccctacccccgaaactatcacctacgcgaaaccgaccgtaacccaaccgcgacgctaaaaaaaacgcgaacgaaaccgcctacaaaaaaacctccccgacccttacctaactaaccgaccgctccgcccgcgccgcgaaaacccaaacgcccgaacctcctaccccgccgactctactcacaataacgctcgccgcctacaactcgaatactaacgacctaaaaaactaacaaactaacaaccccgaaacttcgcgaaaaaaaaaaaaataaacgcgcgaaaaatcgaaaccgaaaaacgacgcctacaaaaaaaaaaaaaccgaaaaaacgaacgaaaaaccccgacgcaccgaactaaaaaaaacaaaaacaaaaaatttcaaaaataaaatc

SEQ ID NO: 1929 - DNA, 607 bp, Artificial Sequence
  chemically treated genomic DNA (Homo sapiens) CpG-island No: 1929
tggttttcgaggtgggttcgcgggtattggtaggtgtcggggaaatttgtcggtacgtcgttcgtcgtttttggacgttcgggtagtttcgtattggagttggaacgagttttggtagtcggtttcgcgggagttttcgggcggcgattagacgcgagcgatttattcgcggttcgcggatgtttcggtttaggagttgcgcgtcgttcgttttagtttcgtttcggttcgcggagcgtttcggttcgtttcgttttttatgatcgttttttaattagtttagaagattgtaattcgtcggttagtaaagatatttacggtggggaaatttgataatttattttcgggttcgggggaggttatttgtagtgtattagcggattggttgttgcgcgggttgcggcggtaaagcgcgtaggtaaagcgcgtaggtagagcgcgcgtagtttttgattcgttttgttatttcggtaaggtacggggcggggagggtcgtttcgaagtagttcgcggtttagtatcgtgtgaaagggacggtgtcggtgtcggaattataaaattgttttatttttttagattgggtggtttggaagagatgttttttgtt

SEQ ID NO: 1930 - DNA, 607 bp, Artificial Sequence
  chemically treated genomic DNA (Homo sapiens) CpG-island No: 1930
aacaaaaaacatctcttccaaaccacccaatctaaaaaaataaaacaattttataattccgacaccgacaccgtccctttcacacgatactaaaccgcgaactacttcgaaacgaccctccccgccccgtaccttaccgaaataacaaaacgaatcaaaaactacgcgcgctctacctacgcgctttacctacgcgctttaccgccgcaacccgcgcaacaaccaatccgctaatacactacaaataacctcccccgaacccgaaaataaattatcaaatttccccaccgtaaatatctttactaaccgacgaattacaatcttctaaactaattaaaaaacgatcataaaaaacgaaacgaaccgaaacgctccgcgaaccgaaacgaaactaaaacgaacgacgcgcaactcctaaaccgaaacatccgcgaaccgcgaataaatcgctcgcgtctaatcgccgcccgaaaactcccgcgaaaccgactaccaaaactcgttccaactccaatacgaaactacccgaacgtccaaaaacgacgaacgacgtaccgacaaatttccccgacacctaccaatacccgcgaacccacctcgaaaacca

SEQ ID NO: 1931 - DNA, 607 bp, Artificial Sequence
  chemically treated genomic DNA (Homo sapiens) CpG-island No: 1931
agtaaagagtattttttttaaattatttaatttggagaggtggggtagttttgtggtttcggtatcgatatcgttttttttatacggtattgagtcgcgggttgtttcggggcggtttttttcgtttcgtgttttgtcgggatggtagagcggattagaagttgcgcgcgttttgtttgcgcgttttgtttgcgcgttttgtcgtcgtaattcgcgtagtagttaattcgttggtgtattgtaggtgatttttttcgggttcgggaataaattgttaagtttttttatcgtgggtgtttttgttagtcggcgagttgtagttttttgagttaattaggagacggttatgaggagcgaggcgggtcggggcgtttcgcgggtcggggcggggttggggcgggcggcgcgtagtttttgggtcgaggtattcgcgagtcgcgggtagatcgttcgcgtttgatcgtcgttcgggagttttcgcggagtcggttgttaggattcgttttagttttagtgcggggttgttcgggcgtttagaggcggcggacggcgtgtcggtaagttttttcggtatttgttagtgttcgcgaatttatttcggaagtta

SEQ ID NO: 1932 - DNA, 607 bp, Artificial Sequence
  chemically treated genomic DNA (Homo sapiens) CpG-island No: 1932
taacttccgaaataaattcgcgaacactaacaaataccgaaaaaacttaccgacacgccgtccgccgcctctaaacgcccgaacaaccccgcactaaaactaaaacgaatcctaacaaccgactccgcgaaaactcccgaacgacgatcaaacgcgaacgatctacccgcgactcgcgaatacctcgacccaaaaactacgcgccgcccgccccaaccccgccccgacccgcgaaacgccccgacccgcctcgctcctcataaccgtctcctaattaactcaaaaaactacaactcgccgactaacaaaaacacccacgataaaaaaacttaacaatttattcccgaacccgaaaaaaatcacctacaatacaccaacgaattaactactacgcgaattacgacgacaaaacgcgcaaacaaaacgcgcaaacaaaacgcgcgcaacttctaatccgctctaccatcccgacaaaacacgaaacgaaaaaaaccgccccgaaacaacccgcgactcaataccgtataaaaaaaacgatatcgataccgaaaccacaaaactaccccacctctccaaattaaataatttaaaaaaaatactctttact

SEQ ID NO: 1933 - DNA, 537 bp, Artificial Sequence
  chemically treated genomic DNA (Homo sapiens) CpG-island No: 1933
tgtgtacgtggtgtgtgtgagtgggatgtgtgatcgacgttgatgtgatgtgtgtatgtgtggggtgtgtgtgtgtgtttgattgtgtacgtggtgtgtgtgagtgggatgtgtgatcgacgttgatgtgacgtgtgtatgtgtggggtgtgcgtgtgtgtgattgtgtacgtggtgtgtgtgaggggtgtgtgatcgacgttgatgtgacgtgtgtatgtgtgtggggtgtgtgtgtgtgtgattgtgtacgtggagtgtgtgatcgatgttgatgtgacgtgtgtatgtgtggggtgtgtgtgtgtgtttgattgtgtacgtggtgtgagtggggtgtgtgatcgacgttgatgtgacgtgtgtatgtgtggggtgtgtgcgtgtgtgattgtgtacgtggtgtgagtggggtgtgtgatcgatgttgatgtgacgtgtgtatgtgtggggtgtgtgtgtgtgtttgtgtacgtggtgtgagtggggtgtgtgattgatgttgatgtgacgtgtgtatgtgtggggtgtgtgtgt

SEQ ID NO: 1934 - DNA, 537 bp, Artificial Sequence
  chemically treated genomic DNA (Homo sapiens) CpG-island No: 1934
acacacacaccccacacatacacacgtcacatcaacatcaatcacacaccccactcacaccacgtacacaaacacacacacacaccccacacatacacacgtcacatcaacatcgatcacacaccccactcacaccacgtacacaatcacacacgcacacaccccacacatacacacgtcacatcaacgtcgatcacacaccccactcacaccacgtacacaatcaaacacacacacacaccccacacatacacacgtcacatcaacatcgatcacacactccacgtacacaatcacacacacacacaccccacacacatacacacgtcacatcaacgtcgatcacacacccctcacacacaccacgtacacaatcacacacacgcacaccccacacatacacacgtcacatcaacgtcgatcacacatcccactcacacacaccacgtacacaatcaaacacacacacacaccccacacatacacacatcacatcaacgtcgatcacacatcccactcacacacaccacgtacaca

SEQ ID NO: 1935 - DNA, 537 bp, Artificial Sequence
  chemically treated genomic DNA (Homo sapiens) CpG-island No: 1935
atatatatattttatatatgtatacgttatattagtattaattatatattttatttatattacgtatataggtatatatatatattttatatatgtatacgttatattagtatcgattatatattttatttatattacgtatatagttatatacgtatatattttatatatgtatacgttatattagcgtcgattatatattttatttatattacgtatatagttagatatatatatatattttatatatgtatacgttatattagtatcgattatatattttacgtatatagttatatatatatatattttatatatatgtatacgttatattagcgtcgattatatattttttatatatattacgtatatagttatatatacgtatattttatatatgtatacgttatattagcgtcgattatatattttatttatatatattacgtatatagttagatatatatatatattttatatatgtatatattatattagcgtcgattatatattttatttatatatattacgtatata

SEQ ID NO: 1936 - DNA, 537 bp, Artificial Sequence
  chemically treated genomic DNA (Homo sapiens) CpG-island No: 1936
tatatacgtaatatatataaataaaatatataatcgacgctaatataatatatacatatataaaatatatatatatatctaactatatacgtaatatatataaataaaatatataatcgacgctaatataacgtatacatatataaaatatacgtatatataactatatacgtaatatatataaaaaatatataatcgacgctaatataacgtatacatatatataaaatatatatatatataactatatacgtaaaatatataatcgatactaatataacgtatacatatataaaatatatatatatatctaactatatacgtaatataaataaaatatataatcgacgctaatataacgtatacatatataaaatatatacgtatataactatatacgtaatataaataaaatatataatcgatactaatataacgtatacatatataaaatatatatatatacctatatacgtaatataaataaaatatataattaatactaatataacgtatacatatataaaatatatatat

SEQ ID NO: 1937 - DNA, 1163 bp, Artificial Sequence
  chemically treated genomic DNA (Homo sapiens) CpG-island No: 1937
tcggcggcgggaaggggcgggttgggggtggggagcgcggagggggcgggcgggcggttggcgggggaggcggggagcgtagttagcgcggtatagaacgagcgagcgagcgagcggagaggcggttatagtttgagcgtcgggtcggtagcggtcgcgtcggcgagcggattagcgggcggcgagtagcgcggagcgcgcggggtatcgaggagcgggcgcggcgggtatcgcgcgaggtagtcggagttttcggaaaggttagagcggcgtcgttttcgttgtttttgcggggtttcggttgggagttcgacgagggagcgggcggtatggttcggcggttcggggcgcgggggcgttaggttttcggaggggcgtttttagtttcgtcgttgtcgtcgtcgtttttcgtagtcgcgcgtttcgttcgttttagtcgttttcggggtcgttatcggtttatgagtttcggttttaaagtttgcggcgggcgggcgggcgcggagtttttaagatgtcgttttattcggtgacggcggcgttgatgtatcggggtatttatatcgtgtttaatttgttgtcggagtagcgttcggtggatatttcggaggacgagttggagggtgagtgttcgtcgggattttcgtttcggcggtttttttatttgtgcgtttaggtgaagcgcgggttaggggcgcgggggcggggggcggggggcggttcgtaggtgtcggttgttaggtgggcgttttagttagtagttgtgtttcgcggtaagatttgttcgtatttcggggcgtcgcggtgggggtcgtttaggcggagagcggtttagtttttgttcgcgtggtttttagcgttgcggaaatttgtcgggtttcgtagcggggttacggggtcgcgtagtcggcggtgacggtgcggtaacgcggcggattggggcgggggttcgcgttgagtttttagcgtcggttcggtcggagtattcgtattttgatttttttcgcggcgttcgttcgcggttttttgttcgtattgatatttcgttcgtgtcgttttaaaaatttaatttgttcgggtagtagtagaaggggagagggcgattgttttgtttttgttcgttgcggggtcgttttcgtttttatttgcggtcgtagtttttt

SEQ ID NO: 1938 - DNA, 1163 bp, Artificial Sequence
  chemically treated genomic DNA (Homo sapiens) CpG-island No: 1938
aaaaaactacgaccgcaaataaaaacgaaaacgaccccgcaacgaacaaaaacaaaacaatcgccctctccccttctactactacccgaacaaattaaatttttaaaacgacacgaacgaaatatcaatacgaacaaaaaaccgcgaacgaacgccgcgaaaaaaatcaaaatacgaatactccgaccgaaccgacgctaaaaactcaacgcgaacccccgccccaatccgccgcgttaccgcaccgtcaccgccgactacgcgaccccgtaaccccgctacgaaacccgacaaatttccgcaacgctaaaaaccacgcgaacaaaaactaaaccgctctccgcctaaacgacccccaccgcgacgccccgaaatacgaacaaatcttaccgcgaaacacaactactaactaaaacgcccacctaacaaccgacacctacgaaccgccccccgccccccgcccccgcgcccctaacccgcgcttcacctaaacgcacaaataaaaaaaccgccgaaacgaaaatcccgacgaacactcaccctccaactcgtcctccgaaatatccaccgaacgctactccgacaacaaattaaacacgatataaataccccgatacatcaacgccgccgtcaccgaataaaacgacatcttaaaaactccgcgcccgcccgcccgccgcaaactttaaaaccgaaactcataaaccgataacgaccccgaaaacgactaaaacgaacgaaacgcgcgactacgaaaaacgacgacgacaacgacgaaactaaaaacgcccctccgaaaacctaacgcccccgcgccccgaaccgccgaaccataccgcccgctccctcgtcgaactcccaaccgaaaccccgcaaaaacaacgaaaacgacgccgctctaacctttccgaaaactccgactacctcgcgcgatacccgccgcgcccgctcctcgataccccgcgcgctccgcgctactcgccgcccgctaatccgctcgccgacgcgaccgctaccgacccgacgctcaaactataaccgcctctccgctcgctcgctcgctcgttctataccgcgctaactacgctccccgcctcccccgccaaccgcccgcccgccccctccgcgctccccacccccaacccgccccttcccgccgccga

SEQ ID NO: 1939 - DNA, 1163 bp, Artificial Sequence
  chemically treated genomic DNA (Homo sapiens) CpG-island No: 1939
aaggggttacggtcgtaggtggggacgggggcggtttcgtagcgggtaagagtagggtagtcgttttttttttttttgttgttgttcgagtagattgaatttttaaagcgatacgagcggaatgttaatgcgagtagagagtcgcgggcgggcgtcgcggaggggattaggatgcgggtgtttcggtcgggtcggcgttgggggtttagcgcggattttcgttttagttcgtcgcgttgtcgtatcgttatcgtcgattgcgcggtttcgtgatttcgttgcggggttcggtaagttttcgtagcgttggggattacgcgggtaggggttgggtcgtttttcgtttgagcgatttttatcgcggcgtttcggggtgcggataggttttgtcgcggggtatagttgttagttggggcgtttatttggtaatcggtatttgcggatcgtttttcgtttttcgttttcgcgtttttggttcgcgttttatttgggcgtataggtaggagggtcgtcggggcggggatttcggcggatatttattttttagttcgtttttcgggatgtttatcgggcgttgtttcgatagtaggttgggtacggtgtagatgtttcggtatattaacgtcgtcgttatcgggtggaacggtattttggaggtttcgcgttcgttcgttcgtcgtaaattttgaggtcggggtttatgggtcggtggcggtttcgggggcggttggagcgggcggggcgcgcggttgcggagggcggcggcggtagcggcgaggttggggacgttttttcgggggtttagcgttttcgcgtttcgggtcgtcgggttatgtcgttcgttttttcgtcgggtttttagtcggggtttcgtaggggtagcgggggcggcgtcgttttggttttttcgagagtttcggttgtttcgcgcggtgttcgtcgcgttcgtttttcggtgtttcgcgcgtttcgcgttgttcgtcgttcgttagttcgttcgtcggcgcggtcgttatcggttcggcgtttaggttgtagtcgttttttcgttcgttcgttcgttcgttttgtgtcgcgttggttgcgtttttcgtttttttcgttagtcgttcgttcgtttttttcgcgttttttatttttagttcgttttttttcgtcgtcgg

SEQ ID NO: 1940 - DNA, 1163 bp, Artificial Sequence
  chemically treated genomic DNA (Homo sapiens) CpG-island No: 1940
ccgacgacgaaaaaaaacgaactaaaaataaaaaacgcgaaaaaaacgaacgaacgactaacgaaaaaaacgaaaaacgcaaccaacgcgacacaaaacgaacgaacgaacgaacgaaaaaacgactacaacctaaacgccgaaccgataacgaccgcgccgacgaacgaactaacgaacgacgaacaacgcgaaacgcgcgaaacaccgaaaaacgaacgcgacgaacaccgcgcgaaacaaccgaaactctcgaaaaaaccaaaacgacgccgcccccgctacccctacgaaaccccgactaaaaacccgacgaaaaaacgaacgacataacccgacgacccgaaacgcgaaaacgctaaacccccgaaaaaacgtccccaacctcgccgctaccgccgccgccctccgcaaccgcgcgccccgcccgctccaaccgcccccgaaaccgccaccgacccataaaccccgacctcaaaatttacgacgaacgaacgaacgcgaaacctccaaaataccgttccacccgataacgacgacgttaatataccgaaacatctacaccgtacccaacctactatcgaaacaacgcccgataaacatcccgaaaaacgaactaaaaaataaatatccgccgaaatccccgccccgacgaccctcctacctatacgcccaaataaaacgcgaaccaaaaacgcgaaaacgaaaaacgaaaaacgatccgcaaataccgattaccaaataaacgccccaactaacaactataccccgcgacaaaacctatccgcaccccgaaacgccgcgataaaaatcgctcaaacgaaaaacgacccaacccctacccgcgtaatccccaacgctacgaaaacttaccgaaccccgcaacgaaatcacgaaaccgcgcaatcgacgataacgatacgacaacgcgacgaactaaaacgaaaatccgcgctaaacccccaacgccgacccgaccgaaacacccgcatcctaatcccctccgcgacgcccgcccgcgactctctactcgcattaacattccgctcgtatcgctttaaaaattcaatctactcgaacaacaacaaaaaaaaaaaaaacgactaccctactcttacccgctacgaaaccgcccccgtccccacctacgaccgtaacccctt

SEQ ID NO: 1941 - DNA, 657 bp, Artificial Sequence
  chemically treated genomic DNA (Homo sapiens) CpG-island No: 1941
aggcgacgcggggggcgttggtcgtaggggtcggtagggggcgcgttggtcgcggtggttgggtagcgcgagtttgcggcgcgtttaggttcgcgcggttttcggtgtattcgttgtttataaagcgttagttgaggggtcgttgcgggtggagtgcggcggagtcggtttcgcgattttagtttgattcgtcgtttgttgtatcgcgttttcgtcgcgtttttgcgcgtttcgagtttcgacggtcgcgtgagtttcgttcgtgcggggaaggtagggtcgggtcggcgtcgtttgtggagaggattcggcggtcgggtttgtttggagtcgggcgcggtggtagcggcggtagcggcggcgattttcgaggttcgggttagatagcgtagggttatggttgaggcggtttcggtttcggtaagggcggtcgcgcgcgagtgttgtgagttttcgagatttagatttcgagggaggaaggcgggcgggtagggagttgttaggtataggcgtcgttttcgggtttcgtcggttacgtcgtttgtcgttcgtgtttggcggttgtagtttcgcgtgaggggatttagcgggtgggtgtgaaatcgtttattcggggatattaggttgggtcgtaggtttgaggggtattcgtaggta

SEQ ID NO: 1942 - DNA, 657 bp, Artificial Sequence
  chemically treated genomic DNA (Homo sapiens) CpG-island No: 1942
tacctacgaatacccctcaaacctacgacccaacctaatatccccgaataaacgatttcacacccacccgctaaatcccctcacgcgaaactacaaccgccaaacacgaacgacaaacgacgtaaccgacgaaacccgaaaacgacgcctatacctaacaactccctacccgcccgccttcctccctcgaaatctaaatctcgaaaactcacaacactcgcgcgcgaccgcccttaccgaaaccgaaaccgcctcaaccataaccctacgctatctaacccgaacctcgaaaatcgccgccgctaccgccgctaccaccgcgcccgactccaaacaaacccgaccgccgaatcctctccacaaacgacgccgacccgaccctaccttccccgcacgaacgaaactcacgcgaccgtcgaaactcgaaacgcgcaaaaacgcgacgaaaacgcgatacaacaaacgacgaatcaaactaaaatcgcgaaaccgactccgccgcactccacccgcaacgacccctcaactaacgctttataaacaacgaatacaccgaaaaccgcgcgaacctaaacgcgccgcaaactcgcgctacccaaccaccgcgaccaacgcgccccctaccgacccctacgaccaacgccccccgcgtcgcct

SEQ ID NO: 1943 - DNA, 657 bp, Artificial Sequence
  chemically treated genomic DNA (Homo sapiens) CpG-island No: 1943
tgtttgcgagtgttttttagatttgcggtttagtttggtgttttcgggtgggcggttttatatttattcgttaagtttttttacgcgaggttgtagtcgttaagtacgggcgataggcgacgtggtcggcgggattcgagaacggcgtttatgtttggtagttttttgttcgttcgtttttttttttcggggtttgggtttcgggggtttataatattcgcgcgcggtcgtttttatcggggtcggggtcgttttagttatggttttgcgttgtttagttcgggtttcggaagtcgtcgtcgttgtcgtcgttgttatcgcgttcggttttaagtaggttcggtcgtcgggttttttttataggcggcgtcgattcggttttgtttttttcgtacggacgggatttacgcggtcgtcggggttcgggacgcgtaggaacgcggcggaggcgcggtgtagtaggcggcggattaagttggggtcgcgaggtcgatttcgtcgtattttattcgtagcggttttttagttggcgttttgtgggtagcgagtgtatcgggaatcgcgcgggtttagacgcgtcgtaggttcgcgttgtttagttatcgcggttagcgcgttttttgtcggtttttgcggttagcgtttttcgcgtcgttt

SEQ ID NO: 1944 - DNA, 657 bp, Artificial Sequence
  chemically treated genomic DNA (Homo sapiens) CpG-island No: 1944
aaacgacgcgaaaaacgctaaccgcaaaaaccgacaaaaaacgcgctaaccgcgataactaaacaacgcgaacctacgacgcgtctaaacccgcgcgattcccgatacactcgctacccacaaaacgccaactaaaaaaccgctacgaataaaatacgacgaaatcgacctcgcgaccccaacttaatccgccgcctactacaccgcgcctccgccgcgttcctacgcgtcccgaaccccgacgaccgcgtaaatcccgtccgtacgaaaaaaacaaaaccgaatcgacgccgcctataaaaaaaacccgacgaccgaacctacttaaaaccgaacgcgataacaacgacgacaacgacgacgacttccgaaacccgaactaaacaacgcaaaaccataactaaaacgaccccgaccccgataaaaacgaccgcgcgcgaatattataaacccccgaaacccaaaccccgaaaaaaaaaaacgaacgaacaaaaaactaccaaacataaacgccgttctcgaatcccgccgaccacgtcgcctatcgcccgtacttaacgactacaacctcgcgtaaaaaaacttaacgaataaatataaaaccgcccacccgaaaacaccaaactaaaccgcaaatctaaaaaacactcgcaaaca

SEQ ID NO: 1945 - DNA, 751 bp, Artificial Sequence
  chemically treated genomic DNA (Homo sapiens) CpG-island No: 1945
tttcgagtcgagggttgttggacgacggtttttaggtgttgttcggggagcgtggtttcggcgaggcgtcgtcgggtggggatcgtagtatcgggggcggcgggggcgatgggggcggtgggggcggcggcgcggaggcggggacgggggtaggcggcggttgtggtagttgttgttttggcgggttgcggcggagtttttttttgtacggcgttcgtagtaagttttattcgtgtttcgagtgcggtaagagtttcggcgtgcgtaagagttttattatttattatcgtagttatattaaggagcggttttacgagtgcgttgagtgcgagaagagttttaattgttattcgggttttattcgttattagatgacgtatcgcggcgagcggttttataagtgttcggagtgcgagaagatttatagtcgtaaggagtatttgtagaattattagcggttgtatacgggcgagcggtttttttaatgtgtattgtgcggtaagagttttattcgtaagtagaatttgtttaagtattagcgtatttatacgggcgagcgtttttatacgtgcggcgagtgcggtaagagttttcgttataaggagtcgtttaaggattatttgcgcgtgtatagcggcggttcgggtttcggcgttttacggtagttttcgtcgttttttgagcgagattagggttgggttgggggagggtagggtcggacggagtggatcgggggcggtttgagtattaa

SEQ ID NO: 1946 - DNA, 751 bp, Artificial Sequence
  chemically treated genomic DNA (Homo sapiens) CpG-island No: 1946
ttaatactcaaaccgcccccgatccactccgtccgaccctaccctcccccaacccaaccctaatctcgctcaaaaaacgacgaaaactaccgtaaaacgccgaaacccgaaccgccgctatacacgcgcaaataatccttaaacgactccttataacgaaaactcttaccgcactcgccgcacgtataaaaacgctcgcccgtataaatacgctaatacttaaacaaattctacttacgaataaaactcttaccgcacaatacacattaaaaaaaccgctcgcccgtatacaaccgctaataattctacaaatactccttacgactataaatcttctcgcactccgaacacttataaaaccgctcgccgcgatacgtcatctaataacgaataaaacccgaataacaattaaaactcttctcgcactcaacgcactcgtaaaaccgctccttaatataactacgataataaataataaaactcttacgcacgccgaaactcttaccgcactcgaaacacgaataaaacttactacgaacgccgtacaaaaaaaaactccgccgcaacccgccaaaacaacaactaccacaaccgccgcctacccccgtccccgcctccgcgccgccgcccccaccgcccccatcgcccccgccgcccccgatactacgatccccacccgacgacgcctcgccgaaaccacgctccccgaacaacacctaaaaaccgtcgtccaacaaccctcgactcgaaa

SEQ ID NO: 1947 - DNA, 751 bp, Artificial Sequence
  chemically treated genomic DNA (Homo sapiens) CpG-island No: 1947
ttggtgtttaggtcgttttcgatttatttcgttcggttttgtttttttttagtttagttttagtttcgtttaggaggcggcgggagttgtcgtggggcgtcggggttcgggtcgtcgttgtgtacgcgtaggtggtttttgagcgattttttgtagcggaagtttttgtcgtattcgtcgtacgtgtaggggcgttcgttcgtgtggatgcgttggtgtttgagtaggttttgtttgcggatgaagtttttgtcgtatagtgtatattggaaaggtcgttcgttcgtgtgtagtcgttggtggttttgtaggtgttttttacggttgtaggttttttcgtatttcgagtatttgtagggtcgttcgtcgcggtgcgttatttggtggcggatgaggttcgagtggtagttgaagtttttttcgtatttagcgtattcgtagggtcgttttttggtgtggttgcggtggtggatgatgaggtttttgcgtacgtcgaagtttttgtcgtattcggggtacgagtagggtttgttgcgggcgtcgtgtaggaggaggtttcgtcgtagttcgttagggtagtagttgttatagtcgtcgtttgttttcgttttcgttttcgcgtcgtcgtttttatcgtttttatcgttttcgtcgttttcggtgttgcggtttttattcggcggcgtttcgtcggagttacgtttttcgggtagtatttggaaatcgtcgtttagtagttttcggttcgggg

SEQ ID NO: 1948 - DNA, 751 bp, Artificial Sequence
  chemically treated genomic DNA (Homo sapiens) CpG-island No: 1948
ccccgaaccgaaaactactaaacgacgatttccaaatactacccgaaaaacgtaactccgacgaaacgccgccgaataaaaaccgcaacaccgaaaacgacgaaaacgataaaaacgataaaaacgacgacgcgaaaacgaaaacgaaaacaaacgacgactataacaactactaccctaacgaactacgacgaaacctcctcctacacgacgcccgcaacaaaccctactcgtaccccgaatacgacaaaaacttcgacgtacgcaaaaacctcatcatccaccaccgcaaccacaccaaaaaacgaccctacgaatacgctaaatacgaaaaaaacttcaactaccactcgaacctcatccgccaccaaataacgcaccgcgacgaacgaccctacaaatactcgaaatacgaaaaaacctacaaccgtaaaaaacacctacaaaaccaccaacgactacacacgaacgaacgacctttccaatatacactatacgacaaaaacttcatccgcaaacaaaacctactcaaacaccaacgcatccacacgaacgaacgcccctacacgtacgacgaatacgacaaaaacttccgctacaaaaaatcgctcaaaaaccacctacgcgtacacaacgacgacccgaaccccgacgccccacgacaactcccgccgcctcctaaacgaaactaaaactaaactaaaaaaaaacaaaaccgaacgaaataaatcgaaaacgacctaaacaccaa

SEQ ID NO: 1949 - DNA, 942 bp, Artificial Sequence
  chemically treated genomic DNA (Homo sapiens) CpG-island No: 1949
ggttcggattggagtttcggcgagggtcgatttcgttttttacgtagttttttttcgcgaggtttcgtattttttagcgcggttttttttcgtagttttttcggttttcgcgtgggacgtagagagaggttgggcgtcgcgttggttcgggagtggtttacgtttgacgtagtttcgttggaggtcgtggtacgttcgttttggcgttaattttcgcgtttcgggtgagggtgggtggtcgcgtttgggtttcggacgtcgcgggcgttgaaggtttcgggagggcgcggggcggcggtcgcgggcgtgcggttttacgggttgtagggggcgttgtgcgcgtttttaagttcggtcgtcgagcgtagtttttttttaaagggttagcggggtacgtggttcgggacgtagttcgttgtcgttcggtagtagtttttaggttaggcgggtttcgtttcgttttcgtcgtcgttgtcgcgtcgtttcgggttcgataggtcgggtttagggattgtaatttagcgagggacgcgggtagttatggtcgaagcggcgtttgttcgggtaagcgttttcggtttcgcggacgttcggaaggtttaggtcgtcgtcgcgtgagttcgcgcgagggattttggtcgcgcgaggtcgcggggtgagagggttttgcgcgtagttttcgcgttcgttgttttcggtttatcgtttagttcgcgtcgaaggtattgatcgggcggtttaaatgttaggttcggcgggcggggtttcgacgttagcggttgacgattcggtttatttgcggttttagttaggtcgggttttagagttacgttcggcgacgaggaggtcgcgttttaggagtattgttttatttgaggtttcgcggttttttttatagtaggttgggcgggtaggggtcgttagttttacgggatagtagcg

SEQ ID NO: 1950 - DNA, 942 bp, Artificial Sequence
  chemically treated genomic DNA (Homo sapiens) CpG-island No: 1950
cgctactatcccgtaaaactaacgacccctacccgcccaacctactataaaaaaaaccgcgaaacctcaaataaaacaatactcctaaaacgcgacctcctcgtcgccgaacgtaactctaaaacccgacctaactaaaaccgcaaataaaccgaatcgtcaaccgctaacgtcgaaaccccgcccgccgaacctaacatttaaaccgcccgatcaataccttcgacgcgaactaaacgataaaccgaaaacaacgaacgcgaaaactacgcgcaaaaccctctcaccccgcgacctcgcgcgaccaaaatccctcgcgcgaactcacgcgacgacgacctaaaccttccgaacgtccgcgaaaccgaaaacgcttacccgaacaaacgccgcttcgaccataactacccgcgtccctcgctaaattacaatccctaaacccgacctatcgaacccgaaacgacgcgacaacgacgacgaaaacgaaacgaaacccgcctaacctaaaaactactaccgaacgacaacgaactacgtcccgaaccacgtaccccgctaaccctttaaaaaaaaactacgctcgacgaccgaacttaaaaacgcgcacaacgccccctacaacccgtaaaaccgcacgcccgcgaccgccgccccgcgccctcccgaaaccttcaacgcccgcgacgtccgaaacccaaacgcgaccacccaccctcacccgaaacgcgaaaattaacgccaaaacgaacgtaccacgacctccaacgaaactacgtcaaacgtaaaccactcccgaaccaacgcgacgcccaacctctctctacgtcccacgcgaaaaccgaaaaaactacgaaaaaaaaccgcgctaaaaaatacgaaacctcgcgaaaaaaaactacgtaaaaaacgaaatcgaccctcgccgaaactccaatccgaacc

SEQ ID NO: 1951 - DNA, 942 bp, Artificial Sequence
  chemically treated genomic DNA (Homo sapiens) CpG-island No: 1951
cgttattgtttcgtggggttggcggtttttgttcgtttagtttgttgtagggggggtcgcgaggttttaaatgggataatatttttaaggcgcggttttttcgtcgtcgagcgtgattttggggttcggtttggttgaggtcgtagatgggtcggatcgttagtcgttgacgtcggggtttcgttcgtcgggtttggtatttgggtcgttcggttaatgttttcgacgcgggttgggcgatgggtcgggggtaacgagcgcggaggttgcgcgtaaggtttttttatttcgcggtttcgcgcggttagagtttttcgcgcgggtttacgcggcggcggtttgggtttttcgggcgttcgcggggtcgagggcgtttattcgggtaggcgtcgtttcggttatggttgttcgcgtttttcgttgggttgtagtttttggattcggtttgtcgggttcggggcggcgcggtagcgacggcggaagcggagcgggattcgtttaatttgagagttattgtcgggcggtagcgaattgcgtttcgagttacgtgtttcgttggttttttaaaaaagagttgcgttcggcggtcgagtttgaggacgcgtatagcgttttttgtagttcgtaggatcgtacgttcgcggtcgtcgtttcgcgttttttcgaggtttttagcgttcgcggcgttcgggatttaggcgcggttatttatttttattcggggcgcgggagttgacgttagggcgggcgtgttacggtttttagcggggttacgttaggcgtaagttattttcgggttagcgcggcgtttaatttttttttgcgttttacgcgggagtcgggagggttgcgggaaggaatcgcgttggaaagtgcgaaatttcgcgagggaaagttgcgtggggaacggggtcggttttcgtcggggttttagttcggatt

SEQ ID NO: 1952 - DNA, 942 bp, Artificial Sequence
  chemically treated genomic DNA (Homo sapiens) CpG-island No: 1952
aatccgaactaaaaccccgacgaaaaccgaccccgttccccacgcaactttccctcgcgaaatttcgcactttccaacgcgattccttcccgcaaccctcccgactcccgcgtaaaacgcaaaaaaaaattaaacgccgcgctaacccgaaaataacttacgcctaacgtaaccccgctaaaaaccgtaacacgcccgccctaacgtcaactcccgcgccccgaataaaaataaataaccgcgcctaaatcccgaacgccgcgaacgctaaaaacctcgaaaaaacgcgaaacgacgaccgcgaacgtacgatcctacgaactacaaaaaacgctatacgcgtcctcaaactcgaccgccgaacgcaactcttttttaaaaaaccaacgaaacacgtaactcgaaacgcaattcgctaccgcccgacaataactctcaaattaaacgaatcccgctccgcttccgccgtcgctaccgcgccgccccgaacccgacaaaccgaatccaaaaactacaacccaacgaaaaacgcgaacaaccataaccgaaacgacgcctacccgaataaacgccctcgaccccgcgaacgcccgaaaaacccaaaccgccgccgcgtaaacccgcgcgaaaaactctaaccgcgcgaaaccgcgaaataaaaaaaccttacgcgcaacctccgcgctcgttacccccgacccatcgcccaacccgcgtcgaaaacattaaccgaacgacccaaataccaaacccgacgaacgaaaccccgacgtcaacgactaacgatccgacccatctacgacctcaaccaaaccgaaccccaaaatcacgctcgacgacgaaaaaaccgcgccttaaaaatattatcccatttaaaacctcgcgaccccccctacaacaaactaaacgaacaaaaaccgccaaccccacgaaacaataacg

SEQ ID NO: 1953 - DNA, 815 bp, Artificial Sequence
  chemically treated genomic DNA (Homo sapiens) CpG-island No: 1953
cgtcgtggtcggggtggtgtttcggggcgtggcggttttggcggtcgcgttttcgggggtaggtgcggcgtcgtcggtgacggtggtttttagttttgtttttgttttttttggcgggtttttcgttggacgagcgtttttttcggttgcggtagtggtttcggtttatttttttgaggttgtcgattttttttttcgttggggaagggtttggggttttcggcgtcgcggcgttttcgattttttcgtcggggttaggtttagcgttttttttcgggtgatcggtcggggttatgtttagtataggagttggcggtcgttttgcggtttcgggtgcgtttaagttttgggatgggttttgagcgtttcgggcgtggttttcgttggggtgaataaggagtggttgttcgtagggttttttcgatcgcgtaggcggagtcggatttaattttttcggggttttcgttaacgtcgagtttcgcgggtttttcgcgattattttttttgcgttttgggataacgggttcgtatcgtttgttaagttttcgggattatataggttagggggtgttgtgttttttacgatgttttcgtcggcgttgggcggaggtttttcgggggcgacggttatggttttttaggcgttttttttggtagcgggggtgtcgggatcgcggggcgcggagtttttttggtgttgttgaggtcggcggtcgtatttggtttttttagggattcggcggcggggttgttaggttgaggttcggcgtcgcggttttcgggagggtttttttttgttttaggtgtattgtagt

SEQ ID NO: 1954 - DNA, 815 bp, Artificial Sequence
  chemically treated genomic DNA (Homo sapiens) CpG-island No: 1954
actacaatacacctaaaacaaaaaaaaaccctcccgaaaaccgcgacgccgaacctcaacctaacaaccccgccgccgaatccctaaaaaaaccaaatacgaccgccgacctcaacaacaccaaaaaaactccgcgccccgcgatcccgacacccccgctaccaaaaaaaacgcctaaaaaaccataaccgtcgcccccgaaaaacctccgcccaacgccgacgaaaacatcgtaaaaaacacaacaccccctaacctatataatcccgaaaacttaacaaacgatacgaacccgttatcccaaaacgcaaaaaaaataatcgcgaaaaacccgcgaaactcgacgttaacgaaaaccccgaaaaaattaaatccgactccgcctacgcgatcgaaaaaaccctacgaacaaccactccttattcaccccaacgaaaaccacgcccgaaacgctcaaaacccatcccaaaacttaaacgcacccgaaaccgcaaaacgaccgccaactcctatactaaacataaccccgaccgatcacccgaaaaaaaacgctaaacctaaccccgacgaaaaaatcgaaaacgccgcgacgccgaaaaccccaaacccttccccaacgaaaaaaaaaatcgacaacctcaaaaaaataaaccgaaaccactaccgcaaccgaaaaaaacgctcgtccaacgaaaaacccgccaaaaaaaacaaaaacaaaactaaaaaccaccgtcaccgacgacgccgcacctacccccgaaaacgcgaccgccaaaaccgccacgccccgaaacaccaccccgaccacgacg

SEQ ID NO: 1955 - DNA, 815 bp, Artificial Sequence
  chemically treated genomic DNA (Homo sapiens) CpG-island No: 1955
gttgtagtgtatttggagtagagaggggttttttcgaggatcgcgacgtcgagttttagtttggtagtttcgtcgtcgaatttttggaggagttagatgcggtcgtcggttttagtagtattaagaaggtttcgcgtttcgcgatttcggtattttcgttattaaagaaggcgtttgggaggttatggtcgtcgttttcgaggagttttcgtttagcgtcggcgaggatatcgtgggggatatagtattttttgatttgtgtgatttcgggagtttaataggcgatgcgagttcgttgttttaggacgtaaaggggatgatcgcggagggttcgcgggattcggcgttggcggaagtttcggaagggttgagttcggtttcgtttgcgcggtcggaggagttttgcgagtagttattttttgtttattttagcggggattacgttcgggacgtttaggatttattttagagtttgggcgtattcgaggtcgtagagcggtcgttagtttttgtgttggatatggtttcggtcggttattcggaaggggacgttgagtttagtttcggcgagagggtcgaggacgtcgcggcgtcgaaagttttaggtttttttttagcgaaggagaaaatcggtagttttagaaaggtggatcgaggttattatcgtagtcggagagagcgttcgtttagcggggagttcgttagagagagtaggagtaagattgagggttatcgttatcggcggcgtcgtatttgttttcgggagcgcgatcgttaggatcgttacgtttcggagtattatttcggttacggcg

SEQ ID NO: 1956 - DNA, 815 bp, Artificial Sequence
  chemically treated genomic DNA (Homo sapiens) CpG-island No: 1956
cgccgtaaccgaaataatactccgaaacgtaacgatcctaacgatcgcgctcccgaaaacaaatacgacgccgccgataacgataaccctcaatcttactcctactctctctaacgaactccccgctaaacgaacgctctctccgactacgataataacctcgatccacctttctaaaactaccgattttctccttcgctaaaaaaaaacctaaaactttcgacgccgcgacgtcctcgaccctctcgccgaaactaaactcaacgtccccttccgaataaccgaccgaaaccatatccaacacaaaaactaacgaccgctctacgacctcgaatacgcccaaactctaaaataaatcctaaacgtcccgaacgtaatccccgctaaaataaacaaaaaataactactcgcaaaactcctccgaccgcgcaaacgaaaccgaactcaacccttccgaaacttccgccaacgccgaatcccgcgaaccctccgcgatcatcccctttacgtcctaaaacaacgaactcgcatcgcctattaaactcccgaaatcacacaaatcaaaaaatactatatcccccacgatatcctcgccgacgctaaacgaaaactcctcgaaaacgacgaccataacctcccaaacgccttctttaataacgaaaataccgaaatcgcgaaacgcgaaaccttcttaatactactaaaaccgacgaccgcatctaactcctccaaaaattcgacgacgaaactaccaaactaaaactcgacgtcgcgatcctcgaaaaaacccctctctactccaaatacactacaac

SEQ ID NO: 1957 - DNA, 902 bp, Artificial Sequence
  chemically treated genomic DNA (Homo sapiens) CpG-island No: 1957
ggttatttcggtgttcgttcgtcgcggtcgtcgttttttttttagcggtttggttcgggcgggcggtggcgtcgtagtttttagagcggcggggtttcgggcggttcgcggttgtgtagggggaggcgggcgaggggtcgtattagttttcggcgggtcgcgtcggttgaggggcggtcgagttagcggcggtttaggcgagcgggtcgttgcgcgggttttatgtcggtttgcggcgggcgggaaggaggcgggagtttatttgattcggttcggcgttcgttttatttttttcggtcgtcgtcgtcgtcgtcgtatatagtttagtcgttcggcgggggataatgacgtgtttttattcgggtatcgtcgtcgtcgttttcgggttagcgtcgcgttcgtcgcgttttttcgggtcgtcggggggcgcgttagggtcgcgttcgaacgcgtcgtcgtttaggggtcgtcgtataagaagcgcggcgcgtagttaataagtacggcgagtgtgggaggggtcgtcgtttaagagtcgtgggcgaaggtagacgtcgcgcgttattagagcgtcggtcgggtcggtagagggagcgcgttgattggttgggttggtcgcgcgtttgcgcgtcggcgaaagggtttttttcgttttgtgtttttttgggtagagttagacggcgcgcggcgggcgtaggattttgggttttcgtttcgttttgcgtttgattttagatgcgtttttagaagcggggtatttggggacgtaggagtttgggattttcgtttttcgaaaacggatttggtttcgagaaatttttcgtttcgtgggtttcgttttttgtaattattttgcgttttttttggtttagcggacgtagtttttattttttgttttttag

SEQ ID NO: 1958 - DNA, 902 bp, Artificial Sequence
  chemically treated genomic DNA (Homo sapiens) CpG-island No: 1958
ctaaaaaacaaaaaataaaaactacgtccgctaaaccaaaaaaaacgcaaaataattacaaaaaacgaaacccacgaaacgaaaaatttctcgaaaccaaatccgttttcgaaaaacgaaaatcccaaactcctacgtccccaaataccccgcttctaaaaacgcatctaaaatcaaacgcaaaacgaaacgaaaacccaaaatcctacgcccgccgcgcgccgtctaactctacccaaaaaaacacaaaacgaaaaaaaccctttcgccgacgcgcaaacgcgcgaccaacccaaccaatcaacgcgctccctctaccgacccgaccgacgctctaataacgcgcgacgtctaccttcgcccacgactcttaaacgacgacccctcccacactcgccgtacttattaactacgcgccgcgcttcttatacgacgacccctaaacgacgacgcgttcgaacgcgaccctaacgcgccccccgacgacccgaaaaaacgcgacgaacgcgacgctaacccgaaaacgacgacgacgatacccgaataaaaacacgtcattatcccccgccgaacgactaaactatatacgacgacgacgacgacgaccgaaaaaaataaaacgaacgccgaaccgaatcaaataaactcccgcctccttcccgcccgccgcaaaccgacataaaacccgcgcaacgacccgctcgcctaaaccgccgctaactcgaccgcccctcaaccgacgcgacccgccgaaaactaatacgacccctcgcccgcctccccctacacaaccgcgaaccgcccgaaaccccgccgctctaaaaactacgacgccaccgcccgcccgaaccaaaccgctaaaaaaaaaacgacgaccgcgacgaacgaacaccgaaataacc

SEQ ID NO: 1959 - DNA, 902 bp, Artificial Sequence
  chemically treated genomic DNA (Homo sapiens) CpG-island No: 1959
ttaagaaataaaaaataaaggttgcgttcgttaggttaagggaggcgtaaggtagttgtagagggcgaagtttacgaagcggaggatttttcggagttaagttcgttttcgggggacggggattttagatttttgcgtttttaggtgtttcgtttttggaaacgtatttggggttaagcgtaggacgaggcgaaagtttaaagttttacgttcgtcgcgcgtcgtttggttttgtttagggaagtatagggcggaaggagttttttcgtcggcgcgtagacgcgcgattagtttagttaattagcgcgttttttttgtcggttcgatcggcgttttggtgacgcgcgacgtttgttttcgtttacggtttttgggcgacgattttttttatattcgtcgtgtttgttagttgcgcgtcgcgttttttgtgcgacggtttttgggcggcggcgcgttcgggcgcggttttggcgcgtttttcggcggttcggaggggcgcggcgggcgcggcgttgattcggaggcggcggcggcggtgttcggatggaggtacgttattgtttttcgtcgggcggttgggttgtgtgcggcggcggcggcggcggtcgagggggatggagcgagcgtcgagtcgggttaggtaagttttcgtttttttttcgttcgtcgtaggtcggtatggggttcgcgtagcggttcgttcgtttgggtcgtcgttggttcggtcgttttttagtcggcgcggttcgtcgggggttggtgcggtttttcgttcgtttttttttatatagtcgcgggtcgttcgggatttcgtcgttttgggggttgcggcgttatcgttcgttcgggttaggtcgttggggagggggcggcggtcgcggcgggcgggtatcggggtagtt

SEQ ID NO: 1960 - DNA, 902 bp, Artificial Sequence
  chemically treated genomic DNA (Homo sapiens) CpG-island No: 1960
aactaccccgatacccgcccgccgcgaccgccgccccctccccaacgacctaacccgaacgaacgataacgccgcaacccccaaaacgacgaaatcccgaacgacccgcgactatataaaaaaaaacgaacgaaaaaccgcaccaacccccgacgaaccgcgccgactaaaaaacgaccgaaccaacgacgacccaaacgaacgaaccgctacgcgaaccccataccgacctacgacgaacgaaaaaaaaacgaaaacttacctaacccgactcgacgctcgctccatccccctcgaccgccgccgccgccgccgcacacaacccaaccgcccgacgaaaaacaataacgtacctccatccgaacaccgccgccgccgcctccgaatcaacgccgcgcccgccgcgcccctccgaaccgccgaaaaacgcgccaaaaccgcgcccgaacgcgccgccgcccaaaaaccgtcgcacaaaaaacgcgacgcgcaactaacaaacacgacgaatataaaaaaaatcgtcgcccaaaaaccgtaaacgaaaacaaacgtcgcgcgtcaccaaaacgccgatcgaaccgacaaaaaaaacgcgctaattaactaaactaatcgcgcgtctacgcgccgacgaaaaaactccttccgccctatacttccctaaacaaaaccaaacgacgcgcgacgaacgtaaaactttaaactttcgcctcgtcctacgcttaaccccaaatacgtttccaaaaacgaaacacctaaaaacgcaaaaatctaaaatccccgtcccccgaaaacgaacttaactccgaaaaatcctccgcttcgtaaacttcgccctctacaactaccttacgcctcccttaacctaacgaacgcaacctttattttttatttcttaa

SEQ ID NO: 1961 - DNA, 644 bp, Artificial Sequence
  chemically treated genomic DNA (Homo sapiens) CpG-island No: 1961
tcggagcgaattcgtagtttacgtaggcgtagtcggtttttagtagcgcgattatttttttattcgattttcgtaggtcgtcgttcgaagattagtttattagagagtatgcgttatgggtgttttcgcgtggtagtcgttttttttgtttcgtttgtttagtcggaaaggagaaggggcggggtttgcggcgggtttcgtttttaaattgcggcgcgcgcgtgggtggggcgggttttacgtttggagaagggttattttcggggtggacggtaatggttgtgggtaaggagcgaggcgcgattggttgttcggcggacgagttttggggttcgcgagcgtaaagtggaaggcggcggggtcggggttgtggttgcgtcgttcgttatttattttttcgcggcggttcggttttcggtatgatggtggggatcggtggggatttaggtcgcgggttaggaggagggtgttggggaacgtgtgtttagtttattttcgttagtcgttgaacgttagtatcgatagaagatttttttattttaaagcggaggtatacggggtgtcgggggaagatatttttattagatttagagttattttgatttgaaagatgatagtcgtagtacgttagttagaattaagtt

SEQ ID NO: 1962 - DNA, 644 bp, Artificial Sequence
  chemically treated genomic DNA (Homo sapiens) CpG-island No: 1962
aacttaattctaactaacgtactacgactatcatctttcaaatcaaaataactctaaatctaataaaaatatcttcccccgacaccccgtatacctccgctttaaaataaaaaaatcttctatcgatactaacgttcaacgactaacgaaaataaactaaacacacgttccccaacaccctcctcctaacccgcgacctaaatccccaccgatccccaccatcataccgaaaaccgaaccgccgcgaaaaaataaataacgaacgacgcaaccacaaccccgaccccgccgccttccactttacgctcgcgaaccccaaaactcgtccgccgaacaaccaatcgcgcctcgctccttacccacaaccattaccgtccaccccgaaaataacccttctccaaacgtaaaacccgccccacccacgcgcgcgccgcaatttaaaaacgaaacccgccgcaaaccccgccccttctcctttccgactaaacaaacgaaacaaaaaaaacgactaccacgcgaaaacacccataacgcatactctctaataaactaatcttcgaacgacgacctacgaaaatcgaataaaaaaataatcgcgctactaaaaaccgactacgcctacgtaaactacgaattcgctccga

SEQ ID NO: 1963 - DNA, 644 bp, Artificial Sequence
  chemically treated genomic DNA (Homo sapiens) CpG-island No: 1963
gatttgattttggttgacgtgttgcgattgttattttttagattagagtaattttgagtttggtgggagtgttttttttcgatatttcgtatattttcgttttaagatgagagaattttttgtcggtgttagcgtttagcggttaacggaggtgagttggatatacgttttttaatattttttttttggttcgcgatttagatttttatcggtttttattattatatcgggggtcgggtcgtcgcggggaggtagatggcgggcggcgtagttatagtttcggtttcgtcgttttttattttgcgttcgcgggttttagaattcgttcgtcggatagttaatcgcgtttcgttttttgtttatagttattgtcgtttatttcggaagtagtttttttttagacgtaagattcgttttatttacgcgcgcgtcgtagtttgggggcggagttcgtcgtagatttcgttttttttttttttcgattgggtaggcggggtaggaggggcggttattacgcgggagtatttatggcgtatgttttttggtgggttagttttcggacggcggtttgcggaggtcgggtgagagggtgatcgcgttgttgaaagtcgattgcgtttacgtggattgcgggttcgtttcgg

SEQ ID NO: 1964 - DNA, 644 bp, Artificial Sequence
  chemically treated genomic DNA (Homo sapiens) CpG-island No: 1964
ccgaaacgaacccgcaatccacgtaaacgcaatcgactttcaacaacgcgatcaccctctcacccgacctccgcaaaccgccgtccgaaaactaacccaccaaaaaacatacgccataaatactcccgcgtaataaccgcccctcctaccccgcctacccaatcgaaaaaaaaaaaaaacgaaatctacgacgaactccgcccccaaactacgacgcgcgcgtaaataaaacgaatcttacgtctaaaaaaaaactacttccgaaataaacgacaataactataaacaaaaaacgaaacgcgattaactatccgacgaacgaattctaaaacccgcgaacgcaaaataaaaaacgacgaaaccgaaactataactacgccgcccgccatctacctccccgcgacgacccgacccccgatataataataaaaaccgataaaaatctaaatcgcgaaccaaaaaaaaaatattaaaaaacgtatatccaactcacctccgttaaccgctaaacgctaacaccgacaaaaaattctctcatcttaaaacgaaaatatacgaaatatcgaaaaaaaacactcccaccaaactcaaaattactctaatctaaaaaataacaatcgcaacacgtcaaccaaaatcaaatc

SEQ ID NO: 1965 - DNA, 614 bp, Artificial Sequence
  chemically treated genomic DNA (Homo sapiens) CpG-island No: 1965
cgcgtattcgcgggtttgtacgtttatagtcgtttcggttggtttcggcgcgtaatttttattcgtagttgggggcggggacgaggggagggggcggggacgaggttcgagttaggttcgtttcgttttgttttcgtttttcgttttcgagtcggcgtcgcggcgttttttgggaagtgtagttcgcgtttgcgtcggtcggtcgggtcgtcgaagtcgggggtttcgggcggaaacggtattatttattaagggatgcgaggcgttcggggcgggtttaacgaggtcgggggcgggttcgggcgcgtttattttcgtttttttttttcggtttaggttttcggtttcgtttttttttgcgcggatttgggtcgtcgtcgacgagggtcgcgtgcgttcgcgttagggttcgcgtcggaaatcgaggagtggcggggaggttgagttcggggatggcgcgttaggtaaggtaggcggacgcgcggatttttcggcgtagtgcggtttcgaaggcggtagggcgagaaagagttgggattttttcgtaatttcgggatcggttgggtgaggttgggtaggtttgatgtttaggggttcgtgtcgggaagtttagg

SEQ ID NO: 1966 - DNA, 614 bp, Artificial Sequence
  chemically treated genomic DNA (Homo sapiens) CpG-island No: 1966
cctaaacttcccgacacgaacccctaaacatcaaacctacccaacctcacccaaccgatcccgaaattacgaaaaaatcccaactctttctcgccctaccgccttcgaaaccgcactacgccgaaaaatccgcgcgtccgcctaccttacctaacgcgccatccccgaactcaacctccccgccactcctcgatttccgacgcgaaccctaacgcgaacgcacgcgaccctcgtcgacgacgacccaaatccgcgcaaaaaaaaacgaaaccgaaaacctaaaccgaaaaaaaaaaacgaaaataaacgcgcccgaacccgcccccgacctcgttaaacccgccccgaacgcctcgcatcccttaataaataataccgtttccgcccgaaacccccgacttcgacgacccgaccgaccgacgcaaacgcgaactacacttcccaaaaaacgccgcgacgccgactcgaaaacgaaaaacgaaaacaaaacgaaacgaacctaactcgaacctcgtccccgccccctcccctcgtccccgcccccaactacgaataaaaattacgcgccgaaaccaaccgaaacgactataaacgtacaaacccgcgaatacgcg

SEQ ID NO: 1967 - DNA, 614 bp, Artificial Sequence
  chemically treated genomic DNA (Homo sapiens) CpG-island No: 1967
tttgaatttttcggtacgaatttttgagtattaggtttgtttagttttatttagtcgatttcgaagttgcgggggggttttagttttttttcgttttatcgttttcggggtcgtattgcgtcgaggggttcgcgcgttcgtttgttttatttggcgcgttattttcgggtttagttttttcgttatttttcggttttcggcgcgggttttggcgcgggcgtacgcgattttcgtcggcggcggtttaggttcgcgtaggagaaggcggggtcgggggtttgggtcgagggggaggggcgggggtgggcgcgttcgggttcgttttcggtttcgttgagttcgtttcgagcgtttcgtattttttggtgggtggtgtcgttttcgttcggagttttcggtttcggcggttcggtcggtcggcgtagacgcggattatattttttagaaggcgtcgcggcgtcggttcggaagcggggggcggagatagggcggggcggatttggttcgggtttcgttttcgtttttttttttcgttttcgtttttagttgcgggtagaggttgcgcgtcgagattagtcggggcggttgtgggcgtgtaagttcgcgggtacgcg

SEQ ID NO: 1968 - DNA, 614 bp, Artificial Sequence
  chemically treated genomic DNA (Homo sapiens) CpG-island No: 1968
cgcgtacccgcgaacttacacgcccacaaccgccccgactaatctcgacgcgcaacctctacccgcaactaaaaacgaaaacgaaaaaaaaaaacgaaaacgaaacccgaaccaaatccgccccgccctatctccgccccccgcttccgaaccgacgccgcgacgccttctaaaaaatataatccgcgtctacgccgaccgaccgaaccgccgaaaccgaaaactccgaacgaaaacgacaccacccaccaaaaaatacgaaacgctcgaaacgaactcaacgaaaccgaaaacgaacccgaacgcgcccacccccgcccctccccctcgacccaaacccccgaccccgccttctcctacgcgaacctaaaccgccgccgacgaaaatcgcgtacgcccgcgccaaaacccgcgccgaaaaccgaaaaataacgaaaaaactaaacccgaaaataacgcgccaaataaaacaaacgaacgcgcgaacccctcgacgcaatacgaccccgaaaacgataaaacgaaaaaaaactaaaacccccccgcaacttcgaaatcgactaaataaaactaaacaaacctaatactcaaaaattcgtaccgaaaaattcaaa

SEQ ID NO: 1969 - DNA, 514 bp, Artificial Sequence
  chemically treated genomic DNA (Homo sapiens) CpG-island No: 1969
tcgtgtttcgtattttatttttttcgtattttgtttcgtatttaatatttttcgcgtttttcgtcgcgtttttttagtacgtattagtttcgtttatttcgtcgcgtgtttagttcgcgttatcgtcgttttttttaggttttagcgcgttttgcggggtcgcgtacgttagcggaatcgtcgggaagagcgtcgtgtcgttaatggcggaggcgcgtacgtttgtagggtcgcgtacgtttgtagggtcgcgtacgtttgtagggtcgcgtacgtttgtagggtcgcgtatgtttgtagggtcgcgtacgtttgtagggtcgcgtacgtttgtagggtcgcgtacgtattgacggttgatcgttattttttttttcgaggcggtagttttaggtgtaagcgtcgggtttgttgttcgttggcgtttttgtagcggttcgagttgtggtcggcgtggatgaggggtaggcgaggtagggcgtttttttagtattgtcgtttttttcgttttagg

SEQ ID NO: 1970 - DNA, 514 bp, Artificial Sequence
  chemically treated genomic DNA (Homo sapiens) CpG-island No: 1970
cctaaaacgaaaaaaacgacaatactaaaaaaacgccctacctcgcctacccctcatccacgccgaccacaactcgaaccgctacaaaaacgccaacgaacaacaaacccgacgcttacacctaaaactaccgcctcgaaaaaaaaaataacgatcaaccgtcaatacgtacgcgaccctacaaacgtacgcgaccctacaaacgtacgcgaccctacaaacatacgcgaccctacaaacgtacgcgaccctacaaacgtacgcgaccctacaaacgtacgcgaccctacaaacgtacgcgcctccgccattaacgacacgacgctcttcccgacgattccgctaacgtacgcgaccccgcaaaacgcgctaaaacctaaaaaaaacgacgataacgcgaactaaacacgcgacgaaataaacgaaactaatacgtactaaaaaaacgcgacgaaaaacgcgaaaaatattaaatacgaaacaaaatacgaaaaaaataaaatacgaaacacga

SEQ ID NO: 1971 - DNA, 514 bp, Artificial Sequence
  chemically treated genomic DNA (Homo sapiens) CpG-island No: 1971
tttggggcgggaggggcggtaatattggaggggcgttttgtttcgtttgttttttatttacgtcggttatagttcgggtcgttgtaggggcgttagcgggtagtaaattcggcgtttgtatttggaattgtcgtttcgggagggaagatggcggttagtcgttagtgcgtgcgcggttttgtagacgtgcgcggttttgtagacgtgcgcggttttgtagatatgcgcggttttgtagacgtgcgcggttttgtagacgtgcgcggttttgtagacgtgcgcggttttgtagacgtgcgcgttttcgttattgacggtacggcgtttttttcggcggtttcgttagcgtgcgcggtttcgtaaggcgcgttggagtttggggaggacggcggtgacgcgggttgggtacgcggcggagtgggcggggttggtgcgtgttgggggagcgcggcgaggggcgcgggaggtgttgggtgcggggtagggtgcgggaaaggtggagtgcgaggtacgg

SEQ ID NO: 1972 - DNA, 514 bp, Artificial Sequence
  chemically treated genomic DNA (Homo sapiens) CpG-island No: 1972
ccgtacctcgcactccacctttcccgcaccctaccccgcacccaacacctcccgcgcccctcgccgcgctcccccaacacgcaccaaccccgcccactccgccgcgtacccaacccgcgtcaccgccgtcctccccaaactccaacgcgccttacgaaaccgcgcacgctaacgaaaccgccgaaaaaaacgccgtaccgtcaataacgaaaacgcgcacgtctacaaaaccgcgcacgtctacaaaaccgcgcacgtctacaaaaccgcgcacgtctacaaaaccgcgcatatctacaaaaccgcgcacgtctacaaaaccgcgcacgtctacaaaaccgcgcacgcactaacgactaaccgccatcttccctcccgaaacgacaattccaaatacaaacgccgaatttactacccgctaacgcccctacaacgacccgaactataaccgacgtaaataaaaaacaaacgaaacaaaacgcccctccaatattaccgcccctcccgccccaaa

SEQ ID NO: 1973 - DNA, 676 bp, Artificial Sequence
  chemically treated genomic DNA (Homo sapiens) CpG-island No: 1973
ttttcgttattcgcggttcgtcggatacgggggtttttttttttcggcggcgcggttttatttcggtttcggcgattttttatcgtcggttttttttttttggggttattgcgttttatttcgtttttttcgcgttattatttcgtattttcgttttttttttttcgcgcgcgtatttcgttcgttcgttttcgcgggcggtatttgttttaattcgtttttttgttttgtcgtttcgcgttttttgttcgcgtttttttttcgtttttttttcggtttttcgtcgttttcgcgcgttttcgcgtttcgcgttttttcgcgtttatttcgttgtttttttcgtcgtatagttattcgttttattacgtcgtttttttttttgtttcgttttatacgtttcgttcgtttttttttattttttattttcgtcgtacggtatttattattttatcgtcgtttatttgcgattgcggttatattttttcgcgtttatagttttcgttcggtttgttttcgcgtcggatttttttttcgtattttcgttattatttttttttttttttcgtatagttttattttttcgtttgttttattttttttttattttgtttattatatatttatatattttattcgcgattattcgattcgtagtttcgcgagtcgcgcgttttta

SEQ ID NO: 1974 - DNA, 676 bp, Artificial Sequence
  chemically treated genomic DNA (Homo sapiens) CpG-island No: 1974
taaaaacgcgcgactcgcgaaactacgaatcgaataatcgcgaataaaatatataaatatataataaacaaaataaaaaaaaaataaaacaaacgaaaaaataaaactatacgaaaaaaaaaaaaaaataataacgaaaatacgaaaaaaaaatccgacgcgaaaacaaaccgaacgaaaactataaacgcgaaaaaatataaccgcaatcgcaaataaacgacgataaaataataaataccgtacgacgaaaataaaaaataaaaaaaaacgaacgaaacgtataaaacgaaacaaaaaaaaaaacgacgtaataaaacgaataactatacgacgaaaaaaacaacgaaataaacgcgaaaaaacgcgaaacgcgaaaacgcgcgaaaacgacgaaaaaccgaaaaaaaaacgaaaaaaaaacgcgaacaaaaaacgcgaaacgacaaaacaaaaaaacgaattaaaacaaataccgcccgcgaaaacgaacgaacgaaatacgcgcgcgaaaaaaaaaaaacgaaaatacgaaataataacgcgaaaaaaacgaaataaaacgcaataaccccaaaaaaaaaaaaccgacgataaaaaatcgccgaaaccgaaataaaaccgcgccgccgaaaaaaaaaaacccccgtatccgacgaaccgcgaataacgaaaa

SEQ ID NO: 1975 - DNA, 676 bp, Artificial Sequence
  chemically treated genomic DNA (Homo sapiens) CpG-island No: 1975
tgggagcgcgcggttcgcggagttgcgggtcgagtggtcgcgagtggagtgtgtgagtatgtggtgagtaggatggagggagagtgaggtaggcgagagagtggagttgtgcgaggaggagagaggagtggtggcgggggtgcgaagagagggttcggcgcgggggtaggtcgggcgagggttgtgagcgcgagagagtgtggtcgtagtcgtaggtagacggcggtgaagtggtgggtgtcgtgcggcgagagtgggagatggggaaaggcgagcgggacgtgtgaggcggagtagggagaggggcggcgtgatggagcgggtgattgtgcggcgagagggatagcggagtaggcgcgagggggcgcggggcgcgggagcgcgcgggagcggcggagggtcggagggagggcgaggagggggcgcgggtagagggcgcggggcggtagggtaggggggcgggttgaggtaggtgtcgttcgcgagggcgggcgggcgaggtgcgcgcgcggagagagaagggcgggggtgcggggtggtggcgcggggggggcggggtggggcgtagtgattttaggaagagggggtcggcggtgggggatcgtcgggatcggggtggggtcgcgtcgtcggaaggggggggttttcgtgttcgacgggtcgcgaatggcggggg

SEQ ID NO: 1976 - DNA, 676 bp, Artificial Sequence
  chemically treated genomic DNA (Homo sapiens) CpG-island No: 1976
cccccgccattcgcgacccgtcgaacacgaaaaccccccccttccgacgacgcgaccccaccccgatcccgacgatcccccaccgccgaccccctcttcctaaaatcactacgccccaccccgccccccccgcgccaccaccccgcacccccgcccttctctctccgcgcgcgcacctcgcccgcccgccctcgcgaacgacacctacctcaacccgcccccctaccctaccgccccgcgccctctacccgcgccccctcctcgccctccctccgaccctccgccgctcccgcgcgctcccgcgccccgcgccccctcgcgcctactccgctatccctctcgccgcacaatcacccgctccatcacgccgcccctctccctactccgcctcacacgtcccgctcgcctttccccatctcccactctcgccgcacgacacccaccacttcaccgccgtctacctacgactacgaccacactctctcgcgctcacaaccctcgcccgacctacccccgcgccgaaccctctcttcgcacccccgccaccactcctctctcctcctcgcacaactccactctctcgcctacctcactctccctccatcctactcaccacatactcacacactccactcgcgaccactcgacccgcaactccgcgaaccgcgcgctccca

SEQ ID NO: 1977 - DNA, 821 bp, Artificial Sequence
  chemically treated genomic DNA (Homo sapiens) CpG-island No: 1977
gtaggcgttgttcgggttcgtgggcggggtttcgggagggggcggagttaggtttacggtcggtgttaggttgtttcggtaacggtgacgtttcgcggcgtgggcggggttagtacgtaggttgtatattttaggaagtgaggaggaggcgcgggttggagttgcggcggggtttggggcgtagagtagcggcgggaggaggcggatacgtggtaatagcggtagtagttcgggcggcggtagtaatagcggcggcggtatcggttcgagtcgtcggtcgtttttttattttttcgtttcgcggtagttttagttttttttatttggtttttttggtttcgttcgttcggtcgggagttgttttgtgtttttttttttgattttttagcgataggattcggcgtcgggtattgagtatcgttattatggggaagggggtgagtgttcggcgcgttcggggagggggttcggggagttttcgaggggaagaggaggaagtcgggagggcgatcgcggttagcgggaggcggcggaggaggaagcggcgtcgcgtggagtgggttggtagagtcgcgcggtttaaaagacgacgtagtttggaaatggagggagcgtagtaacggggggcgggggaagggagcgtcgaggggttggagcgcggtattgtttaggggggtgggcggattttgggcgggggttgcgcgtttcggaggtcgagcgggtcgggggtttcgagaggcggtgtttgggaagtttcggggtcgggaggagggggtttgtagtagcgggggcggtttcgggattgagtcggtatttttgag

SEQ ID NO: 1978 - DNA, 821 bp, Artificial Sequence
  chemically treated genomic DNA (Homo sapiens) CpG-island No: 1978
ctcaaaaataccgactcaatcccgaaaccgcccccgctactacaaaccccctcctcccgaccccgaaacttcccaaacaccgcctctcgaaacccccgacccgctcgacctccgaaacgcgcaacccccgcccaaaatccgcccacccccctaaacaataccgcgctccaacccctcgacgctcccttcccccgccccccgttactacgctccctccatttccaaactacgtcgtcttttaaaccgcgcgactctaccaacccactccacgcgacgccgcttcctcctccgccgcctcccgctaaccgcgatcgccctcccgacttcctcctcttcccctcgaaaactccccgaaccccctccccgaacgcgccgaacactcacccccttccccataataacgatactcaatacccgacgccgaatcctatcgctaaaaaatcaaaaaaaaaaacacaaaacaactcccgaccgaacgaacgaaaccaaaaaaaccaaataaaaaaaactaaaactaccgcgaaacgaaaaaataaaaaaacgaccgacgactcgaaccgataccgccgccgctattactaccgccgcccgaactactaccgctattaccacgtatccgcctcctcccgccgctactctacgccccaaaccccgccgcaactccaacccgcgcctcctcctcacttcctaaaatatacaacctacgtactaaccccgcccacgccgcgaaacgtcaccgttaccgaaacaacctaacaccgaccgtaaacctaactccgccccctcccgaaaccccgcccacgaacccgaacaacgcctac

SEQ ID NO: 1979 - DNA, 821 bp, Artificial Sequence
  chemically treated genomic DNA (Homo sapiens) CpG-island No: 1979
tttagggatgtcggtttagtttcggggtcgttttcgttgttgtaagtttttttttttcggtttcgaggttttttaagtatcgtttttcggagttttcggttcgttcggttttcggggcgcgtagttttcgtttagggttcgtttatttttttaagtaatgtcgcgttttagtttttcggcgtttttttttttcgtttttcgttattgcgttttttttatttttaaattgcgtcgttttttaagtcgcgcggttttgttagtttattttacgcggcgtcgttttttttttcgtcgtttttcgttggtcgcggtcgttttttcgatttttttttttttttttcgagggtttttcgagtttttttttcgggcgcgtcggatatttatttttttttttatggtggcggtgtttagtgttcggcgtcgggttttgtcgttggagaattagagagaaaagtatagagtagttttcggtcgagcgagcgggattaggggagttaagtggagggagttagggttgtcgcggggcgggagggtgggagggcggtcggcggttcgggtcgatgtcgtcgtcgttgttgttgtcgtcgttcgggttgttatcgttgttgttacgtgttcgttttttttcgtcgttgttttgcgttttagatttcgtcgtagttttagttcgcgttttttttttattttttaaaatatgtaatttgcgtgttggtttcgtttacgtcgcgaaacgttatcgttatcggagtaatttgatatcggtcgtgggtttggtttcgttttttttcgaaatttcgtttacgggttcggatagcgtttgt

SEQ ID NO: 1980 - DNA, 821 bp, Artificial Sequence
  chemically treated genomic DNA (Homo sapiens) CpG-island No: 1980
acaaacgctatccgaacccgtaaacgaaatttcgaaaaaaaacgaaaccaaacccacgaccgatatcaaattactccgataacgataacgtttcgcgacgtaaacgaaaccaacacgcaaattacatattttaaaaaataaaaaaaaaacgcgaactaaaactacgacgaaatctaaaacgcaaaacaacgacgaaaaaaaacgaacacgtaacaacaacgataacaacccgaacgacgacaacaacaacgacgacgacatcgacccgaaccgccgaccgccctcccaccctcccgccccgcgacaaccctaactccctccacttaactcccctaatcccgctcgctcgaccgaaaactactctatacttttctctctaattctccaacgacaaaacccgacgccgaacactaaacaccgccaccataaaaaaaaaaataaatatccgacgcgcccgaaaaaaaaactcgaaaaaccctcgaaaaaaaaaaaaaaaaatcgaaaaaacgaccgcgaccaacgaaaaacgacgaaaaaaaaaacgacgccgcgtaaaataaactaacaaaaccgcgcgacttaaaaaacgacgcaatttaaaaataaaaaaaacgcaataacgaaaaacgaaaaaaaaaaacgccgaaaaactaaaacgcgacattacttaaaaaaataaacgaaccctaaacgaaaactacgcgccccgaaaaccgaacgaaccgaaaactccgaaaaacgatacttaaaaaacctcgaaaccgaaaaaaaaaaacttacaacaacgaaaacgaccccgaaactaaaccgacatccctaaa

SEQ ID NO: 1981 - DNA, 936 bp, Artificial Sequence
  chemically treated genomic DNA (Homo sapiens) CpG-island No: 1981
tagttgtcggcgcggtgtttagggcggtatttcgttcggtttcggtttttttagttttgggttcgatttttattacgtttttgtttcgacgcgaacgcggagttcgagcgcgcgttacgtcgtgtggggtcgaagaggttgttatttagaggcggagtgcgggttcgcgagggtttttattcgattttcgttttcgttagtatttacggattcgcgttttcgtcgcgcgtcgattcgggagtagtatcgttttcggtataggagttttacgcgttttttatttaataggaagttgggtggaagtagcgcggatttacggtatatcgaacgtattttaatagaattcgacgtagatacgcgtttttaatcggcggagatattggtagggttagaaacgcgcgtagcgggggcgggaggtcggtaagtttttcgtttttgttcgagatttcgtttcggttcggtttcgtttttttttttgttttttttttttgtacgtacgggtttcgtttttcgcgcgacgttttttgttgattcggaaacggatttttcggagtcgaggttcgttcgggtgagtgtttttcgttttttgtggttaaatttagttacgtagttttttttttgcggcgttttttatattcggggtttgttggttttcgcggatgttataggttcggtaatcgtttttttgtcggcggggagtttcgcgacgttcggaaatgtttcgaagtttgtcgtttagttgttagatttgcgtttgtgttcggtttcgttattgaggtcgtttttgttcggtttttttattttagttttttttatcgttcgtttattttatcgcgcgcggttttaggtttcgattcggtatgtggtttgttttttatcgtttttattttcgttttttttggttttttagggtagttttgggattcggtagacgtt

SEQ ID NO: 1982 - DNA, 936 bp, Artificial Sequence
  chemically treated genomic DNA (Homo sapiens) CpG-island No: 1982
aacgtctaccgaatcccaaaactaccctaaaaaaccaaaaaaaacgaaaataaaaacgataaaaaacaaaccacataccgaatcgaaacctaaaaccgcgcgcgataaaataaacgaacgataaaaaaaactaaaataaaaaaaccgaacaaaaacgacctcaataacgaaaccgaacacaaacgcaaatctaacaactaaacgacaaacttcgaaacatttccgaacgtcgcgaaactccccgccgacaaaaaaacgattaccgaacctataacatccgcgaaaaccaacaaaccccgaatataaaaaacgccgcaaaaaaaaaactacgtaactaaatttaaccacaaaaaacgaaaaacactcacccgaacgaacctcgactccgaaaaatccgtttccgaatcaacaaaaaacgtcgcgcgaaaaacgaaacccgtacgtacaaaaaaaaaaaacaaaaaaaaaaacgaaaccgaaccgaaacgaaatctcgaacaaaaacgaaaaacttaccgacctcccgcccccgctacgcgcgtttctaaccctaccaatatctccgccgattaaaaacgcgtatctacgtcgaattctattaaaatacgttcgatataccgtaaatccgcgctacttccacccaacttcctattaaataaaaaacgcgtaaaactcctataccgaaaacgatactactcccgaatcgacgcgcgacgaaaacgcgaatccgtaaatactaacgaaaacgaaaatcgaataaaaaccctcgcgaacccgcactccgcctctaaataacaacctcttcgaccccacacgacgtaacgcgcgctcgaactccgcgttcgcgtcgaaacaaaaacgtaataaaaatcgaacccaaaactaaaaaaaccgaaaccgaacgaaataccgccctaaacaccgcgccgacaacta

SEQ ID NO: 1983 - DNA, 936 bp, Artificial Sequence
  chemically treated genomic DNA (Homo sapiens) CpG-island No: 1983
ggcgtttgtcgaattttagggttgttttgaggggttaagaggggcgagggtggggacgatggaagataagttatatgtcgaatcgggatttgaggtcgcgcgcgataggatgggcggacggtgaagagaattagggtggaagggtcggataggggcgattttagtgacggaatcggatatagacgtagatttggtagttgggcgataggtttcggagtattttcgggcgtcgcgggatttttcgtcgataggagggcggttgtcgagtttgtgatattcgcggagattagtagatttcgggtgtggaggacgtcgtaggaagggaattgcgtggttgggtttggttataaaaagcggagggtatttattcgagcggatttcggtttcggagaattcgttttcgggttaataaaaaacgtcgcgcgaggggcggggttcgtacgtgtagggaggggaggtagagaaaaaggcggggtcgggtcggggcggggtttcgggtaggggcggggagtttatcgatttttcgttttcgttgcgcgcgtttttggttttgttagtgttttcgtcggttgaaagcgcgtgtttgcgtcgggttttgttggagtgcgttcggtgtgtcgtgggttcgcgttgtttttatttaattttttgttaggtaagaggcgcgtgaggtttttgtgtcgggggcggtgttgttttcgagtcggcgcgcggcggggacgcgagttcgtaggtgttggcgggagcgagagtcgggtggggattttcgcgagttcgtatttcgtttttgggtagtagttttttcggttttatacggcgtgacgcgcgttcgggtttcgcgttcgcgtcgaggtagaggcgtagtaggggtcgggtttagggttggaggggtcgggatcgggcggggtgtcgttttggatatcgcgtcggtagttg

SEQ ID NO: 1984 - DNA, 936 bp, Artificial Sequence
  chemically treated genomic DNA (Homo sapiens) CpG-island No: 1984
caactaccgacgcgatatccaaaacgacaccccgcccgatcccgacccctccaaccctaaacccgacccctactacgcctctacctcgacgcgaacgcgaaacccgaacgcgcgtcacgccgtataaaaccgaaaaaactactacccaaaaacgaaatacgaactcgcgaaaatccccacccgactctcgctcccgccaacacctacgaactcgcgtccccgccgcgcgccgactcgaaaacaacaccgcccccgacacaaaaacctcacgcgcctcttacctaacaaaaaattaaataaaaacaacgcgaacccacgacacaccgaacgcactccaacaaaacccgacgcaaacacgcgctttcaaccgacgaaaacactaacaaaaccaaaaacgcgcgcaacgaaaacgaaaaatcgataaactccccgcccctacccgaaaccccgccccgacccgaccccgcctttttctctacctcccctccctacacgtacgaaccccgcccctcgcgcgacgttttttattaacccgaaaacgaattctccgaaaccgaaatccgctcgaataaataccctccgctttttataaccaaacccaaccacgcaattcccttcctacgacgtcctccacacccgaaatctactaatctccgcgaatatcacaaactcgacaaccgccctcctatcgacgaaaaatcccgcgacgcccgaaaatactccgaaacctatcgcccaactaccaaatctacgtctatatccgattccgtcactaaaatcgcccctatccgacccttccaccctaattctcttcaccgtccgcccatcctatcgcgcgcgacctcaaatcccgattcgacatataacttatcttccatcgtccccaccctcgcccctcttaacccctcaaaacaaccctaaaattcgacaaacgcc

SEQ ID NO: 1985 - DNA, 567 bp, Artificial Sequence
  chemically treated genomic DNA (Homo sapiens) CpG-island No: 1985
cgttcggggtttcggcgtattttacgtttttgcgttcgcggtttcgtttcgggtttttcgtggggttttaatgatataagtaatttttttcgcgtatttttcgtttcgttttggtacggtttgttcggcgttcgacgttttatttttttttttttgtttttaggttggtttagttttcgtttatattggggtggtgtttagtcggcgttagatcgattttcgatttcggagaggtagcgcggtttttttgggtgttttcgttttttttttttttgtttttttagttttttcggttttttcgttcgtcgcgggaattcgagattttagtgtatgttttatttttgatttcgttcgcgatatgtttatttcggttcggcggcgttttatgcgggattttaagaggtaaatcgaggggacggtcgaggtcgggggttgcgagttggggtatagggcgggtttcgaggcgcgtcgggcggggagggttggggagcggtcgggagcgggcgttagtgtcggtttagggggatttttgtttgttttttcgaaggttgtaggaggattttttag

SEQ ID NO: 1986 - DNA, 567 bp, Artificial Sequence
  chemically treated genomic DNA (Homo sapiens) CpG-island No: 1986
ctaaaaaatcctcctacaaccttcgaaaaaacaaacaaaaatccccctaaaccgacactaacgcccgctcccgaccgctccccaaccctccccgcccgacgcgcctcgaaacccgccctataccccaactcgcaacccccgacctcgaccgtcccctcgatttacctcttaaaatcccgcataaaacgccgccgaaccgaaataaacatatcgcgaacgaaatcaaaaataaaacatacactaaaatctcgaattcccgcgacgaacgaaaaaaccgaaaaaactaaaaaaacaaaaaaaaaaaaaacgaaaacacccaaaaaaaccgcgctacctctccgaaatcgaaaatcgatctaacgccgactaaacaccaccccaatataaacgaaaactaaaccaacctaaaaacaaaaaaaaaaaaataaaacgtcgaacgccgaacaaaccgtaccaaaacgaaacgaaaaatacgcgaaaaaaattacttatatcattaaaaccccacgaaaaacccgaaacgaaaccgcgaacgcaaaaacgtaaaatacgccgaaaccccgaacg

SEQ ID NO: 1987 - DNA, 567 bp, Artificial Sequence
  chemically treated genomic DNA (Homo sapiens) CpG-island No: 1987
ttggaggatttttttgtaattttcgggaagatagataggggtttttttaggtcggtattggcgttcgttttcggtcgttttttagtttttttcgttcggcgcgtttcgggattcgttttgtgttttagttcgtaattttcggtttcggtcgttttttcggtttattttttgaagtttcgtatgaggcgtcgtcgagtcggggtggatatgtcgcgagcggggttaggggtggggtatatattggggtttcgggttttcgcggcgggcgaggaggtcgaagaggttggagaagtaggagaaggggaggcggaagtatttagaggaatcgcgttgttttttcgaagtcgagggtcggtttggcgtcggttaagtattattttagtgtagacgggggttgaattaatttgagagtagagagaggggggtggaacgtcgagcgtcggataggtcgtattaagacggggcggggggtgcgcgaggaaagttgtttatgttattaaagttttacgggaggttcggggcggggtcgcgagcgtagaggcgtagggtacgtcggagtttcgggcg

SEQ ID NO: 1988 - DNA, 567 bp, Artificial Sequence
  chemically treated genomic DNA (Homo sapiens) CpG-island No: 1988
cgcccgaaactccgacgtaccctacgcctctacgctcgcgaccccgccccgaacctcccgtaaaactttaataacataaacaactttcctcgcgcaccccccgccccgtcttaatacgacctatccgacgctcgacgttccacccccctctctctactctcaaattaattcaacccccgtctacactaaaataatacttaaccgacgccaaaccgaccctcgacttcgaaaaaacaacgcgattcctctaaatacttccgcctccccttctcctacttctccaacctcttcgacctcctcgcccgccgcgaaaacccgaaaccccaatatataccccacccctaaccccgctcgcgacatatccaccccgactcgacgacgcctcatacgaaacttcaaaaaataaaccgaaaaaacgaccgaaaccgaaaattacgaactaaaacacaaaacgaatcccgaaacgcgccgaacgaaaaaaactaaaaaacgaccgaaaacgaacgccaataccgacctaaaaaaacccctatctatcttcccgaaaattacaaaaaaatcctccaa

SEQ ID NO: 1989 - DNA, 1013 bp, Artificial Sequence
  chemically treated genomic DNA (Homo sapiens) CpG-island No: 1989
ttattatcgatttttttagcgtcgtttttaattcgattttttattatcgattttttattttcgtttttaattcgatatttatattttttttatttgtagtttaggaagacgtggttggtttaggcggcggagagcgcgaggagttggtcgagggtagtttcgggatagttgtgtaggtgtcgatagatgaagttgcgtcgtagagtttattgttagttattttcgtggttatagcgttattgttttagtattggttcgggcgggggcggcgggaggggcggtagcggcggcggcgggagggggggtagcggcggcgcgataggaagtcgttttttaatagtagacgttttttagttatttttttcgtttttaagtagggattttagggacgaagtcgattacggatcgcgagttaggtagttagtaagcgggcggaaacggggggtcggtgggaggggtcgggtaaggaggggcgcgttgaggggagaagattaattttcggggggattggagtgtgtgcgtgggggttatcgttaggaggaaaagaggagtacgagttcgcgtttcgatattgggatgtacgttttttatatttttttaattcgtggaggagtagaagggttttcgtcgtatttacgcgcgagtcggggaggtcgagttaggtttcgtatttttacggattcgtagatttacgtattgcgcggagagcgataaaagattttagtacgttttgttttttttttttaggttttagtttatttattcgcgtgtcgttcggggttgtgaggttagtgcgtttgcgtcgcggttgttttttaatttttaaatttcgtcgtagaatttcgcgcgacgtatttttttttttttagtgacgattacgggtttttgacgtattacggtgataagcggagggcggggattttagaaagggaatttaggaaggttttttgaggttcgagaatatggttagaaggtgtttttagatgaatgttggtagtttacggttcgtttga

SEQ ID NO: 1990 - DNA, 1013 bp, Artificial Sequence
  chemically treated genomic DNA (Homo sapiens) CpG-island No: 1990
tcaaacgaaccgtaaactaccaacattcatctaaaaacaccttctaaccatattctcgaacctcaaaaaaccttcctaaattccctttctaaaatccccgccctccgcttatcaccgtaatacgtcaaaaacccgtaatcgtcactaaaaaaaaaaaaatacgtcgcgcgaaattctacgacgaaatttaaaaattaaaaaacaaccgcgacgcaaacgcactaacctcacaaccccgaacgacacgcgaataaataaactaaaacctaaaaaaaaaaaacaaaacgtactaaaatcttttatcgctctccgcgcaatacgtaaatctacgaatccgtaaaaatacgaaacctaactcgacctccccgactcgcgcgtaaatacgacgaaaacccttctactcctccacgaattaaaaaaatataaaaaacgtacatcccaatatcgaaacgcgaactcgtactcctcttttcctcctaacgataacccccacgcacacactccaatccccccgaaaattaatcttctcccctcaacgcgcccctccttacccgacccctcccaccgaccccccgtttccgcccgcttactaactacctaactcgcgatccgtaatcgacttcgtccctaaaatccctacttaaaaacgaaaaaaataactaaaaaacgtctactattaaaaaacgacttcctatcgcgccgccgctaccccccctcccgccgccgccgctaccgcccctcccgccgcccccgcccgaaccaatactaaaacaataacgctataaccacgaaaataactaacaataaactctacgacgcaacttcatctatcgacacctacacaactatcccgaaactaccctcgaccaactcctcgcgctctccgccgcctaaaccaaccacgtcttcctaaactacaaataaaaaaaatataaatatcgaattaaaaacgaaaataaaaaatcgataataaaaaatcgaattaaaaacgacgctaaaaaaatcgataataa

SEQ ID NO: 1991 - DNA, 1013 bp, Artificial Sequence
  chemically treated genomic DNA (Homo sapiens) CpG-island No: 1991
ttagacgagtcgtgggttattaatatttatttgagggtattttttaattatattttcgaattttagagaatttttttaaattttttttttggagttttcgtttttcgtttgttatcgtagtgcgttaaaggttcgtagtcgttattggagggaaaaaagtacgtcgcgcgagattttgcgacgggatttggaagttagggaatagtcgcggcgtaagcgtattggttttataatttcggacggtacgcgggtaggtaggttagaatttagaggaggggagtagagcgtgttggggttttttatcgtttttcgcgtagtgcgtgggtttgcggattcgtggaggtgcggagtttgattcggttttttcggttcgcgcgtgagtgcggcggaagtttttttgtttttttacgagttagaggagtgtaggggacgtgtattttagtgtcgggacgcgagttcgtgttttttttttttttttaacggtggtttttacgtatatattttagttttttcgagagttgattttttttttttagcgcgtttttttttattcggttttttttatcggtttttcgttttcgttcgtttgttagttgtttagttcgcggttcgtagtcggtttcgtttttggggtttttgtttgggggcggagaagatggttggaggacgtttgttgttggggggcgattttttgtcgcgtcgtcgttgttttttttttcgtcgtcgtcgttgtcgtttttttcgtcgttttcgttcgagttagtgttggagtagtggcgttatagttacgaaagtgattggtagtgggttttgcggcgtagttttatttgtcggtatttgtatagttatttcggggttgttttcgattagtttttcgcgtttttcgtcgtttggattaattacgtttttttgggttgtaggtgaggaaggtgtgggtgtcgggttagggacgggggtgagagatcggtgatgggggatcgggttagggacggcgttggagggatcgatgatgg

SEQ ID NO: 1992 - DNA, 1013 bp, Artificial Sequence
  chemically treated genomic DNA (Homo sapiens) CpG-island No: 1992
ccatcatcgatccctccaacgccgtccctaacccgatcccccatcaccgatctctcacccccgtccctaacccgacacccacaccttcctcacctacaacccaaaaaaacgtaattaatccaaacgacgaaaaacgcgaaaaactaatcgaaaacaaccccgaaataactatacaaataccgacaaataaaactacgccgcaaaacccactaccaatcactttcgtaactataacgccactactccaacactaactcgaacgaaaacgacgaaaaaaacgacaacgacgacgacgaaaaaaaaaacaacgacgacgcgacaaaaaatcgccccccaacaacaaacgtcctccaaccatcttctccgcccccaaacaaaaaccccaaaaacgaaaccgactacgaaccgcgaactaaacaactaacaaacgaacgaaaacgaaaaaccgataaaaaaaaccgaataaaaaaaaacgcgctaaaaaaaaaaaatcaactctcgaaaaaactaaaatatatacgtaaaaaccaccgttaaaaaaaaaaaaaaaacacgaactcgcgtcccgacactaaaatacacgtcccctacactcctctaactcgtaaaaaaacaaaaaaacttccgccgcactcacgcgcgaaccgaaaaaaccgaatcaaactccgcacctccacgaatccgcaaacccacgcactacgcgaaaaacgataaaaaaccccaacacgctctactcccctcctctaaattctaacctacctacccgcgtaccgtccgaaattataaaaccaatacgcttacgccgcgactattccctaacttccaaatcccgtcgcaaaatctcgcgcgacgtacttttttccctccaataacgactacgaacctttaacgcactacgataacaaacgaaaaacgaaaactccaaaaaaaaaatttaaaaaaattctctaaaattcgaaaatataattaaaaaataccctcaaataaatattaataacccacgactcgtctaa

SEQ ID NO: 1993 - DNA, 1107 bp, Artificial Sequence
  chemically treated genomic DNA (Homo sapiens) CpG-island No: 1993
gtattcgttgttgcgttttcgcgcgtaattatgcgcgcgttatagatattcgcgcgttttattcgatatatttgtatatatatacgtaatatttacgcgcgcgtcgtagtatttacgcgcgttgttcgtacgttcgttttcgttttcgcgtatgtttttcgcgtatagtaacgtacgttcgcgtagtttatttttaatacgtaaagcgttttgcgtagttgcgtaagcgttggtaatagcgcgcgcgtataatatagcgcgttcgtttatgttagcgcgcgcgtattgcgcggttagtttagcgttgtatacgcgtattcgttagcgcgtaaatttgatacgttttttttttttcgcgtcgcgttgcgtagcgttgcggcgtttatatagcgtagtttatattattgcgcgtaagcgcgttaaagcgcgtaggcgcgcgtcgcgtatttttagtagcgtttgtagcgcgcggcgtaaaggcgcgcgcgcgaatgcgtttgcgcgtttagtatatagcgtaagcgcgtaagtaaacgcgcgtataagcgtacgcgcgcgcgcgtcgtttagcgcgcgtttttgtttaatagtttgtcgagcgcgttttgtagggtttgtcgcggttttataggcgtacgcgatgtagcgcgcgtcgtcgtcgggttttaagattgtcgcgtcgcgttgaattagcggcgttcgttttgaagtttaatagttcgtttgcgttattttaagcggttgcgattcgttatttaacgcgtttttgtttttcgtttttttgtgtgtatcgtggagcgaagtgggtcgaggtttataaattaggggtagcgcgtttaagtttataagtttcgatttttttacgtcggacgttaagcgtgtcgatcgggtagtcgattgggtggcggtcgtttcgtttgtgtttttgacgtggagttcgttcggcgattcgggtcgtgtataaaagttacgtgcgtttcgttatgcgaggcgtcgcgatttttaggcggttttgcgtgggtttttttcggtttggtttttcgtatgtatgttagattaaagttttgacgttttgcgtttggttgttgacgtatgttatgttgttta

SEQ ID NO: 1994 - DNA, 1107 bp, Artificial Sequence
  chemically treated genomic DNA (Homo sapiens) CpG-island No: 1994
taaacaacataacatacgtcaacaaccaaacgcaaaacgtcaaaactttaatctaacatacatacgaaaaaccaaaccgaaaaaaacccacgcaaaaccgcctaaaaatcgcgacgcctcgcataacgaaacgcacgtaacttttatacacgacccgaatcgccgaacgaactccacgtcaaaaacacaaacgaaacgaccgccacccaatcgactacccgatcgacacgcttaacgtccgacgtaaaaaaatcgaaacttataaacttaaacgcgctacccctaatttataaacctcgacccacttcgctccacgatacacacaaaaaaacgaaaaacaaaaacgcgttaaataacgaatcgcaaccgcttaaaataacgcaaacgaactattaaacttcaaaacgaacgccgctaattcaacgcgacgcgacaatcttaaaacccgacgacgacgcgcgctacatcgcgtacgcctataaaaccgcgacaaaccctacaaaacgcgctcgacaaactattaaacaaaaacgcgcgctaaacgacgcgcgcgcgcgtacgcttatacgcgcgtttacttacgcgcttacgctatatactaaacgcgcaaacgcattcgcgcgcgcgcctttacgccgcgcgctacaaacgctactaaaaatacgcgacgcgcgcctacgcgctttaacgcgcttacgcgcaataatataaactacgctatataaacgccgcaacgctacgcaacgcgacgcgaaaaaaaaaaaacgtatcaaatttacgcgctaacgaatacgcgtatacaacgctaaactaaccgcgcaatacgcgcgcgctaacataaacgaacgcgctatattatacgcgcgcgctattaccaacgcttacgcaactacgcaaaacgctttacgtattaaaaataaactacgcgaacgtacgttactatacgcgaaaaacatacgcgaaaacgaaaacgaacgtacgaacaacgcgcgtaaatactacgacgcgcgcgtaaatattacgtatatatatacaaatatatcgaataaaacgcgcgaatatctataacgcgcgcataattacgcgcgaaaacgcaacaacgaatac

SEQ ID NO: 1995 - DNA, 1107 bp, Artificial Sequence
  chemically treated genomic DNA (Homo sapiens) CpG-island No: 1995
tgggtagtatggtatgcgttaatagttaggcgtaaagcgttagggttttggtttagtatatatgcggaagattaagtcggggggggtttacgtaaggtcgtttgggaatcgcggcgtttcgtatagcgagacgtacgtggtttttgtgtacggttcgggtcgtcgggcgagttttacgttaggggtataggcgaggcggtcgttatttagtcggttgttcggtcgatacgtttggcgttcggcgtaaggaagtcggggtttgtaaatttgggcgcgttgtttttggtttgtgagtttcggtttatttcgttttacggtgtatatagaggagcggaggataggagcgcgttgagtaacgggtcgtagtcgtttggaataacgtagacgggttattaagttttagggcgggcgtcgttggtttagcgcggcgcggtaattttaaagttcggcgacggcgcgcgttgtatcgcgtgcgtttataaggtcgcggtaagttttgtaaggcgcgttcggtaagttattgagtaggagcgcgcgttaggcggcgcgcgcgcgcgtgcgtttgtgcgcgcgtttgtttgcgcgtttgcgttatatgttgggcgcgtaagcgtattcgcgcgcgcgtttttgcgtcgcgcgttgtaagcgttgttaaagatgcgcggcgcgcgtttgcgcgttttagcgcgtttgcgcgtagtagtgtaagttgcgttgtgtgagcgtcgtagcgttgcgtagcgcggcgcgagagagagagagcgtgttaagtttgcgcgttgacgagtgcgcgtgtgtagcgttaggttggtcgcgtagtgcgcgcgcgttgatatgagcgagcgcgttgtgttgtgcgcgcgcgttgttgttagcgtttgcgtagttgcgtagagcgttttgcgtgttgagagtgagttgcgcgagcgtgcgttgttgtgcgcgagaagtatgcgcgagagcgagagcgagcgtgcgagtagcgcgcgtgagtgttgcggcgcgcgcgtgagtgttgcgtgtgtgtgtgtaagtgtgtcgagtgaagcgcgcgagtgtttgtagcgcgcgtataattgcgcgcgagagcgtagtagcgagtgt

SEQ ID NO: 1996 - DNA, 1107 bp, Artificial Sequence
  chemically treated genomic DNA (Homo sapiens) CpG-island No: 1996
acactcgctactacgctctcgcgcgcaattatacgcgcgctacaaacactcgcgcgcttcactcgacacacttacacacacacacgcaacactcacgcgcgcgccgcaacactcacgcgcgctactcgcacgctcgctctcgctctcgcgcatacttctcgcgcacaacaacgcacgctcgcgcaactcactctcaacacgcaaaacgctctacgcaactacgcaaacgctaacaacaacgcgcgcgcacaacacaacgcgctcgctcatatcaacgcgcgcgcactacgcgaccaacctaacgctacacacgcgcactcgtcaacgcgcaaacttaacacgctctctctctctcgcgccgcgctacgcaacgctacgacgctcacacaacgcaacttacactactacgcgcaaacgcgctaaaacgcgcaaacgcgcgccgcgcatctttaacaacgcttacaacgcgcgacgcaaaaacgcgcgcgcgaatacgcttacgcgcccaacatataacgcaaacgcgcaaacaaacgcgcgcacaaacgcacgcgcgcgcgcgccgcctaacgcgcgctcctactcaataacttaccgaacgcgccttacaaaacttaccgcgaccttataaacgcacgcgatacaacgcgcgccgtcgccgaactttaaaattaccgcgccgcgctaaaccaacgacgcccgccctaaaacttaataacccgtctacgttattccaaacgactacgacccgttactcaacgcgctcctatcctccgctcctctatatacaccgtaaaacgaaataaaccgaaactcacaaaccaaaaacaacgcgcccaaatttacaaaccccgacttccttacgccgaacgccaaacgtatcgaccgaacaaccgactaaataacgaccgcctcgcctatacccctaacgtaaaactcgcccgacgacccgaaccgtacacaaaaaccacgtacgtctcgctatacgaaacgccgcgattcccaaacgaccttacgtaaaccccccccgacttaatcttccgcatatatactaaaccaaaaccctaacgctttacgcctaactattaacgcataccatactaccca

SEQ ID NO: 1997 - DNA, 1218 bp, Artificial Sequence
  chemically treated genomic DNA (Homo sapiens) CpG-island No: 1997
ttatgtcgcggtttttgtttgtttttttatgttcgtgagcggaggcgcgtcggatttcgcgtcgagcgttttgtttgcgtgagttacgttttagttaggtcgtttcgtttcgtagtgtcgtttttatgtattttgttgatcgtcgcgacgttcgtcgttcggttacgtcgcgcgtattgtttatagtcgggttcgtggtatttgtacggagttggtttcgtcggtacgcgttgattatattacgttcgttatcgtgtcgtcgcggtagtcggacgtttcggtttcggacggtggtcgagttgttagatgcggttgtaggttatcgttgttgcgttcgcgttcgttttttttttttacgtttattagtcgtgtttagtttcgtttaggatgttggtagtagttgtttttgagttttgttcgtcgcgttagtcgtgtttttcgttaatgtcggtaggttggtttttgcgatcgcgtggtcgtttagttcgaattatcgtttcgtattgcgtatcgtcgtatttttgttgttcgttcgtttttattcggatcgatttagcgttacgacggtcgagttgttacgtttatttatcgtattgtagtcggattcgattcgttcggttcgggttggtcggtgttagtatgcgttggcgttttatcgatttatgtttggtgtcgtagcgtcgtcgagttatgtacgtcggcgacgtttggttcgatcgagcgtcggttggttcgagttcggttggcggtagtcgattcgatggtcgttatttttgttatcggggtttatttgatcgtttatggattatcgtcgtcgagttcgtatagtcgtttatttttttcgtttcgtagcgcgtagatttttcgaggtcgtaggtcggcgaggtttttggtttcgagttgtatttaggttattcggtagttcgggcgtcgattcgatcgttgagtttcggggtttcgagtagttagcggttggtttcgtacggtagtttgcgatttggaggtcgtagtcgggcgtttttcgattttgttgtatcggtggtagtcgttggtttgttcggtttagttggttgttcgtgcgatgttagtttgcgggatcgtgttcgtttaggttaggttcggatcgagcgagcgtttcgtcgttcgttttcggttgtcgttcgagcgatcgttatcgggtacgttagtcgttcgttttttttcgttcggtagtcgtcg

SEQ ID NO: 1998 - DNA, 1218 bp, Artificial Sequence
  chemically treated genomic DNA (Homo sapiens) CpG-island No: 1998
cgacgactaccgaacgaaaaaaaacgaacgactaacgtacccgataacgatcgctcgaacgacaaccgaaaacgaacgacgaaacgctcgctcgatccgaacctaacctaaacgaacacgatcccgcaaactaacatcgcacgaacaaccaactaaaccgaacaaaccaacgactaccaccgatacaacaaaatcgaaaaacgcccgactacgacctccaaatcgcaaactaccgtacgaaaccaaccgctaactactcgaaaccccgaaactcaacgatcgaatcgacgcccgaactaccgaataacctaaatacaactcgaaaccaaaaacctcgccgacctacgacctcgaaaaatctacgcgctacgaaacgaaaaaaataaacgactatacgaactcgacgacgataatccataaacgatcaaataaaccccgataacaaaaataacgaccatcgaatcgactaccgccaaccgaactcgaaccaaccgacgctcgatcgaaccaaacgtcgccgacgtacataactcgacgacgctacgacaccaaacataaatcgataaaacgccaacgcatactaacaccgaccaacccgaaccgaacgaatcgaatccgactacaatacgataaataaacgtaacaactcgaccgtcgtaacgctaaatcgatccgaataaaaacgaacgaacaacaaaaatacgacgatacgcaatacgaaacgataattcgaactaaacgaccacgcgatcgcaaaaaccaacctaccgacattaacgaaaaacacgactaacgcgacgaacaaaactcaaaaacaactactaccaacatcctaaacgaaactaaacacgactaataaacgtaaaaaaaaaaaacgaacgcgaacgcaacaacgataacctacaaccgcatctaacaactcgaccaccgtccgaaaccgaaacgtccgactaccgcgacgacacgataacgaacgtaatataatcaacgcgtaccgacgaaaccaactccgtacaaataccacgaacccgactataaacaatacgcgcgacgtaaccgaacgacgaacgtcgcgacgatcaacaaaatacataaaaacgacactacgaaacgaaacgacctaactaaaacgtaactcacgcaaacaaaacgctcgacgcgaaatccgacgcgcctccgctcacgaacataaaaaaacaaacaaaaaccgcgacataa

SEQ ID NO: 1999 - DNA, 1218 bp, Artificial Sequence
  chemically treated genomic DNA (Homo sapiens) CpG-island No: 1999
cggcggttgtcgaacgggaagggacgggcggttggcgtgttcggtggcgatcgttcgagcggtagtcgggagcgggcgacgggacgttcgttcggttcgaatttagtttgggcggatacggtttcgtaggttggtatcgtacgggtagttagttggatcgggtaggttagcggttgttatcgatgtagtagggtcgagggacgttcggttgcggtttttaggtcgtaggttgtcgtgcggagttagtcgttggttgttcggagtttcggagtttaacggtcgggtcggcgttcgggttgtcgagtagtttaggtatagttcggaattaggagtttcgtcggtttgcggtttcggaaggtttgcgcgttgcgagacgagggggataggcgattgtgcgggttcgacggcggtggtttatgggcgattaggtgggtttcggtggtaagggtggcggttatcgggtcggttgtcgttaatcgagttcgagttagtcggcgttcggtcgagttaggcgtcgtcggcgtgtatggttcggcgacgttgcggtattaggtatagatcggtgggacgttagcgtatgttagtatcggttagttcgagtcggacggatcgggttcgattgtagtgcgatgaatgagcgtggtagttcggtcgtcgtggcgttggatcggttcggatggagacggacgagtagtaagggtacgacggtgcgtagtgcggggcgatggttcgggttgggcggttacgcggtcgtagggattagtttgtcggtattgacggagagtacggttgacgcggcgagtaggatttaagggtagttgttgttagtattttgagcggggttaggtacggttgatgggcgtagaggaggagggcgggcgcggacgtagtagcgatggtttatagtcgtatttggtagttcgattatcgttcggagtcgaagcgttcggttgtcgcggcgatacgatagcgggcgtgatgtgattagcgcgtgtcggcgagattagtttcgtgtaaatgttacgggttcggttgtagatagtacgcgcgacgtggtcgaacgacggacgtcgcggcgattagtaggatgtatgaggacgatattgcggggcgaagcggtttagttggggcgtgatttacgtaagtaggacgttcggcgcgagattcgacgcgttttcgtttacgaatatggaggggtaggtaggagtcgcggtatag

SEQ ID NO: 2000 - DNA, 1218 bp, Artificial Sequence
  chemically treated genomic DNA (Homo sapiens) CpG-island No: 2000
ctataccgcgactcctacctacccctccatattcgtaaacgaaaacgcgtcgaatctcgcgccgaacgtcctacttacgtaaatcacgccccaactaaaccgcttcgccccgcaatatcgtcctcatacatcctactaatcgccgcgacgtccgtcgttcgaccacgtcgcgcgtactatctacaaccgaacccgtaacatttacacgaaactaatctcgccgacacgcgctaatcacatcacgcccgctatcgtatcgccgcgacaaccgaacgcttcgactccgaacgataatcgaactaccaaatacgactataaaccatcgctactacgtccgcgcccgccctcctcctctacgcccatcaaccgtacctaaccccgctcaaaatactaacaacaactacccttaaatcctactcgccgcgtcaaccgtactctccgtcaataccgacaaactaatccctacgaccgcgtaaccgcccaacccgaaccatcgccccgcactacgcaccgtcgtacccttactactcgtccgtctccatccgaaccgatccaacgccacgacgaccgaactaccacgctcattcatcgcactacaatcgaacccgatccgtccgactcgaactaaccgatactaacatacgctaacgtcccaccgatctatacctaataccgcaacgtcgccgaaccatacacgccgacgacgcctaactcgaccgaacgccgactaactcgaactcgattaacgacaaccgacccgataaccgccacccttaccaccgaaacccacctaatcgcccataaaccaccgccgtcgaacccgcacaatcgcctatccccctcgtctcgcaacgcgcaaaccttccgaaaccgcaaaccgacgaaactcctaattccgaactatacctaaactactcgacaacccgaacgccgacccgaccgttaaactccgaaactccgaacaaccaacgactaactccgcacgacaacctacgacctaaaaaccgcaaccgaacgtccctcgaccctactacatcgataacaaccgctaacctacccgatccaactaactacccgtacgataccaacctacgaaaccgtatccgcccaaactaaattcgaaccgaacgaacgtcccgtcgcccgctcccgactaccgctcgaacgatcgccaccgaacacgccaaccgcccgtcccttcccgttcgacaaccgccg

SEQ ID NO: 2001 - DNA, 535 bp, Artificial Sequence
  chemically treated genomic DNA (Homo sapiens) CpG-island No: 2001
gggcggacgttggcgagcggtcgcggttacgttagcgacggaggaatgcggatcgaggggacgtatcgagcgttggtgtcgttcgcgtgttaggtcgaggttgggcgttgtgcgcgcgcgagcgagacgtttggcggtgcgtggcgcgcgtcgacgttttcgtcgcggttttggacgtgttgacgtaggcggatagatcgacgcgtgcggtgggagcgttgcgaaagcgttcgaacgcgttgttaatagtcgacgttcgacgtaggtttagattatgcgagtattgtagcgcgtggtatgcgggacgcgattggttagtcgtcgggagattttataaggtgcgcgggtagtcgagggtgtttcgtagagagcgtgagaggtttgtttgtgatttgtttcgcgaaggtggtatgttcgtagagtggagtatgtcgcgtcggcggagagtacgtgatttagtgagtatagaggaatttaggtcgttgtatgtttggtatggtatcgtagttttagcgtgagattttagagaaaattt

SEQ ID NO: 2002 - DNA, 535 bp, Artificial Sequence
  chemically treated genomic DNA (Homo sapiens) CpG-island No: 2002
aaattttctctaaaatctcacgctaaaactacgataccataccaaacatacaacgacctaaattcctctatactcactaaatcacgtactctccgccgacgcgacatactccactctacgaacataccaccttcgcgaaacaaatcacaaacaaacctctcacgctctctacgaaacaccctcgactacccgcgcaccttataaaatctcccgacgactaaccaatcgcgtcccgcataccacgcgctacaatactcgcataatctaaacctacgtcgaacgtcgactattaacaacgcgttcgaacgctttcgcaacgctcccaccgcacgcgtcgatctatccgcctacgtcaacacgtccaaaaccgcgacgaaaacgtcgacgcgcgccacgcaccgccaaacgtctcgctcgcgcgcgcacaacgcccaacctcgacctaacacgcgaacgacaccaacgctcgatacgtcccctcgatccgcattcctccgtcgctaacgtaaccgcgaccgctcgccaacgtccgccc

SEQ ID NO: 2003 - DNA, 535 bp, Artificial Sequence
  chemically treated genomic DNA (Homo sapiens) CpG-island No: 2003
gggttttttttggggttttacgttaaggttacgatgttatgttaagtatgtagcgatttaggtttttttgtgtttattgggttacgtatttttcgtcggcgcggtatgttttattttgcgaatatgttattttcgcggagtaagttataaataaattttttacgttttttgcggggtattttcgattgttcgcgtattttgtgagatttttcgacgattggttaatcgcgtttcgtatgttacgcgttgtaatgttcgtatggtttgggtttgcgtcgagcgtcgattgttgatagcgcgttcgagcgttttcgtagcgtttttatcgtacgcgtcggtttgttcgtttgcgttagtacgtttaaaatcgcgacgagagcgtcgacgcgcgttacgtatcgttagacgtttcgttcgcgcgcgtatagcgtttagtttcgatttggtacgcgaacgatattagcgttcgatgcgttttttcgattcgtattttttcgtcgttagcgtggtcgcgatcgttcgttagcgttcgttt

SEQ ID NO: 2004 - DNA, 535 bp, Artificial Sequence
  chemically treated genomic DNA (Homo sapiens) CpG-island No: 2004
aaacgaacgctaacgaacgatcgcgaccacgctaacgacgaaaaaatacgaatcgaaaaaacgcatcgaacgctaatatcgttcgcgtaccaaatcgaaactaaacgctatacgcgcgcgaacgaaacgtctaacgatacgtaacgcgcgtcgacgctctcgtcgcgattttaaacgtactaacgcaaacgaacaaaccgacgcgtacgataaaaacgctacgaaaacgctcgaacgcgctatcaacaatcgacgctcgacgcaaacccaaaccatacgaacattacaacgcgtaacatacgaaacgcgattaaccaatcgtcgaaaaatctcacaaaatacgcgaacaatcgaaaataccccgcaaaaaacgtaaaaaatttatttataacttactccgcgaaaataacatattcgcaaaataaaacataccgcgccgacgaaaaatacgtaacccaataaacacaaaaaaacctaaatcgctacatacttaacataacatcgtaaccttaacgtaaaaccccaaaaaaaaccc

SEQ ID NO: 2005 - DNA, 585 bp, Artificial Sequence
  chemically treated genomic DNA (Homo sapiens) CpG-island No: 2005
agtttcgcgttcgagtttatgaatttcgtgttgcggggtatgaagagtttgaaggcgtcgtttagcgttttggtgttgttagttagcgatagttgcgatcgcgagtatattatttttttttttcgcgtttttaatttagtttcgttttttgttttaaagtcgtcgtttcgggcggtcgtggtcggggcgatcgggcgtcggcgtcgtcgtttttttatattgcgtcgtatcgaaggtcgtttcgggttatttacgttcgtcgggttttattattgtcgtcgtcgttttagttcgcgttggtttcgcggcggcggttgttgttggcgtttttcgttatttttttcgttttcgtcgtcgttttttttttttcgagggcggaggacgcgggcgaatattttgttgttcggtataagatggcggtcggcgtttatttttgggttttgttattggacggcgtttcgtttttttggttttttttttttttttttttttgttttttttcgtcggttgtttttttttaaatgtgttcgttttaggttttttttatcgtagtttcgattttatttattgggtgtttttagaaga

SEQ ID NO: 2006 - DNA, 585 bp, Artificial Sequence
  chemically treated genomic DNA (Homo sapiens) CpG-island No: 2006
tcttctaaaaacacccaataaataaaatcgaaactacgataaaaaaaacctaaaacgaacacatttaaaaaaaaacaaccgacgaaaaaaaacaaaaaaaaaaaaaaaaaaaaaaccaaaaaaacgaaacgccgtccaataacaaaacccaaaaataaacgccgaccgccatcttataccgaacaacaaaatattcgcccgcgtcctccgccctcgaaaaaaaaaaaacgacgacgaaaacgaaaaaaataacgaaaaacgccaacaacaaccgccgccgcgaaaccaacgcgaactaaaacgacgacgacaataataaaacccgacgaacgtaaataacccgaaacgaccttcgatacgacgcaatataaaaaaacgacgacgccgacgcccgatcgccccgaccacgaccgcccgaaacgacgactttaaaacaaaaaacgaaactaaattaaaaacgcgaaaaaaaaaaataatatactcgcgatcgcaactatcgctaactaacaacaccaaaacgctaaacgacgccttcaaactcttcataccccgcaacacgaaattcataaactcgaacgcgaaact

SEQ ID NO: 2007 - DNA, 585 bp, Artificial Sequence
  chemically treated genomic DNA (Homo sapiens) CpG-island No: 2007
ttttttgagagtatttaatgggtggagtcggggttgcggtgggaggggtttgaggcgggtatatttaaagaaaggtagtcggcgaaaagaggtaagagaggagaagaaagagaaattaggggggcgaggcgtcgtttaatgataaagtttaggggtgggcgtcggtcgttattttgtatcgggtagtaggatattcgttcgcgtttttcgttttcggagggggaggggcggcggcggaggcgagaaaagtagcgagagacgttagtagtagtcgtcgtcgcggagttaacgcggattgggacggcggcggtagtagtgggattcggcgagcgtgagtggttcggagcggttttcgatgcggcgtagtatgaagaggcggcggcgtcggcgttcggtcgtttcggttacggtcgttcggggcggcgattttagggtagaagacggggttgggttggaggcgcgggaggagaaggtggtgtattcgcggtcgtaattgtcgttggttgatagtattaaggcgttgggcgacgtttttaagttttttatgtttcgtagtacggagtttatgagttcggacgcggagtt

SEQ ID NO: 2008 - DNA, 585 bp, Artificial Sequence
  chemically treated genomic DNA (Homo sapiens) CpG-island No: 2008
aactccgcgtccgaactcataaactccgtactacgaaacataaaaaacttaaaaacgtcgcccaacgccttaatactatcaaccaacgacaattacgaccgcgaatacaccaccttctcctcccgcgcctccaacccaaccccgtcttctaccctaaaatcgccgccccgaacgaccgtaaccgaaacgaccgaacgccgacgccgccgcctcttcatactacgccgcatcgaaaaccgctccgaaccactcacgctcgccgaatcccactactaccgccgccgtcccaatccgcgttaactccgcgacgacgactactactaacgtctctcgctacttttctcgcctccgccgccgcccctccccctccgaaaacgaaaaacgcgaacgaatatcctactacccgatacaaaataacgaccgacgcccacccctaaactttatcattaaacgacgcctcgcccccctaatttctctttcttctcctctcttacctcttttcgccgactacctttctttaaatatacccgcctcaaacccctcccaccgcaaccccgactccacccattaaatactctcaaaaaa

SEQ ID NO: 2009 - DNA, 693 bp, Artificial Sequence
  chemically treated genomic DNA (Homo sapiens) CpG-island No: 2009
ggtgcgcgcgtagcgagtttttttttcgcgtttttaaagttcgggggtatttcgattttttttacgcgtttggtttcggcgcggtttttattcgagcgggggtcgaaggtgattacgaatacggttattatttggtttttttttacgtcgtttagttttaggcgttcgggttgtagtagtattttcggggcggtcggtttttcgggttttcgttttcggggcggtttcgcggtcggtcgggcgttttcgtcgtcgtttcggttttagtttttcgtttgcggttgcggggtttgcggtagggagacggcggggttttcggtttagcgtagtagcggcgtcgcgtttttttgttttattatggttaggcgaggcggagtcgcgggcgcgaggggcggggcgggcgggttgcgggaatttttttcgtttggtcgcgttaacgtcgtcgtcgttcgtcgggtttggcgttgttcggggtttcgtcgcggaggcgttttttttacggagttagagtaggcgttcgcggagtcggtttcgggaatcgcgagtttattcggaggcgttcgtgtgtacgttcgtgtgtgggacgcgtgcggtcggaacgtttatttttgcgtttatatatttgtgtgcgggtggaggtgtttttttatttagggtttcgtggtatagttattattgtgagtttttatgtta

SEQ ID NO: 2010 - DNA, 693 bp, Artificial Sequence
  chemically treated genomic DNA (Homo sapiens) CpG-island No: 2010
taacataaaaactcacaataataactataccacgaaaccctaaataaaaaaacacctccacccgcacacaaatatataaacgcaaaaataaacgttccgaccgcacgcgtcccacacacgaacgtacacacgaacgcctccgaataaactcgcgattcccgaaaccgactccgcgaacgcctactctaactccgtaaaaaaaacgcctccgcgacgaaaccccgaacaacgccaaacccgacgaacgacgacgacgttaacgcgaccaaacgaaaaaaattcccgcaacccgcccgccccgcccctcgcgcccgcgactccgcctcgcctaaccataataaaacaaaaaaacgcgacgccgctactacgctaaaccgaaaaccccgccgtctccctaccgcaaaccccgcaaccgcaaacgaaaaactaaaaccgaaacgacgacgaaaacgcccgaccgaccgcgaaaccgccccgaaaacgaaaacccgaaaaaccgaccgccccgaaaatactactacaacccgaacgcctaaaactaaacgacgtaaaaaaaaaccaaataataaccgtattcgtaatcaccttcgacccccgctcgaataaaaaccgcgccgaaaccaaacgcgtaaaaaaaatcgaaatacccccgaactttaaaaacgcgaaaaaaaaactcgctacgcgcgcacc

SEQ ID NO: 2011 - DNA, 693 bp, Artificial Sequence
  chemically treated genomic DNA (Homo sapiens) CpG-island No: 2011
tgatataaaaatttatagtggtagttatattacggaattttaggtgagaaggtatttttattcgtatataggtgtatggacgtaaggatgaacgtttcggtcgtacgcgttttatatacggacgtgtatacgggcgttttcgaataggttcgcggttttcgaagtcggtttcgcggacgtttgttttggtttcgtgggaaaggcgttttcgcggcggggtttcgggtagcgttagattcggcgggcggcggcggcgttggcgcggttaggcgaggggggttttcgtagttcgttcgtttcgtttttcgcgttcgcggtttcgtttcgtttagttatggtggagtagggagacgcggcgtcgttgttgcgttgggtcgagggtttcgtcgtttttttgtcgtaggtttcgtagtcgtaggcgggaggttggggtcggggcggcggcgggggcgttcggtcggtcgcggagtcgtttcggaggcgggagttcgaggagtcggtcgtttcggaggtgttgttgtagttcgggcgtttggagttgggcgacgtggaggaggattaggtggtggtcgtgttcgtggttattttcgattttcgttcgggtgagggtcgcgtcggggttaggcgcgtggggagggtcggggtgttttcgagttttgggggcgcgggggaggggttcgttgcgcgcgtatt

SEQ ID NO: 2012 - DNA, 693 bp, Artificial Sequence
  chemically treated genomic DNA (Homo sapiens) CpG-island No: 2012
aatacgcgcgcaacgaacccctcccccgcgcccccaaaactcgaaaacaccccgaccctccccacgcgcctaaccccgacgcgaccctcacccgaacgaaaatcgaaaataaccacgaacacgaccaccacctaatcctcctccacgtcgcccaactccaaacgcccgaactacaacaacacctccgaaacgaccgactcctcgaactcccgcctccgaaacgactccgcgaccgaccgaacgcccccgccgccgccccgaccccaacctcccgcctacgactacgaaacctacgacaaaaaaacgacgaaaccctcgacccaacgcaacaacgacgccgcgtctccctactccaccataactaaacgaaacgaaaccgcgaacgcgaaaaacgaaacgaacgaactacgaaaacccccctcgcctaaccgcgccaacgccgccgccgcccgccgaatctaacgctacccgaaaccccgccgcgaaaacgcctttcccacgaaaccaaaacaaacgtccgcgaaaccgacttcgaaaaccgcgaacctattcgaaaacgcccgtatacacgtccgtatataaaacgcgtacgaccgaaacgttcatccttacgtccatacacctatatacgaataaaaataccttctcacctaaaattccgtaatataactaccactataaatttttatatca

SEQ ID NO: 2013 - DNA, 615 bp, Artificial Sequence
  chemically treated genomic DNA (Homo sapiens) CpG-island No: 2013
tgcgttttttatttttagtttcgaaggtgcgcgcggaggtttttcgtttcggcgggtttggttttggcgtttggtttatttcgttttatcgttattcgtcgtgttcggtttcggtttcggtttaggtgcgggtcgtcggtcgggaggagttggtgtcggagttttttaggttagggcgttgtagaatcgaaagtagtagggggcgggggagaggaaagagggggcgggagcggggacgcgagggcgaggcggttacgcggggtcgggaatgttcgcggtgcggggttttagagtcgttcggtggtcgtgttcgggcgatggtttttcgtttggtcgtcgatttcgatttcgggaaggacgtgttttcgtggttgcgggcgtagcgggtagtgtcggaggttagcggggtcggaagcggcggcgtaggtgcgggaggcgcgttgcggagaggggtgggggcggggagtgggagttttttatatttttcggatttcgattcggtggggagtaattcggggcgtcgtcgttttgagaaggttggtgcgagggcgtcgtttttttttttagagggttgttttggttttgttatttatatttagttacggcggaaggttt

SEQ ID NO: 2014 - DNA, 615 bp, Artificial Sequence
  chemically treated genomic DNA (Homo sapiens) CpG-island No: 2014
aaaccttccgccgtaactaaatataaataacaaaaccaaaacaaccctctaaaaaaaaaaacgacgccctcgcaccaaccttctcaaaacgacgacgccccgaattactccccaccgaatcgaaatccgaaaaatataaaaaactcccactccccgcccccacccctctccgcaacgcgcctcccgcacctacgccgccgcttccgaccccgctaacctccgacactacccgctacgcccgcaaccacgaaaacacgtccttcccgaaatcgaaatcgacgaccaaacgaaaaaccatcgcccgaacacgaccaccgaacgactctaaaaccccgcaccgcgaacattcccgaccccgcgtaaccgcctcgccctcgcgtccccgctcccgccccctctttcctctcccccgccccctactactttcgattctacaacgccctaacctaaaaaactccgacaccaactcctcccgaccgacgacccgcacctaaaccgaaaccgaaaccgaacacgacgaataacgataaaacgaaataaaccaaacgccaaaaccaaacccgccgaaacgaaaaacctccgcgcgcaccttcgaaactaaaaataaaaaacgca

SEQ ID NO: 2015 - DNA, 615 bp, Artificial Sequence
  chemically treated genomic DNA (Homo sapiens) CpG-island No: 2015
agatttttcgtcgtggttgggtgtgggtggtaaagttaaaatagttttttgaggaggggagcgacgttttcgtattagtttttttagggcggcgacgtttcgggttgttttttatcgggtcggagttcggggggtatgagggatttttatttttcgtttttattttttttcgtagcgcgtttttcgtatttgcgtcgtcgttttcggtttcgttggttttcgatattgttcgttgcgttcgtaattacgggagtacgtttttttcgaggtcgaagtcggcgattaggcgaagagttatcgttcggatacgattatcgggcggttttggggtttcgtatcgcgggtattttcggtttcgcgtggtcgtttcgttttcgcgttttcgttttcgtttttttttttttttttttcgttttttgttgttttcggttttgtagcgttttggtttgagaagtttcggtattagtttttttcggtcggcggttcgtatttgagtcggagtcggagtcgggtacggcgggtagcggtggggcggggtggattaggcgttaggattaggttcgtcggggcgggaggttttcgcgcgtattttcggggttgaggatagagggcgta

SEQ ID NO: 2016 - DNA, 615 bp, Artificial Sequence
  chemically treated genomic DNA (Homo sapiens) CpG-island No: 2016
tacgccctctatcctcaaccccgaaaatacgcgcgaaaacctcccgccccgacgaacctaatcctaacgcctaatccaccccgccccaccgctacccgccgtacccgactccgactccgactcaaatacgaaccgccgaccgaaaaaaactaataccgaaacttctcaaaccaaaacgctacaaaaccgaaaacaacaaaaaacgaaaaaaaaaaaaaaaaaaacgaaaacgaaaacgcgaaaacgaaacgaccacgcgaaaccgaaaatacccgcgatacgaaaccccaaaaccgcccgataatcgtatccgaacgataactcttcgcctaatcgccgacttcgacctcgaaaaaaacgtactcccgtaattacgaacgcaacgaacaatatcgaaaaccaacgaaaccgaaaacgacgacgcaaatacgaaaaacgcgctacgaaaaaaaataaaaacgaaaaataaaaatccctcataccccccgaactccgacccgataaaaaacaacccgaaacgtcgccgccctaaaaaaactaatacgaaaacgtcgctcccctcctcaaaaaactattttaactttaccacccacacccaaccacgacgaaaaatct

SEQ ID NO: 2017 - DNA, 589 bp, Artificial Sequence
  chemically treated genomic DNA (Homo sapiens) CpG-island No: 2017
gttcgtttcgtacgggatttttcggatttggttcgggggaggcgggtgggagtagcgggagcggttaggagggtaggggcggggcggtaggagacgttagtttatttttcggcggttgtaattcggaaggtttcggggatggaggggaagtgattgggtgtggggtttcgtcggttcgaagtaacggggttatatcgatcgatcgcggggtaaggttggggatgggggtcggggagtaggggcggaaggtacgaggcggaagtttggggtcgggggttggggacgtttcgagggcgttcggtgcgttgggagttcgcgtttttatagtttggttttgcggttattttcgcgttttttttaattttagggttttttttttttttcgtgagtttttcgttttcgcgtttttttttttttatgtgtttttatttattttcgtgtttttattgggcggcgttttatatttatgcgtttttatttttaggcgtttttcggttttttttttgtatttttttttatttttttagtttcgtttatttttaggcggcgttttatatttacgcgtttttttatttttaggtggtttttt

SEQ ID NO: 2018 - DNA, 589 bp, Artificial Sequence
  chemically treated genomic DNA (Homo sapiens) CpG-island No: 2018
aaaaaaccacctaaaaataaaaaaacgcgtaaatataaaacgccgcctaaaaataaacgaaactaaaaaaataaaaaaaaatacaaaaaaaaaaccgaaaaacgcctaaaaataaaaacgcataaatataaaacgccgcccaataaaaacacgaaaataaataaaaacacataaaaaaaaaaaaacgcgaaaacgaaaaactcacgaaaaaaaaaaaaaaccctaaaattaaaaaaaacgcgaaaataaccgcaaaaccaaactataaaaacgcgaactcccaacgcaccgaacgccctcgaaacgtccccaacccccgaccccaaacttccgcctcgtaccttccgcccctactccccgacccccatccccaaccttaccccgcgatcgatcgatataaccccgttacttcgaaccgacgaaaccccacacccaatcacttcccctccatccccgaaaccttccgaattacaaccgccgaaaaataaactaacgtctcctaccgccccgcccctaccctcctaaccgctcccgctactcccacccgcctcccccgaaccaaatccgaaaaatcccgtacgaaacgaac

SEQ ID NO: 2019 - DNA, 589 bp, Artificial Sequence
  chemically treated genomic DNA (Homo sapiens) CpG-island No: 2019
ggggagttatttggaggtgggggggcgcgtagatgtggggcgtcgtttgggagtgagcgggattggagggatgagagggggtgtaaggaggggatcggggggcgtttggaagtgaggacgtatagatgtggggcgtcgtttaataggggtacggggatgagtgggggtatatggagaggagggggcgcggggacgaggggtttacggaaaggagagggagttttgggattggagggggcgcgggggtggtcgtagggttagattgtggaaacgcgggtttttagcgtatcgggcgttttcggggcgtttttagttttcggttttaagttttcgtttcgtgtttttcgtttttgtttttcggtttttatttttagttttgtttcgcggtcggtcggtgtagtttcgttatttcgggtcggcggggttttatatttagttattttttttttattttcggagtttttcgggttgtagtcgtcgggaaatgagttggcgttttttgtcgtttcgtttttgtttttttggtcgttttcgttgtttttattcgtttttttcgggttaggttcgaggggtttcgtacggggcgggt

SEQ ID NO: 2020 - DNA, 589 bp, Artificial Sequence
  chemically treated genomic DNA (Homo sapiens) CpG-island No: 2020
acccgccccgtacgaaacccctcgaacctaacccgaaaaaaacgaataaaaacaacgaaaacgaccaaaaaaacaaaaacgaaacgacaaaaaacgccaactcatttcccgacgactacaacccgaaaaactccgaaaataaaaaaaaaataactaaatataaaaccccgccgacccgaaataacgaaactacaccgaccgaccgcgaaacaaaactaaaaataaaaaccgaaaaacaaaaacgaaaaacacgaaacgaaaacttaaaaccgaaaactaaaaacgccccgaaaacgcccgatacgctaaaaacccgcgtttccacaatctaaccctacgaccacccccgcgccccctccaatcccaaaactccctctcctttccgtaaacccctcgtccccgcgccccctcctctccatatacccccactcatccccgtacccctattaaacgacgccccacatctatacgtcctcacttccaaacgccccccgatcccctccttacaccccctctcatccctccaatcccgctcactcccaaacgacgccccacatctacgcgcccccccacctccaaataactcccc

SEQ ID NO: 2021 - DNA, 610 bp, Artificial Sequence
  chemically treated genomic DNA (Homo sapiens) CpG-island No: 2021
ttattttcgggcgtttttacggtttttatttttcgcgtttcggtcgcggattttgggtagtcgacgcgtcgaatcggttttgggtttcgcgtcggagtagtagttattttttcgtgggcggggggcggggtttgtcgattttagttcggtagggttcgggggcggggatttggggtagcggtcgcgagatttaggtttcgtttttttttcggggtgggggtgttgtcggtattcgcgtagacgtcggagtttaaggttttgttcgtagaagtcgttcgtaattatcgttaatgttttattaatggggaaattgaggttgggagttaggcgcgtagtttgagtcgtcgttgggttggattttcgagtttgggtcgggcgtacggttttcggggattgtcgggcgtagggtcggggagttacgttttttgagttcggacggcgggtattgcgggtttcgcgtttatacgtaggtgagcggttagcgagttttgtagtttcgtcggtagttagcgaggagttttttttacgttgatgtcggtgggcgttaattgtgtaggttttgggcggggagtaggcggttcgggcgtggttagggtagttcggtttcgtt

SEQ ID NO: 2022 - DNA, 610 bp, Artificial Sequence
  chemically treated genomic DNA (Homo sapiens) CpG-island No: 2022
aacgaaaccgaactaccctaaccacgcccgaaccgcctactccccgcccaaaacctacacaattaacgcccaccgacatcaacgtaaaaaaaactcctcgctaactaccgacgaaactacaaaactcgctaaccgctcacctacgtataaacgcgaaacccgcaatacccgccgtccgaactcaaaaaacgtaactccccgaccctacgcccgacaatccccgaaaaccgtacgcccgacccaaactcgaaaatccaacccaacgacgactcaaactacgcgcctaactcccaacctcaatttccccattaataaaacattaacgataattacgaacgacttctacgaacaaaaccttaaactccgacgtctacgcgaataccgacaacacccccaccccgaaaaaaaaacgaaacctaaatctcgcgaccgctaccccaaatccccgcccccgaaccctaccgaactaaaatcgacaaaccccgccccccgcccacgaaaaaataactactactccgacgcgaaacccaaaaccgattcgacgcgtcgactacccaaaatccgcgaccgaaacgcgaaaaataaaaaccgtaaaaacgcccgaaaataa

SEQ ID NO: 2023 - DNA, 610 bp, Artificial Sequence
  chemically treated genomic DNA (Homo sapiens) CpG-island No: 2023
ggcggggtcgggttgttttggttacgttcggatcgtttgtttttcgtttagggtttgtatagttggcgtttatcggtattagcgtgaagggagtttttcgttggttgtcgacggggttgtagggttcgttagtcgtttatttgcgtgtgagcgcggagttcgtagtattcgtcgttcgggtttagaggacgtgatttttcgattttgcgttcggtagttttcgggggtcgtgcgttcggtttaggttcggaggtttagtttagcggcggtttaggttgcgcgtttggtttttagttttagtttttttattggtaaagtattgacggtggttgcggacggtttttgcggatagagttttgggtttcgacgtttgcgcgggtatcggtagtatttttatttcgaagggagggcgggatttggatttcgcgatcgttgttttaggttttcgttttcgggttttatcgggttgaggtcggtaggtttcgtttttcgtttacgaggaagtggttgttgtttcggcgcggagtttagagtcggttcggcgcgtcgattgtttagagttcgcggtcggggcgcgggaggtgagggtcgtgggggcgttcggaggtgg

SEQ ID NO: 2024 - DNA, 610 bp, Artificial Sequence
  chemically treated genomic DNA (Homo sapiens) CpG-island No: 2024
ccacctccgaacgcccccacgaccctcacctcccgcgccccgaccgcgaactctaaacaatcgacgcgccgaaccgactctaaactccgcgccgaaacaacaaccacttcctcgtaaacgaaaaacgaaacctaccgacctcaacccgataaaacccgaaaacgaaaacctaaaacaacgatcgcgaaatccaaatcccgccctcccttcgaaataaaaatactaccgatacccgcgcaaacgtcgaaacccaaaactctatccgcaaaaaccgtccgcaaccaccgtcaatactttaccaataaaaaaactaaaactaaaaaccaaacgcgcaacctaaaccgccgctaaactaaacctccgaacctaaaccgaacgcacgacccccgaaaactaccgaacgcaaaatcgaaaaatcacgtcctctaaacccgaacgacgaatactacgaactccgcgctcacacgcaaataaacgactaacgaaccctacaaccccgtcgacaaccaacgaaaaactcccttcacgctaataccgataaacgccaactatacaaaccctaaacgaaaaacaaacgatccgaacgtaaccaaaacaacccgaccccgcc

SEQ ID NO: 2025 - DNA, 761 bp, Artificial Sequence
  chemically treated genomic DNA (Homo sapiens) CpG-island No: 2025
atatatacgtgttttggaggaggcggttcgtagggcgggatagggcggggcgggggtaggtttcggtcgtcgggaggaagtggtcgggcggtcgtagggatttcggggcgatcgtcgcgagttcgtagtagttcgggttatggaggcggagtcgtcgttttattcgatggcgggggttgcggggtcgtagggcgacgaggatttgttcggggtttcggacgggttcgaggtttcggtgagcggggattcggagtgcgaggcgcgggcgttttttgtgggttagggttttttcggcgggggcggggcgggtcggggggcggcgggtatcgggggatacgggttcggggcgcgatcgcgggtgcgagcggcgtgcgtggttcgtagttggacgagttggtgggcgcgtattttaattataacgaggaggaggaggagcgtcgttattatcgtcgtaagcgtttgggcgtgtttaagaacgtgttggttgttagcgtcgggggtatgtttatttacggcgtttatttgggtaggtgtcgttcggggattcggggtcgtttcgttcgtttttagttcggttcgggaaatagaaatcgcgggtcgtcgtttttcgttcgtttttatttttttttcgttgttttcgtagttgtagttacggtttttcgcggcgggggtggggttggggggttaagtagcgtagcgttttcgggttttagttagagtttcggtgtgggtgggggacgggggttcgggttttcggatag

SEQ ID NO: 2026 - DNA, 761 bp, Artificial Sequence
  chemically treated genomic DNA (Homo sapiens) CpG-island No: 2026
ctatccgaaaacccgaacccccgtcccccacccacaccgaaactctaactaaaacccgaaaacgctacgctacttaaccccccaaccccacccccgccgcgaaaaaccgtaactacaactacgaaaacaacgaaaaaaaaataaaaacgaacgaaaaacgacgacccgcgatttctatttcccgaaccgaactaaaaacgaacgaaacgaccccgaatccccgaacgacacctacccaaataaacgccgtaaataaacatacccccgacgctaacaaccaacacgttcttaaacacgcccaaacgcttacgacgataataacgacgctcctcctcctcctcgttataattaaaatacgcgcccaccaactcgtccaactacgaaccacgcacgccgctcgcacccgcgatcgcgccccgaacccgtatcccccgatacccgccgccccccgacccgccccgcccccgccgaaaaaaccctaacccacaaaaaacgcccgcgcctcgcactccgaatccccgctcaccgaaacctcgaacccgtccgaaaccccgaacaaatcctcgtcgccctacgaccccgcaacccccgccatcgaataaaacgacgactccgcctccataacccgaactactacgaactcgcgacgatcgccccgaaatccctacgaccgcccgaccacttcctcccgacgaccgaaacctacccccgccccgccctatcccgccctacgaaccgcctcctccaaaacacgtatatat

SEQ ID NO: 2027 - DNA, 761 bp, Artificial Sequence
  chemically treated genomic DNA (Homo sapiens) CpG-island No: 2027
ttgttcgggagttcggattttcgttttttatttatatcgaggttttggttgggattcggggacgttgcgttatttgattttttaattttattttcgtcgcggggggtcgtggttgtagttgcgagggtagcggaggggaagtgagagcgggcgggaggcggcggttcgcggtttttgtttttcgggtcgggttgggagcgggcggggcggtttcgggttttcgagcggtatttatttaggtagacgtcgtaggtgagtatgttttcggcgttggtagttagtacgtttttgagtacgtttaggcgtttgcggcggtagtagcggcgttttttttttttttcgttgtagttggggtacgcgtttattagttcgtttagttgcgagttacgtacgtcgttcgtattcgcgatcgcgtttcgaattcgtgtttttcggtgttcgtcgtttttcggttcgtttcgttttcgtcggggggattttggtttataggggacgttcgcgtttcgtatttcgggttttcgtttatcggggtttcgggttcgttcgggatttcgagtaggttttcgtcgttttgcggtttcgtagttttcgttatcgggtagagcggcggtttcgtttttatggttcgaattattgcggattcgcggcggtcgtttcggagtttttgcgatcgttcggttattttttttcggcggtcgggatttgttttcgtttcgttttgtttcgttttgcgggtcgttttttttaggatacgtgtgtgt

SEQ ID NO: 2028 - DNA, 761 bp, Artificial Sequence
  chemically treated genomic DNA (Homo sapiens) CpG-island No: 2028
acacacacgtatcctaaaaaaaacgacccgcaaaacgaaacaaaacgaaacgaaaacaaatcccgaccgccgaaaaaaaataaccgaacgatcgcaaaaactccgaaacgaccgccgcgaatccgcaataattcgaaccataaaaacgaaaccgccgctctacccgataacgaaaactacgaaaccgcaaaacgacgaaaacctactcgaaatcccgaacgaacccgaaaccccgataaacgaaaacccgaaatacgaaacgcgaacgtcccctataaaccaaaatccccccgacgaaaacgaaacgaaccgaaaaacgacgaacaccgaaaaacacgaattcgaaacgcgatcgcgaatacgaacgacgtacgtaactcgcaactaaacgaactaataaacgcgtaccccaactacaacgaaaaaaaaaaaaaacgccgctactaccgccgcaaacgcctaaacgtactcaaaaacgtactaactaccaacgccgaaaacatactcacctacgacgtctacctaaataaataccgctcgaaaacccgaaaccgccccgcccgctcccaacccgacccgaaaaacaaaaaccgcgaaccgccgcctcccgcccgctctcacttcccctccgctaccctcgcaactacaaccacgaccccccgcgacgaaaataaaattaaaaaatcaaataacgcaacgtccccgaatcccaaccaaaacctcgatataaataaaaaacgaaaatccgaactcccgaacaa

SEQ ID NO: 2029 - DNA, 516 bp, Artificial Sequence
  chemically treated genomic DNA (Homo sapiens) CpG-island No: 2029
cggggaaggtgcggggcgaggcggtcgcgggtttttggtatttttttttttacgtttaggttaagttggcggtgttgttggtgacgttggtggcggtcgcggttttttatttgcggatggagtagaagttgcgtcggggcgtggtttcgcgttagtttcgtatttcgcggttttagtataaggtgcgcggttatcgttatttggaggaggataattcggacgagagcgacgcggagggcgagtatggggacggcgcggaggaggaggcgtcgttcgtagggtttaggtttggtttcgagttcgttggattcggtcgtcggttttgttcgtacgaataggcgtaggggggagacgggtcggaggagtagtgaggggtcgtttggttttcggatttagttttttttttcgtcggttttagtttattacgtttgaggtcggggggatttttttcgagtttcgcgttgtttttaaaggtttttgtttttttttttttacgttggggacgttttttttaga

SEQ ID NO: 2030 - DNA, 516 bp, Artificial Sequence
  chemically treated genomic DNA (Homo sapiens) CpG-island No: 2030
tctaaaaaaaacgtccccaacgtaaaaaaaaaaaaacaaaaacctttaaaaacaacgcgaaactcgaaaaaaatccccccgacctcaaacgtaataaactaaaaccgacgaaaaaaaaaactaaatccgaaaaccaaacgacccctcactactcctccgacccgtctcccccctacgcctattcgtacgaacaaaaccgacgaccgaatccaacgaactcgaaaccaaacctaaaccctacgaacgacgcctcctcctccgcgccgtccccatactcgccctccgcgtcgctctcgtccgaattatcctcctccaaataacgataaccgcgcaccttatactaaaaccgcgaaatacgaaactaacgcgaaaccacgccccgacgcaacttctactccatccgcaaataaaaaaccgcgaccgccaccaacgtcaccaacaacaccgccaacttaacctaaacgtaaaaaaaaaaataccaaaaacccgcgaccgcctcgccccgcaccttccccg

SEQ ID NO: 2031 - DNA, 516 bp, Artificial Sequence
  chemically treated genomic DNA (Homo sapiens) CpG-island No: 2031
tttgggaggggcgtttttaacgtgggggaggggagataggggtttttgaagatagcgcgggattcggagggggttttttcgattttagacgtggtaaattgaggtcggcgaggagggaggttgagttcggggattaggcggttttttattgttttttcggttcgttttttttttgcgtttgttcgtacgggtagggtcggcggtcgagtttagcgggttcggggttaggtttgggttttgcgggcggcgttttttttttcgcgtcgtttttatgttcgtttttcgcgtcgttttcgttcgagttgtttttttttaagtagcggtaatcgcgtattttgtgttggggtcgcgggatgcggggttggcgcggggttacgtttcggcgtagtttttgttttattcgtaggtaggagatcgcggtcgttattagcgttattagtagtatcgttagtttagtttgggcgtaaggagagggatgttagggattcgcggtcgtttcgtttcgtatttttttcg

SEQ ID NO: 2032 - DNA, 516 bp, Artificial Sequence
  chemically treated genomic DNA (Homo sapiens) CpG-island No: 2032
cgaaaaaaatacgaaacgaaacgaccgcgaatccctaacatccctctccttacgcccaaactaaactaacgatactactaataacgctaataacgaccgcgatctcctacctacgaataaaacaaaaactacgccgaaacgtaaccccgcgccaaccccgcatcccgcgaccccaacacaaaatacgcgattaccgctacttaaaaaaaaacaactcgaacgaaaacgacgcgaaaaacgaacataaaaacgacgcgaaaaaaaaaacgccgcccgcaaaacccaaacctaaccccgaacccgctaaactcgaccgccgaccctacccgtacgaacaaacgcaaaaaaaaaacgaaccgaaaaaacaataaaaaaccgcctaatccccgaactcaacctccctcctcgccgacctcaatttaccacgtctaaaatcgaaaaaaccccctccgaatcccgcgctatcttcaaaaacccctatctcccctcccccacgttaaaaacgcccctcccaaa

SEQ ID NO: 2033 - DNA, 548 bp, Artificial Sequence
  chemically treated genomic DNA (Homo sapiens) CpG-island No: 2033
gagagtcgagtttcgcgggcgcgcgtagcggttggagcgcgggggcgaggtcgggttatttttttttttcggtcgcgtattgtttggttcgcggcggttttaggtattatttttttcgttcgggttgagttcgttgtggtagtgattagttttcgcggttagcggtattgtttatcgacgagcggcgttttttttttttttttttttttacgatttttttttttgcggcggtacgtcgtttagtagtttgtttcgtttcgtcgttaattttgagttggaggagaagtaattttggtagtggtcgcggggttggaatttcgttttttttcggtagtagtaggttcgtaagtcgttggggttaggtggggtaagagtttcgtcggcgtattagcgttgtttcggattgtttgtaacgtgtttttagcgagttgggagcggggttgtgattgcgagtcgtttgggggagggggatttgtttttttttttttttagagatttcggtttgtaattggattaaacgttgtcgaaaggatgtaaataggtagagt

SEQ ID NO: 2034 - DNA, 548 bp, Artificial Sequence
  chemically treated genomic DNA (Homo sapiens) CpG-island No: 2034
actctacctatttacatcctttcgacaacgtttaatccaattacaaaccgaaatctctaaaaaaaaaaaaaaacaaatccccctcccccaaacgactcgcaatcacaaccccgctcccaactcgctaaaaacacgttacaaacaatccgaaacaacgctaatacgccgacgaaactcttaccccacctaaccccaacgacttacgaacctactactaccgaaaaaaaacgaaattccaaccccgcgaccactaccaaaattacttctcctccaactcaaaattaacgacgaaacgaaacaaactactaaacgacgtaccgccgcaaaaaaaaaaatcgtaaaaaaaaaaaaaaaaaaaaaacgccgctcgtcgataaacaataccgctaaccgcgaaaactaatcactaccacaacgaactcaacccgaacgaaaaaaataatacctaaaaccgccgcgaaccaaacaatacgcgaccgaaaaaaaaaaataacccgacctcgcccccgcgctccaaccgctacgcgcgcccgcgaaactcgactctc

SEQ ID NO: 2035 - DNA, 548 bp, Artificial Sequence
  chemically treated genomic DNA (Homo sapiens) CpG-island No: 2035
gttttgtttatttatattttttcgatagcgtttgatttagttgtaagtcgaggtttttagaggaaaagaaaaataagttttttttttttagacgattcgtagttataatttcgtttttagttcgttggaaatacgttgtaaatagttcgaagtagcgttgatgcgtcggcgaaatttttgttttatttaattttagcgatttgcgagtttattgttgtcgaggagaagcgggattttaatttcgcggttattgttaaagttgttttttttttagtttaaagttgacgacggggcgaagtaggttgttggacggcgtgtcgtcgtagagaaggaaatcgtggggagaagggggagaagagggcgtcgttcgtcggtggatagtgtcgttagtcgcgggagttagttattgttatagcgggtttagttcggacgggaagggtggtgtttggaatcgtcgcgggttaggtagtgcgcggtcgggaaggggaggtggttcggtttcgttttcgcgttttagtcgttgcgcgcgttcgcgaagttcgattttt

SEQ ID NO: 2036 - DNA, 548 bp, Artificial Sequence
  chemically treated genomic DNA (Homo sapiens) CpG-island No: 2036
aaaaatcgaacttcgcgaacgcgcgcaacgactaaaacgcgaaaacgaaaccgaaccacctccccttcccgaccgcgcactacctaacccgcgacgattccaaacaccacccttcccgtccgaactaaacccgctataacaataactaactcccgcgactaacgacactatccaccgacgaacgacgccctcttctcccccttctccccacgatttccttctctacgacgacacgccgtccaacaacctacttcgccccgtcgtcaactttaaactaaaaaaaaaacaactttaacaataaccgcgaaattaaaatcccgcttctcctcgacaacaataaactcgcaaatcgctaaaattaaataaaacaaaaatttcgccgacgcatcaacgctacttcgaactatttacaacgtatttccaacgaactaaaaacgaaattataactacgaatcgtctaaaaaaaaaaaacttatttttcttttcctctaaaaacctcgacttacaactaaatcaaacgctatcgaaaaaatataaataaacaaaac

SEQ ID NO: 2037 - DNA, 1011 bp, Artificial Sequence
  chemically treated genomic DNA (Homo sapiens) CpG-island No: 2037
gagatcgttcggttcgcgttcgttattgttttttcgtcgtttttgcggcgcgcggggtcgcgttggcgcggcgggggttaataaggcgcgtttcgggtcggtcggcgggagggcgaggcggagaagagcggtttgagtcgtcgtcgcggcgcgcggagttaagagcgaggcggcggcggcggcgataggataaaggagattatgtgcggagggagggaggagggagagggaggaggaggaggagggcgcgcggcggttttttttcggcggtcgttcggggtttttcgatagtcggtttcgtttttttagtcgcgtcgcgggttgtttggttttgggttcgtcgcggtgttggagggagtcgtttcgggagtttggattttgtgcggatttcgtcggcgcgcggtttaggaggcgttgtaacggcggggcgcggggcggcggcgtttttggtcggagtttgcgggttggcgggtgagcgttcggggttggttgggtttcggttcgcgttcggtttgcgggcgtttgtttttttcgtcggtttatagtttaagtgaattttatcggcggtcgtcgcgggttttttggttggacggtagtaggagggggcggcggttacgcgggggttttttgtttcggatttcgtttttcgattgcgtcgagcgcgttttttttagacgttcgtagttttcggagcgggattttttcggcgcgtcgagttcgagtcgtcggtgttatcgtttttttttcgtttcgtttcgcgcgtttcgtttttcgtcgttttttttttcgttttcggcgtcgggtcggtttagcggaggcgcggtttttaggcgcgatatcgatagttgttgtttttttcgcggttcgagttttcggtttttttcggttgttttttttgcgggcgggcgcggcggaaattgtatcgtttttcgtttttttcgtagttgtcgtttttaagattgcgttatggtagggaaaggttattaggttcgtagtttggggttgaattgt

SEQ ID NO: 2038 - DNA, 1011 bp, Artificial Sequence
  chemically treated genomic DNA (Homo sapiens) CpG-island No: 2038
acaattcaaccccaaactacgaacctaataacctttccctaccataacgcaatcttaaaaacgacaactacgaaaaaaacgaaaaacgatacaatttccgccgcgcccgcccgcaaaaaaaacaaccgaaaaaaaccgaaaactcgaaccgcgaaaaaaacaacaactatcgatatcgcgcctaaaaaccgcgcctccgctaaaccgacccgacgccgaaaacgaaaaaaaaaacgacgaaaaacgaaacgcgcgaaacgaaacgaaaaaaaaacgataacaccgacgactcgaactcgacgcgccgaaaaaatcccgctccgaaaactacgaacgtctaaaaaaaacgcgctcgacgcaatcgaaaaacgaaatccgaaacaaaaaacccccgcgtaaccgccgccccctcctactaccgtccaaccaaaaaacccgcgacgaccgccgataaaattcacttaaactataaaccgacgaaaaaaacaaacgcccgcaaaccgaacgcgaaccgaaacccaaccaaccccgaacgctcacccgccaacccgcaaactccgaccaaaaacgccgccgccccgcgccccgccgttacaacgcctcctaaaccgcgcgccgacgaaatccgcacaaaatccaaactcccgaaacgactccctccaacaccgcgacgaacccaaaaccaaacaacccgcgacgcgactaaaaaaacgaaaccgactatcgaaaaaccccgaacgaccgccgaaaaaaaaccgccgcgcgccctcctcctcctcctccctctccctcctccctccctccgcacataatctcctttatcctatcgccgccgccgccgcctcgctcttaactccgcgcgccgcgacgacgactcaaaccgctcttctccgcctcgccctcccgccgaccgacccgaaacgcgccttattaacccccgccgcgccaacgcgaccccgcgcgccgcaaaaacgacgaaaaaacaataacgaacgcgaaccgaacgatctc

SEQ ID NO: 2039 - DNA, 1011 bp, Artificial Sequence
  chemically treated genomic DNA (Homo sapiens) CpG-island No: 2039
gtaatttaattttaggttgcgggtttagtggtttttttttgttatggcgtaattttggaagcggtaattgcggggagggcgaggagcggtgtagttttcgtcgcgttcgttcgtaaggaaggtagtcggggggagtcgagggttcgagtcgcggggggagtaatagttgtcgatgtcgcgtttggggatcgcgttttcgttgggtcgattcggcgtcggggacgagaggaggggcggcgaggggcggggcgcgcggggcgggacggaggaggggcggtggtatcggcggttcgggttcggcgcgtcgaggaagtttcgtttcgagagttgcgagcgtttggaggaggcgcgttcggcgtagtcggggagcgaagttcggagtaaggggttttcgcgtagtcgtcgtttttttttgttatcgtttagttagggagttcgcggcggtcgtcgatggagtttatttgagttgtgaatcggcgggagaggtaggcgttcgtaagtcgagcgcgggtcggagtttagttagtttcgggcgtttattcgttagttcgtaagtttcggttagaggcgtcgtcgtttcgcgtttcgtcgttgtagcgttttttgggtcgcgcgtcggcgagattcgtataaaatttagattttcggagcggttttttttagtatcgcggcgggtttaggattaggtagttcgcggcgcggttggagaggcgggatcggttgtcggggagtttcgggcggtcgtcggggagaagtcgtcgcgcgttttttttttttttttttttttttttttttttttttttcgtatatggttttttttgttttgtcgtcgtcgtcgtcgtttcgtttttagtttcgcgcgtcgcggcggcggtttaggtcgttttttttcgtttcgttttttcgtcggtcggttcgggacgcgttttgttagttttcgtcgcgttagcgcggtttcgcgcgtcgtaggagcggcggggagatagtggcgagcgcgggtcgggcgatttt

SEQ ID NO: 2040 - DNA, 1011 bp, Artificial Sequence
  chemically treated genomic DNA (Homo sapiens) CpG-island No: 2040
aaaatcgcccgacccgcgctcgccactatctccccgccgctcctacgacgcgcgaaaccgcgctaacgcgacgaaaactaacaaaacgcgtcccgaaccgaccgacgaaaaaacgaaacgaaaaaaaacgacctaaaccgccgccgcgacgcgcgaaactaaaaacgaaacgacgacgacgacgacaaaacaaaaaaaaccatatacgaaaaaaaaaaaaaaaaaaaaaaaaaaaaaaaaaaaaaacgcgcgacgacttctccccgacgaccgcccgaaactccccgacaaccgatcccgcctctccaaccgcgccgcgaactacctaatcctaaacccgccgcgatactaaaaaaaaccgctccgaaaatctaaattttatacgaatctcgccgacgcgcgacccaaaaaacgctacaacgacgaaacgcgaaacgacgacgcctctaaccgaaacttacgaactaacgaataaacgcccgaaactaactaaactccgacccgcgctcgacttacgaacgcctacctctcccgccgattcacaactcaaataaactccatcgacgaccgccgcgaactccctaactaaacgataacaaaaaaaaacgacgactacgcgaaaaccccttactccgaacttcgctccccgactacgccgaacgcgcctcctccaaacgctcgcaactctcgaaacgaaacttcctcgacgcgccgaacccgaaccgccgataccaccgcccctcctccgtcccgccccgcgcgccccgcccctcgccgcccctcctctcgtccccgacgccgaatcgacccaacgaaaacgcgatccccaaacgcgacatcgacaactattactccccccgcgactcgaaccctcgactccccccgactaccttccttacgaacgaacgcgacgaaaactacaccgctcctcgccctccccgcaattaccgcttccaaaattacgccataacaaaaaaaaaccactaaacccgcaacctaaaattaaattac

SEQ ID NO: 2041 - DNA, 883 bp, Artificial Sequence
  chemically treated genomic DNA (Homo sapiens) CpG-island No: 2041
cgggggacgttttgttcggaagttcgtgttcgttcgcggcgcggttaggcgggttttatgagggggatttttttaataatcgagttttcgggttgggcgcggggtagcgtagtgatttttttcgcgttcggtagttcggtcggggtcgcggggtcgcggggtcgcggggtcggttcggggtcgttaggttttttcgtcgggtttcgcggcggcgtgtggcggggcggggcgcgggtaggcgggcgtacgttttgcgttcgttttttaggttgtaggtggggttgtgcggtcgcgttgtttttaggaagttttacgggttttcgtttgtcgggtcgcggcgtcgtttttaggatgtagtgtggatcggtcgggcgttgacggaggcggcgcgattgcgggcggcgcggcgtaggggtagttagcgaggagcgcggtagaggaaaggttaggtaggcgtcgtttgggaagagtatcgggcggtcgggtttgcgtggtgtcgcgcgcggcggttgcgacgacgatttttttcgggtcgggcgggatagcgtagggttatggtcgaggcggtcgcgtttcggtaagggcgattcgcgcgcgtagggattcgcggtttgggggtttaggcggtcggtttcggtatacggcgtcgtaggttttggggaggggtttcggggttcgggcggattatcgggtttgggttttcgcgaatggggcgcggggttcgtcggggtttattgcgttcgtcggtcgggtttttatttcgagtcgaattcgagcgttggcggaacggttgttttcgtttcgggtcgttttacgttaagttttttgggtttttcgggttttttgttttcgttttagtcgttgttttttttttttgggtgtt

SEQ ID NO: 2042 - DNA, 883 bp, Artificial Sequence
  chemically treated genomic DNA (Homo sapiens) CpG-island No: 2042
aacacccaaaaaaaaaaaacaacgactaaaacgaaaacaaaaaacccgaaaaacccaaaaaacttaacgtaaaacgacccgaaacgaaaacaaccgttccgccaacgctcgaattcgactcgaaataaaaacccgaccgacgaacgcaataaaccccgacgaaccccgcgccccattcgcgaaaacccaaacccgataatccgcccgaaccccgaaacccctccccaaaacctacgacgccgtataccgaaaccgaccgcctaaacccccaaaccgcgaatccctacgcgcgcgaatcgcccttaccgaaacgcgaccgcctcgaccataaccctacgctatcccgcccgacccgaaaaaaatcgtcgtcgcaaccgccgcgcgcgacaccacgcaaacccgaccgcccgatactcttcccaaacgacgcctacctaacctttcctctaccgcgctcctcgctaactacccctacgccgcgccgcccgcaatcgcgccgcctccgtcaacgcccgaccgatccacactacatcctaaaaacgacgccgcgacccgacaaacgaaaacccgtaaaacttcctaaaaacaacgcgaccgcacaaccccacctacaacctaaaaaacgaacgcaaaacgtacgcccgcctacccgcgccccgccccgccacacgccgccgcgaaacccgacgaaaaaacctaacgaccccgaaccgaccccgcgaccccgcgaccccgcgaccccgaccgaactaccgaacgcgaaaaaaatcactacgctaccccgcgcccaacccgaaaactcgattattaaaaaaatccccctcataaaacccgcctaaccgcgccgcgaacgaacacgaacttccgaacaaaacgtcccccg

SEQ ID NO: 2043 - DNA, 883 bp, Artificial Sequence
  chemically treated genomic DNA (Homo sapiens) CpG-island No: 2043
ggtatttagaaggaggggatagcggttggggcgggggtaggaagttcggagggtttaaagaatttggcgtggggcggttcggggcggggataatcgtttcgttagcgttcgggttcggttcggagtgggggttcggtcgacgggcgtagtaggtttcggcggatttcgcgttttattcgcgggagtttaggttcggtggttcgttcggatttcggaatttttttttagggtttgcggcgtcgtgtgtcggggtcggtcgtttgggtttttaggtcgcgagtttttgcgcgcgcgggtcgtttttatcggagcgcgatcgtttcggttatggttttgcgttgtttcgttcggttcggaggaagtcgtcgtcgtagtcgtcgcgcgcggtattacgtaggttcggtcgttcggtgttttttttaggcggcgtttgtttggttttttttttgtcgcgtttttcgttggttgtttttgcgtcgcgtcgttcgtagtcgcgtcgttttcgttagcgttcggtcggtttatattgtattttgggagcggcgtcgcggttcggtagacgaaggttcgtgaggttttttggaggtagcgcggtcgtatagttttatttgtagtttgagaggcgaacgtagggcgtgcgttcgtttgttcgcgtttcgtttcgttatacgtcgtcgcggggttcgacgggaggatttagcgatttcgggtcgatttcgcgatttcgcgatttcgcgatttcggtcggattgtcgagcgcggggggagttattgcgttgtttcgcgtttagttcgaggattcggttattgaaagggttttttttatgggattcgtttggtcgcgtcgcgggcgagtacgggttttcgggtagggcgtttttcg

SEQ ID NO: 2044 - DNA, 883 bp, Artificial Sequence
  chemically treated genomic DNA (Homo sapiens) CpG-island No: 2044
cgaaaaacgccctacccgaaaacccgtactcgcccgcgacgcgaccaaacgaatcccataaaaaaaaccctttcaataaccgaatcctcgaactaaacgcgaaacaacgcaataactccccccgcgctcgacaatccgaccgaaatcgcgaaatcgcgaaatcgcgaaatcgacccgaaatcgctaaatcctcccgtcgaaccccgcgacgacgtataacgaaacgaaacgcgaacaaacgaacgcacgccctacgttcgcctctcaaactacaaataaaactatacgaccgcgctacctccaaaaaacctcacgaaccttcgtctaccgaaccgcgacgccgctcccaaaatacaatataaaccgaccgaacgctaacgaaaacgacgcgactacgaacgacgcgacgcaaaaacaaccaacgaaaaacgcgacaaaaaaaaaaccaaacaaacgccgcctaaaaaaaacaccgaacgaccgaacctacgtaataccgcgcgcgacgactacgacgacgacttcctccgaaccgaacgaaacaacgcaaaaccataaccgaaacgatcgcgctccgataaaaacgacccgcgcgcgcaaaaactcgcgacctaaaaacccaaacgaccgaccccgacacacgacgccgcaaaccctaaaaaaaaattccgaaatccgaacgaaccaccgaacctaaactcccgcgaataaaacgcgaaatccgccgaaacctactacgcccgtcgaccgaacccccactccgaaccgaacccgaacgctaacgaaacgattatccccgccccgaaccgccccacgccaaattctttaaaccctccgaacttcctacccccgccccaaccgctatcccctccttctaaatacc

SEQ ID NO: 2045 - DNA, 884 bp, Artificial Sequence
  chemically treated genomic DNA (Homo sapiens) CpG-island No: 2045
ggcggttcggggcggggataatcgtttcgttagcgtttggttcggttcggagtggggggttcggttggtaagcgtagtaggttcgggtagacgtcgcggttttgtttttcggagttttaggcgcggtagtacggttcggttttcgtagttttcgtgtgtcgggttcgggtcgttcggggaatttaggtcgcgagttcgtgcgcgcgttggtcgtttttatcggagttgcggtcgttttttttatggttttgcgttgtttttcgcggtttagataaagtcgtcgtcgttgttgcgcgcgttttacgtagggttcgtttttcggtgtttttcgtagcggcgttcgtttagttttgtttttgtcgtcgttgttttttgattgtttttgttttgcgtcgttcgtagttgcgttaacgtttttagcgttcggtcggttcgtattgtattttgggagtcggcgcggtcgacgaaggtatatgaggttttttggaggtaggtagtcgtatagttttatttgtagtttcggaggcgaattgtaggcgcgatttcgtttggttcgcgttcgggagttgatttcgcgatttttggtcgatttttcgtttttttttcgattgtcgcgtgtgcgcgcgtagttattgcgttggtttcgcgatttaggtcgagggattcggttatcgaaagagttttttttataagattcgtttggtcgcgttcgcgggtaagtaggggtttttaggtagggtttttttcggtgatcgcgggtagtgtggtttttcgtttagttgggttcggcgcggtcgaataggtatttttgtcgttcgaggttttgggtttggaggtttgggttgttttcggggggtagttgtaatttatttttatttgtgttt

SEQ ID NO: 2046 - DNA, 884 bp, Artificial Sequence
  chemically treated genomic DNA (Homo sapiens) CpG-island No: 2046
aaacacaaataaaaataaattacaactaccccccgaaaacaacccaaacctccaaacccaaaacctcgaacgacaaaaatacctattcgaccgcgccgaacccaactaaacgaaaaaccacactacccgcgatcaccgaaaaaaaccctacctaaaaacccctacttacccgcgaacgcgaccaaacgaatcttataaaaaaaactctttcgataaccgaatccctcgacctaaatcgcgaaaccaacgcaataactacgcgcgcacacgcgacaatcgaaaaaaaaacgaaaaatcgaccaaaaatcgcgaaatcaactcccgaacgcgaaccaaacgaaatcgcgcctacaattcgcctccgaaactacaaataaaactatacgactacctacctccaaaaaacctcatataccttcgtcgaccgcgccgactcccaaaatacaatacgaaccgaccgaacgctaaaaacgttaacgcaactacgaacgacgcaaaacaaaaacaatcaaaaaacaacgacgacaaaaacaaaactaaacgaacgccgctacgaaaaacaccgaaaaacgaaccctacgtaaaacgcgcgcaacaacgacgacgactttatctaaaccgcgaaaaacaacgcaaaaccataaaaaaaacgaccgcaactccgataaaaacgaccaacgcgcgcacgaactcgcgacctaaattccccgaacgacccgaacccgacacacgaaaactacgaaaaccgaaccgtactaccgcgcctaaaactccgaaaaacaaaaccgcgacgtctacccgaacctactacgcttaccaaccgaaccccccactccgaaccgaaccaaacgctaacgaaacgattatccccgccccgaaccgcc

SEQ ID NO: 2047 - DNA, 884 bp, Artificial Sequence
  chemically treated genomic DNA (Homo sapiens) CpG-island No: 2047
aaatatagatggggatgagttatagttgtttttcgaaaatagtttaaatttttaggtttaggatttcgggcggtagaagtgtttgttcggtcgcgtcgggtttagttgggcgaggggttatattgttcgcggttatcggggagggttttgtttggaagtttttgtttgttcgcgggcgcggttaggcgggttttatgagggggattttttcggtaatcgagtttttcggtttgggtcgcggggttagcgtagtgattgcgcgcgtatacgcggtagtcggggaaggggcgaggggtcggttaggggtcgcggggttagttttcgggcgcgggttaggcggggtcgcgtttgtagttcgttttcggagttgtaggtggggttgtgcggttgtttgtttttaggaagttttatgtgttttcgtcggtcgcgtcggtttttaggatatagtgcggatcggtcgggcgttaaaggcgttgacgtaattgcgggcggcgtagggtaggggtagttagggagtagcggcggtagagatagggttgggcgggcgtcgttgcggagagtatcgggaggcgggttttgcgtggggcgcgcgtagtagcggcgacgattttatttgggtcgcgggggatagcgtagggttatggaggaggcggtcgtagtttcggtaagggcgattagcgcgcgtacgaattcgcggtttggatttttcgggcgattcgggttcggtatacgggggttgcgggagtcgagtcgtattatcgcgtttggggtttcggggaatagggtcgcggcgtttgttcgggtttattgcgtttgttagtcgggttttttatttcgggtcgagttaggcgttggcggaacggttgttttcgtttcgggtcgtt

SEQ ID NO: 2048 - DNA, 884 bp, Artificial Sequence
  chemically treated genomic DNA (Homo sapiens) CpG-island No: 2048
aacgacccgaaacgaaaacaaccgttccgccaacgcctaactcgacccgaaataaaaaacccgactaacaaacgcaataaacccgaacaaacgccgcgaccctattccccgaaaccccaaacgcgataatacgactcgactcccgcaacccccgtataccgaacccgaatcgcccgaaaaatccaaaccgcgaattcgtacgcgcgctaatcgcccttaccgaaactacgaccgcctcctccataaccctacgctatcccccgcgacccaaataaaatcgtcgccgctactacgcgcgccccacgcaaaacccgcctcccgatactctccgcaacgacgcccgcccaaccctatctctaccgccgctactccctaactacccctaccctacgccgcccgcaattacgtcaacgcctttaacgcccgaccgatccgcactatatcctaaaaaccgacgcgaccgacgaaaacacataaaacttcctaaaaacaaacaaccgcacaaccccacctacaactccgaaaacgaactacaaacgcgaccccgcctaacccgcgcccgaaaactaaccccgcgacccctaaccgacccctcgccccttccccgactaccgcgtatacgcgcgcaatcactacgctaaccccgcgacccaaaccgaaaaactcgattaccgaaaaaatccccctcataaaacccgcctaaccgcgcccgcgaacaaacaaaaacttccaaacaaaaccctccccgataaccgcgaacaatataacccctcgcccaactaaacccgacgcgaccgaacaaacacttctaccgcccgaaatcctaaacctaaaaatttaaactattttcgaaaaacaactataactcatccccatctatattt

SEQ ID NO: 2049 - DNA, 1004 bp, Artificial Sequence
  chemically treated genomic DNA (Homo sapiens) CpG-island No: 2049
ttcgcggcggcggattacggaggggttcggggcgggggttagcgtttcggtttatttgggtgtaggtgttgggcggggggcgcgcgttattttgaggatgttgtcgaagatggtgtcgcggaattttagtagcgttttttggtcgaattcgcggtcgtggatgatgcgtatttgtttgaggaacgtggatttgtcgttttcgttcgcgtttagtagtaggatttttattaggcgtcggatcgcgcgtcgttcgcgggttagtagcgcgtcgatgtcgcggttacgttttcgggtttcgcgtttcgcgtcgcgcgcgtcgttgttcgttttgcgttcgcgggtttcgtcggtttcggtcggtagtaggtagcggttgagggttcgtattatttcggatatggttttttaggtcgcggtcgcgtttcgtcggcgttcgggggttatggacgttttcgtcggcgagggcgagttcgggtcgaggtatcgttttacgtttcgtcgttcgttttaggtcgcgttcgtcgtcgtcgttgtagtcgtttcgaggttcgtattcgtcgttcggtcgttattcgggttcggcggaggggcgggcggcgtcgcgtgaggttcggcggattgggtcggttgtcgtttatttggtcgtgagagtttttcgattggtttatttcgttaagggaggcgggtatttttttcggtttcggggcggggtcgacgtcgaaagaggcgggatttttgaggtgaaggcgttttttattggacgtttaggttgaggtttttttttttagaatgaaagggaggcggggtcgttcgggaggcggagcgatcgttcgttatggttaattataattgttttgagtggatattagacgtgtttaacgggttttggattgggtgttcgggggacggggcgtgacgagaagtgttaggtgtatagaaagatttttttttggtttttagattgggttcgtttgtgagattaggatttcgcggagtagtttaaa

SEQ ID NO: 2050 - DNA, 1004 bp, Artificial Sequence
  chemically treated genomic DNA (Homo sapiens) CpG-island No: 2050
tttaaactactccgcgaaatcctaatctcacaaacgaacccaatctaaaaaccaaaaaaaaatctttctatacacctaacacttctcgtcacgccccgtcccccgaacacccaatccaaaacccgttaaacacgtctaatatccactcaaaacaattataattaaccataacgaacgatcgctccgcctcccgaacgaccccgcctccctttcattctaaaaaaaaaaacctcaacctaaacgtccaataaaaaacgccttcacctcaaaaatcccgcctctttcgacgtcgaccccgccccgaaaccgaaaaaaatacccgcctcccttaacgaaataaaccaatcgaaaaactctcacgaccaaataaacgacaaccgacccaatccgccgaacctcacgcgacgccgcccgcccctccgccgaacccgaataacgaccgaacgacgaatacgaacctcgaaacgactacaacgacgacgacgaacgcgacctaaaacgaacgacgaaacgtaaaacgatacctcgacccgaactcgccctcgccgacgaaaacgtccataacccccgaacgccgacgaaacgcgaccgcgacctaaaaaaccatatccgaaataatacgaaccctcaaccgctacctactaccgaccgaaaccgacgaaacccgcgaacgcaaaacgaacaacgacgcgcgcgacgcgaaacgcgaaacccgaaaacgtaaccgcgacatcgacgcgctactaacccgcgaacgacgcgcgatccgacgcctaataaaaatcctactactaaacgcgaacgaaaacgacaaatccacgttcctcaaacaaatacgcatcatccacgaccgcgaattcgaccaaaaaacgctactaaaattccgcgacaccatcttcgacaacatcctcaaaataacgcgcgccccccgcccaacacctacacccaaataaaccgaaacgctaacccccgccccgaacccctccgtaatccgccgccgcgaa

SEQ ID NO: 2051 - DNA, 1004 bp, Artificial Sequence
  chemically treated genomic DNA (Homo sapiens) CpG-island No: 2051
tttgggttatttcgcgaggttttggttttataggcggatttaatttgggaattaagggagaatttttttgtatatttggtatttttcgttacgtttcgtttttcgaatatttaatttaaagttcgttgggtacgtttgatgtttatttagagtaattataattggttatggcggacgatcgtttcgtttttcgggcgatttcgttttttttttattttgaaagaaagaattttagtttgggcgtttaatgagaagcgtttttattttaaagatttcgtttttttcggcgtcgatttcgtttcgaggtcggaagggatgttcgttttttttggcgagatgagttaatcgaagggtttttacggttagatggacggtagtcggtttaattcgtcgggttttacgcggcgtcgttcgttttttcgtcgggttcgagtggcggtcgggcgacgagtgcgggtttcggagcgattgtagcggcggcggcggacgcggtttgaggcgagcggcggggcgtggggcggtgtttcggttcgggttcgttttcgtcggcgggagcgtttatggttttcgggcgtcggcggggcgcggtcgcggtttgaggggttatgttcggggtggtgcggatttttagtcgttgtttgttgtcggtcgaggtcggcggggttcgcgagcgtagggcgggtagcggcgcgcgcgacgcggagcgcgaggttcggaggcgtagtcgcgatatcgacgcgttgttggttcgcgagcggcgcgcggttcggcgtttggtgaagattttgttgttgggcgcgggcgagagcggtaagtttacgttttttaagtagatgcgtattatttacggtcgcgagttcgattagaaggcgttgttggagtttcgcgatattattttcgataatatttttaaggtgacgcgcgtttttcgtttagtatttgtatttaggtgggtcggggcgttaattttcgtttcgggttttttcgtggttcgtcgtcgcggg

SEQ ID NO: 2052 - DNA, 1004 bp, Artificial Sequence
  chemically treated genomic DNA (Homo sapiens) CpG-island No: 2052
cccgcgacgacgaaccacgaaaaaacccgaaacgaaaattaacgccccgacccacctaaatacaaatactaaacgaaaaacgcgcgtcaccttaaaaatattatcgaaaataatatcgcgaaactccaacaacgccttctaatcgaactcgcgaccgtaaataatacgcatctacttaaaaaacgtaaacttaccgctctcgcccgcgcccaacaacaaaatcttcaccaaacgccgaaccgcgcgccgctcgcgaaccaacaacgcgtcgatatcgcgactacgcctccgaacctcgcgctccgcgtcgcgcgcgccgctacccgccctacgctcgcgaaccccgccgacctcgaccgacaacaaacaacgactaaaaatccgcaccaccccgaacataacccctcaaaccgcgaccgcgccccgccgacgcccgaaaaccataaacgctcccgccgacgaaaacgaacccgaaccgaaacaccgccccacgccccgccgctcgcctcaaaccgcgtccgccgccgccgctacaatcgctccgaaacccgcactcgtcgcccgaccgccactcgaacccgacgaaaaaacgaacgacgccgcgtaaaacccgacgaattaaaccgactaccgtccatctaaccgtaaaaacccttcgattaactcatctcgccaaaaaaaacgaacatcccttccgacctcgaaacgaaatcgacgccgaaaaaaacgaaatctttaaaataaaaacgcttctcattaaacgcccaaactaaaattctttctttcaaaataaaaaaaaaacgaaatcgcccgaaaaacgaaacgatcgtccgccataaccaattataattactctaaataaacatcaaacgtacccaacgaactttaaattaaatattcgaaaaacgaaacgtaacgaaaaataccaaatatacaaaaaaattctcccttaattcccaaattaaatccgcctataaaaccaaaacctcgcgaaataacccaaa

SEQ ID NO: 2053 - DNA, 552 bp, Artificial Sequence
  chemically treated genomic DNA (Homo sapiens) CpG-island No: 2053
acgatttcggttttcgtttcggtcgaggttttttttgtaggtcgcgagaattaggtgcgttagcggcgttcgggaacgcggaagagttagtggagcggttttgtagtttaaagtatttcgtcgattttagtacggtcgttttatcgttttttattagatttagttttagggattgcgtagtcgtagagtttcgttcgagtatcggaagtttaggtcgttagtattttcgggaagtgatttcgttttcgaagtcgattggttgttgttttgttttcgttcgcgtcggtggcgttttttttgtagcgcgtgcgtgttgcgttattgagtagcgttatggaggattttgaagtattgggtttcgaatatatgggtatcgattttcggtttttttaggtatacgcgagggttggggagtcggtttacggttttgcggggcgcgttatcgttttttacgtcgtttaaatcgtatttttggttttttaggttgttatcgatttgggttggtcgcgatttacgttgatttaggagaaggttattttattggttttagaa

SEQ ID NO: 2054 - DNA, 552 bp, Artificial Sequence
  chemically treated genomic DNA (Homo sapiens) CpG-island No: 2054
ttctaaaaccaataaaataaccttctcctaaatcaacgtaaatcgcgaccaacccaaatcgataacaacctaaaaaaccaaaaatacgatttaaacgacgtaaaaaacgataacgcgccccgcaaaaccgtaaaccgactccccaaccctcgcgtatacctaaaaaaaccgaaaatcgatacccatatattcgaaacccaatacttcaaaatcctccataacgctactcaataacgcaacacgcacgcgctacaaaaaaaacgccaccgacgcgaacgaaaacaaaacaacaaccaatcgacttcgaaaacgaaatcacttcccgaaaatactaacgacctaaacttccgatactcgaacgaaactctacgactacgcaatccctaaaactaaatctaataaaaaacgataaaacgaccgtactaaaatcgacgaaatactttaaactacaaaaccgctccactaactcttccgcgttcccgaacgccgctaacgcacctaattctcgcgacctacaaaaaaaacctcgaccgaaacgaaaaccgaaatcgt

SEQ ID NO: 2055 - DNA, 552 bp, Artificial Sequence
  chemically treated genomic DNA (Homo sapiens) CpG-island No: 2055
ttttagggttagtgggatggtttttttttggattagcgtaggtcgcgattagtttagatcggtgatagtttaggagattaggagtgcggtttaagcggcgtgaagagcgatggcgcgtttcgtagagtcgtaagtcggttttttagttttcgcgtgtatttgaaggagtcggggatcgatgtttatgtgttcgaagtttagtgttttagagttttttatggcgttgtttagtagcgtagtacgtacgcgttgtaggaaaaacgttatcgacgcgagcgggagtaaagtaataattaatcggtttcggagacgaagttatttttcggaagtgttggcggtttaggttttcggtattcggacggagttttgcgattgcgtagtttttaggattgggtttagtaggaggcggtggagcggtcgtgttggggtcgacggggtattttggattatagagtcgttttattggttttttcgcgttttcggacgtcgttgacgtatttgattttcgcgatttgtaggagaagtttcggtcggggcgagggtcgaggtcgt

SEQ ID NO: 2056 - DNA, 552 bp, Artificial Sequence
  chemically treated genomic DNA (Homo sapiens) CpG-island No: 2056
acgacctcgaccctcgccccgaccgaaacttctcctacaaatcgcgaaaatcaaatacgtcaacgacgtccgaaaacgcgaaaaaaccaataaaacgactctataatccaaaataccccgtcgaccccaacacgaccgctccaccgcctcctactaaacccaatcctaaaaactacgcaatcgcaaaactccgtccgaataccgaaaacctaaaccgccaacacttccgaaaaataacttcgtctccgaaaccgattaattattactttactcccgctcgcgtcgataacgtttttcctacaacgcgtacgtactacgctactaaacaacgccataaaaaactctaaaacactaaacttcgaacacataaacatcgatccccgactccttcaaatacacgcgaaaactaaaaaaccgacttacgactctacgaaacgcgccatcgctcttcacgccgcttaaaccgcactcctaatctcctaaactatcaccgatctaaactaatcgcgacctacgctaatccaaaaaaaaaccatcccactaaccctaaaa

SEQ ID NO: 2057 - DNA, 850 bp, Artificial Sequence
  chemically treated genomic DNA (Homo sapiens) CpG-island No: 2057
cggggtttttttttttagttacggatttgggagtttatgattgcgaattcgtatattttttttagtttttttacgaagtagataggtttgtcgatgaattgagttagtatgtcggcgttgatgcgcgatttgggtaagtttattatgtttattatgattatggtttaagattgcggttggcgggaaatttacggacgattgaaattgtgcgtttcgcgggtgtttatggggtagatttttcggtattaattagcgaagattagcgttttagtttcgttaattaaatgcgcggaaatttaaatcgtaatcgcgttgtttttgaaaggggtggagaaggggttggatgagttcggaagtggagattggttgtttagtgacgcgcggcgtttcggaagttgatagatatagggcgagaggtagtggaggcgggatttggataggggcggaatttgagattatttttttgcgattataggattttcggcggtgatttgatttcggaagtggggtgtgaagtttcggtgttggtgcggcgggggattgcggggttagttttaggtatttcgtttcgcgggaggcgtcgtaattttattgtttttttatttttttcgcgaatagagttaaaagagttaggcgggagtcggtattagttgttgtcgcggtgttgtgggtgttgcgtattagttgtttattgttgtttcgtttttttttttgttagttttgcgtgggaggcgcgggagttttgcggaatgatacgtggtgtggcgtcggggttgtgatattcgtttttttggagatgggtagcggggttattagtgattttgattattttttttaggtttttgttatt

SEQ ID NO: 2058 - DNA, 850 bp, Artificial Sequence
  chemically treated genomic DNA (Homo sapiens) CpG-island No: 2058
aataacaaaaacctaaaaaaaataatcaaaatcactaataaccccgctacccatctccaaaaaaacgaatatcacaaccccgacgccacaccacgtatcattccgcaaaactcccgcgcctcccacgcaaaactaacaaaaaaaaaaacgaaacaacaataaacaactaatacgcaacacccacaacaccgcgacaacaactaataccgactcccgcctaactcttttaactctattcgcgaaaaaaataaaaaaacaataaaattacgacgcctcccgcgaaacgaaatacctaaaactaaccccgcaatcccccgccgcaccaacaccgaaacttcacaccccacttccgaaatcaaatcaccgccgaaaatcctataatcgcaaaaaaataatctcaaattccgcccctatccaaatcccgcctccactacctctcgccctatatctatcaacttccgaaacgccgcgcgtcactaaacaaccaatctccacttccgaactcatccaaccccttctccacccctttcaaaaacaacgcgattacgatttaaatttccgcgcatttaattaacgaaactaaaacgctaatcttcgctaattaataccgaaaaatctaccccataaacacccgcgaaacgcacaatttcaatcgtccgtaaatttcccgccaaccgcaatcttaaaccataatcataataaacataataaacttacccaaatcgcgcatcaacgccgacatactaactcaattcatcgacaaacctatctacttcgtaaaaaaactaaaaaaaatatacgaattcgcaatcataaactcccaaatccgtaactaaaaaaaaaaaccccg

SEQ ID NO: 2059 - DNA, 850 bp, Artificial Sequence
  chemically treated genomic DNA (Homo sapiens) CpG-island No: 2059
agtggtaaaagtttgaagaaagtgattaagattattgatgatttcgttgtttatttttaagggggcgggtattataatttcgacgttatattacgtattatttcgtaaaattttcgcgttttttacgtagaattggtaagagggaaggcgagatagtagtgaatagttggtacgtagtatttatagtatcgcggtagtagttagtgtcgattttcgtttagtttttttgattttgttcgcgggaagaatggggaaatagtaaggttgcggcgtttttcgcgagacgaggtatttgaggttggtttcgtagtttttcgtcgtattagtatcggagttttatattttattttcggggttaagttatcgtcgggaattttgtgatcgtagaaaggtagttttaggtttcgtttttatttaagtttcgtttttattgtttttcgttttgtatttgttaattttcgggacgtcgcgcgttattaagtagttaatttttattttcggatttatttagttttttttttattttttttagagatagcgcgattgcgatttaggttttcgcgtatttaattggcgaagttggagcgttagttttcgttgattggtgtcgagaaatttgttttatagatattcgcggggcgtatagttttagtcgttcgtgggtttttcgttagtcgtagttttggattataattatggtggatatgatggatttgtttaggtcgcgtattaacgtcggtatgttagtttaatttatcgataagtttgtttgtttcgtagggaggttggaaaaggtgtgcgggttcgtaattatgggtttttaagttcgtagttggagggagggatttcg

SEQ ID NO: 2060 - DNA, 850 bp, Artificial Sequence
  chemically treated genomic DNA (Homo sapiens) CpG-island No: 2060
cgaaatccctccctccaactacgaacttaaaaacccataattacgaacccgcacaccttttccaacctccctacgaaacaaacaaacttatcgataaattaaactaacataccgacgttaatacgcgacctaaacaaatccatcatatccaccataattataatccaaaactacgactaacgaaaaacccacgaacgactaaaactatacgccccgcgaatatctataaaacaaatttctcgacaccaatcaacgaaaactaacgctccaacttcgccaattaaatacgcgaaaacctaaatcgcaatcgcgctatctctaaaaaaaataaaaaaaaaactaaataaatccgaaaataaaaattaactacttaataacgcgcgacgtcccgaaaattaacaaatacaaaacgaaaaacaataaaaacgaaacttaaataaaaacgaaacctaaaactacctttctacgatcacaaaattcccgacgataacttaaccccgaaaataaaatataaaactccgatactaatacgacgaaaaactacgaaaccaacctcaaatacctcgtctcgcgaaaaacgccgcaaccttactatttccccattcttcccgcgaacaaaatcaaaaaaactaaacgaaaatcgacactaactactaccgcgatactataaatactacgtaccaactattcactactatctcgccttccctcttaccaattctacgtaaaaaacgcgaaaattttacgaaataatacgtaatataacgtcgaaattataatacccgcccccttaaaaataaacaacgaaatcatcaataatcttaatcactttcttcaaacttttaccact

SEQ ID NO: 2061 - DNA, 740 bp, Artificial Sequence
  chemically treated genomic DNA (Homo sapiens) CpG-island No: 2061
gagttcgtcgtacggagttcgaataattacgacgagtatagcgagtgacgcgcgcgagcgaagcgtacgataaagagcgtttattacgtatacgagagtacgcgtatagagttagatatatcgttatttggttagtatttcggatatgagtcgtatcgggtgttgattagataatttataaggcgataagtaaggacggatcgagcgagagatatattatagatatttgcggagtagacgcggagataagtacgagtataggatagattaagagacgcgtatagagtgatgttgttagtagatattcgatagttcgttgttatataaataggtcgtacgtatagcgtgatacgttattgtgtatagagaatcgaataagtgagatacgtatatggagtatatagtattagtacgtatgatattttatatacgtagattacgcgtattagcgcggtatgtagagcgtataacgtgagtacgagtatcgaagtatatagtatagtatagaagcgtattagtattagtacgatagtatatagtaggagcgatatgagcgtagcgcgttagtatatgattagagatagcgtacgagtagtatgtagaatagttatagatagtagagtatcgttagtaacgatagacgatgagatagttattaatattgtatagcgatagtcgtattcgtagtagagatagtgtagcgatagtagtagtagttagtatagagatagcgatagtag

SEQ ID NO: 2062 - DNA, 740 bp, Artificial Sequence
  chemically treated genomic DNA (Homo sapiens) CpG-island No: 2062
ctactatcgctatctctatactaactactactactatcgctacactatctctactacgaatacgactatcgctatacaatattaataactatctcatcgtctatcgttactaacgatactctactatctataactattctacatactactcgtacgctatctctaatcatatactaacgcgctacgctcatatcgctcctactatatactatcgtactaatactaatacgcttctatactatactatatacttcgatactcgtactcacgttatacgctctacataccgcgctaatacgcgtaatctacgtatataaaatatcatacgtactaatactatatactccatatacgtatctcacttattcgattctctatacacaataacgtatcacgctatacgtacgacctatttatataacaacgaactatcgaatatctactaacaacatcactctatacgcgtctcttaatctatcctatactcgtacttatctccgcgtctactccgcaaatatctataatatatctctcgctcgatccgtccttacttatcgccttataaattatctaatcaacacccgatacgactcatatccgaaatactaaccaaataacgatatatctaactctatacgcgtactctcgtatacgtaataaacgctctttatcgtacgcttcgctcgcgcgcgtcactcgctatactcgtcgtaattattcgaactccgtacgacgaactc

SEQ ID NO: 2063 - DNA, 740 bp, Artificial Sequence
  chemically treated genomic DNA (Homo sapiens) CpG-island No: 2063
ttgttgtcgttgtttttgtgttggttgttgttgttgtcgttgtattgtttttgttgcggatgcgattgtcgttatgtagtgttgatggttgttttatcgtttgtcgttgttgacgatgttttgttgtttgtagttgttttgtatgttattcgtgcgttgtttttgattatatgttggcgcgttgcgtttatgtcgtttttgttatatgttgtcgtattgatgttggtgcgtttttatgttatgttatatgtttcgatgttcgtgtttacgttgtgcgttttgtatgtcgcgttgatgcgcgtggtttgcgtgtgtgagatgttatgcgtgttggtgttatgtgttttatgtacgtgttttatttgttcgattttttgtgtataatggcgtgttacgttgtacgtgcgatttgtttgtatgataacggattgtcgagtgtttgttgatagtattattttgtgcgcgttttttagtttattttgtgttcgtatttgttttcgcgtttatttcgtagatgtttgtggtgtgtttttcgttcggttcgtttttgtttgtcgttttgtgggttgtttggttagtattcggtgcgatttatgttcgaggtattggttaggtagcggtgtgtttggttttgtgcgcgtgttttcgtgtacgtggtgggcgttttttgtcgtgcgtttcgttcgcgcgcgttattcgttgtgttcgtcgtgattgttcgaatttcgtgcggcggattt

SEQ ID NO: 2064 - DNA, 740 bp, Artificial Sequence
  chemically treated genomic DNA (Homo sapiens) CpG-island No: 2064
aaatccgccgcacgaaattcgaacaatcacgacgaacacaacgaataacgcgcgcgaacgaaacgcacgacaaaaaacgcccaccacgtacacgaaaacacgcgcacaaaaccaaacacaccgctacctaaccaatacctcgaacataaatcgcaccgaatactaaccaaacaacccacaaaacgacaaacaaaaacgaaccgaacgaaaaacacaccacaaacatctacgaaataaacgcgaaaacaaatacgaacacaaaataaactaaaaaacgcgcacaaaataatactatcaacaaacactcgacaatccgttatcatacaaacaaatcgcacgtacaacgtaacacgccattatacacaaaaaatcgaacaaataaaacacgtacataaaacacataacaccaacacgcataacatctcacacacgcaaaccacgcgcatcaacgcgacatacaaaacgcacaacgtaaacacgaacatcgaaacatataacataacataaaaacgcaccaacatcaatacgacaacatataacaaaaacgacataaacgcaacgcgccaacatataatcaaaaacaacgcacgaataacatacaaaacaactacaaacaacaaaacatcgtcaacaacgacaaacgataaaacaaccatcaacactacataacgacaatcgcatccgcaacaaaaacaatacaacgacaacaacaacaaccaacacaaaaacaacgacaacaa

SEQ ID NO: 2065 - DNA, 505 bp, Artificial Sequence
  chemically treated genomic DNA (Homo sapiens) CpG-island No: 2065
gtggttacggttcggtttcgtttcgcgttcgcgtaattttttttttaggttgcgttcgttttttaggttgcgcgggaggttgttttgttttttttttaggtaggtgtattcgcgattcgcggagttttcgttattttttattttacggtagcggcgtttcgtttatatttcgacgtttcggatatttaaagagttggagggtgggaaagtgcgtattttttggattcgttttagcgttattttatttcgttgtcggggattcgggcggttcggtcggggttgtttgaggcggttcgttgtcggtttagtcgttattaagttgtacgtcgggagtcgtagtttgcgtttgcgcgcgcggggtattgtggggtcgtcgtcgtcgcgtgtcgagcgttttggcgcggtcgaggggaagtagcggggttgttcgggttacgttggttattcgtatttggttttgtggtttcgattattagttagtaaggtttcggagaggttagcgaag

SEQ ID NO: 2066 - DNA, 505 bp, Artificial Sequence
  chemically treated genomic DNA (Homo sapiens) CpG-island No: 2066
cttcgctaacctctccgaaaccttactaactaataatcgaaaccacaaaaccaaatacgaataaccaacgtaacccgaacaaccccgctacttcccctcgaccgcgccaaaacgctcgacacgcgacgacgacgaccccacaataccccgcgcgcgcaaacgcaaactacgactcccgacgtacaacttaataacgactaaaccgacaacgaaccgcctcaaacaaccccgaccgaaccgcccgaatccccgacaacgaaataaaataacgctaaaacgaatccaaaaaatacgcactttcccaccctccaactctttaaatatccgaaacgtcgaaatataaacgaaacgccgctaccgtaaaataaaaaataacgaaaactccgcgaatcgcgaatacacctacctaaaaaaaaaacaaaacaacctcccgcgcaacctaaaaaacgaacgcaacctaaaaaaaaaattacgcgaacgcgaaacgaaaccgaaccgtaaccac

SEQ ID NO: 2067 - DNA, 505 bp, Artificial Sequence
  chemically treated genomic DNA (Homo sapiens) CpG-island No: 2067
tttcgttggttttttcggggttttgttgattagtggtcgaagttataggattaggtgcgggtggttagcgtaattcgggtagtttcgttgttttttttcggtcgcgttaggacgttcggtacgcggcgacgacggttttatagtgtttcgcgcgcgtaagcgtaggttgcggttttcggcgtgtagtttggtggcggttgagtcggtagcgggtcgttttaggtagtttcggtcgggtcgttcgggttttcggtagcggggtaggatggcgttaaagcggatttagaaggtacgtatttttttattttttaattttttgggtgttcgaagcgtcgaggtgtgggcggggcgtcgttgtcgtgaagtgaaaggtgacggaggtttcgcgagtcgcggatatatttgtttgggaaggaggtagaatagtttttcgcgtagtttgaaaagcgaacgtagtttgagaaagggattgcgcgagcgcggggcggggtcgggtcgtggttat

SEQ ID NO: 2068 - DNA, 505 bp, Artificial Sequence
  chemically treated genomic DNA (Homo sapiens) CpG-island No: 2068
ataaccacgacccgaccccgccccgcgctcgcgcaatccctttctcaaactacgttcgcttttcaaactacgcgaaaaactattctacctccttcccaaacaaatatatccgcgactcgcgaaacctccgtcacctttcacttcacgacaacgacgccccgcccacacctcgacgcttcgaacacccaaaaaattaaaaaataaaaaaatacgtaccttctaaatccgctttaacgccatcctaccccgctaccgaaaacccgaacgacccgaccgaaactacctaaaacgacccgctaccgactcaaccgccaccaaactacacgccgaaaaccgcaacctacgcttacgcgcgcgaaacactataaaaccgtcgtcgccgcgtaccgaacgtcctaacgcgaccgaaaaaaaacaacgaaactacccgaattacgctaaccacccgcacctaatcctataacttcgaccactaatcaacaaaaccccgaaaaaaccaacgaaa

SEQ ID NO: 2069 - DNA, 682 bp, Artificial Sequence
  chemically treated genomic DNA (Homo sapiens) CpG-island No: 2069
ttgattcgtaaagacggttgtatgtattgtttcgatttaggttgtttgaaagcgtgttcggcggaaggtgtaattatttagtatgttaacggtatcgtcgatttttagttcgagtagtgtattggttgcggttattgtattgcgggttgttcgttcgatatttcgcgttttaattcggaagataatcgcgtttataaatgtacgttgtgcgttgatcgcgtggtggttgtgtaagaattagtttgcgtgaagatttgtttaacgggcgcgatttatttcggtacgaaagagtcgatgaatacgttggcgagcgagcgcgtcgttgagttgaaaattcgcgggtacgataatgcgcgtttgtacgattcggatgcgtcggtcgtattttgtcgtgtgaggacgtattacgttgaatagtttatcgttatatggtttttcgagaatcggaattttttaaattttaattttggtaatttttggggatttttttcgtttacggtttttgtttttttttcggtcgatttttacgtttcggggggcgggattaatcgtcgcgaggggtaaatttatcgttcgtttaaatgcgggcgtttataaatatttgcggtcggtggggttttttttttcggggttgtggtatatagatttttttttttatttcgtcgtagggttatgcgttttt

SEQ ID NO: 2070 - DNA, 682 bp, Artificial Sequence
  chemically treated genomic DNA (Homo sapiens) CpG-island No: 2070
aaaaacgcataaccctacgacgaaataaaaaaaaaaatctatataccacaaccccgaaaaaaaaaaccccaccgaccgcaaatatttataaacgcccgcatttaaacgaacgataaatttacccctcgcgacgattaatcccgccccccgaaacgtaaaaatcgaccgaaaaaaaaacaaaaaccgtaaacgaaaaaaatccccaaaaattaccaaaattaaaatttaaaaaattccgattctcgaaaaaccatataacgataaactattcaacgtaatacgtcctcacacgacaaaatacgaccgacgcatccgaatcgtacaaacgcgcattatcgtacccgcgaattttcaactcaacgacgcgctcgctcgccaacgtattcatcgactctttcgtaccgaaataaatcgcgcccgttaaacaaatcttcacgcaaactaattcttacacaaccaccacgcgatcaacgcacaacgtacatttataaacgcgattatcttccgaattaaaacgcgaaatatcgaacgaacaacccgcaatacaataaccgcaaccaatacactactcgaactaaaaatcgacgataccgttaacatactaaataattacaccttccgccgaacacgctttcaaacaacctaaatcgaaacaatacatacaaccgtctttacgaatcaa

SEQ ID NO: 2071 - DNA, 682 bp, Artificial Sequence
  chemically treated genomic DNA (Homo sapiens) CpG-island No: 2071
aggagcgtatgattttgcggcgagatggaggagagggtttgtatgttatagtttcggaggggagggttttatcggtcgtaggtgtttgtgggcgttcgtatttaggcgggcgatggatttgtttttcgcgacggttggtttcgtttttcgagacgtggaaatcggtcgggaggggagtagaaatcgtaagcgggaggggtttttaggggttgttagagttagagtttggagagtttcggttttcgggaggttatgtgacgatgggttgtttagcgtggtgcgtttttatacgatagggtacgatcggcgtattcggatcgtatagacgcgtattgtcgtattcgcgggtttttagtttagcgacgcgttcgttcgttagcgtgtttatcgattttttcgtatcgaagtgaatcgcgttcgttgggtaggtttttacgtaggttggtttttgtataattattacgcggttaacgtatagcgtatatttgtagacgcggttgtttttcgggttgaggcgcggaatgtcgaacggatagttcgtaatgtaataatcgtagttaatgtattgttcggattggaagtcgacgatatcgttggtatattgaataattgtatttttcgtcgggtacgtttttaggtagtttggatcggaatagtgtatatagtcgtttttgcggattag

SEQ ID NO: 2072 - DNA, 682 bp, Artificial Sequence
  chemically treated genomic DNA (Homo sapiens) CpG-island No: 2072
ctaatccgcaaaaacgactatatacactattccgatccaaactacctaaaaacgtacccgacgaaaaatacaattattcaatataccaacgatatcgtcgacttccaatccgaacaatacattaactacgattattacattacgaactatccgttcgacattccgcgcctcaacccgaaaaacaaccgcgtctacaaatatacgctatacgttaaccgcgtaataattatacaaaaaccaacctacgtaaaaacctacccaacgaacgcgattcacttcgatacgaaaaaatcgataaacacgctaacgaacgaacgcgtcgctaaactaaaaacccgcgaatacgacaatacgcgtctatacgatccgaatacgccgatcgtaccctatcgtataaaaacgcaccacgctaaacaacccatcgtcacataacctcccgaaaaccgaaactctccaaactctaactctaacaacccctaaaaacccctcccgcttacgatttctactcccctcccgaccgatttccacgtctcgaaaaacgaaaccaaccgtcgcgaaaaacaaatccatcgcccgcctaaatacgaacgcccacaaacacctacgaccgataaaaccctcccctccgaaactataacatacaaaccctctcctccatctcgccgcaaaatcatacgctcct

SEQ ID NO: 2073 - DNA, 619 bp, Artificial Sequence
  chemically treated genomic DNA (Homo sapiens) CpG-island No: 2073
cgggtggcgcgttgggtttcggttcgttattattaagatttgaggatcgcgcgagttcgggaggaaggcggttgagttttcgttatcggtcgattgatgagaaggggtcgcggttgatttcggtttttaggtacgggagattgtcgggaaagtcgtcggcgacggagggcgacgcgttggtttcggagtttttatttttatttcgacgatcgtttttttttttcgtttcgatttattttcgaaattttgttagaattcgacgatttttatattgtttattcgagcgcggaggtgatgtcgtttttatcgtaggagcgagcgtcgcgtcgttaggaggcggttgaggtgcgcgcgggagatttcgaagttagcgtcgtcgttaatagagtttaaggagttataacgaggttgttcgcgggcgcgttgtttttagagggttgttttattttttttttcgtaggattttgcgtcggagtttgtagttattgcgcgcgggtagggaggatgggaggaggggcggggcgtttcgagagggcggagttgagcgtcggttgttttgattaatatttgtgggtttaatgggagtacggaaattttaggttgattttggattgatttt

SEQ ID NO: 2074 - DNA, 619 bp, Artificial Sequence
  chemically treated genomic DNA (Homo sapiens) CpG-island No: 2074
aaaatcaatccaaaatcaacctaaaatttccgtactcccattaaacccacaaatattaatcaaaacaaccgacgctcaactccgccctctcgaaacgccccgcccctcctcccatcctccctacccgcgcgcaataactacaaactccgacgcaaaatcctacgaaaaaaaaaataaaacaaccctctaaaaacaacgcgcccgcgaacaacctcgttataactccttaaactctattaacgacgacgctaacttcgaaatctcccgcgcgcacctcaaccgcctcctaacgacgcgacgctcgctcctacgataaaaacgacatcacctccgcgctcgaataaacaatataaaaatcgtcgaattctaacaaaatttcgaaaataaatcgaaacgaaaaaaaaaaacgatcgtcgaaataaaaataaaaactccgaaaccaacgcgtcgccctccgtcgccgacgactttcccgacaatctcccgtacctaaaaaccgaaatcaaccgcgaccccttctcatcaatcgaccgataacgaaaactcaaccgccttcctcccgaactcgcgcgatcctcaaatcttaataataacgaaccgaaacccaacgcgccacccg

SEQ ID NO: 2075 - DNA, 619 bp, Artificial Sequence
  chemically treated genomic DNA (Homo sapiens) CpG-island No: 2075
gaagttagtttaagattagtttggagttttcgtgtttttattgggtttatagatgttaattagagtagtcggcgtttagtttcgttttttcgggacgtttcgtttttttttttattttttttgttcgcgcgtagtgattgtaggtttcggcgtaaaattttgcgggagagggggtggggtaattttttggaggtagcgcgttcgcgggtagtttcgttgtggttttttgggttttgttggcggcggcgttagtttcggagtttttcgcgcgtattttagtcgttttttagcggcgcggcgttcgtttttacggtaagagcggtattattttcgcgttcgggtgggtagtgtggaggtcgtcgagttttgatagaatttcgaggatggatcgggacgagggaggagagcggtcgtcgggatggaggtgggggtttcggggttaacgcgtcgtttttcgtcgtcggcgattttttcggtagtttttcgtatttgagggtcggggttagtcgcgatttttttttattagtcggtcggtggcggaggtttagtcgtttttttttcgagttcgcgcggtttttaagttttgatggtgacgggtcgaagtttagcgcgttattcg

SEQ ID NO: 2076 - DNA, 619 bp, Artificial Sequence
  chemically treated genomic DNA (Homo sapiens) CpG-island No: 2076
cgaataacgcgctaaacttcgacccgtcaccatcaaaacttaaaaaccgcgcgaactcgaaaaaaaaacgactaaacctccgccaccgaccgactaataaaaaaaaatcgcgactaaccccgaccctcaaatacgaaaaactaccgaaaaaatcgccgacgacgaaaaacgacgcgttaaccccgaaacccccacctccatcccgacgaccgctctcctccctcgtcccgatccatcctcgaaattctatcaaaactcgacgacctccacactacccacccgaacgcgaaaataataccgctcttaccgtaaaaacgaacgccgcgccgctaaaaaacgactaaaatacgcgcgaaaaactccgaaactaacgccgccgccaacaaaacccaaaaaaccacaacgaaactacccgcgaacgcgctacctccaaaaaattaccccaccccctctcccgcaaaattttacgccgaaacctacaatcactacgcgcgaacaaaaaaaataaaaaaaaaaacgaaacgtcccgaaaaaacgaaactaaacgccgactactctaattaacatctataaacccaataaaaacacgaaaactccaaactaatcttaaactaacttc

SEQ ID NO: 2077 - DNA, 547 bp, Artificial Sequence
  chemically treated genomic DNA (Homo sapiens) CpG-island No: 2077
aaaatttcgtcggtgtttaattatattatttttttagattattttttttttttcgcgcggcggggagggagagaagcggggtttttttttatcgcgtttacgtattttaggttattcgcgcggtcggaggttatattcgcggcggggataattttttgttcgatttttttatatattcgttttgttttttatttcgcgttggaaagcgcgcggggaagagaagaagaaaatttttttattttcgttcgtttttgtattcgcgagatatatagagcgtcgtcgcgcggttagcgcgagcgcgaagtagatagcgattattcgttttcgcgagacgtcgcggtttcgcgagcgacgttcgaggaggattgcggaggatagttagacgatattaggagtcgcgacgtagcggtagtacgtagatcgagtttatagtagcgttgcgtagcgcgtacggagcgagtaagcgtgtcgatgaagcgcgatcgacggtcgacggtcgaagagatagatatttcgacgcgcgagtaacgagcgagttacgataagt

SEQ ID NO: 2078 - DNA, 547 bp, Artificial Sequence
  chemically treated genomic DNA (Homo sapiens) CpG-island No: 2078
acttatcgtaactcgctcgttactcgcgcgtcgaaatatctatctcttcgaccgtcgaccgtcgatcgcgcttcatcgacacgcttactcgctccgtacgcgctacgcaacgctactataaactcgatctacgtactaccgctacgtcgcgactcctaatatcgtctaactatcctccgcaatcctcctcgaacgtcgctcgcgaaaccgcgacgtctcgcgaaaacgaataatcgctatctacttcgcgctcgcgctaaccgcgcgacgacgctctatatatctcgcgaatacaaaaacgaacgaaaataaaaaaattttcttcttctcttccccgcgcgctttccaacgcgaaataaaaaacaaaacgaatatataaaaaaatcgaacaaaaaattatccccgccgcgaatataacctccgaccgcgcgaataacctaaaatacgtaaacgcgataaaaaaaaaccccgcttctctccctccccgccgcgcgaaaaaaaaaaaataatctaaaaaaataatataattaaacaccgacgaaatttt

SEQ ID NO: 2079 - DNA, 547 bp, Artificial Sequence
  chemically treated genomic DNA (Homo sapiens) CpG-island No: 2079
atttgtcgtggttcgttcgttgttcgcgcgtcgaggtgtttgttttttcgatcgtcggtcgtcggtcgcgttttatcgatacgtttgttcgtttcgtacgcgttgcgtagcgttgttgtgagttcggtttgcgtgttgtcgttgcgtcgcgatttttggtatcgtttggttgtttttcgtagtttttttcgagcgtcgttcgcggagtcgcggcgtttcgcgggggcgagtggtcgttgtttgtttcgcgttcgcgttgatcgcgcgacgacgttttgtgtgtttcgcgagtgtagaggcgagcgggggtagaggggttttttttttttttttttcgcgcgttttttagcgcggggtgggaggtagagcgggtgtgtgagggggtcgaataaagggttgttttcgtcgcgggtgtggttttcgatcgcgcgggtgatttggggtgcgtgggcgcggtgggggggggtttcgttttttttttttttcgtcgcgcggaaaagggggggtggtttagaggagtaatatagttgggtatcggcggggtttt

SEQ ID NO: 2080 - DNA, 547 bp, Artificial Sequence
  chemically treated genomic DNA (Homo sapiens) CpG-island No: 2080
aaaaccccgccgatacccaactatattactcctctaaaccacccccccttttccgcgcgacgaaaaaaaaaaaaaacgaaacccccccccaccgcgcccacgcaccccaaatcacccgcgcgatcgaaaaccacacccgcgacgaaaacaaccctttattcgaccccctcacacacccgctctacctcccaccccgcgctaaaaaacgcgcgaaaaaaaaaaaaaaaaaacccctctacccccgctcgcctctacactcgcgaaacacacaaaacgtcgtcgcgcgatcaacgcgaacgcgaaacaaacaacgaccactcgcccccgcgaaacgccgcgactccgcgaacgacgctcgaaaaaaactacgaaaaacaaccaaacgataccaaaaatcgcgacgcaacgacaacacgcaaaccgaactcacaacaacgctacgcaacgcgtacgaaacgaacaaacgtatcgataaaacgcgaccgacgaccgacgatcgaaaaaacaaacacctcgacgcgcgaacaacgaacgaaccacgacaaat

SEQ ID NO: 2081 - DNA, 919 bp, Artificial Sequence
  chemically treated genomic DNA (Homo sapiens) CpG-island No: 2081
gtcgacggacggaaaggtcggcgcgtacgggcgtggtgcggcggggataggaggtagttacgggcgtattttagggttagtatataatgggtcgcgtaggtcgggtaggcgtttagttgggacgtcgtcgtattacgtgggttgtagagcgtacggggtaggtagttgtcggtggtttagggcgggcgttgcgcggttagcgttcgtgcgtgcgtgcgcgcgcgcgcgtgcgcgtgtttgcgtttaagggatttgcgattaggcggcgcggcggatagttcggcggcggggcggggggagttatattgcggggttttttttcgtttattttggtttttttcggagcggagacggtaaatggcggatttcgatatttacgacgatcgggtttatagtagtttcggcggcggtagagggtgaggcgggcgtgcgcgggtttcgtcgggggttgcgggatcggcggagtcggggtcgttagggtggcggtcgttttgcgtttagtcggggcggcgggaggcgggggttcgcggaggtttaggagcggcgtttggagggtcggggtttggaaatggcgcgttcggagacggggcggcggcggttgggttttcggggttttgtttgcggggcggattttttttattgtttttcgttaacgataacgtgttggtttttgttttgttttggtcgcggcggcgtcgatgttcggagacgagcgttcgtttttagttttattttttttacggtaggattagtgcggggttgagttgtggcgttggggtacgggttatacggtttgtttcgtttcggtttcggtttttttcgcggttttttgttgtttgttcgttttgtaggtttttggttttttcgttacgaggtcggtcgattggggaaggtcggtagttaagaggggcgatttttt

SEQ ID NO: 2082 - DNA, 919 bp, Artificial Sequence
  chemically treated genomic DNA (Homo sapiens) CpG-island No: 2082
aaaaaatcgcccctcttaactaccgaccttccccaatcgaccgacctcgtaacgaaaaaaccaaaaacctacaaaacgaacaaacaacaaaaaaccgcgaaaaaaaccgaaaccgaaacgaaacaaaccgtataacccgtaccccaacgccacaactcaaccccgcactaatcctaccgtaaaaaaaataaaactaaaaacgaacgctcgtctccgaacatcgacgccgccgcgaccaaaacaaaacaaaaaccaacacgttatcgttaacgaaaaacaataaaaaaaatccgccccgcaaacaaaaccccgaaaacccaaccgccgccgccccgtctccgaacgcgccatttccaaaccccgaccctccaaacgccgctcctaaacctccgcgaacccccgcctcccgccgccccgactaaacgcaaaacgaccgccaccctaacgaccccgactccgccgatcccgcaacccccgacgaaacccgcgcacgcccgcctcaccctctaccgccgccgaaactactataaacccgatcgtcgtaaatatcgaaatccgccatttaccgtctccgctccgaaaaaaaccaaaataaacgaaaaaaaaccccgcaatataactccccccgccccgccgccgaactatccgccgcgccgcctaatcgcaaatcccttaaacgcaaacacgcgcacgcgcgcgcgcgcacgcacgcacgaacgctaaccgcgcaacgcccgccctaaaccaccgacaactacctaccccgtacgctctacaacccacgtaatacgacgacgtcccaactaaacgcctacccgacctacgcgacccattatatactaaccctaaaatacgcccgtaactacctcctatccccgccgcaccacgcccgtacgcgccgacctttccgtccgtcgac

SEQ ID NO: 2083 - DNA, 919 bp, Artificial Sequence
  chemically treated genomic DNA (Homo sapiens) CpG-island No: 2083
agggaatcgttttttttggttgtcgattttttttagtcggtcggtttcgtggcgaaggggttaggggtttgtaaggcgggtaggtaatagagggtcgcgaaagaggtcgggatcggagcggggtaggtcgtgtggttcgtattttagcgttatagtttagtttcgtattggttttatcgtaggggggatggggttggaagcgggcgttcgttttcgggtatcggcgtcgtcgcggttaaggtagggtaaaaattaatacgttgtcgttggcgggaggtagtggaagggattcgtttcgtaagtaagatttcgggagtttagtcgtcgtcgtttcgttttcgagcgcgttatttttaggtttcggttttttaggcgtcgtttttaggttttcgcgggttttcgtttttcgtcgtttcggttgagcgtaggacggtcgttattttgacggtttcgatttcgtcggtttcgtagttttcgacggggttcgcgtacgttcgttttattttttgtcgtcgtcgaagttgttgtaggttcgatcgtcgtaggtgtcgaagttcgttatttgtcgttttcgtttcgagaggaattagggtgagcgaggaaggatttcgtaatataatttttttcgtttcgtcgtcgggttgttcgtcgcgtcgtttgatcgtaaattttttggacgtaggtacgcgtacgcgcgcgcgcgtacgtacgtacggacgttggtcgcgtagcgttcgttttgggttatcggtagttgtttgtttcgtgcgttttgtagtttacgtggtgcggcggcgttttagttggacgtttgttcggtttacgcggtttattatgtgttggttttggggtgcgttcgtggttgttttttattttcgtcgtattacgttcgtgcgcgtcggttttttcgttcgtcggt

SEQ ID NO: 2084 - DNA, 919 bp, Artificial Sequence
  chemically treated genomic DNA (Homo sapiens) CpG-island No: 2084
accgacgaacgaaaaaaccgacgcgcacgaacgtaatacgacgaaaataaaaaacaaccacgaacgcaccccaaaaccaacacataataaaccgcgtaaaccgaacaaacgtccaactaaaacgccgccgcaccacgtaaactacaaaacgcacgaaacaaacaactaccgataacccaaaacgaacgctacgcgaccaacgtccgtacgtacgtacgcgcgcgcgcgtacgcgtacctacgtccaaaaaatttacgatcaaacgacgcgacgaacaacccgacgacgaaacgaaaaaaattatattacgaaatccttcctcgctcaccctaattcctctcgaaacgaaaacgacaaataacgaacttcgacacctacgacgatcgaacctacaacaacttcgacgacgacaaaaaataaaacgaacgtacgcgaaccccgtcgaaaactacgaaaccgacgaaatcgaaaccgtcaaaataacgaccgtcctacgctcaaccgaaacgacgaaaaacgaaaacccgcgaaaacctaaaaacgacgcctaaaaaaccgaaacctaaaaataacgcgctcgaaaacgaaacgacgacgactaaactcccgaaatcttacttacgaaacgaatcccttccactacctcccgccaacgacaacgtattaatttttaccctaccttaaccgcgacgacgccgatacccgaaaacgaacgcccgcttccaaccccatcccccctacgataaaaccaatacgaaactaaactataacgctaaaatacgaaccacacgacctaccccgctccgatcccgacctctttcgcgaccctctattacctacccgccttacaaacccctaaccccttcgccacgaaaccgaccgactaaaaaaaatcgacaaccaaaaaaaacgattccct

SEQ ID NO: 2085 - DNA, 605 bp, Artificial Sequence
  chemically treated genomic DNA (Homo sapiens) CpG-island No: 2085
tttcggcgttaattgtatttattaggtttggttaatatagagtcgcgttaattttttgaggttgcgttaagatttgaagcggcggatcgagagttcgggtttgagattgagagagtaacggaatggaggcggggtagaggcggaaatataatttgtagggttagagcgaggcgcgagaaggacggcggcgtgagggggcggggcgcgtagcgcgagaaggtaggtacgaggggcgagcgcgaggcggggtacggcgcgtggcgtgagacggggcggggcgcgcgtatcggcgcgcggtcgcgtgacgcgtttttaaatttttaatcgtcgtagtttattcgtttgtgttttgcgtttttttttttcgcgttttggagtcggattcggtttcggaaattcgatttgtagacgcggtatttttattgcgtagaggtcgtagttggcggaaggagagaggcggtcgttttgttaataggtcgggggaagtcgtgttttcgcggttgttcggtgcgatatttttttcggatttagtatgtaggtgtcgggcgattgttatgaatttcggagttatgaggatttatagtaaaggatatttttagggtaag

SEQ ID NO: 2086 - DNA, 605 bp, Artificial Sequence
  chemically treated genomic DNA (Homo sapiens) CpG-island No: 2086
cttaccctaaaaatatcctttactataaatcctcataactccgaaattcataacaatcgcccgacacctacatactaaatccgaaaaaaatatcgcaccgaacaaccgcgaaaacacgacttcccccgacctattaacaaaacgaccgcctctctccttccgccaactacgacctctacgcaataaaaataccgcgtctacaaatcgaatttccgaaaccgaatccgactccaaaacgcgaaaaaaaaaaacgcaaaacacaaacgaataaactacgacgattaaaaatttaaaaacgcgtcacgcgaccgcgcgccgatacgcgcgccccgccccgtctcacgccacgcgccgtaccccgcctcgcgctcgcccctcgtacctaccttctcgcgctacgcgccccgccccctcacgccgccgtccttctcgcgcctcgctctaaccctacaaattatatttccgcctctaccccgcctccattccgttactctctcaatctcaaacccgaactctcgatccgccgcttcaaatcttaacgcaacctcaaaaaattaacgcgactctatattaaccaaacctaataaatacaattaacgccgaaa

SEQ ID NO: 2087 - DNA, 605 bp, Artificial Sequence
  chemically treated genomic DNA (Homo sapiens) CpG-island No: 2087
tttattttggaaatgttttttattgtggatttttatggtttcggagtttatggtagtcgttcggtatttatatgttgggttcggagaaagtgtcgtatcgggtagtcgcgaaagtacggtttttttcggtttgttgataggacggtcgttttttttttttcgttagttacggtttttacgtagtagaggtatcgcgtttgtaggtcgggttttcggggtcggattcggttttaaggcgcggaggaggaaggcgtaaagtataaacgagtgggttgcggcggttgaagatttgaaaacgcgttacgcggtcgcgcgtcgatacgcgcgtttcgtttcgttttacgttacgcgtcgtgtttcgtttcgcgttcgtttttcgtgtttgttttttcgcgttgcgcgtttcgtttttttacgtcgtcgtttttttcgcgtttcgttttggttttgtaggttgtgttttcgtttttatttcgtttttatttcgttgtttttttagttttagattcgggttttcggttcgtcgttttaggttttggcgtagttttagagagttggcgcggttttgtgttgattaaatttagtggatgtagttagcgtcggag

SEQ ID NO: 2088 - DNA, 605 bp, Artificial Sequence
  chemically treated genomic DNA (Homo sapiens) CpG-island No: 2088
ctccgacgctaactacatccactaaatttaatcaacacaaaaccgcgccaactctctaaaactacgccaaaacctaaaacgacgaaccgaaaacccgaatctaaaactaaaaaaacaacgaaataaaaacgaaataaaaacgaaaacacaacctacaaaaccaaaacgaaacgcgaaaaaaacgacgacgtaaaaaaacgaaacgcgcaacgcgaaaaaacaaacacgaaaaacgaacgcgaaacgaaacacgacgcgtaacgtaaaacgaaacgaaacgcgcgtatcgacgcgcgaccgcgtaacgcgttttcaaatcttcaaccgccgcaacccactcgtttatactttacgccttcctcctccgcgccttaaaaccgaatccgaccccgaaaacccgacctacaaacgcgatacctctactacgtaaaaaccgtaactaacgaaaaaaaaaaaacgaccgtcctatcaacaaaccgaaaaaaaccgtactttcgcgactacccgatacgacactttctccgaacccaacatataaataccgaacgactaccataaactccgaaaccataaaaatccacaataaaaaacatttccaaaataaa

SEQ ID NO: 2089 - DNA, 510 bp, Artificial Sequence
  chemically treated genomic DNA (Homo sapiens) CpG-island No: 2089
cgcgacggttcgtgtcgtcgtggagataagcgggatacggagagagaattatattttttagttgatttttttgcgcgcgtttttgtttgcgcgcggggggcgagtgtatcgggcgttcgttttttgtcgagtttttgtcgttcgttcgagtttttgttaggggatgaggtgggaggcgttagaaattatttagttatagttaatcgtttaatgtagtattcgttcgtttttttcgttagcggaagcgttcgcgaagtataatgtagtattgagtcgcggtggaggttgtagcgttacggtcgtcgtagtatcggtcggggttgggtggaggtggcgcggggatttcgggggcgcggagcgagggaaacggattcggcggcgtcggtatgaggagttgagcgtttcgggcgaggcgggttgacggtagtattatgtaggcggtagtggttgtgttcgtgttttttttgttgttttgtgttttggggatttgtttttcggcgcgttgcggtt

SEQ ID NO: 2090 - DNA, 510 bp, Artificial Sequence
  chemically treated genomic DNA (Homo sapiens) CpG-island No: 2090
aaccgcaacgcgccgaaaaacaaatccccaaaacacaaaacaacaaaaaaaacacgaacacaaccactaccgcctacataatactaccgtcaacccgcctcgcccgaaacgctcaactcctcataccgacgccgccgaatccgtttccctcgctccgcgcccccgaaatccccgcgccacctccacccaaccccgaccgatactacgacgaccgtaacgctacaacctccaccgcgactcaatactacattatacttcgcgaacgcttccgctaacgaaaaaaacgaacgaatactacattaaacgattaactataactaaataatttctaacgcctcccacctcatcccctaacaaaaactcgaacgaacgacaaaaactcgacaaaaaacgaacgcccgatacactcgccccccgcgcgcaaacaaaaacgcgcgcaaaaaaatcaactaaaaaatataattctctctccgtatcccgcttatctccacgacgacacgaaccgtcgcg

SEQ ID NO: 2091 - DNA, 510 bp, Artificial Sequence
  chemically treated genomic DNA (Homo sapiens) CpG-island No: 2091
ggtcgtagcgcgtcggagggtaggtttttaggatatagagtagtaagaaaggtacggatatagttattgtcgtttgtatggtgttgtcgttagttcgtttcgttcgagacgtttagttttttatgtcggcgtcgtcgagttcgtttttttcgtttcgcgttttcggggttttcgcgttatttttatttagtttcggtcggtgttgcggcggtcgtggcgttgtaatttttatcgcggtttagtgttgtattgtgtttcgcggacgttttcgttggcggggggagcgagcgagtgttgtattgggcggttggttgtagttaagtggtttttagcgttttttattttattttttggtaaaggttcgggcgggcgataagagttcggtagggagcgagcgttcggtgtattcgtttttcgcgcgtaggtaagggcgcgcgtaggagagttagttgggaaatgtagtttttttttcgtgtttcgtttgtttttacgacggtacggatcgtcgcg

SEQ ID NO: 2092 - DNA, 510 bp, Artificial Sequence
  chemically treated genomic DNA (Homo sapiens) CpG-island No: 2092
cgcgacgatccgtaccgtcgtaaaaacaaacgaaacacgaaaaaaaaactacatttcccaactaactctcctacgcgcgcccttacctacgcgcgaaaaacgaatacaccgaacgctcgctccctaccgaactcttatcgcccgcccgaacctttaccaaaaaataaaataaaaaacgctaaaaaccacttaactacaaccaaccgcccaatacaacactcgctcgctccccccgccaacgaaaacgtccgcgaaacacaatacaacactaaaccgcgataaaaattacaacgccacgaccgccgcaacaccgaccgaaactaaataaaaataacgcgaaaaccccgaaaacgcgaaacgaaaaaaacgaactcgacgacgccgacataaaaaactaaacgtctcgaacgaaacgaactaacgacaacaccatacaaacgacaataactatatccgtacctttcttactactctatatcctaaaaacctaccctccgacgcgctacgacc

SEQ ID NO: 2093 - DNA, 592 bp, Artificial Sequence
  chemically treated genomic DNA (Homo sapiens) CpG-island No: 2093
ttcgttcgttttagttttttattttttaaagatcggttttatattttcgtatttttttatttttttcgtttttttatttttttatttttttatattttttttatttttatttttttttttttataattttttaattcgtttttttttttttttaatttttttttcgattatttatattatgttttattatatttatattgttttatatcgtttttatcgatcgattatcgttttttttattttttttttaatcgtattttatttttttttatcgtaatttttttttttttcgtcgcgttagttaattttatttttttttttttttatttttttttttatttttattatttttttttttttatttttataattatatttattcgtttagttttttcgcgttttttttattattttttttttttttttatatagtttttattcgatttcgttttgttattttttttttttatacggttcgtcgcgtttgttttttcgtttatatattatttttatgttttttcgtatattttatttacgttatttttttgtttttattttatatattttatttttttttagtgtttattttatt

SEQ ID NO: 2094 - DNA, 592 bp, Artificial Sequence
  chemically treated genomic DNA (Homo sapiens) CpG-island No: 2094
aataaaataaacactaaaaaaaaataaaatatataaaataaaaacaaaaaaataacgtaaataaaatatacgaaaaaacataaaaataatatataaacgaaaaaacaaacgcgacgaaccgtataaaaaaaaaaaataacaaaacgaaatcgaataaaaactatataaaaaaaaaaaaaaaataataaaaaaaacgcgaaaaaactaaacgaataaatataattataaaaataaaaaaaaaaaaataataaaaataaaaaaaaaaataaaaaaaaaaaaaaataaaattaactaacgcgacgaaaaaaaaaaaaattacgataaaaaaaaataaaatacgattaaaaaaaaaataaaaaaaacgataatcgatcgataaaaacgatataaaacaatataaatataataaaacataatataaataatcgaaaaaaaaattaaaaaaaaaaaaaaacgaattaaaaaattataaaaaaaaaaaaataaaaataaaaaaaatataaaaaaataaaaaaataaaaaaacgaaaaaaataaaaaaatacgaaaatataaaaccgatctttaaaaaataaaaaactaaaacgaacgaa

SEQ ID NO: 2095 - DNA, 592 bp, Artificial Sequence
  chemically treated genomic DNA (Homo sapiens) CpG-island No: 2095
agtggagtgggtattaggagagggtgaggtatgtggggtgagggtaggagagtggcgtgggtggggtgtgcgagggggtatgggggtggtatgtgagcggggaggtaggcgcggcgggtcgtgtagaggaggagggtagtagagcggggtcggatagaagttgtgtgagggaggggagggggtggtgaaggagacgcgaggaggttgggcggatgagtgtagttgtgaaggtggggggggaggggtagtgagggtggggaggggggtgagagggggagggggtggagttaattaacgcggcggggaaggggggggttgcgatagggggaagtagggtgcgattagggagagggtgagggagacggtggtcggtcggtgaggacgatgtgagataatgtgggtgtggtaggatatggtgtaagtgatcggggggagggttaggggaaaggaggggcgagttggagggttgtgggaggagaagggtaggggtgagggagatgtaggggagtaagggggtgaaaggacggggaggatgggggggtacgaggatgtggggtcggtttttggaagatagagaattaggacggacggg

SEQ ID NO: 2096 - DNA, 592 bp, Artificial Sequence
  chemically treated genomic DNA (Homo sapiens) CpG-island No: 2096
cccgtccgtcctaattctctatcttccaaaaaccgaccccacatcctcgtacccccccatcctccccgtcctttcacccccttactcccctacatctccctcacccctacccttctcctcccacaaccctccaactcgcccctcctttcccctaaccctccccccgatcacttacaccatatcctaccacacccacattatctcacatcgtcctcaccgaccgaccaccgtctccctcaccctctccctaatcgcaccctacttccccctatcgcaaccccccccttccccgccgcgttaattaactccaccccctccccctctcacccccctccccaccctcactacccctccccccccaccttcacaactacactcatccgcccaacctcctcgcgtctccttcaccaccccctcccctccctcacacaacttctatccgaccccgctctactaccctcctcctctacacgacccgccgcgcctacctccccgctcacataccacccccataccccctcgcacaccccacccacgccactctcctaccctcaccccacatacctcaccctctcctaatacccactccact

SEQ ID NO: 2097 - DNA, 563 bp, Artificial Sequence
  chemically treated genomic DNA (Homo sapiens) CpG-island No: 2097
tcgacgatttggattatttttcgggttatttttatttggagatgtagttgaatttcgagtcgcgttcgtcggttttatagcgcgttcgggatttgaagttgtagcgggagggtttgcggtaggagttttagttggcggtcgtttcgtagcgtttcgttgtgcgttattttttgggcgttttcgtattttatttggaggagttggacgaggttcgcgagtgttttttcgaggtggtttacgagtattcgggtaattttaatgtttgggttaatttggtatacgtgtacgggcggttgggttaggaagaagaggaggaggcgtgcgtcgtacggttggtcgattttatgggtttggtagaggagttcgaggtcgtcggggatttttagtttcgcgtcgttcgttgtttggtcgagtagggttacgcgtatggtttcgacgtcggttgcgttagtttagaggagcgtgcgcgggggttggcggtaggtatcgcgttttacgataaggcgttaggttacgggtagtaggtaggtgatttttgtttttttatttttttttgggaggat

SEQ ID NO: 2098 - DNA, 563 bp, Artificial Sequence
  chemically treated genomic DNA (Homo sapiens) CpG-island No: 2098
atcctcccaaaaaaaaataaaaaaacaaaaatcacctacctactacccgtaacctaacgccttatcgtaaaacgcgatacctaccgccaacccccgcgcacgctcctctaaactaacgcaaccgacgtcgaaaccatacgcgtaaccctactcgaccaaacaacgaacgacgcgaaactaaaaatccccgacgacctcgaactcctctaccaaacccataaaatcgaccaaccgtacgacgcacgcctcctcctcttcttcctaacccaaccgcccgtacacgtataccaaattaacccaaacattaaaattacccgaatactcgtaaaccacctcgaaaaaacactcgcgaacctcgtccaactcctccaaataaaatacgaaaacgcccaaaaaataacgcacaacgaaacgctacgaaacgaccgccaactaaaactcctaccgcaaaccctcccgctacaacttcaaatcccgaacgcgctataaaaccgacgaacgcgactcgaaattcaactacatctccaaataaaaataacccgaaaaataatccaaatcgtcga

SEQ ID NO: 2099 - DNA, 563 bp, Artificial Sequence
  chemically treated genomic DNA (Homo sapiens) CpG-island No: 2099
gtttttttagagggaggtagggagataggggttatttatttgttgttcgtagtttagcgttttgtcgtagagcgcgatgtttgtcgttagttttcgcgtacgtttttttgggttggcgtagtcgacgtcgaagttatgcgcgtagttttgttcggttaggtagcgagcggcgcggagttgggggttttcggcggtttcgggtttttttgttaggtttatgaggtcggttagtcgtgcggcgtacgttttttttttttttttttggtttagtcgttcgtatacgtgtgttagattggtttaggtattgaggttgttcgggtgttcgtgggttatttcgaggaagtattcgcgggtttcgtttagtttttttaggtagaatgcgaaagcgtttaggaggtgacgtatagcggggcgttgcggggcggtcgttagttggagtttttgtcgtagattttttcgttgtagttttaggtttcgggcgcgttgtggggtcggcgagcgcggttcgaagtttaattgtatttttaggtgaaagtggttcgggaggtagtttaggtcgtcga

SEQ ID NO: 2100 - DNA, 563 bp, Artificial Sequence
  chemically treated genomic DNA (Homo sapiens) CpG-island No: 2100
tcgacgacctaaactacctcccgaaccactttcacctaaaaatacaattaaacttcgaaccgcgctcgccgaccccacaacgcgcccgaaacctaaaactacaacgaaaaaatctacgacaaaaactccaactaacgaccgccccgcaacgccccgctatacgtcacctcctaaacgctttcgcattctacctaaaaaaactaaacgaaacccgcgaatacttcctcgaaataacccacgaacacccgaacaacctcaatacctaaaccaatctaacacacgtatacgaacgactaaaccaaaaaaaaaaaaaaaaaacgtacgccgcacgactaaccgacctcataaacctaacaaaaaaacccgaaaccgccgaaaacccccaactccgcgccgctcgctacctaaccgaacaaaactacgcgcataacttcgacgtcgactacgccaacccaaaaaaacgtacgcgaaaactaacgacaaacatcgcgctctacgacaaaacgctaaactacgaacaacaaataaataacccctatctccctacctccctctaaaaaaac

SEQ ID NO: 2101 - DNA, 636 bp, Artificial Sequence
  chemically treated genomic DNA (Homo sapiens) CpG-island No: 2101
gtttgcggtgaagggtttatttcgcgttttcgattttaggtttattattatatgggcgtggacgcggtgtaggagttgttggcggtggacgaggcggcgttgaattaggcgttggtgtttttggttaaggcgggcgagtcggagttgggtgttacgttgttcgagttgtagttgttgcgcggtaagtgtttgcgtattaagggcgaggacgttaacgcggtcgtttgttttaagcgcgtagtggagttggacgacgcgggttttagttatatcgacggtttcggttgtttgttcgaggcgttgttggcgtagtggagttaggtatagttgagcgacggggagttgggtcgcgaggtggacgtttggttgcgtcgcgtttaggataagtatttcgcggcgcgtttgcgttaggagttgtagcgcgtgtggcgcgggtatacggacgaggtgttggggttggttcgggttttggtggtttagggacggtcggcgttggtgcggttgtttttcgagattatggagcgcgagggcgagggcgttagcgcgtcgcgggatcgtcgggttgttttattttagggtttaggtgtttaggtcggaggttttttgggatttcgtttaggtttcgtttagttgatg

SEQ ID NO: 2102 - DNA, 636 bp, Artificial Sequence
  chemically treated genomic DNA (Homo sapiens) CpG-island No: 2102
catcaactaaacgaaacctaaacgaaatcccaaaaaacctccgacctaaacacctaaaccctaaaataaaacaacccgacgatcccgcgacgcgctaacgccctcgccctcgcgctccataatctcgaaaaacaaccgcaccaacgccgaccgtccctaaaccaccaaaacccgaaccaaccccaacacctcgtccgtatacccgcgccacacgcgctacaactcctaacgcaaacgcgccgcgaaatacttatcctaaacgcgacgcaaccaaacgtccacctcgcgacccaactccccgtcgctcaactatacctaactccactacgccaacaacgcctcgaacaaacaaccgaaaccgtcgatataactaaaacccgcgtcgtccaactccactacgcgcttaaaacaaacgaccgcgttaacgtcctcgcccttaatacgcaaacacttaccgcgcaacaactacaactcgaacaacgtaacacccaactccgactcgcccgccttaaccaaaaacaccaacgcctaattcaacgccgcctcgtccaccgccaacaactcctacaccgcgtccacgcccatataataataaacctaaaatcgaaaacgcgaaataaacccttcaccgcaaac

SEQ ID NO: 2103 - DNA, 636 bp, Artificial Sequence
  chemically treated genomic DNA (Homo sapiens) CpG-island No: 2103
tattagttgggcggggtttgggcggggttttagggagttttcggtttgggtatttgagttttagaatgagatagttcggcggtttcgcggcgcgttggcgttttcgttttcgcgttttatggtttcgaagagtagtcgtattagcgtcggtcgtttttgggttattagggttcgggttagttttaatatttcgttcgtgtgttcgcgttatacgcgttgtagtttttggcgtaggcgcgtcgcggggtatttgttttgggcgcggcgtagttaggcgtttatttcgcggtttagtttttcgtcgtttagttgtgtttggttttattgcgttagtagcgtttcgagtaggtagtcgaagtcgtcggtgtggttggagttcgcgtcgtttagttttattgcgcgtttgaagtaggcggtcgcgttggcgttttcgtttttgatgcgtaggtatttgtcgcgtagtagttgtagttcgggtagcgtggtatttagtttcgattcgttcgttttggttaggaatattagcgtttggtttagcgtcgtttcgtttatcgttagtagtttttgtatcgcgtttacgtttatatagtagtagatttggggtcggggacgcggggtgagttttttatcgtaggt

SEQ ID NO: 2104 - DNA, 636 bp, Artificial Sequence
  chemically treated genomic DNA (Homo sapiens) CpG-island No: 2104
acctacgataaaaaactcaccccgcgtccccgaccccaaatctactactatataaacgtaaacgcgatacaaaaactactaacgataaacgaaacgacgctaaaccaaacgctaatattcctaaccaaaacgaacgaatcgaaactaaataccacgctacccgaactacaactactacgcgacaaatacctacgcatcaaaaacgaaaacgccaacgcgaccgcctacttcaaacgcgcaataaaactaaacgacgcgaactccaaccacaccgacgacttcgactacctactcgaaacgctactaacgcaataaaaccaaacacaactaaacgacgaaaaactaaaccgcgaaataaacgcctaactacgccgcgcccaaaacaaataccccgcgacgcgcctacgccaaaaactacaacgcgtataacgcgaacacacgaacgaaatattaaaactaacccgaaccctaataacccaaaaacgaccgacgctaatacgactactcttcgaaaccataaaacgcgaaaacgaaaacgccaacgcgccgcgaaaccgccgaactatctcattctaaaactcaaatacccaaaccgaaaactccctaaaaccccgcccaaaccccgcccaactaata

SEQ ID NO: 2105 - DNA, 1048 bp, Artificial Sequence
  chemically treated genomic DNA (Homo sapiens) CpG-island No: 2105
cgcgcgggagttagggtgtgtcggtttttaggtatagggcgtagcgcgtaaggattttggggtttattttgtgttcggttcgttcgcgtcgagtttcggaggcgtcggcgtgcgtttttattatttagttgtcggtatacgatgttttttagtagcgataggcgttttaggatcgtattttggatggggttggcgttgtgcgcgttgaggttggttatttcggcgcgcggtcggatttcgtggaaggcgttttcgttgcgtatcgcgatgggtcggtatttggttaggaagagtacgaagtcggttatcgcgattaagtttaatattaatagtattttgattttttttagtgaagttattaaatagttcggtcggttttcgtttcggatttgcgttttttcgggtttcggcgaggcgcggggtagttaggggtcgtgtaagttttatatattagacggtcggtagggatttaagtttttgttcgttttattttaaggatgttcgggcggcggagacggttgggaggtcggattggtggtggggagaacggaatcgtttatatggaagttttcgttttgtagaagtgtttttcgagacgtttgtttagtttacggcgtacggtttcgtttaggcgttttcgcgaaaggttagggatttgagggttttttttttgtattagtaagtggttcgtttttggatttttagtcgtcggcgtcgcggatttcgaggtcggtaggcggggttgttcgggaggtatagagggagcggcgtataggtgtcggatttagggatcgtcgttcgtttacggcggagcgcgtcgcgtttggggtcgtatagttttttattttggttcgtaggcggtcgtcgcggcgcgttattcgcgttttttagcggaagattcgttttttcgggtaggcgtttttgtttcgtttatcgattcgttttatcgcgtcgggtagaggggaagttcgttcggggagttcgtattttttaggtttcgtagttacgtttaagttttaattatttttaaagtgggggtagtattagg

SEQ ID NO: 2106 - DNA, 1048 bp, Artificial Sequence
  chemically treated genomic DNA (Homo sapiens) CpG-island No: 2106
cctaatactacccccactttaaaaataattaaaacttaaacgtaactacgaaacctaaaaaatacgaactccccgaacgaacttcccctctacccgacgcgataaaacgaatcgataaacgaaacaaaaacgcctacccgaaaaaacgaatcttccgctaaaaaacgcgaataacgcgccgcgacgaccgcctacgaaccaaaataaaaaactatacgaccccaaacgcgacgcgctccgccgtaaacgaacgacgatccctaaatccgacacctatacgccgctccctctatacctcccgaacaaccccgcctaccgacctcgaaatccgcgacgccgacgactaaaaatccaaaaacgaaccacttactaatacaaaaaaaaaaccctcaaatccctaacctttcgcgaaaacgcctaaacgaaaccgtacgccgtaaactaaacaaacgtctcgaaaaacacttctacaaaacgaaaacttccatataaacgattccgttctccccaccaccaatccgacctcccaaccgtctccgccgcccgaacatccttaaaataaaacgaacaaaaacttaaatccctaccgaccgtctaatatataaaacttacacgacccctaactaccccgcgcctcgccgaaacccgaaaaaacgcaaatccgaaacgaaaaccgaccgaactatttaataacttcactaaaaaaaatcaaaatactattaatattaaacttaatcgcgataaccgacttcgtactcttcctaaccaaataccgacccatcgcgatacgcaacgaaaacgccttccacgaaatccgaccgcgcgccgaaataaccaacctcaacgcgcacaacgccaaccccatccaaaatacgatcctaaaacgcctatcgctactaaaaaacatcgtataccgacaactaaataataaaaacgcacgccgacgcctccgaaactcgacgcgaacgaaccgaacacaaaataaaccccaaaatccttacgcgctacgccctatacctaaaaaccgacacaccctaactcccgcgcg

SEQ ID NO: 2107 - DNA, 1048 bp, Artificial Sequence
  chemically treated genomic DNA (Homo sapiens) CpG-island No: 2107
tttagtgttgtttttattttgagagtaattgagatttgagcgtgattgcggagtttggaggatgcgggtttttcgagcgggttttttttttgttcggcgcgatggagcgggtcggtgagcggaataaaggcgtttgttcgggggagcgggtttttcgttgaagagcgcgggtggcgcgtcgcgacggtcgtttgcgggttaaggtgggaggttgtgcggttttaggcgcggcgcgtttcgtcgtgggcgggcggcgatttttgagttcggtatttgtgcgtcgttttttttgtgtttttcgggtagtttcgtttgtcggtttcggagttcgcggcgtcggcggttagaggtttagaggcgaattatttgttggtgtagaagagaaatttttaaatttttggtttttcgcggagacgtttggacggggtcgtgcgtcgtggattgagtaggcgtttcggggagtatttttgtagagcgaggatttttatgtgagcgatttcgttttttttattattaattcgattttttagtcgttttcgtcgttcgagtatttttgaggtgggacgagtaggggtttggatttttgtcggtcgtttggtgtgtgaggtttgtacggtttttggttgtttcgcgtttcgtcggagttcgagggggcgtaggttcggggcgagggtcggtcgggttgtttgatggttttattgagaagagttaaagtgttgttggtgttgaatttgatcgcggtagtcggtttcgtgttttttttggttaagtgtcggtttatcgcggtgcgtagcggagacgttttttacgagattcggtcgcgcgtcgaggtggttaattttagcgcgtatagcgttagttttatttaggatgcggttttgaagcgtttgtcgttgttggaggatatcgtgtatcggtagttgaatggtaaggacgtacgtcggcgttttcggggttcgacgcgggcgggtcgggtatagggtgagttttagggtttttgcgcgttgcgttttgtgtttgggagtcggtatattttggttttcgcgcg

SEQ ID NO: 2108 - DNA, 1048 bp, Artificial Sequence
  chemically treated genomic DNA (Homo sapiens) CpG-island No: 2108
cgcgcgaaaaccaaaatataccgactcccaaacacaaaacgcaacgcgcaaaaaccctaaaactcaccctatacccgacccgcccgcgtcgaaccccgaaaacgccgacgtacgtccttaccattcaactaccgatacacgatatcctccaacaacgacaaacgcttcaaaaccgcatcctaaataaaactaacgctatacgcgctaaaattaaccacctcgacgcgcgaccgaatctcgtaaaaaacgtctccgctacgcaccgcgataaaccgacacttaaccaaaaaaaacacgaaaccgactaccgcgatcaaattcaacaccaacaacactttaactcttctcaataaaaccatcaaacaacccgaccgaccctcgccccgaacctacgccccctcgaactccgacgaaacgcgaaacaaccaaaaaccgtacaaacctcacacaccaaacgaccgacaaaaatccaaacccctactcgtcccacctcaaaaatactcgaacgacgaaaacgactaaaaaatcgaattaataataaaaaaaacgaaatcgctcacataaaaatcctcgctctacaaaaatactccccgaaacgcctactcaatccacgacgcacgaccccgtccaaacgtctccgcgaaaaaccaaaaatttaaaaatttctcttctacaccaacaaataattcgcctctaaacctctaaccgccgacgccgcgaactccgaaaccgacaaacgaaactacccgaaaaacacaaaaaaaacgacgcacaaataccgaactcaaaaatcgccgcccgcccacgacgaaacgcgccgcgcctaaaaccgcacaacctcccaccttaacccgcaaacgaccgtcgcgacgcgccacccgcgctcttcaacgaaaaacccgctcccccgaacaaacgcctttattccgctcaccgacccgctccatcgcgccgaacaaaaaaaaaacccgctcgaaaaacccgcatcctccaaactccgcaatcacgctcaaatctcaattactctcaaaataaaaacaacactaaa

SEQ ID NO: 2109 - DNA, 924 bp, Artificial Sequence
  chemically treated genomic DNA (Homo sapiens) CpG-island No: 2109
gcgggcgtcgggtcgagcgttacgtttttttcgtttttcgcgcggagtttattttatttcgtcggtaaatttattagcgtttatagcgtcgtcggttttcggatacgttttaagtttttaaatcgcgtcgagagttttcggggtttttagggtatatcggtttgtttcggagttggcgcgtcgcgaggttggtcggaaggagtcggattttaaaagttatagtagttttttatttttttttaaaacgtcgcgggtagcgcggcggggaggtacgcgtgtcgaattatttttcgttcgttagattcggtcgcgcggttcgtttcgcgttttcgggagttaaaacgtcgagttttttaattggcggacgcggtgatatcgtcgttgcggtatcgagagttatatagtttcggagttgaggagttcggaggggacgcgtaggtggcggcggagggcggggcgcggttcgaggggagcggcggcggcgttagtttttttttcgtcgtttttcgttattttgttttcgagaggttgtcggcggtcgtcgtcgtcgttcgtaggttgtcgagcgtatagtttttcggttcgtcgattcgtgcgcgcgcgtattcgggtagggcgggggtttttggagagtggggatcgcgcgggatggaggtagttaaggtatgttggttgcggtcggcgttggagggattttttagtttttagtattttttgagcgggcgggttcgttttatttcggttggcgatgaagatatttttttttgtgtgttcgcggtttcgcgttgcgtggttaggaatggttagagggaaaatttggtttggaggttcggattttgagattttcggagttaggtcgggcgtgagcgggtttgggggggttttttgcgtgtaagaattttaatttttttagttattgttttt

SEQ ID NO: 2110 - DNA, 924 bp, Artificial Sequence
  chemically treated genomic DNA (Homo sapiens) CpG-island No: 2110
aaaaacaataactaaaaaaattaaaattcttacacgcaaaaaacccccccaaacccgctcacgcccgacctaactccgaaaatctcaaaatccgaacctccaaaccaaattttccctctaaccattcctaaccacgcaacgcgaaaccgcgaacacacaaaaaaaaatatcttcatcgccaaccgaaataaaacgaacccgcccgctcaaaaaatactaaaaactaaaaaatccctccaacgccgaccgcaaccaacataccttaactacctccatcccgcgcgatccccactctccaaaaacccccgccctacccgaatacgcgcgcgcacgaatcgacgaaccgaaaaactatacgctcgacaacctacgaacgacgacgacgaccgccgacaacctctcgaaaacaaaataacgaaaaacgacgaaaaaaaaactaacgccgccgccgctcccctcgaaccgcgccccgccctccgccgccacctacgcgtcccctccgaactcctcaactccgaaactatataactctcgataccgcaacgacgatatcaccgcgtccgccaattaaaaaactcgacgttttaactcccgaaaacgcgaaacgaaccgcgcgaccgaatctaacgaacgaaaaataattcgacacgcgtacctccccgccgcgctacccgcgacgttttaaaaaaaaataaaaaactactataacttttaaaatccgactccttccgaccaacctcgcgacgcgccaactccgaaacaaaccgatataccctaaaaaccccgaaaactctcgacgcgatttaaaaacttaaaacgtatccgaaaaccgacgacgctataaacgctaataaatttaccgacgaaataaaataaactccgcgcgaaaaacgaaaaaaacgtaacgctcgacccgacgcccgc

SEQ ID NO: 2111 - DNA, 924 bp, Artificial Sequence
  chemically treated genomic DNA (Homo sapiens) CpG-island No: 2111
agaagtagtgattggggaggttagaatttttgtacgtagagaatttttttaagttcgtttacgttcggtttggtttcgaaggttttagaattcgagtttttaggttagattttttttttagttatttttggttacgtagcgcggagtcgcgagtatatagaaaaggatgtttttatcgttaatcgggatggaacgaattcgttcgtttagggagtattgagaattaaagggtttttttagcgtcggtcgtagttagtatgttttgattgtttttatttcgcgcggtttttattttttagaagttttcgttttgttcgggtgcgcgcgcgtacgagtcggcgaatcggggagttgtgcgttcggtagtttgcgggcggcggcggcggtcgtcgatagtttttcggggatagggtggcgaagagcggcggaggaggagttggcgtcgtcgtcgtttttttcgggtcgcgtttcgtttttcgtcgttatttgcgcgtttttttcgggttttttagtttcggggttgtgtggttttcggtgtcgtagcggcggtgttatcgcgttcgttaattgggagattcggcgttttggttttcgggggcgcgggacgagtcgcgcggtcggatttggcgagcggagggtgattcggtacgcgtattttttcgtcgcgttgttcgcgacgttttgggagggggtagagaattgttgtgatttttgaggttcgatttttttcggttagtttcgcgacgcgttagtttcgagataggtcggtgtgttttgaaggtttcgaaggttttcggcgcggtttgggggtttggaacgtgttcgggagtcggcggcgttgtgagcgttggtgagtttgtcggcggggtggggtggatttcgcgcggggggcggagaggacgtagcgttcggttcggcgttcgt

SEQ ID NO: 2112 - DNA, 924 bp, Artificial Sequence
  chemically treated genomic DNA (Homo sapiens) CpG-island No: 2112
acgaacgccgaaccgaacgctacgtcctctccgccccccgcgcgaaatccaccccaccccgccgacaaactcaccaacgctcacaacgccgccgactcccgaacacgttccaaacccccaaaccgcgccgaaaaccttcgaaaccttcaaaacacaccgacctatctcgaaactaacgcgtcgcgaaactaaccgaaaaaaatcgaacctcaaaaatcacaacaattctctaccccctcccaaaacgtcgcgaacaacgcgacgaaaaaatacgcgtaccgaatcaccctccgctcgccaaatccgaccgcgcgactcgtcccgcgcccccgaaaaccaaaacgccgaatctcccaattaacgaacgcgataacaccgccgctacgacaccgaaaaccacacaaccccgaaactaaaaaacccgaaaaaaacgcgcaaataacgacgaaaaacgaaacgcgacccgaaaaaaacgacgacgacgccaactcctcctccgccgctcttcgccaccctatccccgaaaaactatcgacgaccgccgccgccgcccgcaaactaccgaacgcacaactccccgattcgccgactcgtacgcgcgcgcacccgaacaaaacgaaaacttctaaaaaataaaaaccgcgcgaaataaaaacaatcaaaacatactaactacgaccgacgctaaaaaaaccctttaattctcaatactccctaaacgaacgaattcgttccatcccgattaacgataaaaacatccttttctatatactcgcgactccgcgctacgtaaccaaaaataactaaaaaaaaaatctaacctaaaaactcgaattctaaaaccttcgaaaccaaaccgaacgtaaacgaacttaaaaaaattctctacgtacaaaaattctaacctccccaatcactacttct

SEQ ID NO: 2113 - DNA, 995 bp, Artificial Sequence
  chemically treated genomic DNA (Homo sapiens) CpG-island No: 2113
cgcgcgcgggcgggcgcggaagcgcgcggggggtggggggggggcggggttggggtagagagcggagagagaggggggtgggtcgagcgttgtgttggtggtgtggtggcgcgtgtggtgggggagggcgagtcgtaggggtaggggcggcgggtgggtggtgtggggcggtggggggtgacggttcggcgggcgcggcggggagggtgtgtggtgcgcgcgtggagcgaagaggggtgggtgtcgcgaggtgagaggggggcgtcgttgttggagaggtgtggtggagaggaggggagtgggatcgggaaatgtggggggtcgtggcggcgtgggggagggggaggcggaaggggcgcggggcgggggggtggtgtggtgggggcgagggggaggaggggcgcgcgtcgtgggcgcgggggggaggtggtttgtgggagggcgtgggggtggaggtgagggggagaggcgagaattgtggggggcgtcgaaaacgggtgggggtgtaagggattcgcgtttgaatgagatcgttgagtgagacggattgcgtgatagacggtttagaaggtcgtgggtgaagcgtggggtaggacgtgaaggttagaaaattgatcgcggcgaatgtggtcggtagatggtgtatagttagtgttgcgttattgggtgtcgggtatttagtggtatgataacggaagagcgatgatgttgtattcggtcgtttggtagtgggagagttcgtttgatttttttagcgtttacggtagatagggatcgaattgttttacgacgttttaaatttagttcgcgtattattttaaatggcgaatagttatatttttgggatttattttagttttaggatgtgatgagtcgatatcgaggtgttaaatatcgtcgtcgatatgaatttttgggcggtattagtttgttattttcggagtaatttttattcgttgaggcgatggttttttaatttaggaattatcggatga

SEQ ID NO: 2114 - DNA, 995 bp, Artificial Sequence
  chemically treated genomic DNA (Homo sapiens) CpG-island No: 2114
tcatccgataattcctaaattaaaaaaccatcgcctcaacgaataaaaattactccgaaaataacaaactaataccgcccaaaaattcatatcgacgacgatatttaacacctcgatatcgactcatcacatcctaaaactaaaataaatcccaaaaatataactattcgccatttaaaataatacgcgaactaaatttaaaacgtcgtaaaacaattcgatccctatctaccgtaaacgctaaaaaaatcaaacgaactctcccactaccaaacgaccgaatacaacatcatcgctcttccgttatcataccactaaatacccgacacccaataacgcaacactaactatacaccatctaccgaccacattcgccgcgatcaattttctaaccttcacgtcctaccccacgcttcacccacgaccttctaaaccgtctatcacgcaatccgtctcactcaacgatctcattcaaacgcgaatcccttacacccccacccgttttcgacgccccccacaattctcgcctctccccctcacctccacccccacgccctcccacaaaccacctcccccccgcgcccacgacgcgcgcccctcctccccctcgcccccaccacaccacccccccgccccgcgccccttccgcctccccctcccccacgccgccacgaccccccacatttcccgatcccactcccctcctctccaccacacctctccaacaacgacgcccccctctcacctcgcgacacccacccctcttcgctccacgcgcgcaccacacaccctccccgccgcgcccgccgaaccgtcaccccccaccgccccacaccacccacccgccgcccctacccctacgactcgccctcccccaccacacgcgccaccacaccaccaacacaacgctcgacccacccccctctctctccgctctctaccccaaccccgccccccccccaccccccgcgcgcttccgcgcccgcccgcgcgcg

SEQ ID NO: 2115 - DNA, 995 bp, Artificial Sequence
  chemically treated genomic DNA (Homo sapiens) CpG-island No: 2115
ttattcggtggtttttgaattgaaaggttatcgttttaacggataaaagttatttcggggataataggttgatatcgtttaagagtttatatcgacggcggtgtttggtatttcgatgtcggtttattatattttggggttgaagtaggttttaagggtatggttgttcgttatttaaagtggtacgcgagttgggtttagaacgtcgtgagatagttcggtttttatttgtcgtgggcgttggagaaattaggcgggtttttttattattaagcgatcgagtgtagtattatcgttttttcgttgttatgttattgaatgttcggtatttaatggcgtagtattagttgtgtattatttatcgattatattcgtcgcgattagttttttgatttttacgttttgttttacgttttatttacgattttttaggtcgtttgttacgtagttcgttttatttaacggttttatttaagcgcgggttttttatatttttattcgttttcggcgttttttataattttcgttttttttttttatttttatttttacgtttttttataaattatttttttttcgcgtttacggcgcgcgttttttttttttttcgtttttattatattattttttcgtttcgcgtttttttcgttttttttttttttacgtcgttacggttttttatatttttcggttttattttttttttttttattatatttttttaatagcggcgttttttttttatttcgcgatatttattttttttcgttttacgcgcgtattatatatttttttcgtcgcgttcgtcgggtcgttattttttatcgttttatattatttattcgtcgtttttgtttttgcggttcgtttttttttattatacgcgttattatattattaatataacgttcggtttattttttttttttttcgttttttgttttaatttcgttttttttttatttttcgcgcgttttcgcgttcgttcgcgcgcg

SEQ ID NO: 2116 - DNA, 995 bp, Artificial Sequence
  chemically treated genomic DNA (Homo sapiens) CpG-island No: 2116
cgcgcgcgaacgaacgcgaaaacgcgcgaaaaataaaaaaaaaacgaaattaaaacaaaaaacgaaaaaaaaaaaaaataaaccgaacgttatattaataatataataacgcgtataataaaaaaaaacgaaccgcaaaaacaaaaacgacgaataaataatataaaacgataaaaaataacgacccgacgaacgcgacgaaaaaaatatataatacgcgcgtaaaacgaaaaaaaataaatatcgcgaaataaaaaaaaaacgccgctattaaaaaaatataataaaaaaaaaaaaaataaaaccgaaaaatataaaaaaccgtaacgacgtaaaaaaaaaaaaaacgaaaaaaacgcgaaacgaaaaaataatataataaaaacgaaaaaaaaaaaaaacgcgcgccgtaaacgcgaaaaaaaaataatttataaaaaaacgtaaaaataaaaataaaaaaaaaaaacgaaaattataaaaaacgccgaaaacgaataaaaatataaaaaacccgcgcttaaataaaaccgttaaataaaacgaactacgtaacaaacgacctaaaaaatcgtaaataaaacgtaaaacaaaacgtaaaaatcaaaaaactaatcgcgacgaatataatcgataaataatacacaactaatactacgccattaaataccgaacattcaataacataacaacgaaaaaacgataatactacactcgatcgcttaataataaaaaaacccgcctaatttctccaacgcccacgacaaataaaaaccgaactatctcacgacgttctaaacccaactcgcgtaccactttaaataacgaacaaccatacccttaaaacctacttcaaccccaaaatataataaaccgacatcgaaataccaaacaccgccgtcgatataaactcttaaacgatatcaacctattatccccgaaataacttttatccgttaaaacgataacctttcaattcaaaaaccaccgaataa

SEQ ID NO: 2117 - DNA, 719 bp, Artificial Sequence
  chemically treated genomic DNA (Homo sapiens) CpG-island No: 2117
tcgtatcgtcgtgtttttcggtttaagttttaatattcgggcgaattggcgtgttttattagttcggtagtatgaattattattcgttagttattttattggagacgacggaagatcgttgtcgaagcggcgttttatcgtttttagtatgacgttttgtattgttttattgttgaagtcgtcggtagtgatcgtttagtgtagtgttttacgattatagtagtttagcgcgaacgtgatacgtagttttttttcgttattatagtagaattcgaattcgttagagtattatcgttgattgtttttttttacggttattttgtttgtatgtgttcgtttcgatggcggtatagtaggttttcgtttaagtaatagcgtattttggcgtatgattcggtaaatacgtttggaattgatcgtaggcgtattattaagttttgtttgtttgcgaatagcgtttatattcgacgataatttatacgttggtagttttgcgtatgatatggtgtatacggagaagtattattcgtattattagtgtgacgattgcgtcggttatttatttagttatcggttcgtttgagaatgacgtgtattgcgtacgcgatattcggagataagcggttgattaagtttatttttttattttcgggtaataaggtgcgtgcggtatttatttgattgttcgtttatatttaacggattttttgaggagatta

SEQ ID NO: 2118 - DNA, 719 bp, Artificial Sequence
  chemically treated genomic DNA (Homo sapiens) CpG-island No: 2118
taatctcctcaaaaaatccgttaaatataaacgaacaatcaaataaataccgcacgcaccttattacccgaaaataaaaaaataaacttaatcaaccgcttatctccgaatatcgcgtacgcaatacacgtcattctcaaacgaaccgataactaaataaataaccgacgcaatcgtcacactaataatacgaataatacttctccgtatacaccatatcatacgcaaaactaccaacgtataaattatcgtcgaatataaacgctattcgcaaacaaacaaaacttaataatacgcctacgatcaattccaaacgtatttaccgaatcatacgccaaaatacgctattacttaaacgaaaacctactataccgccatcgaaacgaacacatacaaacaaaataaccgtaaaaaaaaacaatcaacgataatactctaacgaattcgaattctactataataacgaaaaaaaactacgtatcacgttcgcgctaaactactataatcgtaaaacactacactaaacgatcactaccgacgacttcaacaataaaacaatacaaaacgtcatactaaaaacgataaaacgccgcttcgacaacgatcttccgtcgtctccaataaaataactaacgaataataattcatactaccgaactaataaaacacgccaattcgcccgaatattaaaacttaaaccgaaaaacacgacgatacga

SEQ ID NO: 2119 - DNA, 719 bp, Artificial Sequence
  chemically treated genomic DNA (Homo sapiens) CpG-island No: 2119
tgatttttttaaagaattcgttgaatatggacgggtaattaagtggatatcgtacgtattttattgttcggggatggggagataagtttagttagtcgtttgttttcgggtgtcgcgtgcgtagtgtacgttatttttagacgaatcgatgattggatggatggtcgacgtagtcgttatattgatgatacggatagtgttttttcgtatatattatgttatgcgtagagttgttaacgtatgagttatcgtcgggtataggcgttgttcgtagataggtagaatttgatggtacgtttgcgattaattttaaacgtgtttatcggattatgcgttagaatgcgttgttgtttgagcgaaaatttgttgtatcgttatcgaaacgggtatatataggtagagtggtcgtgaaagaaagtaattagcgatggtgttttgacgggttcgagttttgttgtgataacggagagagattgcgtgttacgttcgcgttggattgttgtgatcgtgaggtattgtattgggcggttattatcggcggttttaatagtgaaatagtataggacgttatgttgggagcggtggaacgtcgtttcggtaacgatttttcgtcgtttttagtggagtggttgacggataatggtttatgttatcgggttaatgaaatacgttagttcgttcggatgttgggatttgaatcgaagaatacggcggtgcgg

SEQ ID NO: 2120 - DNA, 719 bp, Artificial Sequence
  chemically treated genomic DNA (Homo sapiens) CpG-island No: 2120
ccgcaccgccgtattcttcgattcaaatcccaacatccgaacgaactaacgtatttcattaacccgataacataaaccattatccgtcaaccactccactaaaaacgacgaaaaatcgttaccgaaacgacgttccaccgctcccaacataacgtcctatactatttcactattaaaaccgccgataataaccgcccaatacaatacctcacgatcacaacaatccaacgcgaacgtaacacgcaatctctctccgttatcacaacaaaactcgaacccgtcaaaacaccatcgctaattactttctttcacgaccactctacctatatatacccgtttcgataacgatacaacaaattttcgctcaaacaacaacgcattctaacgcataatccgataaacacgtttaaaattaatcgcaaacgtaccatcaaattctacctatctacgaacaacgcctatacccgacgataactcatacgttaacaactctacgcataacataatatatacgaaaaaacactatccgtatcatcaatataacgactacgtcgaccatccatccaatcatcgattcgtctaaaaataacgtacactacgcacgcgacacccgaaaacaaacgactaactaaacttatctccccatccccgaacaataaaatacgtacgatatccacttaattacccgtccatattcaacgaattctttaaaaaaatca

SEQ ID NO: 2121 - DNA, 730 bp, Artificial Sequence
  chemically treated genomic DNA (Homo sapiens) CpG-island No: 2121
ttttcgtcgttttatttttatttatcgttacgcggttatttattagcgcgtcgcgattattatcgtgtgcgattgttgatatatgagttgcgttcgaggtgttttacgtatttataggtttatatttcgtattgttacgtttatacgttattggcgcgtattgttatattattattatttatcgcgttattttcgatttttattttatttttatttttttttatttttttttatagttttttttcgatattttatttttttatttttatttagtatatttttttttacgttttatcgtcgtcgttatatttttcgtttatttattagttttttttcgtttcgtttcgttcgttatattttttttttttttcgcgtacgtatatcgtatattatttttttttcgtatattttattcgttacgcgcggtttatttttatttcgttttatcgcgttttttttcgcgtacgtattatttcgttatataatttatatacgcggtatatttatacgttttttcgcgcgtcgcgcgtttttttatatataattcgtatttatcgcgttatcgcgttttttttttttttttgtacgtatattattttttttatatatattcgttattcgttttttttcgtttttatttttttcgttttttcgcgttacgttcgttatttttattcgtacgcgtttttatatttcgtatatttattatttttattttattatttttatt

SEQ ID NO: 2122 - DNA, 730 bp, Artificial Sequence
  chemically treated genomic DNA (Homo sapiens) CpG-island No: 2122
aataaaaataataaaataaaaataataaatatacgaaatataaaaacgcgtacgaataaaaataacgaacgtaacgcgaaaaaacgaaaaaaataaaaacgaaaaaaaacgaataacgaatatatataaaaaaaataatatacgtacaaaaaaaaaaaaaaaacgcgataacgcgataaatacgaattatatataaaaaaacgcgcgacgcgcgaaaaaacgtataaatataccgcgtatataaattatataacgaaataatacgtacgcgaaaaaaaacgcgataaaacgaaataaaaataaaccgcgcgtaacgaataaaatatacgaaaaaaaaataatatacgatatacgtacgcgaaaaaaaaaaaaaatataacgaacgaaacgaaacgaaaaaaaactaataaataaacgaaaaatataacgacgacgataaaacgtaaaaaaaaatatactaaataaaaataaaaaaataaaatatcgaaaaaaaactataaaaaaaaataaaaaaaaataaaaataaaataaaaatcgaaaataacgcgataaataataataatataacaatacgcgccaataacgtataaacgtaacaatacgaaatataaacctataaatacgtaaaacacctcgaacgcaactcatatatcaacaatcgcacacgataataatcgcgacgcgctaataaataaccgcgtaacgataaataaaaataaaacgacgaaaa

SEQ ID NO: 2123 - DNA, 730 bp, Artificial Sequence
  chemically treated genomic DNA (Homo sapiens) CpG-island No: 2123
ggtgggggtggtggggtgggggtggtgggtgtgcgaggtgtgggggcgcgtgcgggtgggggtggcgagcgtggcgcgagagggcgaggggggtgagggcgggggaaggcgagtggcgggtgtgtgtggggggagtggtgtgcgtgtagggagagaggaggagcgcggtggcgcggtgagtgcgggttgtgtgtgggggggcgcgcggcgcgcgagagagcgtgtgggtgtgtcgcgtgtgtgagttgtgtggcgaggtgatgcgtgcgcggaggagggcgcggtggggcggggtggaggtgggtcgcgcgtgacgggtggagtgtgcgaggagagagtggtgtgcggtgtgcgtgcgcgagagagagagagagtgtggcgggcgaagcggggcgggagaagattggtgagtgagcgaggagtgtggcggcggcggtggggcgtggggagaggtgtgttgggtggggatggagaggtggggtgtcgaggaggggttgtgagaaagagtggggaggaatggaagtgaggtgggagtcggaagtggcgcggtgggtggtgatgatgtgatagtgcgcgttaatggcgtgtgagcgtgatagtacggaatgtggatttgtgagtgcgtgaagtatttcgagcgtaatttatgtgttaatagtcgtatacgatagtgatcgcggcgcgttgataagtgatcgcgtgacgatgaatgagagtgagacgacgggga

SEQ ID NO: 2124 - DNA, 730 bp, Artificial Sequence
  chemically treated genomic DNA (Homo sapiens) CpG-island No: 2124
tccccgtcgtctcactctcattcatcgtcacgcgatcacttatcaacgcgccgcgatcactatcgtatacgactattaacacataaattacgctcgaaatacttcacgcactcacaaatccacattccgtactatcacgctcacacgccattaacgcgcactatcacatcatcaccacccaccgcgccacttccgactcccacctcacttccattcctccccactctttctcacaacccctcctcgacaccccacctctccatccccacccaacacacctctccccacgccccaccgccgccgccacactcctcgctcactcaccaatcttctcccgccccgcttcgcccgccacactctctctctctctcgcgcacgcacaccgcacaccactctctcctcgcacactccacccgtcacgcgcgacccacctccaccccgccccaccgcgccctcctccgcgcacgcatcacctcgccacacaactcacacacgcgacacacccacacgctctctcgcgcgccgcgcgcccccccacacacaacccgcactcaccgcgccaccgcgctcctcctctctccctacacgcacaccactccccccacacacacccgccactcgccttcccccgccctcacccccctcgccctctcgcgccacgctcgccacccccacccgcacgcgcccccacacctcgcacacccaccacccccaccccaccacccccacc

SEQ ID NO: 2125 - DNA, 659 bp, Artificial Sequence
  chemically treated genomic DNA (Homo sapiens) CpG-island No: 2125
gtgtagtgtgagtgagtttagcgtcgatttcgtagtgtgagtgagtttagcgtcgatttcgtagtgtgagtgagttcggtttcgatttcgtagtgtgagtgagttcggtttcgatttcgtagtgtgagtgagttcggcgtcgatttcgtagtgtgagtgagttcggcgtcgatttcgtagtgtgagtgagttcggtttcgatttcgtagtgtgagtgagttcggtttcgatttcgtagtgtgagtgagttcggtttcgatttcgtagtgtgagtgagttcggcgtcgatttcgtagtgtgagtgagttcggtttcgatttcgtagtgtgagtgagttcggcgtcgatttcgtagtgtgagttcggcgtcgatttcgtagtgtgagtgagttcggcgtcgatttcgtagtgtgagtgagttcggtttcgatttcgtagtgtgagtgagttcggtttcgatttcgtagtgtgagtgagttcggcgtcgatttcgtagtgtgagtgagttcggcgtcgatttcgtagtgtgagttcggtttcgatttcgtagtgtgagtgagttcggcgtcgatttcgtagtgtgagtgagtgagtgtggttggttgacgatgggatttgttgtatgacgtggttagagtttatgtgttgagttagtatata

SEQ ID NO: 2126 - DNA, 659 bp, Artificial Sequence
  chemically treated genomic DNA (Homo sapiens) CpG-island No: 2126
tatatactaactcaacacataaactctaaccacgtcatacaacaaatcccatcgtcaaccaaccacactcactcactcacactacgaaatcgacgccgaactcactcacactacgaaatcgaaaccgaactcacactacgaaatcgacgccgaactcactcacactacgaaatcgacgccgaactcactcacactacgaaatcgaaaccgaactcactcacactacgaaatcgaaaccgaactcactcacactacgaaatcgacgccgaactcactcacactacgaaatcgacgccgaactcacactacgaaatcgacgccgaactcactcacactacgaaatcgaaaccgaactcactcacactacgaaatcgacgccgaactcactcacactacgaaatcgaaaccgaactcactcacactacgaaatcgaaaccgaactcactcacactacgaaatcgaaaccgaactcactcacactacgaaatcgacgccgaactcactcacactacgaaatcgacgccgaactcactcacactacgaaatcgaaaccgaactcactcacactacgaaatcgaaaccgaactcactcacactacgaaatcgacgctaaactcactcacactacgaaatcgacgctaaactcactcacactacac

SEQ ID NO: 2127 - DNA, 659 bp, Artificial Sequence
  chemically treated genomic DNA (Homo sapiens) CpG-island No: 2127
tgtgtgttagtttagtatatggattttggttacgttatgtaataggttttatcgttagttagttatatttatttatttatattacggagtcgacgtcggatttatttatattacggagtcgaagtcggatttatattacggagtcgacgtcggatttatttatattacggagtcgacgtcggatttatttatattacggagtcgaagtcggatttatttatattacggagtcgaagtcggatttatttatattacggagtcgacgtcggatttatttatattacggagtcgacgtcggatttatattacggagtcgacgtcggatttatttatattacggagtcgaagtcggatttatttatattacggagtcgacgtcggatttatttatattacggagtcgaagtcggatttatttatattacggagtcgaagtcggatttatttatattacggagtcgaagtcggatttatttatattacggagtcgacgtcggatttatttatattacggagtcgacgtcggatttatttatattacggagtcgaagtcggatttatttatattacggagtcgaagtcggatttatttatattacggagtcgacgttggatttatttatattacggagtcgacgttggatttatttatattatat

SEQ ID NO: 2128 - DNA, 659 bp, Artificial Sequence
  chemically treated genomic DNA (Homo sapiens) CpG-island No: 2128
atataatataaataaatccaacgtcgactccgtaatataaataaatccaacgtcgactccgtaatataaataaatccgacttcgactccgtaatataaataaatccgacttcgactccgtaatataaataaatccgacgtcgactccgtaatataaataaatccgacgtcgactccgtaatataaataaatccgacttcgactccgtaatataaataaatccgacttcgactccgtaatataaataaatccgacttcgactccgtaatataaataaatccgacgtcgactccgtaatataaataaatccgacttcgactccgtaatataaataaatccgacgtcgactccgtaatataaatccgacgtcgactccgtaatataaataaatccgacgtcgactccgtaatataaataaatccgacttcgactccgtaatataaataaatccgacttcgactccgtaatataaataaatccgacgtcgactccgtaatataaataaatccgacgtcgactccgtaatataaatccgacttcgactccgtaatataaataaatccgacgtcgactccgtaatataaataaataaatataactaactaacgataaaacctattacataacgtaaccaaaatccatatactaaactaacacaca

SEQ ID NO: 2129 - DNA, 669 bp, Artificial Sequence
  chemically treated genomic DNA (Homo sapiens) CpG-island No: 2129
ggcgtggttaggcgggttgtaggcgtggcgaggtcgggcgaggagcgcggcgggttcgaggggcggattgtgggcgtggcgcgcgggggagggggcgtgattaggcggggtgtgggcggggcgagggcgcggcgcggtagggttgcgcggtcgggtggcgcgggaggaagttacgtgggaacgcgggtttatatgattgttcgcgcgatggaattcgtgtcgcgggtgtagtcggggcggtagttgaggcggaggttgacgaggaggcggatttttcggcgttaggtagggcgtggggcggcggtagtttttatttgtttagggcgcgcggttcgattattttcggcggacggggtttagtcgtcgcgtttggttttcgattcgttttttgtcgttcgcgtttcgcgttcggttttacggttttagtttttcggaggtttttttgtttttttgcgcgtttgttttttgggggttttcgtgttttttcgcgttttcgttttttcggggttttttgtttttttgcgtcgggagagttttgtttaggttatagttggtcgcgtttcgaggcgttttttcggggtttttagaggcgttttcgggatagtttttttttcgtttcgtttttggtgttttgtttttttgttttgtttggttacgttgagcgatggt

SEQ ID NO: 2130 - DNA, 669 bp, Artificial Sequence
  chemically treated genomic DNA (Homo sapiens) CpG-island No: 2130
accatcgctcaacgtaaccaaacaaaacaaaaaaacaaaacaccaaaaacgaaacgaaaaaaaaactatcccgaaaacgcctctaaaaaccccgaaaaaacgcctcgaaacgcgaccaactataacctaaacaaaactctcccgacgcaaaaaaacaaaaaaccccgaaaaaacgaaaacgcgaaaaaacacgaaaacccccaaaaaacaaacgcgcaaaaaaacaaaaaaacctccgaaaaactaaaaccgtaaaaccgaacgcgaaacgcgaacgacaaaaaacgaatcgaaaaccaaacgcgacgactaaaccccgtccgccgaaaataatcgaaccgcgcgccctaaacaaataaaaactaccgccgccccacgccctacctaacgccgaaaaatccgcctcctcgtcaacctccgcctcaactaccgccccgactacacccgcgacacgaattccatcgcgcgaacaatcatataaacccgcgttcccacgtaacttcctcccgcgccacccgaccgcgcaaccctaccgcgccgcgccctcgccccgcccacaccccgcctaatcacgccccctcccccgcgcgccacgcccacaatccgcccctcgaacccgccgcgctcctcgcccgacctcgccacgcctacaacccgcctaaccacgcc

SEQ ID NO: 2131 - DNA, 669 bp, Artificial Sequence
  chemically treated genomic DNA (Homo sapiens) CpG-island No: 2131
gttatcgtttagcgtgattaggtagggtagaagagtagggtattaggaacggggcgaggaggaaattgtttcgaggacgtttttgagagtttcgggaaagcgtttcggaacgcggttagttgtaatttggatagggttttttcggcgtaggagggtaggggatttcgaggggacggaggcgcgagagagtacggggatttttaaaggataggcgcgtaggagggtagggggattttcgagggattggggtcgtggggtcgaacgcggggcgcgggcggtaggaaacgagtcggggattaagcgcggcggttgagtttcgttcgtcgggggtggtcgggtcgcgcgttttgggtaggtgggggttatcgtcgttttacgttttatttgacgtcgggggattcgttttttcgttagttttcgttttagttgtcgtttcgattgtattcgcggtacgggttttatcgcgcgggtagttatgtgagttcgcgtttttacgtgattttttttcgcgttattcggtcgcgtagttttgtcgcgtcgcgttttcgtttcgtttatatttcgtttggttacgttttttttttcgcgcgttacgtttatagttcgtttttcgggttcgtcgcgtttttcgttcggtttcgttacgtttataattcgtttagttacgtt

SEQ ID NO: 2132 - DNA, 669 bp, Artificial Sequence
  chemically treated genomic DNA (Homo sapiens) CpG-island No: 2132
aacgtaactaaacgaattataaacgtaacgaaaccgaacgaaaaacgcgacgaacccgaaaaacgaactataaacgtaacgcgcgaaaaaaaaaacgtaaccaaacgaaatataaacgaaacgaaaacgcgacgcgacaaaactacgcgaccgaataacgcgaaaaaaaatcacgtaaaaacgcgaactcacataactacccgcgcgataaaacccgtaccgcgaatacaatcgaaacgacaactaaaacgaaaactaacgaaaaaacgaatcccccgacgtcaaataaaacgtaaaacgacgataacccccacctacccaaaacgcgcgacccgaccacccccgacgaacgaaactcaaccgccgcgcttaatccccgactcgtttcctaccgcccgcgccccgcgttcgaccccacgaccccaatccctcgaaaatccccctaccctcctacgcgcctatcctttaaaaatccccgtactctctcgcgcctccgtcccctcgaaatcccctaccctcctacgccgaaaaaaccctatccaaattacaactaaccgcgttccgaaacgctttcccgaaactctcaaaaacgtcctcgaaacaatttcctcctcgccccgttcctaataccctactcttctaccctacctaatcacgctaaacgataac

SEQ ID NO: 2133 - DNA, 831 bp, Artificial Sequence
  chemically treated genomic DNA (Homo sapiens) CpG-island No: 2133
tttttcgtttagatttcgaggagtcgtagaacgcgttgattagggttttagggttgggtttttttggtcgaggacgacgagcggggtttagagagggcgcgcgtagggttaaggttatattgcgcgtcggcgcgggaattcgaatttaggtttaagtcgcgttcgttaggttaggttaaggagagtcgattcgcgttttttagacgtcgttcgggattttcgttcgggttttgggagtttagtattggtcgagagagagggagatcgcgtttcgagttcgtcgttcgtcgcgttttttatttcgcgatttttatttcgcgttttttatttcgcgttcgtagtcgtcgtcgtcgtttcgcgattagcggattttttagaggtagttttcgttcggatcgttttcggcgtaggagtttttttatcggtcgttttttcgcgagacgtcgcggtcgtcggaggggttacggaggtcgagggcgttcgtttttagcgcgtttgcgttcggttagttcgttcgttttcgttttcgcgagttagtgttatgtggcgtcgtatttacggttagagatcgatttcgtttatcggtcgttacgagttacgttttttttttagtagttaattcgcggcgttgatatcgttcggcggatcgggcgcgcggcggttcggggacgcgtagttgtttcgtcgttcgattcgggagttttacgttgtagttaaatacgatttcgttaattaatttttatgtagtgtttgttgtttattcgattttttttcgagtatcggtttattggtaaaggatcgtgatgtttatcggttggggtttgagattcg

SEQ ID NO: 2134 - DNA, 831 bp, Artificial Sequence
  chemically treated genomic DNA (Homo sapiens) CpG-island No: 2134
cgaatctcaaaccccaaccgataaacatcacgatcctttaccaataaaccgatactcgaaaaaaaatcgaataaacaacaaacactacataaaaattaattaacgaaatcgtatttaactacaacgtaaaactcccgaatcgaacgacgaaacaactacgcgtccccgaaccgccgcgcgcccgatccgccgaacgatatcaacgccgcgaattaactactaaaaaaaaaacgtaactcgtaacgaccgataaacgaaatcgatctctaaccgtaaatacgacgccacataacactaactcgcgaaaacgaaaacgaacgaactaaccgaacgcaaacgcgctaaaaacgaacgccctcgacctccgtaacccctccgacgaccgcgacgtctcgcgaaaaaacgaccgataaaaaaactcctacgccgaaaacgatccgaacgaaaactacctctaaaaaatccgctaatcgcgaaacgacgacgacgactacgaacgcgaaataaaaaacgcgaaataaaaatcgcgaaataaaaaacgcgacgaacgacgaactcgaaacgcgatctccctctctctcgaccaatactaaactcccaaaacccgaacgaaaatcccgaacgacgtctaaaaaacgcgaatcgactctccttaacctaacctaacgaacgcgacttaaacctaaattcgaattcccgcgccgacgcgcaatataaccttaaccctacgcgcgccctctctaaaccccgctcgtcgtcctcgaccaaaaaaacccaaccctaaaaccctaatcaacgcgttctacgactcctcgaaatctaaacgaaaaa

SEQ ID NO: 2135 - DNA, 831 bp, Artificial Sequence
  chemically treated genomic DNA (Homo sapiens) CpG-island No: 2135
cgagttttaagttttagtcggtgagtattacgattttttgttaatgagtcgatgttcgagaaagggtcggatagataataggtattgtataaaggttggttaacgggatcgtgtttggttgtaacgtggagttttcgggtcgaacggcgagatagttgcgcgttttcgagtcgtcgcgcgttcggttcgtcgggcgatgttaacgtcgcggattggttgttgagaaaggggcgtggttcgtggcggtcggtgggcggagtcgatttttggtcgtaaatacggcgttatatggtattggttcgcgagggcgggggcgggcgggttggtcgggcgtaggcgcgttgagggcgggcgttttcggttttcgtggttttttcggcggtcgcgacgtttcgcgagaagacgatcggtagaggggtttttgcgtcgggggcggttcgggcgagggttgtttttggggggttcgttagtcgcggggcggcggcggcggttgcgggcgcgaggtgaggggcgcgaggtgagggtcgcgaggtgaggggcgcggcgggcggcgggttcggggcgcggtttttttttttttcggttagtgttgggtttttagggttcgggcgggggtttcgggcgacgtttgaggggcgcgggtcggttttttttaatttggtttggcgggcgcggtttgggtttgggttcgagttttcgcgtcggcgcgtagtgtgattttggttttgcgcgcgttttttttgagtttcgttcgtcgttttcggttagggggatttagttttggggttttgattagcgcgttttgcggtttttcggggtttggacgagaaa

SEQ ID NO: 2136 - DNA, 831 bp, Artificial Sequence
  chemically treated genomic DNA (Homo sapiens) CpG-island No: 2136
tttctcgtccaaaccccgaaaaaccgcaaaacgcgctaatcaaaaccccaaaactaaatccccctaaccgaaaacgacgaacgaaactcaaaaaaaacgcgcgcaaaaccaaaatcacactacgcgccgacgcgaaaactcgaacccaaacccaaaccgcgcccgccaaaccaaattaaaaaaaaccgacccgcgcccctcaaacgtcgcccgaaacccccgcccgaaccctaaaaacccaacactaaccgaaaaaaaaaaaaaccgcgccccgaacccgccgcccgccgcgcccctcacctcgcgaccctcacctcgcgcccctcacctcgcgcccgcaaccgccgccgccgccccgcgactaacgaaccccccaaaaacaaccctcgcccgaaccgcccccgacgcaaaaacccctctaccgatcgtcttctcgcgaaacgtcgcgaccgccgaaaaaaccacgaaaaccgaaaacgcccgccctcaacgcgcctacgcccgaccaacccgcccgcccccgccctcgcgaaccaataccatataacgccgtatttacgaccaaaaatcgactccgcccaccgaccgccacgaaccacgcccctttctcaacaaccaatccgcgacgttaacatcgcccgacgaaccgaacgcgcgacgactcgaaaacgcgcaactatctcgccgttcgacccgaaaactccacgttacaaccaaacacgatcccgttaaccaacctttatacaatacctattatctatccgaccctttctcgaacatcgactcattaacaaaaaatcgtaatactcaccgactaaaacttaaaactcg

SEQ ID NO: 2137 - DNA, 833 bp, Artificial Sequence
  chemically treated genomic DNA (Homo sapiens) CpG-island No: 2137
tacgaatcggtggtatagttcgacgatattttttatttcgggaattttagttacgttttcgcgtcgttcgttagtttcgtttcgggcgtttttatttttttcgtttacgtcgtttacgaagttttcggggtcgttgaaggagggttcgttcgcgtcgtcgttttttagcgttcggggttcggtttcggtcgttttgttttcgttttttttcgcgttttcggatatcgtttgggttcggttgtcggagcgttcgtttcgagtttgtttttttggggtttcgttttgtgtcgggatagggggtttagtatgcgattcgggtagtttttcggcgtcggcggcgagggcgattcggacggcggaggtcgtttttgtttcggtcgtcggttcggtttttatttcggattacggttcggttttcgcgatttttatttttttattggagtttcggttttcgcggttttcggagcgtcggtttcgcgggtagtagtagtttttcggttggcggcggttcggcggtcggttgttgttggtcgggttcggcgcgtttttcggtcgtttcggtatcgttacgtttttcgcgttttgtatgggtttaacgttgtttattcgtagggtttcgcggtcgtcgcgttttcgatttttttaggtcgtatcgcgcgtcgcgacggttatagtttagttatgtgcgtgcgacggggaggtcgtattaaggtcgcggggcggggggcgtatttacgttttggggttttacgaacgattttgagaggattcgtatttataagatcgcgttcgaaaattattaaattgatatatttgtgataagaaagtgttta

SEQ ID NO: 2138 - DNA, 833 bp, Artificial Sequence
  chemically treated genomic DNA (Homo sapiens) CpG-island No: 2138
taaacactttcttatcacaaatatatcaatttaataattttcgaacgcgatcttataaatacgaatcctctcaaaatcgttcgtaaaaccccaaaacgtaaatacgccccccgccccgcgaccttaatacgacctccccgtcgcacgcacataactaaactataaccgtcgcgacgcgcgatacgacctaaaaaaatcgaaaacgcgacgaccgcgaaaccctacgaataaacaacgttaaacccatacaaaacgcgaaaaacgtaacgataccgaaacgaccgaaaaacgcgccgaacccgaccaacaacaaccgaccgccgaaccgccgccaaccgaaaaactactactacccgcgaaaccgacgctccgaaaaccgcgaaaaccgaaactccaataaaaaaataaaaatcgcgaaaaccgaaccgtaatccgaaataaaaaccgaaccgacgaccgaaacaaaaacgacctccgccgtccgaatcgccctcgccgccgacgccgaaaaactacccgaatcgcatactaaaccccctatcccgacacaaaacgaaaccccaaaaaaacaaactcgaaacgaacgctccgacaaccgaacccaaacgatatccgaaaacgcgaaaaaaaacgaaaacaaaacgaccgaaaccgaaccccgaacgctaaaaaacgacgacgcgaacgaaccctccttcaacgaccccgaaaacttcgtaaacgacgtaaacgaaaaaaataaaaacgcccgaaacgaaactaacgaacgacgcgaaaacgtaactaaaattcccgaaataaaaaatatcgtcgaactataccaccgattcgta

SEQ ID NO: 2139 - DNA, 833 bp, Artificial Sequence
  chemically treated genomic DNA (Homo sapiens) CpG-island No: 2139
taagtatttttttgttataaatatattagtttgatgattttcgggcgcggttttgtggatgcgagtttttttagggtcgttcgtgaggttttagggcgtgggtgcgtttttcgtttcgcggttttggtgcggttttttcgtcgtacgtatatggttgggttgtagtcgtcgcggcgcgcggtgcggtttgggagagtcggaagcgcggcggtcgcggagttttgcgagtaggtagcgttgggtttatgtaggacgcggagaacgtggcggtgtcgaggcggtcgaggagcgcgtcgagttcggttagtagtagtcggtcgtcgagtcgtcgttagtcgaggggttgttgttgttcgcggggtcggcgtttcggaggtcgcggggatcgaggttttagtgaggaggtggggatcgcggaggtcgggtcgtagttcgaggtgaggatcgagtcggcgatcgaggtagaggcggttttcgtcgttcgagtcgttttcgtcgtcggcgtcgaggagttgttcgggtcgtatgttgagttttttgtttcggtatagggcgaggttttaggagagtaggttcgggacgagcgtttcgatagtcgggtttaggcggtgttcgaggacgcgggaggaaacgagggtagagcggtcgaggtcgaatttcgggcgttggagaacggcgacgcggacgagtttttttttagcgatttcgaggatttcgtggacgacgtgagcgaggaaggtgagggcgttcggggcggggttggcgagcggcgcgggagcgtggttggggttttcgaggtgggagatatcgtcgggttgtgttatcggttcgtg

SEQ ID NO: 2140 - DNA, 833 bp, Artificial Sequence
  chemically treated genomic DNA (Homo sapiens) CpG-island No: 2140
cacgaaccgataacacaacccgacgatatctcccacctcgaaaaccccaaccacgctcccgcgccgctcgccaaccccgccccgaacgccctcaccttcctcgctcacgtcgtccacgaaatcctcgaaatcgctaaaaaaaaactcgtccgcgtcgccgttctccaacgcccgaaattcgacctcgaccgctctaccctcgtttcctcccgcgtcctcgaacaccgcctaaacccgactatcgaaacgctcgtcccgaacctactctcctaaaacctcgccctataccgaaacaaaaaactcaacatacgacccgaacaactcctcgacgccgacgacgaaaacgactcgaacgacgaaaaccgcctctacctcgatcgccgactcgatcctcacctcgaactacgacccgacctccgcgatccccacctcctcactaaaacctcgatccccgcgacctccgaaacgccgaccccgcgaacaacaacaacccctcgactaacgacgactcgacgaccgactactactaaccgaactcgacgcgctcctcgaccgcctcgacaccgccacgttctccgcgtcctacataaacccaacgctacctactcgcaaaactccgcgaccgccgcgcttccgactctcccaaaccgcaccgcgcgccgcgacgactacaacccaaccatatacgtacgacgaaaaaaccgcaccaaaaccgcgaaacgaaaaacgcacccacgccctaaaacctcacgaacgaccctaaaaaaactcgcatccacaaaaccgcgcccgaaaatcatcaaactaatatatttataacaaaaaaatactta

SEQ ID NO: 2141 - DNA, 542 bp, Artificial Sequence
  chemically treated genomic DNA (Homo sapiens) CpG-island No: 2141
tttgcgttcgtattttattcgtcgtttgttggatatcgtttattagtttatcgttcgttacgttcgtagcgttaaagaggatatcgtttttttttattagtttatcgagcgagtatatacggttaacgttaacgtttattgttttgtaacgtttgcgtttttgttttgtaatttgtcgatttttcgtgtaattttttttagtttggtaaaagttaattagttcggtttgtatattttcgtttaatgttttaacggtataggtagaaattacgttttttggtattcgcgatggtgtatattatatcgtaaggattattttgttagtaggttagtacgttggcggcgatatcgttattcggtaggtaaaattttttacgttagttgtgttgttttttaatcgcggtatttagcgcgtttattagcgtaatatgcgagtttattagcgggttgttcgtttcgtacgtgcgtagtgtcgtagagtaagaagattatcggcgcgtagcgatataatagtttttaataatatggcgattatagtattt

SEQ ID NO: 2142 - DNA, 542 bp, Artificial Sequence
  chemically treated genomic DNA (Homo sapiens) CpG-island No: 2142
aaatactataatcgccatattattaaaaactattatatcgctacgcgccgataatcttcttactctacgacactacgcacgtacgaaacgaacaacccgctaataaactcgcatattacgctaataaacgcgctaaataccgcgattaaaaaacaacacaactaacgtaaaaaattttacctaccgaataacgatatcgccgccaacgtactaacctactaacaaaataatccttacgatataatatacaccatcgcgaataccaaaaaacgtaatttctacctataccgttaaaacattaaacgaaaatatacaaaccgaactaattaacttttaccaaactaaaaaaaattacacgaaaaatcgacaaattacaaaacaaaaacgcaaacgttacaaaacaataaacgttaacgttaaccgtatatactcgctcgataaactaataaaaaaaaacgatatcctctttaacgctacgaacgtaacgaacgataaactaataaacgatatccaacaaacgacgaataaaatacgaacgcaaa

SEQ ID NO: 2143 - DNA, 542 bp, Artificial Sequence
  chemically treated genomic DNA (Homo sapiens) CpG-island No: 2143
gaatattgtaatcgttatattattaaaagttgttgtatcgttgcgcgtcgatgatttttttgttttacgatattgcgtacgtgcgaagcgagtaattcgttgataagttcgtatgttacgttgataaacgcgttgagtgtcgcgattgaggagtaatatagttggcgtgaaggattttgtttgtcggatggcgatgtcgtcgttagcgtgttgatttgttggtaggataatttttacgatgtgatgtatattatcgcggatgttagaaggcgtgatttttgtttgtgtcgttaaagtattaggcggggatatgtaggtcgagttgattgatttttgttaggttaaaggggattatacggaaaatcggtagattgtagagtaggagcgtaagcgttgtaaggtaatgggcgttgacgttaatcgtgtgtattcgttcgatgaattggtgagggggaacgatattttttttagcgttacgggcgtgacgggcggtgagttggtgaacggtatttaatagacggcgaatggggtgcggacgtaga

SEQ ID NO: 2144 - DNA, 542 bp, Artificial Sequence
  chemically treated genomic DNA (Homo sapiens) CpG-island No: 2144
tctacgtccgcaccccattcgccgtctattaaataccgttcaccaactcaccgcccgtcacgcccgtaacgctaaaaaaaatatcgttccccctcaccaattcatcgaacgaatacacacgattaacgtcaacgcccattaccttacaacgcttacgctcctactctacaatctaccgattttccgtataatcccctttaacctaacaaaaatcaatcaactcgacctacatatccccgcctaatactttaacgacacaaacaaaaatcacgccttctaacatccgcgataatatacatcacatcgtaaaaattatcctaccaacaaatcaacacgctaacgacgacatcgccatccgacaaacaaaatccttcacgccaactatattactcctcaatcgcgacactcaacgcgtttatcaacgtaacatacgaacttatcaacgaattactcgcttcgcacgtacgcaatatcgtaaaacaaaaaaatcatcgacgcgcaacgatacaacaacttttaataatataacgattacaatattc

SEQ ID NO: 2145 - DNA, 638 bp, Artificial Sequence
  chemically treated genomic DNA (Homo sapiens) CpG-island No: 2145
ttcgcggtttcggatttcggattttttaggttttcgcgttttattttcgattagtttcgggttaggttagggcgtagacggggtttttcgttttttacgcgggttcgttttatgtcgggcggggtttggggttcgttattttcgttcgtggtcggagagttttaggttcgagttacgcggtttttcgggttcgggtcggggttcgatggttacgtggaggcgggacggtcgattgataggcggttaaaggttgttgtgcgttgggttggcggggacgtttagttttagttttatcgcgtttttggagttcgttatcgtgttggtttaggttggcgtcgtgcgaggttacgttcggggatcgtgggttatagggtatcgggtgtggcgggtagaggggtttcgggttttgtggaaggggaacgcggtggcgtgtttgcgtttttttttttgtagcgtcgtgtagttcgtcgtttatcgtaagtaagagtcgggcggggtcggggaatcgggagatcggacgggggtggggtgggggagtcgcggttcgacgtcgttttgttgtttggattcggggttttggagtagggacggtttttttgtcgattatttggggatttttcggggcggtgggttatttt

SEQ ID NO: 2146 - DNA, 638 bp, Artificial Sequence
  chemically treated genomic DNA (Homo sapiens) CpG-island No: 2146
aaaataacccaccgccccgaaaaatccccaaataatcgacaaaaaaaccgtccctactccaaaaccccgaatccaaacaacaaaacgacgtcgaaccgcgactcccccaccccacccccgtccgatctcccgattccccgaccccgcccgactcttacttacgataaacgacgaactacacgacgctacaaaaaaaaaaacgcaaacacgccaccgcgttccccttccacaaaacccgaaacccctctacccgccacacccgataccctataacccacgatccccgaacgtaacctcgcacgacgccaacctaaaccaacacgataacgaactccaaaaacgcgataaaactaaaactaaacgtccccgccaacccaacgcacaacaacctttaaccgcctatcaatcgaccgtcccgcctccacgtaaccatcgaaccccgacccgaacccgaaaaaccgcgtaactcgaacctaaaactctccgaccacgaacgaaaataacgaaccccaaaccccgcccgacataaaacgaacccgcgtaaaaaacgaaaaaccccgtctacgccctaacctaacccgaaactaatcgaaaataaaacgcgaaaacctaaaaaatccgaaatccgaaaccgcgaa

SEQ ID NO: 2147 - DNA, 638 bp, Artificial Sequence
  chemically treated genomic DNA (Homo sapiens) CpG-island No: 2147
gaggtggtttatcgtttcgaggggtttttaggtgatcgataagggggtcgtttttattttagggtttcgagtttaggtagtagggcggcgtcgggtcgcggtttttttattttattttcgttcggtttttcggtttttcggtttcgttcggtttttatttgcggtaggcggcgagttgtacggcgttgtaggggaagaggcgtaggtacgttatcgcgttttttttttatagggttcggagtttttttgttcgttatattcggtgttttgtggtttacggttttcgggcgtggtttcgtacgacgttaatttgggttagtacggtggcgagttttaggggcgcggtgaggttgaggttgagcgttttcgttagtttagcgtatagtagtttttggtcgtttgttagtcggtcgtttcgtttttacgtagttatcgagtttcgattcgggttcggaagatcgcgtggttcgggtttggggtttttcggttacgggcggaggtggcgggttttaggtttcgttcggtatggggcgggttcgcgtgagggacgggaagtttcgtttacgttttagtttggttcgaggttggtcgggggtggggcgcgagggtttggagggttcggggttcgaggtcgcgga

SEQ ID NO: 2148 - DNA, 638 bp, Artificial Sequence
  chemically treated genomic DNA (Homo sapiens) CpG-island No: 2148
tccgcgacctcgaaccccgaaccctccaaaccctcgcgccccacccccgaccaacctcgaaccaaactaaaacgtaaacgaaacttcccgtccctcacgcgaacccgccccataccgaacgaaacctaaaacccgccacctccgcccgtaaccgaaaaaccccaaacccgaaccacgcgatcttccgaacccgaatcgaaactcgataactacgtaaaaacgaaacgaccgactaacaaacgaccaaaaactactatacgctaaactaacgaaaacgctcaacctcaacctcaccgcgcccctaaaactcgccaccgtactaacccaaattaacgtcgtacgaaaccacgcccgaaaaccgtaaaccacaaaacaccgaatataacgaacaaaaaaactccgaaccctataaaaaaaaaacgcgataacgtacctacgcctcttcccctacaacgccgtacaactcgccgcctaccgcaaataaaaaccgaacgaaaccgaaaaaccgaaaaaccgaacgaaaataaaataaaaaaaccgcgacccgacgccgccctactacctaaactcgaaaccctaaaataaaaacgacccccttatcgatcacctaaaaacccctcgaaacgataaaccacctc

SEQ ID NO: 2149 - DNA, 822 bp, Artificial Sequence
  chemically treated genomic DNA (Homo sapiens) CpG-island No: 2149
tattttattttcgtattcgttcgttcgtttagtaaatagtgagaacgcgtaaatttttgcggggttcgggttttcgggacgggttggacggataggtttgaggggcgcggttcggggacgcgggagggggcgtgggaggcggaagttttaggagagtttttggggattttagggtcgcgggagcggttgtgggtgcggggtcgggatttgtatttttcgcgttgggtcggcggacgttcgaggtttgtaggagattcggggtttagggttcggagtttaggaggtgattcgggagggtttgggacggttcggggttaggggtcgagtcgagagcggttcgcgtcgtttttaggaaggaaggagagttacgttcggtttcgttacgttttagagatttggaatcgcgtaaaggacgtttcggattcggttattttggggtttggcggtcgtttttttagaaaacgggttcgcggagggaggatcggggttttcgtagttaaggttttttttcgttcgttttagttcgtagtttttcgggttttttagagtcgcggtttcgagagttttcgggggtttttatcgggggtcggaggtcggaggagggaggcgaggtttgcgcgggacggtgtcgcgcggatggtagaggacgttcgtgggtgtcgtttttacgtcggttgtttcgggtttttcgtttcgtttttatttttgttttgatttgggagcggtcgtcgtcgtttagttttattcgataaggattttagagcgttgatcgtagggggtatagggtattagaaggtttcgttttgtatgtttttagtttgg

SEQ ID NO: 2150 - DNA, 822 bp, Artificial Sequence
  chemically treated genomic DNA (Homo sapiens) CpG-island No: 2150
ccaaactaaaaacatacaaaacgaaaccttctaataccctataccccctacgatcaacgctctaaaatccttatcgaataaaactaaacgacgacgaccgctcccaaatcaaaacaaaaataaaaacgaaacgaaaaacccgaaacaaccgacgtaaaaacgacacccacgaacgtcctctaccatccgcgcgacaccgtcccgcgcaaacctcgcctccctcctccgacctccgacccccgataaaaacccccgaaaactctcgaaaccgcgactctaaaaaacccgaaaaactacgaactaaaacgaacgaaaaaaaaccttaactacgaaaaccccgatcctccctccgcgaacccgttttctaaaaaaacgaccgccaaaccccaaaataaccgaatccgaaacgtcctttacgcgattccaaatctctaaaacgtaacgaaaccgaacgtaactctccttccttcctaaaaacgacgcgaaccgctctcgactcgacccctaaccccgaaccgtcccaaaccctcccgaatcacctcctaaactccgaaccctaaaccccgaatctcctacaaacctcgaacgtccgccgacccaacgcgaaaaatacaaatcccgaccccgcacccacaaccgctcccgcgaccctaaaatccccaaaaactctcctaaaacttccgcctcccacgccccctcccgcgtccccgaaccgcgcccctcaaacctatccgtccaacccgtcccgaaaacccgaaccccgcaaaaatttacgcgttctcactatttactaaacgaacgaacgaatacgaaaataaaata

SEQ ID NO: 2151 - DNA, 822 bp, Artificial Sequence
  chemically treated genomic DNA (Homo sapiens) CpG-island No: 2151
ttaagttggaagtatgtagggcggaattttttggtattttgtgttttttgcggttagcgttttgaagtttttgtcgggtgggattggacggcggcggtcgtttttaggttagggtaggagtgggggcggggcggggggttcggagtagtcggcgtgggggcgatatttacgggcgttttttgttattcgcgcggtatcgtttcgcgtaggtttcgtttttttttttcgattttcggttttcggtggggattttcgaggattttcgggatcgcggttttggagggttcggagggttgcgggttggagcgggcggggaggagttttggttgcgggagtttcggtttttttttcgcggattcgttttttaggagagcggtcgttaggttttagggtggtcgagttcgaagcgttttttgcgcggttttaagtttttggaacgtggcggggtcgggcgtggtttttttttttttttgggagcggcgcgggtcgttttcggttcgatttttggtttcgggtcgttttaggttttttcgaattattttttggatttcgagttttgggtttcgggttttttgtaggtttcgggcgttcgtcggtttagcgcgggaaatgtaaatttcgatttcgtatttataatcgttttcgcggttttggagtttttagaggtttttttgggattttcgttttttacgttttttttcgcgttttcgggtcgcgttttttaggtttgttcgtttagttcgtttcggaagttcgggtttcgtagggatttgcgcgtttttattgtttattgggcgagcggacgaatacggaaatgaagtg

SEQ ID NO: 2152 - DNA, 822 bp, Artificial Sequence
  chemically treated genomic DNA (Homo sapiens) CpG-island No: 2152
cacttcatttccgtattcgtccgctcgcccaataaacaataaaaacgcgcaaatccctacgaaacccgaacttccgaaacgaactaaacgaacaaacctaaaaaacgcgacccgaaaacgcgaaaaaaaacgtaaaaaacgaaaatcccaaaaaaacctctaaaaactccaaaaccgcgaaaacgattataaatacgaaatcgaaatttacatttcccgcgctaaaccgacgaacgcccgaaacctacaaaaaacccgaaacccaaaactcgaaatccaaaaaataattcgaaaaaacctaaaacgacccgaaaccaaaaatcgaaccgaaaacgacccgcgccgctcccaaaaaaaaaaaaaaaccacgcccgaccccgccacgttccaaaaacttaaaaccgcgcaaaaaacgcttcgaactcgaccaccctaaaacctaacgaccgctctcctaaaaaacgaatccgcgaaaaaaaaaccgaaactcccgcaaccaaaactcctccccgcccgctccaacccgcaaccctccgaaccctccaaaaccgcgatcccgaaaatcctcgaaaatccccaccgaaaaccgaaaatcgaaaaaaaaaaacgaaacctacgcgaaacgataccgcgcgaataacaaaaaacgcccgtaaatatcgcccccacgccgactactccgaaccccccgccccgcccccactcctaccctaacctaaaaacgaccgccgccgtccaatcccacccgacaaaaacttcaaaacgctaaccgcaaaaaacacaaaataccaaaaaattccgccctacatacttccaacttaa

SEQ ID NO: 2153 - DNA, 526 bp, Artificial Sequence
  chemically treated genomic DNA (Homo sapiens) CpG-island No: 2153
ggatcgcggtgggtgttcggggaggcggattttcggtgtatttttgcgcgtgtgtatttttttttgcgtgcgtgttcgcgcgtgcgtgttcgtatatgcgcgttattttcgtattgttttcgttttttgcgtttgtttaggttatcgtttgttttggtttttaggttttggtttttagtggacgagaattatcgagtttgcggggttagacgttgatcgttcgggttagtatttaggcgggcgggagttgtgcggtttagggttcgcgcgggtcgggtagaggttcgagttaggattttcgagcgtgaatttcggagtcggcggcgttggggttagaggggtcgggcgggaggtgatggcggaggcgaaggggcgacgggatttggtttggttcgtgtgtgtttttatgaggtttggcgtcggtcgtcgttgtacggtgagttttagggaggcggatttgggtttcgagaaggatatttatttggatttgtttatatacgcggttcgggtttttcgggagtagaat

SEQ ID NO: 2154 - DNA, 526 bp, Artificial Sequence
  chemically treated genomic DNA (Homo sapiens) CpG-island No: 2154
attctactcccgaaaaacccgaaccgcgtatataaacaaatccaaataaatatccttctcgaaacccaaatccgcctccctaaaactcaccgtacaacgacgaccgacgccaaacctcataaaaacacacacgaaccaaaccaaatcccgtcgccccttcgcctccgccatcacctcccgcccgacccctctaaccccaacgccgccgactccgaaattcacgctcgaaaatcctaactcgaacctctacccgacccgcgcgaaccctaaaccgcacaactcccgcccgcctaaatactaacccgaacgatcaacgtctaaccccgcaaactcgataattctcgtccactaaaaaccaaaacctaaaaaccaaaacaaacgataacctaaacaaacgcaaaaaacgaaaacaatacgaaaataacgcgcatatacgaacacgcacgcgcgaacacgcacgcaaaaaaaaatacacacgcgcaaaaatacaccgaaaatccgcctccccgaacacccaccgcgatcc

SEQ ID NO: 2155 - DNA, 526 bp, Artificial Sequence
  chemically treated genomic DNA (Homo sapiens) CpG-island No: 2155
gttttgttttcgaggggttcgggtcgcgtatgtgggtaaatttaggtgggtgtttttttcggggtttagattcgtttttttggggtttatcgtatagcgacggtcggcgttaggttttatgaggatatatacgggttaggttaggtttcgtcgttttttcgttttcgttattatttttcgttcggtttttttggttttagcgtcgtcggtttcggggtttacgttcgggggttttggttcgagtttttattcggttcgcgcgaattttgggtcgtatagttttcgttcgtttaggtgttggttcgggcggttagcgtttagtttcgtagattcggtgattttcgtttattagaggttaaagtttgggaattagagtaagcgatgatttgaataggcgtaggaagcgagggtagtgcggaggtggcgcgtatgtgcgagtacgtacgcgcgaatacgtacgtagggagaggtgtatacgcgtaggagtgtatcggaagttcgttttttcggatatttatcgcggttt

SEQ ID NO: 2156 - DNA, 526 bp, Artificial Sequence
  chemically treated genomic DNA (Homo sapiens) CpG-island No: 2156
aaaccgcgataaatatccgaaaaaacgaacttccgatacactcctacgcgtatacacctctccctacgtacgtattcgcgcgtacgtactcgcacatacgcgccacctccgcactaccctcgcttcctacgcctattcaaatcatcgcttactctaattcccaaactttaacctctaataaacgaaaatcaccgaatctacgaaactaaacgctaaccgcccgaaccaacacctaaacgaacgaaaactatacgacccaaaattcgcgcgaaccgaataaaaactcgaaccaaaacccccgaacgtaaaccccgaaaccgacgacgctaaaaccaaaaaaaccgaacgaaaaataataacgaaaacgaaaaaacgacgaaacctaacctaacccgtatatatcctcataaaacctaacgccgaccgtcgctatacgataaaccccaaaaaaacgaatctaaaccccgaaaaaaacacccacctaaatttacccacatacgcgacccgaacccctcgaaaacaaaac

SEQ ID NO: 2157 - DNA, 636 bp, Artificial Sequence
  chemically treated genomic DNA (Homo sapiens) CpG-island No: 2157
tcggcgttttcgggcggaaggcggggtttttcggttagtgatttcgtttcgaggcgtttttcgggcggggaagggcggggttcgcgttgggaaattttttttttaaggtcgaggcgtcgttgcgcgttttttaggcgtggtggtggggtcgtgggttttagtttagtggtttaggttacgggtcgtacggtcgcggtcgttattttgttcgcgttcgggtttttgcggcgggcggggcggtgtttcggtcggaagcggttgtgcggcggtcgcgttgttattttaggttagtgagcgcgattcggttcgcgtttcgattttcgggagcgtcgcggtcgtagcgaggggtcggagatagtttagttgaaaggttcgggcgtttcggcggggagcgcgtttcgcgttgtagggtaatcgcgtcgggcggtcggtcgtttggtcgggttttagcgggagttatcgggggttgcgggcggtcgtgggatttgcggagattttttcggggcgtagggaatacgttatagttttcgtcgcggcgggtttgtggggagcggcgttttagtttttttcgggaggtttagttaggtgtttggagcgggagagtcggatttagatttttgttttatttagaatagt

SEQ ID NO: 2158 - DNA, 636 bp, Artificial Sequence
  chemically treated genomic DNA (Homo sapiens) CpG-island No: 2158
actattctaaataaaacaaaaatctaaatccgactctcccgctccaaacacctaactaaacctcccgaaaaaaactaaaacgccgctccccacaaacccgccgcgacgaaaactataacgtattccctacgccccgaaaaaatctccgcaaatcccacgaccgcccgcaacccccgataactcccgctaaaacccgaccaaacgaccgaccgcccgacgcgattaccctacaacgcgaaacgcgctccccgccgaaacgcccgaacctttcaactaaactatctccgacccctcgctacgaccgcgacgctcccgaaaatcgaaacgcgaaccgaatcgcgctcactaacctaaaataacaacgcgaccgccgcacaaccgcttccgaccgaaacaccgccccgcccgccgcaaaaacccgaacgcgaacaaaataacgaccgcgaccgtacgacccgtaacctaaaccactaaactaaaacccacgaccccaccaccacgcctaaaaaacgcgcaacgacgcctcgaccttaaaaaaaaaatttcccaacgcgaaccccgcccttccccgcccgaaaaacgcctcgaaacgaaatcactaaccgaaaaaccccgccttccgcccgaaaacgccga

SEQ ID NO: 2159 - DNA, 636 bp, Artificial Sequence
  chemically treated genomic DNA (Homo sapiens) CpG-island No: 2159
gttattttaggtaaagtaggaatttgagttcgattttttcgttttaggtatttggttgagtttttcgggaaaggttgggacgtcgttttttataagttcgtcgcggcgaaggttgtagcgtgttttttgcgtttcgaggaggttttcgtaggttttacggtcgttcgtagttttcggtggttttcgttgaggttcggttaggcggtcggtcgttcggcgcgattattttatagcgcggaacgcgtttttcgtcgagacgttcgggttttttaattaggttattttcggtttttcgttgcggtcgcggcgttttcgagagtcgagacgcgaatcgggtcgcgtttattgatttgaggtggtagcgcggtcgtcgtatagtcgttttcggtcgggatatcgtttcgttcgtcgtaggagttcggacgcgggtaagatggcggtcgcggtcgtgcggttcgtgatttggattattgggttgggatttacgattttattattacgtttggaggacgcgtagcggcgtttcggttttggaaggggagttttttagcgcgagtttcgttttttttcgttcgggaggcgtttcggggcggggttattggtcgggaggtttcgtttttcgttcgaaagcgtcgg

SEQ ID NO: 2160 - DNA, 636 bp, Artificial Sequence
  chemically treated genomic DNA (Homo sapiens) CpG-island No: 2160
ccgacgctttcgaacgaaaaacgaaacctcccgaccaataaccccgccccgaaacgcctcccgaacgaaaaaaaacgaaactcgcgctaaaaaactccccttccaaaaccgaaacgccgctacgcgtcctccaaacgtaataataaaatcgtaaatcccaacccaataatccaaatcacgaaccgcacgaccgcgaccgccatcttacccgcgtccgaactcctacgacgaacgaaacgatatcccgaccgaaaacgactatacgacgaccgcgctaccacctcaaatcaataaacgcgacccgattcgcgtctcgactctcgaaaacgccgcgaccgcaacgaaaaaccgaaaataacctaattaaaaaacccgaacgtctcgacgaaaaacgcgttccgcgctataaaataatcgcgccgaacgaccgaccgcctaaccgaacctcaacgaaaaccaccgaaaactacgaacgaccgtaaaacctacgaaaacctcctcgaaacgcaaaaaacacgctacaaccttcgccgcgacgaacttataaaaaacgacgtcccaacctttcccgaaaaactcaaccaaatacctaaaacgaaaaaatcgaactcaaattcctactttacctaaaataac

SEQ ID NO: 2161 - DNA, 703 bp, Artificial Sequence
  chemically treated genomic DNA (Homo sapiens) CpG-island No: 2161
ttcgttttcgtttacgtttcgataatgttttcgggttcgtagtttcgttttcggttaggtcgtcgtttttcgtattttttcgttttttgttgttcgcgcgattttttttttcggtttttttagtagtttttattttcgtttttttagtattaggttaagcggcgggaggttcggagagtttcggtttttttttttcgggttcgggcgcgttggggggcgaggatgttgcggtttttttttgcgcggcgttgtttatcggttgtatttttttttggcgtcggggattttcgcgataggtgtttagggttcgggtttcgcgttacgtttttgggaaggcgggaggcgcgtatcgaggtcgtttagtagtcgtttgcgcgtttcgcggtcgagtcgagttgagcgttcgcggagttagcggagttagcggagttagcggttcggtttcgggagggaataaaaggggtcggcgtaggggcgggcgcgggagggcggggtttggggcgggcgggaggggggggcgggttaggcgcgcgtgggcggtttcgcggtttttaggttttagtgtttcgcggaaagtaggcgggcgggcggaaaacgcggagtaatttttttttttttttttcgttttatttttttttttttttaggtcgtagttgttttttgtggggcgtttagggttcgtttatatttattttcgcgttgg

SEQ ID NO: 2162 - DNA, 703 bp, Artificial Sequence
  chemically treated genomic DNA (Homo sapiens) CpG-island No: 2162
ccaacgcgaaaataaatataaacgaaccctaaacgccccacaaaaaacaactacgacctaaaaaaaaaaaaaaataaaacgaaaaaaaaaaaaaaaaattactccgcgttttccgcccgcccgcctactttccgcgaaacactaaaacctaaaaaccgcgaaaccgcccacgcgcgcctaacccgcccccccctcccgcccgccccaaaccccgccctcccgcgcccgcccctacgccgaccccttttattccctcccgaaaccgaaccgctaactccgctaactccgctaactccgcgaacgctcaactcgactcgaccgcgaaacgcgcaaacgactactaaacgacctcgatacgcgcctcccgccttcccaaaaacgtaacgcgaaacccgaaccctaaacacctatcgcgaaaatccccgacgccaaaaaaaaatacaaccgataaacaacgccgcgcaaaaaaaaaccgcaacatcctcgccccccaacgcgcccgaacccgaaaaaaaaaaaccgaaactctccgaacctcccgccgcttaacctaatactaaaaaaacgaaaataaaaactactaaaaaaaccgaaaaaaaaaatcgcgcgaacaacaaaaaacgaaaaaatacgaaaaacgacgacctaaccgaaaacgaaactacgaacccgaaaacattatcgaaacgtaaacgaaaacgaa

SEQ ID NO: 2163 - DNA, 703 bp, Artificial Sequence
  chemically treated genomic DNA (Homo sapiens) CpG-island No: 2163
ttagcgcggaggtggatgtgggcgaattttggacgttttataaaggatagttgcggtttgggaagggaaggagatggagcggggagagggggaagaggttgtttcgcgtttttcgttcgttcgtttgtttttcgcgaggtattgaggtttgaaaatcgcgaggtcgtttacgcgcgtttgattcgtttttttttttcgttcgttttaggtttcgttttttcgcgttcgtttttgcgtcggttttttttgttttttttcggagtcgggtcgttggtttcgttggtttcgttggtttcgcgggcgtttagttcggttcggtcgcggggcgcgtaggcggttgttgggcggtttcggtgcgcgtttttcgtttttttagagacgtggcgcgaggttcgggttttgagtatttatcgcggggattttcggcgttaggagggggtgtagtcggtgggtagcgtcgcgtagggaggggtcgtagtattttcgttttttagcgcgttcgggttcgagaggaggaggtcggggtttttcgggtttttcgtcgtttagtttgatgttggaaggacgaaggtaggggttgttggaggggtcgagggagggggtcgcgcgggtaataaaggacggagagatgcggggggcggcggtttggtcgaaagcggggttgcgggttcggaggtattgtcggggcgtgggcgggggcggg

SEQ ID NO: 2164 - DNA, 703 bp, Artificial Sequence
  chemically treated genomic DNA (Homo sapiens) CpG-island No: 2164
cccgcccccgcccacgccccgacaatacctccgaacccgcaaccccgctttcgaccaaaccgccgccccccgcatctctccgtcctttattacccgcgcgaccccctccctcgacccctccaacaacccctaccttcgtccttccaacatcaaactaaacgacgaaaaacccgaaaaaccccgacctcctcctctcgaacccgaacgcgctaaaaaacgaaaatactacgacccctccctacgcgacgctacccaccgactacaccccctcctaacgccgaaaatccccgcgataaatactcaaaacccgaacctcgcgccacgtctctaaaaaaacgaaaaacgcgcaccgaaaccgcccaacaaccgcctacgcgccccgcgaccgaaccgaactaaacgcccgcgaaaccaacgaaaccaacgaaaccaacgacccgactccgaaaaaaaacaaaaaaaaccgacgcaaaaacgaacgcgaaaaaacgaaacctaaaacgaacgaaaaaaaaaaacgaatcaaacgcgcgtaaacgacctcgcgattttcaaacctcaatacctcgcgaaaaacaaacgaacgaacgaaaaacgcgaaacaacctcttccccctctccccgctccatctccttcccttcccaaaccgcaactatcctttataaaacgtccaaaattcgcccacatccacctccgcgctaa

SEQ ID NO: 2165 - DNA, 1222 bp, Artificial Sequence
  chemically treated genomic DNA (Homo sapiens) CpG-island No: 2165
cgttcgcggtcgtcggtttcggttttttttcgacgtattatatttagtaatcggcgttgataggacgtagtggcggcggcggcggcgggaggaggaagcggaatggttgtcgcggtggagttattttcgttttttcgttttattttttcgcggttgtagtcgtcgtcgagttttgatagttcgagtcggggcggaagcgttcggcggcgtgtagcgttcgtttttcgttgtttttagcgtttcgggttatttcgattattcgggttaattaatttcgcgattttgtttagcgtttagttttcgtcgttcgtcgcgtttttcgtttcgcgtttcgcgcgtcggtattcggtttcgtcgtcgtaatttcgtcgtttcgtcgcggcgtttttcgtttttattatttcgtagttcgcgtgtacgtttttgagttttttagtcgttcgttcgttcgttcgcggtatttcggggcgttcgtttttttttttattcgagttcgtttttcgtttttcggtatttcgcgttttcgtatttcgttatttttatttcggggttcgtacgcgtttttttcgttttgtcgttttttttttcgtcggttatttttggttatttcggggtttttcgttcgggtaggagttttcgcgcgtttggtattttcgtttattttcgggttatttatcgatgtggttgttttcgatgtgttcgatgaggtcggttagggtggggaagtggagttcgtagttttcgaatcggtaggtattggagaagaaggaggcggcggcgatgtttgttatggtgttatatcgagagtttttttggtgtcggttttgcgagcgtcgggcgggcgagggagggagggaggtcgggtggggtgaggagaggaggggttgggggagggggagagaggcggggtgaggggagcggcgaggacgggacggagggagagggggcgagagagatggaaggagagcgaggagttatcgggaggtagaggggaggcggcggttgcggcggcggcgtcgggagcggcggggggagggcgggggcgggggcggggggggaaggtcgtcgtagttgggaggagggattagggcgcgcggttatagttgtgcggttttaattttagcgcgcggatttaggttttatttgcgagttttgttattaattttatttcgttaggtttgttttttacggtttgttattcgtgttatttgtttggagtttt

SEQ ID NO: 2166 - DNA, 1222 bp, Artificial Sequence
  chemically treated genomic DNA (Homo sapiens) CpG-island No: 2166
aaaactccaaacaaataacacgaataacaaaccgtaaaaaacaaacctaacgaaataaaattaataacaaaactcgcaaataaaacctaaatccgcgcgctaaaattaaaaccgcacaactataaccgcgcgccctaatccctcctcccaactacgacgaccttccccccccgcccccgcccccgccctccccccgccgctcccgacgccgccgccgcaaccgccgcctcccctctacctcccgataactcctcgctctccttccatctctctcgccccctctccctccgtcccgtcctcgccgctcccctcaccccgcctctctccccctcccccaacccctcctctcctcaccccacccgacctccctccctccctcgcccgcccgacgctcgcaaaaccgacaccaaaaaaactctcgatataacaccataacaaacatcgccgccgcctccttcttctccaatacctaccgattcgaaaactacgaactccacttccccaccctaaccgacctcatcgaacacatcgaaaacaaccacatcgataaataacccgaaaataaacgaaaataccaaacgcgcgaaaactcctacccgaacgaaaaaccccgaaataaccaaaaataaccgacgaaaaaaaaaacgacaaaacgaaaaaaacgcgtacgaaccccgaaataaaaataacgaaatacgaaaacgcgaaataccgaaaaacgaaaaacgaactcgaataaaaaaaaaaacgaacgccccgaaataccgcgaacgaacgaacgaacgactaaaaaactcaaaaacgtacacgcgaactacgaaataataaaaacgaaaaacgccgcgacgaaacgacgaaattacgacgacgaaaccgaataccgacgcgcgaaacgcgaaacgaaaaacgcgacgaacgacgaaaactaaacgctaaacaaaatcgcgaaattaattaacccgaataatcgaaataacccgaaacgctaaaaacaacgaaaaacgaacgctacacgccgccgaacgcttccgccccgactcgaactatcaaaactcgacgacgactacaaccgcgaaaaaataaaacgaaaaaacgaaaataactccaccgcgacaaccattccgcttcctcctcccgccgccgccgccgccactacgtcctatcaacgccgattactaaatataatacgtcgaaaaaaaaccgaaaccgacgaccgcgaacg

SEQ ID NO: 2167 - DNA, 1222 bp, Artificial Sequence
  chemically treated genomic DNA (Homo sapiens) CpG-island No: 2167
gaggttttaaatagatggtacggatggtaagtcgtaaagggtaggtttagcgagataaagttggtggtagggttcgtaggtgaggtttgggttcgcgcgttgaggttggggtcgtatagttgtagtcgcgcgttttggtttttttttttagttgcggcggtttttttttttcgttttcgttttcgtttttttttcgtcgttttcgacgtcgtcgtcgtagtcgtcgttttttttttgtttttcggtggtttttcgttttttttttatttttttcgtttttttttttttcgtttcgttttcgtcgttttttttatttcgttttttttttttttttttagttttttttttttttattttattcggtttttttttttttttcgttcgttcggcgttcgtagagtcgatattaggggggttttcgatgtagtattatgataggtatcgtcgtcgttttttttttttttaatatttgtcgattcgggggttgcggattttatttttttattttggtcgattttatcgagtatatcgaggataattatatcggtaaatggttcgggggtgggcgggggtgttaggcgcgcggaaatttttgttcgggcggggagtttcggaatggttaggggtggtcggcggggagggaggcggtagggcggggagggcgcgtgcgagtttcgaggtgggggtggcgggatgcgggggcgcgaggtgtcggggggcggggagcgggttcgggtgggggagggggcgggcgtttcgaggtgtcgcgggcgggcgggcgggcggttgggggatttaggggcgtgtacgcgggttgcgaagtggtgggagcggggagcgtcgcggcggggcggcggggttgcggcggcggggtcgagtgtcggcgcgcggggcgcggggcggagggcgcggcgggcggcgggagttgggcgttgggtagggtcgcggagttagttggttcgggtggtcggagtagttcgaggcgttgagggtagcggggggcgggcgttgtacgtcgtcgggcgttttcgtttcggttcgagttgttagggttcggcggcggttgtagtcgcggggaggtggagcgggggggcgggggtggttttatcgcggtagttatttcgtttttttttttcgtcgtcgtcgtcgttattgcgttttgttagcgtcggttgttaggtgtggtgcgtcgggagggggtcggggtcggcggtcgcgggcg

SEQ ID NO: 2168 - DNA, 1222 bp, Artificial Sequence
  chemically treated genomic DNA (Homo sapiens) CpG-island No: 2168
cgcccgcgaccgccgaccccgaccccctcccgacgcaccacacctaacaaccgacgctaacaaaacgcaataacgacgacgacgacgaaaaaaaaaaacgaaataactaccgcgataaaaccacccccgcccccccgctccacctccccgcgactacaaccgccgccgaaccctaacaactcgaaccgaaacgaaaacgcccgacgacgtacaacgcccgccccccgctaccctcaacgcctcgaactactccgaccacccgaaccaactaactccgcgaccctacccaacgcccaactcccgccgcccgccgcgccctccgccccgcgccccgcgcgccgacactcgaccccgccgccgcaaccccgccgccccgccgcgacgctccccgctcccaccacttcgcaacccgcgtacacgcccctaaatcccccaaccgcccgcccgcccgcccgcgacacctcgaaacgcccgccccctcccccacccgaacccgctccccgccccccgacacctcgcgcccccgcatcccgccacccccacctcgaaactcgcacgcgccctccccgccctaccgcctccctccccgccgaccacccctaaccattccgaaactccccgcccgaacaaaaatttccgcgcgcctaacacccccgcccacccccgaaccatttaccgatataattatcctcgatatactcgataaaatcgaccaaaataaaaaaataaaatccgcaacccccgaatcgacaaatattaaaaaaaaaaaaaacgacgacgatacctatcataatactacatcgaaaacccccctaatatcgactctacgaacgccgaacgaacgaaaaaaaaaaaaaaaccgaataaaataaaaaaaaaaaaaactaaaaaaaaaaaaaaaaaacgaaataaaaaaaacgacgaaaacgaaacgaaaaaaaaaaaaacgaaaaaaataaaaaaaaaacgaaaaaccaccgaaaaacaaaaaaaaaacgacgactacgacgacgacgtcgaaaacgacgaaaaaaaaacgaaaacgaaaacgaaaaaaaaaaaccgccgcaactaaaaaaaaaaaccaaaacgcgcgactacaactatacgaccccaacctcaacgcgcgaacccaaacctcacctacgaaccctaccaccaactttatctcgctaaacctaccctttacgacttaccatccgtaccatctatttaaaacctc

SEQ ID NO: 2169 - DNA, 557 bp, Artificial Sequence
  chemically treated genomic DNA (Homo sapiens) CpG-island No: 2169
ggaggtgtagcgacgggggagtttacggttacgggcggcgttatttgtagtcgtacgatgcgtcgggttacggcgtgaggagggttagcgattcggtgcggataggtttcgagggtttggttttgtttcgtgtgtcgcgttttagtagttttagtagttgtaatttttcggcgatggttacgttcgcggagaagcgtagtttcgtgttttagaattatacgcggttcgagggcggttagtttcgaaatttttattcgtttttttgtttttttagtattatcgagaacgttattttggagtttttgattatggacgttgatgttaatttgaacgatgaggattttttgtcggacgacgtggtgtagtatttaaatttttagaattaagtagggtacgagtagtatttttttagcgttttttcggacgatagtaaagtgttttacgggttcggtgattttgacgcgttcgggttgttagatagttacgttggttagtagttttatgttttcgagtagttttgtttcgagggtagtaaaatcgatttgtttatttagtgg

SEQ ID NO: 2170 - DNA, 557 bp, Artificial Sequence
  chemically treated genomic DNA (Homo sapiens) CpG-island No: 2170
ccactaaataaacaaatcgattttactaccctcgaaacaaaactactcgaaaacataaaactactaaccaacgtaactatctaacaacccgaacgcgtcaaaatcaccgaacccgtaaaacactttactatcgtccgaaaaaacgctaaaaaaatactactcgtaccctacttaattctaaaaatttaaatactacaccacgtcgtccgacaaaaaatcctcatcgttcaaattaacatcaacgtccataatcaaaaactccaaaataacgttctcgataatactaaaaaaacaaaaaaacgaataaaaatttcgaaactaaccgccctcgaaccgcgtataattctaaaacacgaaactacgcttctccgcgaacgtaaccatcgccgaaaaattacaactactaaaactactaaaacgcgacacacgaaacaaaaccaaaccctcgaaacctatccgcaccgaatcgctaaccctcctcacgccgtaacccgacgcatcgtacgactacaaataacgccgcccgtaaccgtaaactcccccgtcgctacacctcc

SEQ ID NO: 2171 - DNA, 557 bp, Artificial Sequence
  chemically treated genomic DNA (Homo sapiens) CpG-island No: 2171
ttattgaatgggtaggtcggttttgttgttttcggggtagggttgttcgagggtatggaattgttggttagcgtggttgtttggtagttcgggcgcgttaaagttatcgggttcgtggggtattttgttgtcgttcgggagggcgttggggaagtgttgttcgtattttgtttggttttgggaatttaaatattgtattacgtcgttcggtaggaaatttttatcgtttaggttggtattagcgtttatggttagggattttagggtgacgttttcggtgatgttgggaggatagggggacgagtggaagtttcgggattggtcgttttcgggtcgcgtgtaattttgaagtacgagattgcgttttttcgcggacgtggttatcgtcggggggttgtagttgttgaggttgttgaagcgcggtatacgaggtagggttaggttttcggagtttgttcgtatcgggtcgttggttttttttacgtcgtggttcggcgtatcgtgcggttgtaggtggcgtcgttcgtagtcgtgggttttttcgtcgttgtattttt

SEQ ID NO: 2172 - DNA, 557 bp, Artificial Sequence
  chemically treated genomic DNA (Homo sapiens) CpG-island No: 2172
aaaaatacaacgacgaaaaaacccacgactacgaacgacgccacctacaaccgcacgatacgccgaaccacgacgtaaaaaaaaccaacgacccgatacgaacaaactccgaaaacctaaccctacctcgtataccgcgcttcaacaacctcaacaactacaaccccccgacgataaccacgtccgcgaaaaaacgcaatctcgtacttcaaaattacacgcgacccgaaaacgaccaatcccgaaacttccactcgtccccctatcctcccaacatcaccgaaaacgtcaccctaaaatccctaaccataaacgctaataccaacctaaacgataaaaatttcctaccgaacgacgtaatacaatatttaaattcccaaaaccaaacaaaatacgaacaacacttccccaacgccctcccgaacgacaacaaaataccccacgaacccgataactttaacgcgcccgaactaccaaacaaccacgctaaccaacaattccataccctcgaacaaccctaccccgaaaacaacaaaaccgacctacccattcaataa

SEQ ID NO: 2173 - DNA, 900 bp, Artificial Sequence
  chemically treated genomic DNA (Homo sapiens) CpG-island No: 2173
gagcgcgggtattaagcgtgcgttttttttttcgagacgcgtttttttttcggaatttaatgttttgttttttttttttttttttttttttattcgtagagaattcggtggcggttaaatcgggaggttgtttttcgggttcggttacggtgtatttggagtagggcggtattaagttggtgaaggatttgagtttcggggatcgcgtgttggcggcggacgattagggtcggttgttttatagcgatttttttatttttttggatcgcgacgacggcgttaagaaggttttttacgtgatcgagacgcgggagtcgcgcgagcgtttgttgtttatcgtcgcgtatttgttttttgtggcgtcgtataacgattcggttatcggggagttcgaggcgttttcgggttcggggtcgtttttcgggggcgtattggggtttcgggcgttgttcgttagtcgcgtgcgttcgggttagcgcgtgtacgtggtggtcgagcgtgacggggatcgtcggtttttgttcgtcgttgtgtatagcgtgattttaagcgaggaggtcgcgggcgtttacgcgtcgtttacggtttagggtattatttttattaatcgggtgttggtttcgtgttacgcggttatcgaggagtatagttgggcgtatcgggttttcgcgttttttcgtttggcgtacgcgtttttggttgtattggcgttcgcgcgtacggatcgcggcggggatagcggcggcggggatcgcgggggcggcggcggtagagtagttttaatcgttttaggtgttgtcgacgtttcgggtgcgggggttatcgcgggtatttattggtattcgtagttgttttattaaataggtatttggtttttggatagcgaggttttgtattcgt

SEQ ID NO: 2174 - DNA, 900 bp, Artificial Sequence
  chemically treated genomic DNA (Homo sapiens) CpG-island No: 2174
acgaatacaaaacctcgctatccaaaaaccaaatacctatttaataaaacaactacgaataccaataaatacccgcgataacccccgcacccgaaacgtcgacaacacctaaaacgattaaaactactctaccgccgccgcccccgcgatccccgccgccgctatccccgccgcgatccgtacgcgcgaacgccaatacaaccaaaaacgcgtacgccaaacgaaaaaacgcgaaaacccgatacgcccaactatactcctcgataaccgcgtaacacgaaaccaacacccgattaataaaaataataccctaaaccgtaaacgacgcgtaaacgcccgcgacctcctcgcttaaaatcacgctatacacaacgacgaacaaaaaccgacgatccccgtcacgctcgaccaccacgtacacgcgctaacccgaacgcacgcgactaacgaacaacgcccgaaaccccaatacgcccccgaaaaacgaccccgaacccgaaaacgcctcgaactccccgataaccgaatcgttatacgacgccacaaaaaacaaatacgcgacgataaacaacaaacgctcgcgcgactcccgcgtctcgatcacgtaaaaaaccttcttaacgccgtcgtcgcgatccaaaaaaataaaaaaatcgctataaaacaaccgaccctaatcgtccgccgccaacacgcgatccccgaaactcaaatccttcaccaacttaataccgccctactccaaatacaccgtaaccgaacccgaaaaacaacctcccgatttaaccgccaccgaattctctacgaataaaaaaaaaaaaaaaaaaaaaaaacaaaacattaaattccgaaaaaaaaacgcgtctcgaaaaaaaaaacgcacgcttaatacccgcgctc

SEQ ID NO: 2175 - DNA, 900 bp, Artificial Sequence
  chemically treated genomic DNA (Homo sapiens) CpG-island No: 2175
gcgggtgtagggtttcgttgtttaggagttaggtgtttatttggtagagtagttgcgagtattagtggatgttcgcggtggttttcgtattcggagcgtcggtagtatttggagcggttagggttattttgtcgtcgtcgttttcgcggttttcgtcgtcgttgttttcgtcgcggttcgtgcgcgcgggcgttagtgtagttaggagcgcgtgcgttaggcggaagggcgcgaaggttcggtgcgtttagttgtgtttttcgatgatcgcgtagtacgaggttagtattcggttgatgagaatggtgttttgggtcgtgagcggcgcgtaggcgttcgcggttttttcgtttagggttacgttgtgtatagcggcgggtaggagtcggcggttttcgttacgttcggttattacgtatacgcgttggttcgggcgtacgcggttggcgaatagcgttcgaggttttagtgcgttttcggaaggcggtttcgagttcgaggacgtttcgggtttttcggtggtcgagtcgttgtgcggcgttataaagagtaggtgcgcggcggtgagtagtaggcgttcgcgcggttttcgcgtttcgattacgtagaagatttttttggcgtcgtcgtcgcggtttaggaaagtgaggaagtcgttgtagagtagtcggttttggtcgttcgtcgttagtacgcggttttcggggtttaggttttttattagtttggtgtcgttttgttttaggtgtatcgtggtcgagttcgggaagtagtttttcgatttggtcgttatcgagttttttgcgggtgaggagaagggaaagaagagaggatagggtattgagtttcgagagggaggcgcgtttcggggaggagggcgtacgtttggtgttcgcgttt

SEQ ID NO: 2176 - DNA, 900 bp, Artificial Sequence
  chemically treated genomic DNA (Homo sapiens) CpG-island No: 2176
aaacgcgaacaccaaacgtacgccctcctccccgaaacgcgcctccctctcgaaactcaataccctatcctctcttctttcccttctcctcacccgcaaaaaactcgataacgaccaaatcgaaaaactacttcccgaactcgaccacgatacacctaaaacaaaacgacaccaaactaataaaaaacctaaaccccgaaaaccgcgtactaacgacgaacgaccaaaaccgactactctacaacgacttcctcactttcctaaaccgcgacgacgacgccaaaaaaatcttctacgtaatcgaaacgcgaaaaccgcgcgaacgcctactactcaccgccgcgcacctactctttataacgccgcacaacgactcgaccaccgaaaaacccgaaacgtcctcgaactcgaaaccgccttccgaaaacgcactaaaacctcgaacgctattcgccaaccgcgtacgcccgaaccaacgcgtatacgtaataaccgaacgtaacgaaaaccgccgactcctacccgccgctatacacaacgtaaccctaaacgaaaaaaccgcgaacgcctacgcgccgctcacgacccaaaacaccattctcatcaaccgaatactaacctcgtactacgcgatcatcgaaaaacacaactaaacgcaccgaaccttcgcgcccttccgcctaacgcacgcgctcctaactacactaacgcccgcgcgcacgaaccgcgacgaaaacaacgacgacgaaaaccgcgaaaacgacgacgacaaaataaccctaaccgctccaaatactaccgacgctccgaatacgaaaaccaccgcgaacatccactaatactcgcaactactctaccaaataaacacctaactcctaaacaacgaaaccctacacccgc

SEQ ID NO: 2177 - DNA, 778 bp, Artificial Sequence
  chemically treated genomic DNA (Homo sapiens) CpG-island No: 2177
tatcgagaggggggattacggagagggggattattgatagaggggggattatggagagggagggattacggagagagggagggattacggagagagggagggattatggagaggggggattatggagagggagggattacggagagggggtattatgaagagggggattatggagagagggagggattacggagagggagggattatggagagaggggggattatggagagagggagggattacggagagggagggattatggagagaggggggattatggagagagggagggattacggagagggagggattacggagagagggagggattacggagagagggggattacggagagagggaggattatagagacgggggattatggagagggtgattacggagagagggagggattacggagagagggagggattacggagagagggagggattatggagaggggggattacggagagggggattacggagagagggagggattatggaggggggattacggagaggggtattacggagagagggagggattatggagagagggagggattacggagagagggagggattacggagagagggagggattacggagagagggagggattacggagagagggaggatgatagagagaggggggattatggaaaaggagggattacggagagagggagggattatggagagagggagggattatggagagggagggattatggagagggaggattatagagagagggagggattatggag

SEQ ID NO: 2178 - DNA, 778 bp, Artificial Sequence
  chemically treated genomic DNA (Homo sapiens) CpG-island No: 2178
ctccataatccctccctctctctataatcctccctctccataatccctccctctccataatccctccctctctccataatccctccctctctccgtaatccctccttttccataatcccccctctctctatcatcctccctctctccgtaatccctccctctctccgtaatccctccctctctccgtaatccctccctctctccgtaatccctccctctctccataatccctccctctctccgtaatacccctctccgtaatcccccctccataatccctccctctctccgtaatccccctctccgtaatcccccctctccataatccctccctctctccgtaatccctccctctctccgtaatccctccctctctccgtaatcaccctctccataatcccccgtctctataatcctccctctctccgtaatccccctctctccgtaatccctccctctctccgtaatccctccctctccgtaatccctccctctctccataatcccccctctctccataatccctccctctccgtaatccctccctctctccataatcccccctctctccataatccctccctctccgtaatccctccctctctccataatccccctcttcataataccccctctccgtaatccctccctctccataatcccccctctccataatccctccctctctccgtaatccctccctctctccgtaatccctccctctccataatcccccctctatcaataatccccctctccgtaatcccccctctcgata

SEQ ID NO: 2179 - DNA, 778 bp, Artificial Sequence
  chemically treated genomic DNA (Homo sapiens) CpG-island No: 2179
ttttataatttttttttttttttgtaattttttttttttataatttttttttttttataatttttttttttttttataattttttttttttttcgtaatttttttttttttataattttttttttttttgttatttttttttttttcgtaattttttttttttttcgtaattttttttttttttcgtaattttttttttttttcgtaatttttttttttttttataattttttttttttttcgtaatattttttttcgtaattttttttttataattttttttttttttcgtaattttttttttcgtaattttttttttttataattttttttttttttcgtaattttttttttttttcgtaattttttttttttttcgtaattattttttttataatttttcgtttttgtaatttttttttttttcgtaattttttttttttcgtaattttttttttttttcgtaattttttttttttcgtaatttttttttttttttataattttttttttttttataattttttttttttcgtaatttttttttttttttataattttttttttttttataattttttttttttcgtaatttttttttttttttataatttttttttttataatatttttttttcgtaatttttttttttttataattttttttttttataattttttttttttttcgtaattttttttttttttcgtaatttttttttttttataattttttttttattagtaattttttttttcgtaattttttttttcggta

SEQ ID NO: 2180 - DNA, 778 bp, Artificial Sequence
  chemically treated genomic DNA (Homo sapiens) CpG-island No: 2180
taccgaaaaaaaaaattacgaaaaaaaaaattactaataaaaaaaaaattataaaaaaaaaaaaattacgaaaaaaaaaaaaaattacgaaaaaaaaaaaaaattataaaaaaaaaaaattataaaaaaaaaaaaattacgaaaaaaaaatattataaaaaaaaaaattataaaaaaaaaaaaaaattacgaaaaaaaaaaaattataaaaaaaaaaaaaattataaaaaaaaaaaaaaattacgaaaaaaaaaaaattataaaaaaaaaaaaaattataaaaaaaaaaaaaaattacgaaaaaaaaaaaattacgaaaaaaaaaaaaaattacgaaaaaaaaaaaattacgaaaaaaaaaaaaattacaaaaacgaaaaattataaaaaaaataattacgaaaaaaaaaaaaaattacgaaaaaaaaaaaaaattacgaaaaaaaaaaaaaattataaaaaaaaaaaattacgaaaaaaaaaattacgaaaaaaaaaaaaaattataaaaaaaaaattacgaaaaaaaatattacgaaaaaaaaaaaaaattataaaaaaaaaaaaaaattacgaaaaaaaaaaaaaattacgaaaaaaaaaaaaaattacgaaaaaaaaaaaaaattacgaaaaaaaaaaaaataacaaaaaaaaaaaaaattataaaaaaaaaaaaattacgaaaaaaaaaaaaaattataaaaaaaaaaaaaaattataaaaaaaaaaaaattataaaaaaaaaaaattacaaaaaaaaaaaaaaattataaaa

SEQ ID NO: 2181 - DNA, 525 bp, Artificial Sequence
  chemically treated genomic DNA (Homo sapiens) CpG-island No: 2181
ggggtcgaatggtcggcgtcgattggacggtagagtcgtcgtttttggtcgatttttttttttattggttttttcgggtatcgttttttgaatagggcgggagattcggtgtgtcgtacgtaggttttttattttttagttggttttcggtgttttttattttttcggtggtcgggcgcgaattattggaaattggtttttttcgttggggtcgaaggtattttttttgcggcggcgatttagcggggtgtcgttcggtcggcgtgacgtagtcggatcggcgttagacggaaatttagcggtgagtagtggggtgtcggggtagtttgttttttttttttgtttagttcgcggcgtgtgaggtgcgtttaggtgtatttagtttcgcgtcggagtttggtttttagcgttttaagtcgcgtattttaggattttttttcggtatttggggtatggtttttgcgtttcgttgtttttcgtaggttgttcgggggttcgagaatttttattggtggagcgtagtta

SEQ ID NO: 2182 - DNA, 525 bp, Artificial Sequence
  chemically treated genomic DNA (Homo sapiens) CpG-island No: 2182
taactacgctccaccaataaaaattctcgaacccccgaacaacctacgaaaaacaacgaaacgcaaaaaccataccccaaataccgaaaaaaaatcctaaaatacgcgacttaaaacgctaaaaaccaaactccgacgcgaaactaaatacacctaaacgcacctcacacgccgcgaactaaacaaaaaaaaaaaacaaactaccccgacaccccactactcaccgctaaatttccgtctaacgccgatccgactacgtcacgccgaccgaacgacaccccgctaaatcgccgccgcaaaaaaaataccttcgaccccaacgaaaaaaaccaatttccaataattcgcgcccgaccaccgaaaaaataaaaaacaccgaaaaccaactaaaaaataaaaaacctacgtacgacacaccgaatctcccgccctattcaaaaaacgatacccgaaaaaaccaataaaaaaaaaaatcgaccaaaaacgacgactctaccgtccaatcgacgccgaccattcgacccc

SEQ ID NO: 2183 - DNA, 525 bp, Artificial Sequence
  chemically treated genomic DNA (Homo sapiens) CpG-island No: 2183
tggttgcgttttattagtaagggttttcgagttttcgggtagtttgcggggggtagcgaggcgtaaagattatgttttaagtgtcgagggaaagttttgagatgcgcgatttgggacgttaggggttaagtttcgacgcggggttgggtgtatttggacgtattttatacgtcgcgagttaagtagaaaagggaggtaggttgtttcgatattttattatttatcgttaggttttcgtttggcgtcgattcggttgcgttacgtcggtcgaacgatatttcgttgagtcgtcgtcgtagggaaggtattttcggttttaacgggaaaagttaatttttagtaattcgcgttcgattatcggggaggtaaggagtatcggaggttagttgggggatgggaagtttgcgtgcggtatatcgaatttttcgttttgtttagggggcggtgttcgaggaagttaataggaagaggagtcggttaagagcgacggttttgtcgtttagtcggcgtcggttattcggtttt

SEQ ID NO: 2184 - DNA, 525 bp, Artificial Sequence
  chemically treated genomic DNA (Homo sapiens) CpG-island No: 2184
aaaaccgaataaccgacgccgactaaacgacaaaaccgtcgctcttaaccgactcctcttcctattaacttcctcgaacaccgccccctaaacaaaacgaaaaattcgatataccgcacgcaaacttcccatcccccaactaacctccgatactccttacctccccgataatcgaacgcgaattactaaaaattaacttttcccgttaaaaccgaaaataccttccctacgacgacgactcaacgaaatatcgttcgaccgacgtaacgcaaccgaatcgacgccaaacgaaaacctaacgataaataataaaatatcgaaacaacctacctcccttttctacttaactcgcgacgtataaaatacgtccaaatacacccaaccccgcgtcgaaacttaacccctaacgtcccaaatcgcgcatctcaaaactttccctcgacacttaaaacataatctttacgcctcgctaccccccgcaaactacccgaaaactcgaaaacccttactaataaaacgcaacca

SEQ ID NO: 2185 - DNA, 769 bp, Artificial Sequence
  chemically treated genomic DNA (Homo sapiens) CpG-island No: 2185
gttttggttttttttttggcgtttgcgtttacgatggtcgcgcgcgcgatacgttcgtttttttcgtttgttcgtttcgtgtatgattcgtttcgcggcggagacgcgttcgttgcgttattagtgttttcgagacgagtttcgacgtagtagttgttagttttattttgttgttggtgcgcgacgtagttagttgcgtgattttcgtgattgcgttataagttttgtttttttcgatttggagtttttgtttaggacggtaagacgtaggagggagcggattaggtgatagggtcgtttttgtgagtttcgcgggcgtttggcgatgttttttttttttgtttgtttgttgttcgtcgttttcggcgcgacgattgtttgttttttttatttttaggttgtatagtggcggcgcgttttttttttttgcgcggtcgagtttgtcgtcgtcggattcggtttgcgggggtagttacggtgtttgttaggtcggtcgtttttttggagtttttgtttttcgttgaggaagcggcgtcgtttgacgcgggacggtcgggcgggcgttatgttgtgaatcgtttcggcggagttgtaagatggcggttgggcggaggtcggtttcggttttgtggtcggaaaggcgaggtttttcgttgaggggggatttgttggggttttagaatgtgcgtgagttaagtagttgtggggaaacgttgtttggagtaagtggagaaagagacggaattcgtaggggttatagttaatgttt

SEQ ID NO: 2186 - DNA, 769 bp, Artificial Sequence
  chemically treated genomic DNA (Homo sapiens) CpG-island No: 2186
aaacattaactataacccctacgaattccgtctctttctccacttactccaaacaacgtttccccacaactacttaactcacgcacattctaaaaccccaacaaatcccccctcaacgaaaaacctcgcctttccgaccacaaaaccgaaaccgacctccgcccaaccgccatcttacaactccgccgaaacgattcacaacataacgcccgcccgaccgtcccgcgtcaaacgacgccgcttcctcaacgaaaaacaaaaactccaaaaaaacgaccgacctaacaaacaccgtaactacccccgcaaaccgaatccgacgacgacaaactcgaccgcgcaaaaaaaaaaaacgcgccgccactatacaacctaaaaataaaaaaaacaaacaatcgtcgcgccgaaaacgacgaacaacaaacaaacaaaaaaaaaaaacatcgccaaacgcccgcgaaactcacaaaaacgaccctatcacctaatccgctccctcctacgtcttaccgtcctaaacaaaaactccaaatcgaaaaaaacaaaacttataacgcaatcacgaaaatcacgcaactaactacgtcgcgcaccaacaacaaaataaaactaacaactactacgtcgaaactcgtctcgaaaacactaataacgcaacgaacgcgtctccgccgcgaaacgaatcatacacgaaacgaacaaacgaaaaaaacgaacgtatcgcgcgcgcgaccatcgtaaacgcaaacgccaaaaaaaaaaccaaaac

SEQ ID NO: 2187 - DNA, 769 bp, Artificial Sequence
  chemically treated genomic DNA (Homo sapiens) CpG-island No: 2187
agatattaattgtaatttttacgggtttcgtttttttttttatttattttagataacgtttttttatagttgtttggtttacgtatattttggaattttagtaaatttttttttaacggggagtttcgttttttcggttatagggtcgaagtcggttttcgtttagtcgttattttatagtttcgtcgaggcggtttataatatggcgttcgttcgatcgtttcgcgttaggcggcgtcgtttttttagcggagggtagaagttttaagagggcggtcggtttagtaaatatcgtaattattttcgtaggtcggattcggcggcgataggttcggtcgcgtaggaaagaggggcgcgtcgttattgtgtagtttgggagtgaagggagtaggtagtcgtcgcgtcggggacggcgggtagtaaataagtaggaaaagggggtatcgttaggcgttcgcgaggtttataggaacggttttgttatttagttcgtttttttttgcgttttatcgttttggataaagattttaagtcgaaggagataaagtttgtaacgtaattacgggaattacgtagttgattgcgtcgcgtattaataataaaatggagttgatagttgttgcgtcgagattcgtttcgaaaatattgatgacgtagcgagcgcgttttcgtcgcggggcgggttatgtacggggcgagtaggcggaaagggcgggcgtgtcgcgcgcgcgattatcgtgggcgtaggcgttagggagggaattagagt

SEQ ID NO: 2188 - DNA, 769 bp, Artificial Sequence
  chemically treated genomic DNA (Homo sapiens) CpG-island No: 2188
actctaattccctccctaacgcctacgcccacgataatcgcgcgcgcgacacgcccgccctttccgcctactcgccccgtacataacccgccccgcgacgaaaacgcgctcgctacgtcatcaatattttcgaaacgaatctcgacgcaacaactatcaactccattttattattaatacgcgacgcaatcaactacgtaattcccgtaattacgttacaaactttatctccttcgacttaaaatctttatccaaaacgataaaacgcaaaaaaaaacgaactaaataacaaaaccgttcctataaacctcgcgaacgcctaacgatacccccttttcctacttatttactacccgccgtccccgacgcgacgactacctactcccttcactcccaaactacacaataacgacgcgcccctctttcctacgcgaccgaacctatcgccgccgaatccgacctacgaaaataattacgatatttactaaaccgaccgccctcttaaaacttctaccctccgctaaaaaaacgacgccgcctaacgcgaaacgatcgaacgaacgccatattataaaccgcctcgacgaaactataaaataacgactaaacgaaaaccgacttcgaccctataaccgaaaaaacgaaactccccgttaaaaaaaaatttactaaaattccaaaatatacgtaaaccaaacaactataaaaaaacgttatctaaaataaataaaaaaaaaaacgaaacccgtaaaaattacaattaatatct

SEQ ID NO: 2189 - DNA, 710 bp, Artificial Sequence
  chemically treated genomic DNA (Homo sapiens) CpG-island No: 2189
ggggttcgcgttttcgtttgttttgtcgtcggtttgagtgttcggcggtttcgcggggttgagttttaggattagcgtgtgcgtgtgtgtgtgtgtgtgtgtgtgtgtgtgatcgcgtatgtatgcgggtatttgtgggtaagagtgtgggtgtacgtatcgggatgtttgtttcgtcgtaaaggtcggggtaggtgcgcgcgtttgggtgttatcgttgttattaaggagttgaagcgggagggagagggaagtggggggagtttttgcgtggggtggcgggggggcgtagacgtcggttcgatcgggggcggcgggcgtaggttgtgcgggtagcgtcggagttagagcgtggtattgttcgttcgaggagttagtggttttgcgttttgggggtttgtaggggtcgatagtcggtcgtgttgtatttagcgtgcgggttttcgttcgttttatcgttttttagcgatcgttagtttggttgtttatttggtttttttagtcggtttgtttttttatttgttttttcggtgtcggttttagtgttcgtgcgttcgcgggattcgggaagtcgcgcgggagagttttggcgtatttagtttttttttgttcgcgttttggtcgcggttttgggaagggattgcgagcgagtcgggagttttttgggggttgttattttgggaagaattcgtgttttttttattttaatt

SEQ ID NO: 2190 - DNA, 710 bp, Artificial Sequence
  chemically treated genomic DNA (Homo sapiens) CpG-island No: 2190
aattaaaataaaaaaaacacgaattcttcccaaaataacaacccccaaaaaactcccgactcgctcgcaatcccttcccaaaaccgcgaccaaaacgcgaacaaaaaaaaactaaatacgccaaaactctcccgcgcgacttcccgaatcccgcgaacgcacgaacactaaaaccgacaccgaaaaaacaaataaaaaaacaaaccgactaaaaaaaccaaataaacaaccaaactaacgatcgctaaaaaacgataaaacgaacgaaaacccgcacgctaaatacaacacgaccgactatcgacccctacaaacccccaaaacgcaaaaccactaactcctcgaacgaacaataccacgctctaactccgacgctacccgcacaacctacgcccgccgcccccgatcgaaccgacgtctacgcccccccgccaccccacgcaaaaactccccccacttccctctccctcccgcttcaactccttaataacaacgataacacccaaacgcgcgcacctaccccgacctttacgacgaaacaaacatcccgatacgtacacccacactcttacccacaaatacccgcatacatacgcgatcacacacacacacacacacacacacacacgcacacgctaatcctaaaactcaaccccgcgaaaccgccgaacactcaaaccgacgacaaaacaaacgaaaacgcgaacccc

SEQ ID NO: 2191 - DNA, 710 bp, Artificial Sequence
  chemically treated genomic DNA (Homo sapiens) CpG-island No: 2191
ggttggggtggggagggtacggattttttttagggtagtaatttttagagaattttcggttcgttcgtagtttttttttaaagtcgcggttagagcgcggataaagagaggttgagtgcgttaggattttttcgcgcggtttttcgggtttcgcgggcgtacgggtattggaatcggtatcgggagggtagatagggaggtaggtcggttggaggggttagataggtagttaggttggcggtcgttgagaggcgatggagcgagcgggagttcgtacgttgggtgtagtacggtcgattgtcgatttttgtaggtttttagagcgtagaattattggtttttcggacggatagtgttacgttttggtttcggcgttattcgtatagtttgcgttcgtcgttttcgatcgaatcggcgtttgcgttttttcgttattttacgtaggagttttttttatttttttttttttttcgttttagttttttggtgatagcggtgatatttagacgcgcgtatttatttcgatttttgcggcgagatagatatttcggtgcgtgtatttatatttttatttatagatgttcgtatatatgcgcgattatatatatatatatatatatatatatacgtatacgttggttttggggtttagtttcgcggagtcgtcgaatatttagatcgacggtaggatagacggaggcgcgggtttt

SEQ ID NO: 2192 - DNA, 710 bp, Artificial Sequence
  chemically treated genomic DNA (Homo sapiens) CpG-island No: 2192
aaaacccgcgcctccgtctatcctaccgtcgatctaaatattcgacgactccgcgaaactaaaccccaaaaccaacgtatacgtatatatatatatatatatatatatataatcgcgcatatatacgaacatctataaataaaaatataaatacacgcaccgaaatatctatctcgccgcaaaaatcgaaataaatacgcgcgtctaaatatcaccgctatcaccaaaaaactaaaacgaaaaaaaaaaaaaaataaaaaaaactcctacgtaaaataacgaaaaaacgcaaacgccgattcgatcgaaaacgacgaacgcaaactatacgaataacgccgaaaccaaaacgtaacactatccgtccgaaaaaccaataattctacgctctaaaaacctacaaaaatcgacaatcgaccgtactacacccaacgtacgaactcccgctcgctccatcgcctctcaacgaccgccaacctaactacctatctaacccctccaaccgacctacctccctatctaccctcccgataccgattccaatacccgtacgcccgcgaaacccgaaaaaccgcgcgaaaaaatcctaacgcactcaacctctctttatccgcgctctaaccgcgactttaaaaaaaaactacgaacgaaccgaaaattctctaaaaattactaccctaaaaaaaatccgtaccctccccaccccaacc

SEQ ID NO: 2193 - DNA, 575 bp, Artificial Sequence
  chemically treated genomic DNA (Homo sapiens) CpG-island No: 2193
gatttcgagtaggcggcggggtcgggtcgggcgggagagtggggtttgcggagggtcgggaggggtcggtgtcggttcgggggcggggtcgtggggcggggatttcggcgtttcggtatttttttatcgtaggggtcggggcgggtcgtcgtttttacgttagtttaggtttatacgtggcggttgatgtaacgttcgtgtttttatattttttttttcgattaaagcggacgcgttttatttcgaggaatcgggtacgttgcgggcggtgtcgttgtttttagatcgatcgcgtttttgttcgttggtcggaggttttcgtttcgggtcggcggatatttaaaggagtcgtattttttttcgggtttgtttttcgtaagttatattttttcgcggattatttttaaaggagacgggacgtttgttcgttgatagttttcgtataaagcgcggtttattttttcgttgaaaggagcgtgagggtgcggtcgttgggaaataaaggttgtagggcgaggagtggggaaagagaaaaatttgaaaggttaaagattgttaaagtgagggagtattag

SEQ ID NO: 2194 - DNA, 575 bp, Artificial Sequence
  chemically treated genomic DNA (Homo sapiens) CpG-island No: 2194
ctaatactccctcactttaacaatctttaacctttcaaatttttctctttccccactcctcgccctacaacctttatttcccaacgaccgcaccctcacgctcctttcaacgaaaaaataaaccgcgctttatacgaaaactatcaacgaacaaacgtcccgtctcctttaaaaataatccgcgaaaaaatataacttacgaaaaacaaacccgaaaaaaaatacgactcctttaaatatccgccgacccgaaacgaaaacctccgaccaacgaacaaaaacgcgatcgatctaaaaacaacgacaccgcccgcaacgtacccgattcctcgaaataaaacgcgtccgctttaatcgaaaaaaaaaatataaaaacacgaacgttacatcaaccgccacgtataaacctaaactaacgtaaaaacgacgacccgccccgacccctacgataaaaaaataccgaaacgccgaaatccccgccccacgaccccgcccccgaaccgacaccgacccctcccgaccctccgcaaaccccactctcccgcccgacccgaccccgccgcctactcgaaatc

SEQ ID NO: 2195 - DNA, 575 bp, Artificial Sequence
  chemically treated genomic DNA (Homo sapiens) CpG-island No: 2195
ttgatgtttttttattttggtagtttttaattttttaggtttttttttttttttatttttcgttttgtagtttttattttttaacggtcgtatttttacgttttttttagcggagaaatagatcgcgttttgtgcggaagttgttagcgagtaagcgtttcgttttttttaagagtgattcgcgagggggtgtggtttgcggagagtaggttcgaaagggggtgcggtttttttaagtattcgtcggttcgaggcggaggttttcggttagcgggtaggggcgcggtcggtttgggagtagcggtatcgttcgtagcgtattcggtttttcgaagtggggcgcgttcgttttaatcggggagagagatgtgggggtacgggcgttatattagtcgttacgtgtgggtttaagttggcgtggaggcggcggttcgtttcggtttttgcggtggaaaagtatcggggcgtcgaggttttcgttttacggtttcgttttcgggtcggtatcggtttttttcggtttttcgtaagttttattttttcgttcggttcggtttcgtcgtttgttcgagatt

SEQ ID NO: 2196 - DNA, 575 bp, Artificial Sequence
  chemically treated genomic DNA (Homo sapiens) CpG-island No: 2196
aatctcgaacaaacgacgaaaccgaaccgaacgaaaaaataaaacttacgaaaaaccgaaaaaaaccgataccgacccgaaaacgaaaccgtaaaacgaaaacctcgacgccccgatacttttccaccgcaaaaaccgaaacgaaccgccgcctccacgccaacttaaacccacacgtaacgactaatataacgcccgtacccccacatctctctccccgattaaaacgaacgcgccccacttcgaaaaaccgaatacgctacgaacgataccgctactcccaaaccgaccgcgcccctacccgctaaccgaaaacctccgcctcgaaccgacgaatacttaaaaaaaccgcaccccctttcgaacctactctccgcaaaccacaccccctcgcgaatcactcttaaaaaaaacgaaacgcttactcgctaacaacttccgcacaaaacgcgatctatttctccgctaaaaaaaacgtaaaaatacgaccgttaaaaaataaaaactacaaaacgaaaaataaaaaaaaaaaaaaacctaaaaaattaaaaactaccaaaataaaaaaacatcaa

SEQ ID NO: 2197 - DNA, 1114 bp, Artificial Sequence
  chemically treated genomic DNA (Homo sapiens) CpG-island No: 2197
gttcgaattcgaggcgggatcgagggagtaagcgttttagttagatttcgtcggtttagttcgtttcgttgtttatttaataagttgtgggtgggggagggtaaagcgattgggaaaagaggaatcggagtagtcggtttgtgatcgagcgggtcggttaggagtaagaaaggggggatagtagtgagacgtgggagcgaggggagatagcgatagtggtaggacgggggagtgttgttttcgcggtttttattcgttcgtatttttttttaagtagttggaaattcgggttttttttgtcggagttagaggttttcgtaggcgtaagtttttagagtttcgggtgtagagcgcgcggggggttagtatttttcgtaggttattttttcgtcgagtttcgattcggttagttcggtcgcgatgttgttttcgttcgttaggattcggttttatttacggttagcgcgtaggtttagaaggttacgaagatttcggagtagagtagtgttagtttcgttatggcggcgacggcggcgggggtcggaacggcggggtcggagttataaacgcgttttagcgtttatcgttcgtttcgtagtttgttcgttcgtttcgtagcgttatttaattcgtttacgtgatgcgtcggtattacgtgattttacgtcggtttttcgcgtagcgtcgtcgttcgtttagagtaaggcgacgttggaatcgtagcgttggggattgtggtagttgtagttacgcgtttcggcggaggtttgggcgtttttttttttaggaatttcgatatttggtcggtttttttcgagtttttttatttcgttttgttagttttgttttattttcgagtttgttcgcgggtttttaaggcgttttttttggtagtcgtgcgttttagtttgtggcgggtggcgtcgcgcgtgttttttgttttattttgtttacggcgttttttcgttttagtgcgtttgttggcgttcgtttcgttgtttggttaatatttgttgtttttcgaaatcgttttttcggtaagttttttttaatttagtggtagggaagcgcgtttgttgggttttcgcgatgttttggtgatgtttattaagtt

SEQ ID NO: 2198 - DNA, 1114 bp, Artificial Sequence
  chemically treated genomic DNA (Homo sapiens) CpG-island No: 2198
aacttaataaacatcaccaaaacatcgcgaaaacccaacaaacgcgcttccctaccactaaattaaaaaaaacttaccgaaaaaacgatttcgaaaaacaacaaatattaaccaaacaacgaaacgaacgccaacaaacgcactaaaacgaaaaaacgccgtaaacaaaataaaacaaaaaacacgcgcgacgccacccgccacaaactaaaacgcacgactaccaaaaaaaacgccttaaaaacccgcgaacaaactcgaaaataaaacaaaactaacaaaacgaaataaaaaaactcgaaaaaaaccgaccaaatatcgaaattcctaaaaaaaaaaacgcccaaacctccgccgaaacgcgtaactacaactaccacaatccccaacgctacgattccaacgtcgccttactctaaacgaacgacgacgctacgcgaaaaaccgacgtaaaatcacgtaataccgacgcatcacgtaaacgaattaaataacgctacgaaacgaacgaacaaactacgaaacgaacgataaacgctaaaacgcgtttataactccgaccccgccgttccgacccccgccgccgtcgccgccataacgaaactaacactactctactccgaaatcttcgtaaccttctaaacctacgcgctaaccgtaaataaaaccgaatcctaacgaacgaaaacaacatcgcgaccgaactaaccgaatcgaaactcgacgaaaaaataacctacgaaaaatactaaccccccgcgcgctctacacccgaaactctaaaaacttacgcctacgaaaacctctaactccgacaaaaaaaacccgaatttccaactacttaaaaaaaaatacgaacgaataaaaaccgcgaaaacaacactcccccgtcctaccactatcgctatctcccctcgctcccacgtctcactactatcccccctttcttactcctaaccgacccgctcgatcacaaaccgactactccgattcctcttttcccaatcgctttaccctcccccacccacaacttattaaataaacaacgaaacgaactaaaccgacgaaatctaactaaaacgcttactccctcgatcccgcctcgaattcgaac

SEQ ID NO: 2199 - DNA, 1114 bp, Artificial Sequence
  chemically treated genomic DNA (Homo sapiens) CpG-island No: 2199
agtttaataagtattattaggatatcgcgggagtttagtaaacgcgtttttttgttattgggttagggaaggtttgtcggaaggacgatttcggaggatagtaggtgttagttaggtagcggagcgagcgttaataggcgtattggggcggagagacgtcgtgagtaaggtgaggtagagggtacgcgcggcgttattcgttataggttaggacgtacggttgttagagaggacgttttaggggttcgcgagtaggttcgggaataaaatagggttggtagggcgaggtggagagattcgagaaggatcggttagatgtcgaagtttttagagaggagggcgtttaagttttcgtcgagacgcgtgattataattattataatttttagcgttgcggttttagcgtcgttttgttttagacgggcggcggcgttgcgcggggaatcggcgtggggttacgtggtatcggcgtattacgtgggcgagttaggtgacgttgcggggcgggcggatagattgcgggacggacggtggacgttgggacgcgtttgtagtttcggtttcgtcgtttcgattttcgtcgtcgtcgtcgttatgacggggttagtattgttttatttcggggttttcgtggttttttgggtttgcgcgttggtcgtgggtgaggtcgggttttggcgggcgggagtagtatcgcggtcgagttggtcgggtcggaattcggcggggaagtggtttgcggggaatattggtttttcgcgcgttttgtattcgaggttttggggatttgcgtttgcgagggtttttgatttcgataaaggagattcggatttttagttgtttgaggaggggtgcgggcgggtaggggtcgcgagggtagtattttttcgttttgttattatcgttgttttttttcgtttttacgttttattgttgtttttttttttttgtttttgatcggttcgttcggttataagtcggttgtttcggtttttttttttttagtcgttttgtttttttttatttatagtttgttgggtaaatagcggaacggattgggtcggcgggatttggttggagcgtttgttttttcggtttcgtttcggattcgggt

SEQ ID NO: 2200 - DNA, 1114 bp, Artificial Sequence
  chemically treated genomic DNA (Homo sapiens) CpG-island No: 2200
acccgaatccgaaacgaaaccgaaaaaacaaacgctccaaccaaatcccgccgacccaatccgttccgctatttacccaacaaactataaataaaaaaaaacaaaacgactaaaaaaaaaaaaaccgaaacaaccgacttataaccgaacgaaccgatcaaaaacaaaaaaaaaaaaacaacaataaaacgtaaaaacgaaaaaaaacaacgataataacaaaacgaaaaaatactaccctcgcgacccctacccgcccgcacccctcctcaaacaactaaaaatccgaatctcctttatcgaaatcaaaaaccctcgcaaacgcaaatccccaaaacctcgaatacaaaacgcgcgaaaaaccaatattccccgcaaaccacttccccgccgaattccgacccgaccaactcgaccgcgatactactcccgcccgccaaaacccgacctcacccacgaccaacgcgcaaacccaaaaaaccacgaaaaccccgaaataaaacaatactaaccccgtcataacgacgacgacgacgaaaatcgaaacgacgaaaccgaaactacaaacgcgtcccaacgtccaccgtccgtcccgcaatctatccgcccgccccgcaacgtcacctaactcgcccacgtaatacgccgataccacgtaaccccacgccgattccccgcgcaacgccgccgcccgtctaaaacaaaacgacgctaaaaccgcaacgctaaaaattataataattataatcacgcgtctcgacgaaaacttaaacgccctcctctctaaaaacttcgacatctaaccgatccttctcgaatctctccacctcgccctaccaaccctattttattcccgaacctactcgcgaacccctaaaacgtcctctctaacaaccgtacgtcctaacctataacgaataacgccgcgcgtaccctctacctcaccttactcacgacgtctctccgccccaatacgcctattaacgctcgctccgctacctaactaacacctactatcctccgaaatcgtccttccgacaaaccttccctaacccaataacaaaaaaacgcgtttactaaactcccgcgatatcctaataatacttattaaact

SEQ ID NO: 2201 - DNA, 710 bp, Artificial Sequence
  chemically treated genomic DNA (Homo sapiens) CpG-island No: 2201
cgtttaacgaagcgcggagatgtagtttcgttagtttagggcgaagagttcgtggagttgaggggttgtggtaggtttttttcgttcggtttggttcgcgttgtgtttaacgttcggttatagtttcgttatagtcgttgttttcgttttagtgattgataagataagttaggtcggtcgggacggggtagggatttcggtaaggcgcgggttgtttcgagcgtttgttttcggtatttttaatttaggtttttatttttgttagttttggttcggtacggttcggtattagtcgtacggtttagcggaattgcgcggaaatttatttcgggtttttagttttgttttcgcgttagttcgtatttttttgagtaggcggtggagcggttcgtcgttttaggtcgcggtcgagtttaggtttcgtcgttgtttattttgggaaatgtagttcgtgttgcgtttagtcggaaggcggcgtttgcggaggaggtcgggagtacgtgggttggggatttgtagagtttcgtttgttttcggtttatcgcggcgagtaggtatttcgggttagatcggcgcggggcgttgcggtttaattttttagtaggacgacgtgattcgaggggtcggaggacggaggtgggagttcgggttagagggtggaggttggggaggttgtttggttattttggcgtttcgttgtcgggggtatt

SEQ ID NO: 2202 - DNA, 710 bp, Artificial Sequence
  chemically treated genomic DNA (Homo sapiens) CpG-island No: 2202
aatacccccgacaacgaaacgccaaaataaccaaacaacctccccaacctccaccctctaacccgaactcccacctccgtcctccgacccctcgaatcacgtcgtcctactaaaaaattaaaccgcaacgccccgcgccgatctaacccgaaatacctactcgccgcgataaaccgaaaacaaacgaaactctacaaatccccaacccacgtactcccgacctcctccgcaaacgccgccttccgactaaacgcaacacgaactacatttcccaaaataaacaacgacgaaacctaaactcgaccgcgacctaaaacgacgaaccgctccaccgcctactcaaaaaaatacgaactaacgcgaaaacaaaactaaaaacccgaaataaatttccgcgcaattccgctaaaccgtacgactaataccgaaccgtaccgaaccaaaactaacaaaaataaaaacctaaattaaaaataccgaaaacaaacgctcgaaacaacccgcgccttaccgaaatccctaccccgtcccgaccgacctaacttatcttatcaatcactaaaacgaaaacaacgactataacgaaactataaccgaacgttaaacacaacgcgaaccaaaccgaacgaaaaaaacctaccacaacccctcaactccacgaactcttcgccctaaactaacgaaactacatctccgcgcttcgttaaacg

SEQ ID NO: 2203 - DNA, 710 bp, Artificial Sequence
  chemically treated genomic DNA (Homo sapiens) CpG-island No: 2203
gatgttttcggtagcggagcgttagagtgattaggtaatttttttagtttttattttttagttcgggtttttattttcgtttttcggtttttcgagttacgtcgttttattaaggagttgggtcgtagcgtttcgcgtcggtttgattcggaatgtttgttcgtcgcggtaggtcgaggataggcggggttttgtaggtttttaatttacgtgttttcggtttttttcgtaggcgtcgtttttcggttaggcgtaatacggattatattttttagggtgaatagcggcggggtttagattcggtcgcggtttggggcggcgagtcgttttatcgtttgtttaggggagtgcgagttggcgcgaggatagggttaaggattcggaatgagttttcgcgtagtttcgttgggtcgtgcggttggtatcgggtcgtgtcgagttagaattggtaggagtgggggtttgagttggaggtgtcggggataggcgttcggggtagttcgcgttttgtcgaggtttttgtttcgtttcggtcggtttggtttgttttgttagttattggggcggaggtagcggttgtagcggggttgtagtcgggcgttgagtatagcgcgggttaggtcgaacggaagggatttgttatagttttttaattttacggatttttcgttttagattagcggagttgtattttcgcgtttcgttggacg

SEQ ID NO: 2204 - DNA, 710 bp, Artificial Sequence
  chemically treated genomic DNA (Homo sapiens) CpG-island No: 2204
cgtccaacgaaacgcgaaaatacaactccgctaatctaaaacgaaaaatccgtaaaattaaaaaactataacaaatcccttccgttcgacctaacccgcgctatactcaacgcccgactacaaccccgctacaaccgctacctccgccccaataactaacaaaacaaaccaaaccgaccgaaacgaaacaaaaacctcgacaaaacgcgaactaccccgaacgcctatccccgacacctccaactcaaacccccactcctaccaattctaactcgacacgacccgataccaaccgcacgacccaacgaaactacgcgaaaactcattccgaatccttaaccctatcctcgcgccaactcgcactcccctaaacaaacgataaaacgactcgccgccccaaaccgcgaccgaatctaaaccccgccgctattcaccctaaaaaatataatccgtattacgcctaaccgaaaaacgacgcctacgaaaaaaaccgaaaacacgtaaattaaaaacctacaaaaccccgcctatcctcgacctaccgcgacgaacaaacattccgaatcaaaccgacgcgaaacgctacgacccaactccttaataaaacgacgtaactcgaaaaaccgaaaaacgaaaataaaaacccgaactaaaaaataaaaactaaaaaaattacctaatcactctaacgctccgctaccgaaaacatc

SEQ ID NO: 2205 - DNA, 598 bp, Artificial Sequence
  chemically treated genomic DNA (Homo sapiens) CpG-island No: 2205
gttgacgtttatgaaggagatcgtttcgtagcgcgtgggtcggtagtagggttggttgacgggtcgggagttcgggggcggtcgtagggtttcggcgtttagtaggttggttaggttgaggtcgtgtggagagcgcgcgtcggaggagcgttgtagaagcggaaacgtattagttcgtcggagcggtggtttaggtcgagcgcgcgtatcggtattagttgcgagcgtaggcgtagtttcgcgttttcgttgttcgagcgcgttgttcggttttttagtcgcgtcgcgcggattcgcggggaagagtagatgggggtgtaggcggcgggggcgcgggtcgagaagtgtttgcggcgcggtcgtcgggtttttttattgtattagcgggtcgtgcgtttttttggaatgagatttagttacgcgcggtgtttcgggttagtttcgtttcgttttttcgtttttttatttattcggtaggtggtcggcgggggacgttaggataggcggggggttttcgcggggggtagggttgcggggcgcggagtttagggaggtttttgcgacgttgtttagtagagttagagcggttagggtgggt

SEQ ID NO: 2206 - DNA, 598 bp, Artificial Sequence
  chemically treated genomic DNA (Homo sapiens) CpG-island No: 2206
acccaccctaaccgctctaactctactaaacaacgtcgcaaaaacctccctaaactccgcgccccgcaaccctaccccccgcgaaaaccccccgcctatcctaacgtcccccgccgaccacctaccgaataaataaaaaaacgaaaaaacgaaacgaaactaacccgaaacaccgcgcgtaactaaatctcattccaaaaaaacgcacgacccgctaatacaataaaaaaacccgacgaccgcgccgcaaacacttctcgacccgcgcccccgccgcctacacccccatctactcttccccgcgaatccgcgcgacgcgactaaaaaaccgaacaacgcgctcgaacaacgaaaacgcgaaactacgcctacgctcgcaactaataccgatacgcgcgctcgacctaaaccaccgctccgacgaactaatacgtttccgcttctacaacgctcctccgacgcgcgctctccacacgacctcaacctaaccaacctactaaacgccgaaaccctacgaccgcccccgaactcccgacccgtcaaccaaccctactaccgacccacgcgctacgaaacgatctccttcataaacgtcaac

SEQ ID NO: 2207 - DNA, 598 bp, Artificial Sequence
  chemically treated genomic DNA (Homo sapiens) CpG-island No: 2207
gtttattttggtcgttttggttttgttgagtagcgtcgtagaggtttttttgggtttcgcgtttcgtagttttgtttttcgcgaaggtttttcgtttgttttggcgtttttcgtcggttatttgtcgggtaggtgagagggcgagggggcggggcggggttggttcgggatatcgcgcgtgattgggttttattttagggggacgtacggttcgttggtgtagtggaagagttcggcggtcgcgtcgtagatatttttcggttcgcgttttcgtcgtttgtatttttatttgttttttttcgcgggttcgcgcggcgcggttggggggtcgggtagcgcgttcgggtagcgggggcgcggggttgcgtttgcgttcgtagttggtgtcggtgcgcgcgttcggtttgggttatcgtttcgacgagttggtgcgttttcgtttttgtagcgttttttcggcgcgcgttttttatacgattttagtttggttagtttattgggcgtcggggttttgcgatcgttttcgggttttcggttcgttagttagttttgttgtcgatttacgcgttacgaagcggttttttttatggacgttaat

SEQ ID NO: 2208 - DNA, 598 bp, Artificial Sequence
  chemically treated genomic DNA (Homo sapiens) CpG-island No: 2208
attaacgtccataaaaaaaaccgcttcgtaacgcgtaaatcgacaacaaaactaactaacgaaccgaaaacccgaaaacgatcgcaaaaccccgacgcccaataaactaaccaaactaaaatcgtataaaaaacgcgcgccgaaaaaacgctacaaaaacgaaaacgcaccaactcgtcgaaacgataacccaaaccgaacgcgcgcaccgacaccaactacgaacgcaaacgcaaccccgcgcccccgctacccgaacgcgctacccgaccccccaaccgcgccgcgcgaacccgcgaaaaaaaacaaataaaaatacaaacgacgaaaacgcgaaccgaaaaatatctacgacgcgaccgccgaactcttccactacaccaacgaaccgtacgtccccctaaaataaaacccaatcacgcgcgatatcccgaaccaaccccgccccgccccctcgccctctcacctacccgacaaataaccgacgaaaaacgccaaaacaaacgaaaaaccttcgcgaaaaacaaaactacgaaacgcgaaacccaaaaaaacctctacgacgctactcaacaaaaccaaaacgaccaaaataaac

SEQ ID NO: 2209 - DNA, 846 bp, Artificial Sequence
  chemically treated genomic DNA (Homo sapiens) CpG-island No: 2209
agtcgttttttcgttcgtttttttagaattttttgtttttttttaaattatttttaatattttttatatacgggtttcgtttttaaatacggagtgtaatttcgcgtatagtagcgcggaggttgtagcgttattaagaaaggcgtcgttaatttttatttagtgtttttttttattagttttttttttacgtcgcgtttcgaagcgtacgatatcgtggtgttcggtgttttttttggtagcgcggtattggagtttaaggcgtgcgtgttatattttatttttcggtagtcgttcgggtgcgcgcgttacgcgtttttatatttacgttggcgttcgttagagttgggattttggtcggggttttcgatttacgtcgcggaatttgggggttgtagaaggcgagtgcgcggcgggagtcgttttgtcgtaggttcgagttttttttttgttatcgtggggtttcggagttgtttcgcgttttcgttttaggcggtttgcgggattattttttcggggttagcgttgtttcgcgtcggcggtagttgtaagcgcgggcggcggggtatagcgggtggttcggttttaaagtcggcgggaggttacgtttagtttcgcgttgtacgttttattgtttcgggtagcgcggcggcggttttcgcggttagaggaatcgcggtttcgagtttcggggagaggcggcggttttcggtttacgtatcgaggttgcgtcgcgtttcgttttcgagtttcgttcgttttagagtttttttttttttcgcgattttttttatttttttcgttttaggtttatttagttggcgggagtcgggtattgggaagttg

SEQ ID NO: 2210 - DNA, 846 bp, Artificial Sequence
  chemically treated genomic DNA (Homo sapiens) CpG-island No: 2210
caacttcccaatacccgactcccgccaactaaataaacctaaaacgaaaaaaataaaaaaaatcgcgaaaaaaaaaaaaactctaaaacgaacgaaactcgaaaacgaaacgcgacgcaacctcgatacgtaaaccgaaaaccgccgcctctccccgaaactcgaaaccgcgattcctctaaccgcgaaaaccgccgccgcgctacccgaaacaataaaacgtacaacgcgaaactaaacgtaacctcccgccgactttaaaaccgaaccacccgctataccccgccgcccgcgcttacaactaccgccgacgcgaaacaacgctaaccccgaaaaaataatcccgcaaaccgcctaaaacgaaaacgcgaaacaactccgaaaccccacgataacaaaaaaaaaactcgaacctacgacaaaacgactcccgccgcgcactcgccttctacaacccccaaattccgcgacgtaaatcgaaaaccccgaccaaaatcccaactctaacgaacgccaacgtaaatataaaaacgcgtaacgcgcgcacccgaacgactaccgaaaaataaaatataacacgcacgccttaaactccaataccgcgctaccaaaaaaaacaccgaacaccacgatatcgtacgcttcgaaacgcgacgtaaaaaaaaaactaataaaaaaaaacactaaataaaaattaacgacgcctttcttaataacgctacaacctccgcgctactatacgcgaaattacactccgtatttaaaaacgaaacccgtatataaaaaatattaaaaataatttaaaaaaaaacaaaaaattctaaaaaaacgaacgaaaaaacgact

SEQ ID NO: 2211 - DNA, 846 bp, Artificial Sequence
  chemically treated genomic DNA (Homo sapiens) CpG-island No: 2211
taattttttagtgttcggttttcgttagttaggtgagtttggagcgggaaggatgaaagggatcgcggagagggagggggttttggggcgagcggagttcgggggcggggcgcggcgtagtttcggtgcgtgggtcgggaatcgtcgttttttttcggggttcggggtcgcggtttttttggtcgcgggagtcgtcgtcgcgttgttcgaaataatgaggcgtgtagcgcggggttgagcgtagtttttcgtcggttttgaggtcgagttattcgttgtgtttcgtcgttcgcgtttgtagttgtcgtcggcgcggagtagcgttggtttcggagaggtgatttcgtaggtcgtttgggacgggagcgcggggtagtttcgagattttacggtggtaggaggaggattcgagtttgcggtaggacgattttcgtcgcgtattcgttttttgtagtttttaagtttcgcggcgtgagtcggggatttcggttagggttttagttttagcgggcgttagcgtgagtgtgggagcgcgtagcgcgcgtattcgagcggttgtcggggaataaaatgtgatacgtacgttttggattttagtgtcgcgttgttagggggagtatcgagtattacggtgtcgtgcgtttcgaggcgcggcgtgggaagaaggttggtaagggagggtattgggtaagggttggcgacgttttttttggtggcgttgtagttttcgcgttgttgtgcgcggagttatatttcgtgtttaggagcgagattcgtgtgtggggaatgttgaaggtggtttggggaaaagtaggaaattttggagaagcgaacgggaggacggtt

SEQ ID NO: 2212 - DNA, 846 bp, Artificial Sequence
  chemically treated genomic DNA (Homo sapiens) CpG-island No: 2212
aaccgtcctcccgttcgcttctccaaaatttcctacttttccccaaaccaccttcaacattccccacacacgaatctcgctcctaaacacgaaatataactccgcgcacaacaacgcgaaaactacaacgccaccaaaaaaaacgtcgccaacccttacccaataccctcccttaccaaccttcttcccacgccgcgcctcgaaacgcacgacaccgtaatactcgatactccccctaacaacgcgacactaaaatccaaaacgtacgtatcacattttattccccgacaaccgctcgaatacgcgcgctacgcgctcccacactcacgctaacgcccgctaaaactaaaaccctaaccgaaatccccgactcacgccgcgaaacttaaaaactacaaaaaacgaatacgcgacgaaaatcgtcctaccgcaaactcgaatcctcctcctaccaccgtaaaatctcgaaactaccccgcgctcccgtcccaaacgacctacgaaatcacctctccgaaaccaacgctactccgcgccgacgacaactacaaacgcgaacgacgaaacacaacgaataactcgacctcaaaaccgacgaaaaactacgctcaaccccgcgctacacgcctcattatttcgaacaacgcgacgacgactcccgcgaccaaaaaaaccgcgaccccgaaccccgaaaaaaaacgacgattcccgacccacgcaccgaaactacgccgcgccccgcccccgaactccgctcgccccaaaaccccctccctctccgcgatccctttcatccttcccgctccaaactcacctaactaacgaaaaccgaacactaaaaaatta

SEQ ID NO: 2213 - DNA, 769 bp, Artificial Sequence
  chemically treated genomic DNA (Homo sapiens) CpG-island No: 2213
ttttcggcgtagttattagtttcgttttggttgttttttcgttcgttttatttagaggcggtatttaggacgcgagtaggcggatagtaggacgcggggtacgtcggtatttgaagttttttagaagtgtacgtcgggattaggatttcgggaggtcgatttttttttgttttacgaatgtcgggaattgtggttttcgtcggacgcgagttgtgagacggtttaaggggtcgcggggtatgttgggatcgttagttttttcggcgcgttttaggatttcgggtttttttatttcgggcggatgtttaaagatttcgtttttttaagagtttttgcggtcgggcgcgaaaatggcggcggcggcgacggtcgggcgtttttgaagtagtagttatggagttttttttagggtcggggtcggagcggttttttgattcgtatcggtaagagattcggcgggaagagatcgattttcgcgtgttttcggttttcggcgtttgattatttcgtttttcgtttttaggttttcgggtgattgttttttattgttcgtgttgttgttttacgcgttagtcgggttttgttttttcgttttgcgtttttttttcgggatttacgtttttttggttagttgcgcgttgttagatagcgtttttcgtaggtttcgacgcgggcgttcggggagtgttagagttgggtttggttcgaggttatatagttattattttttgtgtttttagattcgtagtgcggattatgtgtgcggtgt

SEQ ID NO: 2214 - DNA, 769 bp, Artificial Sequence
  chemically treated genomic DNA (Homo sapiens) CpG-island No: 2214
acaccgcacacataatccgcactacgaatctaaaaacacaaaaaataataactatataacctcgaaccaaacccaactctaacactccccgaacgcccgcgtcgaaacctacgaaaaacgctatctaacaacgcgcaactaaccaaaaaaacgtaaatcccgaaaaaaaaacgcaaaacgaaaaaacaaaacccgactaacgcgtaaaacaacaacacgaacaataaaaaacaatcacccgaaaacctaaaaacgaaaaacgaaataatcaaacgccgaaaaccgaaaacacgcgaaaatcgatctcttcccgccgaatctcttaccgatacgaatcaaaaaaccgctccgaccccgaccctaaaaaaaactccataactactacttcaaaaacgcccgaccgtcgccgccgccgccattttcgcgcccgaccgcaaaaactcttaaaaaaacgaaatctttaaacatccgcccgaaataaaaaaacccgaaatcctaaaacgcgccgaaaaaactaacgatcccaacataccccgcgaccccttaaaccgtctcacaactcgcgtccgacgaaaaccacaattcccgacattcgtaaaacaaaaaaaaatcgacctcccgaaatcctaatcccgacgtacacttctaaaaaacttcaaataccgacgtaccccgcgtcctactatccgcctactcgcgtcctaaataccgcctctaaataaaacgaacgaaaaaacaaccaaaacgaaactaataactacgccgaaaa

SEQ ID NO: 2215 - DNA, 769 bp, Artificial Sequence
  chemically treated genomic DNA (Homo sapiens) CpG-island No: 2215
gtatcgtatatatggttcgtattacgaatttggggatataggaggtggtgattgtgtggtttcgggttagatttagttttgatatttttcgaacgttcgcgtcggaatttgcgaaggacgttgtttggtagcgcgtagttgattaggaagacgtggatttcgagaaagaggcgtaggacgaggaggtagaattcgattggcgcgtagagtagtagtacgagtagtaggaagtagttattcggaagtttgggggcgagaggcgaagtggttaggcgtcgaaggtcgagagtacgcggggatcggttttttttcgtcgggttttttatcggtgcgagttaaagagtcgtttcggtttcggttttgagggaagttttataattgttgttttaggagcgttcggtcgtcgtcgtcgtcgttattttcgcgttcggtcgtaggggtttttgggaaggcggagtttttgggtattcgttcggggtgaggggattcgaagttttgaggcgcgtcggaagggttagcggttttagtatatttcgcggttttttgggtcgttttataattcgcgttcggcggagattataattttcggtattcgtggggtagggaggagtcggtttttcggaattttggtttcggcgtgtatttttgaaggattttaggtatcggcgtgtttcgcgttttattgttcgtttgttcgcgttttgggtgtcgtttttgagtagggcgggcgaggaggtagttaaggcggagttgatggttgcgtcgaggg

SEQ ID NO: 2216 - DNA, 769 bp, Artificial Sequence
  chemically treated genomic DNA (Homo sapiens) CpG-island No: 2216
ccctcgacgcaaccatcaactccgccttaactacctcctcgcccgccctactcaaaaacgacacccaaaacgcgaacaaacgaacaataaaacgcgaaacacgccgatacctaaaatccttcaaaaatacacgccgaaaccaaaattccgaaaaaccgactcctccctaccccacgaataccgaaaattataatctccgccgaacgcgaattataaaacgacccaaaaaaccgcgaaatatactaaaaccgctaacccttccgacgcgcctcaaaacttcgaatcccctcaccccgaacgaatacccaaaaactccgccttcccaaaaacccctacgaccgaacgcgaaaataacgacgacgacgacgaccgaacgctcctaaaacaacaattataaaacttccctcaaaaccgaaaccgaaacgactctttaactcgcaccgataaaaaacccgacgaaaaaaaaccgatccccgcgtactctcgaccttcgacgcctaaccacttcgcctctcgcccccaaacttccgaataactacttcctactactcgtactactactctacgcgccaatcgaattctacctcctcgtcctacgcctctttctcgaaatccacgtcttcctaatcaactacgcgctaccaaacaacgtccttcgcaaattccgacgcgaacgttcgaaaaatatcaaaactaaatctaacccgaaaccacacaatcaccacctcctatatccccaaattcgtaatacgaaccatatatacgatac

SEQ ID NO: 2217 - DNA, 970 bp, Artificial Sequence
  chemically treated genomic DNA (Homo sapiens) CpG-island No: 2217
ggcgtaacggtagtgaagtgaaaaatggcgggaaaggtcgtttttgagttggtcgtgtatttgcgtaacgttggtttgggagtcggtcggtggtggaggagttttcgacgatagttttaaggtttgtcgttttttacgcgttcggttgttattagattatggacgtaggtagtcgcgcgttttatcgtttcgggttcggcgttttacgtcgatcggacgggcgtcgtttatattatcgaggcgagttcggatattgaagttattttgttgttttcggtttagggttgtaggttttgtagcgcgaagagcgacgagttgtgtaggtagagagggttcgggggtagcggcggtcgtagcggtcgtggtaacgcgttttgttgtagatgtaggagtagtcggttcgcgcggtgtcgttcggtttcgcgttttttcgtcgtttggcgtttaagggagggagacgcggggttagcggggcgttcgtcgcgtcgttttttattaggttttgttcgggaattttagttcgttttcgttcgcgtcgcgttttatcgttatttggtgcgtcggttttggaattacgttttgatttgtgcgtcggttatgcgtaaggttttggttagcgtcgtttttttcgtagaggttaggtatttttggcgtaggaagcgtcgttttaattttagtatttgtgagcgggagaaggacgtgcgcggtttttttcgtttcggaggggttcggttttggtaggggtggtttatgcggcgcgttttagagaagggcgagagcgtagttatcgggaggaagaaagattagggtaggatttgtagggtggttcgaggtgttattgagaaggtcgcgcggttgtttaggtcgtagaattttcgcgttttgtttttattcgggttttaagtattagtcgagttttatagttaagaaaggttttttttttgggatgcgagggagacgttttttgtaa

SEQ ID NO: 2218 - DNA, 970 bp, Artificial Sequence
  chemically treated genomic DNA (Homo sapiens) CpG-island No: 2218
ttacaaaaaacgtctccctcgcatcccaaaaaaaaaacctttcttaactataaaactcgactaatacttaaaacccgaataaaaacaaaacgcgaaaattctacgacctaaacaaccgcgcgaccttctcaataacacctcgaaccaccctacaaatcctaccctaatctttcttcctcccgataactacgctctcgcccttctctaaaacgcgccgcataaaccacccctaccaaaaccgaacccctccgaaacgaaaaaaaccgcgcacgtccttctcccgctcacaaatactaaaattaaaacgacgcttcctacgccaaaaatacctaacctctacgaaaaaaacgacgctaaccaaaaccttacgcataaccgacgcacaaatcaaaacgtaattccaaaaccgacgcaccaaataacgataaaacgcgacgcgaacgaaaacgaactaaaattcccgaacaaaacctaataaaaaacgacgcgacgaacgccccgctaaccccgcgtctccctcccttaaacgccaaacgacgaaaaaacgcgaaaccgaacgacaccgcgcgaaccgactactcctacatctacaacaaaacgcgttaccacgaccgctacgaccgccgctacccccgaaccctctctacctacacaactcgtcgctcttcgcgctacaaaacctacaaccctaaaccgaaaacaacaaaataacttcaatatccgaactcgcctcgataatataaacgacgcccgtccgatcgacgtaaaacgccgaacccgaaacgataaaacgcgcgactacctacgtccataatctaataacaaccgaacgcgtaaaaaacgacaaaccttaaaactatcgtcgaaaactcctccaccaccgaccgactcccaaaccaacgttacgcaaatacacgaccaactcaaaaacgacctttcccgccatttttcacttcactaccgttacgcc

SEQ ID NO: 2219 - DNA, 970 bp, Artificial Sequence
  chemically treated genomic DNA (Homo sapiens) CpG-island No: 2219
ttataggggacgtttttttcgtattttaggggaagggttttttttggttatagggttcggttgatgtttagggttcgggtaaggatagggcgcgggagttttgcggtttggatagtcgcgcggtttttttagtggtatttcgggttattttgtaaattttgttttggtttttttttttttcggtagttgcgttttcgtttttttttgggacgcgtcgtataggttatttttattaaaatcggattttttcgaagcggaagaagtcgcgtacgtttttttttcgtttataggtgttggagttggagcggcgttttttgcgttagaagtatttggtttttgcggagagggcggcgttggttaaggttttgcgtatgatcgacgtataggttaaaacgtggttttagaatcgacgtattaagtggcggtgaggcgcggcgcgggcgagggcggattggggttttcgagtagggtttggtgagaagcgacgcggcgggcgtttcgttgatttcgcgttttttttttttaggcgttagacggcggaggagcgcgaggtcgagcggtatcgcgcgggtcggttgtttttgtatttgtagtaggacgcgttgttacggtcgttgcggtcgtcgttgttttcggattttttttgtttgtataattcgtcgtttttcgcgttgtagaatttgtagttttgggtcgaggataataaagtggttttagtgttcgggttcgtttcggtggtgtgagcgacgttcgttcgatcggcgtggagcgtcgggttcggagcggtggagcgcgcggttgtttgcgtttatggtttagtggtagtcgggcgcgtgaggagcggtaggttttgaggttgtcgtcgagggtttttttattatcggtcggtttttaagttagcgttgcgtagatgtacggttagtttagaggcggtttttttcgttattttttattttattgtcgttacgtt

SEQ ID NO: 2220 - DNA, 970 bp, Artificial Sequence
  chemically treated genomic DNA (Homo sapiens) CpG-island No: 2220
aacgtaacgacaataaaataaaaaataacgaaaaaaaccgcctctaaactaaccgtacatctacgcaacgctaacttaaaaaccgaccgataataaaaaaaccctcgacgacaacctcaaaacctaccgctcctcacgcgcccgactaccactaaaccataaacgcaaacaaccgcgcgctccaccgctccgaacccgacgctccacgccgatcgaacgaacgtcgctcacaccaccgaaacgaacccgaacactaaaaccactttattatcctcgacccaaaactacaaattctacaacgcgaaaaacgacgaattatacaaacaaaaaaaatccgaaaacaacgacgaccgcaacgaccgtaacaacgcgtcctactacaaatacaaaaacaaccgacccgcgcgataccgctcgacctcgcgctcctccgccgtctaacgcctaaaaaaaaaaaacgcgaaatcaacgaaacgcccgccgcgtcgcttctcaccaaaccctactcgaaaaccccaatccgccctcgcccgcgccgcgcctcaccgccacttaatacgtcgattctaaaaccacgttttaacctatacgtcgatcatacgcaaaaccttaaccaacgccgccctctccgcaaaaaccaaatacttctaacgcaaaaaacgccgctccaactccaacacctataaacgaaaaaaaaacgtacgcgacttcttccgcttcgaaaaaatccgattttaataaaaataacctatacgacgcgtcccaaaaaaaaacgaaaacgcaactaccgaaaaaaaaaaaaaccaaaacaaaatttacaaaataacccgaaataccactaaaaaaaccgcgcgactatccaaaccgcaaaactcccgcgccctatccttacccgaaccctaaacatcaaccgaaccctataaccaaaaaaaacccttcccctaaaatacgaaaaaaacgtcccctataa

SEQ ID NO: 2221 - DNA, 734 bp, Artificial Sequence
  chemically treated genomic DNA (Homo sapiens) CpG-island No: 2221
gacgttggaggggttagataattttattcgtgagtcggtttttggtaaagcggcggtcgttgtttatttaggggaaggtgagtttcgttaggttttcggcgtcgtttaaattcgagggtttaggtattgtaggcgtttttttagcgggcggcggtataggtagcgggcggtgcgtagggacgcggattacgtcgtttgggtttatttcggagttgtcgggtagcggggtaagtgagtcggcgggatcgtagttcgaggtttcgtggtatttattcgagaacgttttattttttttatgattttggttttcgcgatttaggtttagatcgttttttggggtttcggggtcgtttaggatttgatcgatgtcgaagttgattggttcgtggtgtgggaggttgtgtggatttagtattttcggttttatcggtttgggtcgaggagaatcgtcggaggttcggtggttggggaggatgttttaggtagcgttagaagtttagcggcggcgcgtttcggagagtggttttaggggttcgcggggttggttaaggtagggcgtcggggttttcgaaatagtagtatttttgtgtattcggagtagtcgcgttcgtgttagtcgttgtcgggcgttagcgtagggatttgtatttcgggggagtacggttagttggggtttttggagtttttttgttggtttttaagcgtaaatagacgttgggttgtcggcgtcgttg

SEQ ID NO: 2222 - DNA, 734 bp, Artificial Sequence
  chemically treated genomic DNA (Homo sapiens) CpG-island No: 2222
caacgacgccgacaacccaacgtctatttacgcttaaaaaccaacaaaaaaactccaaaaaccccaactaaccgtactcccccgaaatacaaatccctacgctaacgcccgacaacgactaacacgaacgcgactactccgaatacacaaaaatactactatttcgaaaaccccgacgccctaccttaaccaaccccgcgaacccctaaaaccactctccgaaacgcgccgccgctaaacttctaacgctacctaaaacatcctccccaaccaccgaacctccgacgattctcctcgacccaaaccgataaaaccgaaaatactaaatccacacaacctcccacaccacgaaccaatcaacttcgacatcgatcaaatcctaaacgaccccgaaaccccaaaaaacgatctaaacctaaatcgcgaaaaccaaaatcataaaaaaaataaaacgttctcgaataaataccacgaaacctcgaactacgatcccgccgactcacttaccccgctacccgacaactccgaaataaacccaaacgacgtaatccgcgtccctacgcaccgcccgctacctataccgccgcccgctaaaaaaacgcctacaatacctaaaccctcgaatttaaacgacgccgaaaacctaacgaaactcaccttcccctaaataaacaacgaccgccgctttaccaaaaaccgactcacgaataaaattatctaacccctccaacgtc

SEQ ID NO: 2223 - DNA, 734 bp, Artificial Sequence
  chemically treated genomic DNA (Homo sapiens) CpG-island No: 2223
tagcggcgtcggtagtttagcgtttatttgcgtttaagagttagtaaggaagttttaggggttttagttggtcgtgttttttcgggatgtaagtttttgcgttgacgttcggtagcggttggtacgggcgcggttgtttcgggtgtatagggatgttgttgtttcggggatttcggcgttttgttttggttagtttcgcgggtttttgaggttatttttcggagcgcgtcgtcgttgggtttttggcgttgtttgaggtattttttttaattatcgaattttcggcggtttttttcggtttagatcgatggagtcggggatgttgggtttatataattttttatattacgagttaattagtttcggtatcgattagattttgagcggtttcgaaattttagggggcggtttaggtttgggtcgcgggggttagggttatggggagaatggggcgttttcgggtggatattacggagtttcgggttacggtttcgtcggtttatttgtttcgttgttcggtagtttcggagtgggtttaggcggcgtgattcgcgtttttgcgtatcgttcgttgtttgtgtcgtcgttcgttgggggggcgtttgtagtgtttgggttttcgggtttgggcggcgtcggaggtttagcgggatttatttttttttggatggatagcggtcgtcgttttgttaaggatcggtttacgggtgaggttgtttgatttttttagcgtt

SEQ ID NO: 2224 - DNA, 734 bp, Artificial Sequence
  chemically treated genomic DNA (Homo sapiens) CpG-island No: 2224
aacgctaaaaaaatcaaacaacctcacccgtaaaccgatccttaacaaaacgacgaccgctatccatccaaaaaaaaataaatcccgctaaacctccgacgccgcccaaacccgaaaacccaaacactacaaacgcccccccaacgaacgacgacacaaacaacgaacgatacgcaaaaacgcgaatcacgccgcctaaacccactccgaaactaccgaacaacgaaacaaataaaccgacgaaaccgtaacccgaaactccgtaatatccacccgaaaacgccccattctccccataaccctaacccccgcgacccaaacctaaaccgccccctaaaatttcgaaaccgctcaaaatctaatcgataccgaaactaattaactcgtaatataaaaaattatataaacccaacatccccgactccatcgatctaaaccgaaaaaaaccgccgaaaattcgataattaaaaaaaatacctcaaacaacgccaaaaacccaacgacgacgcgctccgaaaaataacctcaaaaacccgcgaaactaaccaaaacaaaacgccgaaatccccgaaacaacaacatccctatacacccgaaacaaccgcgcccgtaccaaccgctaccgaacgtcaacgcaaaaacttacatcccgaaaaaacacgaccaactaaaacccctaaaacttccttactaactcttaaacgcaaataaacgctaaactaccgacgccgcta

SEQ ID NO: 2225 - DNA, 663 bp, Artificial Sequence
  chemically treated genomic DNA (Homo sapiens) CpG-island No: 2225
cgttacgtattaattttgtgttaagtcgtaggtagcggtttcggattttgggatttaatttaacgtggcggggcgggattttcggcgggaggcggaggcggaggcgtaggcgttggttggtaggtgtcgttaatcggacggtggtcgttagggcgagaggcgggagtcggagaggtgaggtaggattcgggttttattgtcgttttttcgagtttttgtgacgcggattttagtgttaggatggttcggggcgagcggcggcgtcgcgtagtgtcggtagagggagtgcggatagtcgagagggcggttcggggaggtttcgggcgacgggacggtcggggcggcgggtcgcgtagtacggttggaggagtggttttggtcgtcgtggttttgtttttggttttgggtatgtcggggcgttgggtgttggcgtggtatcgtgcgcggcgggcggttacgttgtatttcgcgttttttgtgttgtttgtcgatttttttagtttcgtcgtggtttcggattttttttggggaatttatcgtttttacgtttatttcggtatgaagattcgtagttcgaagtttttttttatcggtaatcgggttttagggcgggtaggtaggcggatttttaatttgggcgttttagtttgaagcgagagtaag

SEQ ID NO: 2226 - DNA, 663 bp, Artificial Sequence
  chemically treated genomic DNA (Homo sapiens) CpG-island No: 2226
cttactctcgcttcaaactaaaacgcccaaattaaaaatccgcctacctacccgccctaaaacccgattaccgataaaaaaaaacttcgaactacgaatcttcataccgaaataaacgtaaaaacgataaattccccaaaaaaaatccgaaaccacgacgaaactaaaaaaatcgacaaacaacacaaaaaacgcgaaatacaacgtaaccgcccgccgcgcacgataccacgccaacacccaacgccccgacatacccaaaaccaaaaacaaaaccacgacgaccaaaaccactcctccaaccgtactacgcgacccgccgccccgaccgtcccgtcgcccgaaacctccccgaaccgccctctcgactatccgcactccctctaccgacactacgcgacgccgccgctcgccccgaaccatcctaacactaaaatccgcgtcacaaaaactcgaaaaaacgacaataaaacccgaatcctacctcacctctccgactcccgcctctcgccctaacgaccaccgtccgattaacgacacctaccaaccaacgcctacgcctccgcctccgcctcccgccgaaaatcccgccccgccacgttaaattaaatcccaaaatccgaaaccgctacctacgacttaacacaaaattaatacgtaacg

SEQ ID NO: 2227 - DNA, 663 bp, Artificial Sequence
  chemically treated genomic DNA (Homo sapiens) CpG-island No: 2227
tttgttttcgttttaagttggggcgtttagattaggagttcgtttgtttgttcgttttggggttcggttatcggtgaggaggggtttcgggttgcgggtttttatgtcgaagtagacgtgagggcggtaggttttttagaagaggttcggggttacggcggggttggaggagtcggtaggtaatataggaggcgcggagtgtagcgtgatcgttcgtcgcgtacggtattacgttagtatttagcgtttcgatatatttagggttaaagataggattacgacggttagagttatttttttagtcgtgttacgcggttcgtcgtttcggtcgtttcgtcgttcggggttttttcgagtcgttttttcggttgttcgtattttttttgtcggtattgcgcggcgtcgtcgttcgtttcgagttattttggtattgaggttcgcgttataagagttcggagaggcggtagtggagttcgggttttgttttattttttcggttttcgtttttcgttttggcgattatcgttcggttagcgatatttgttagttagcgtttgcgttttcgttttcgtttttcgtcggaagtttcgtttcgttacgttaggttaagttttagagttcggaatcgttgtttgcggtttgatatagggttggtacgtagcg

SEQ ID NO: 2228 - DNA, 663 bp, Artificial Sequence
  chemically treated genomic DNA (Homo sapiens) CpG-island No: 2228
cgctacgtaccaaccctatatcaaaccgcaaacaacgattccgaactctaaaacttaacctaacgtaacgaaacgaaacttccgacgaaaaacgaaaacgaaaacgcaaacgctaactaacaaatatcgctaaccgaacgataatcgccaaaacgaaaaacgaaaaccgaaaaaataaaacaaaacccgaactccactaccgcctctccgaactcttataacgcgaacctcaataccaaaataactcgaaacgaacgacgacgccgcgcaataccgacaaaaaaaatacgaacaaccgaaaaaacgactcgaaaaaaccccgaacgacgaaacgaccgaaacgacgaaccgcgtaacacgactaaaaaaataactctaaccgtcgtaatcctatctttaaccctaaatatatcgaaacgctaaatactaacgtaataccgtacgcgacgaacgatcacgctacactccgcgcctcctatattacctaccgactcctccaaccccgccgtaaccccgaacctcttctaaaaaacctaccgccctcacgtctacttcgacataaaaacccgcaacccgaaacccctcctcaccgataaccgaaccccaaaacgaacaaacaaacgaactcctaatctaaacgccccaacttaaaacgaaaacaaa

SEQ ID NO: 2229 - DNA, 780 bp, Artificial Sequence
  chemically treated genomic DNA (Homo sapiens) CpG-island No: 2229
tgttacgcggcgatttttgagttacggggtttttagcgttcgggaagttaggtttgttaggttggggcggttggcggggtagggtttttcggttcgttttaagtttaggtaggcgttcgcgattcgcgcgggtagggagaacgcgtttttatagtgttcgcgaggtgtagtgcgtttttgggggtttcggggtcgtcgggttaggtcggtttggcgtttagggattggtcggacgggttgggtttttggcgggggtggaagaggaggttgtcgcgttttgttcggtttaggtgtcgttttcgggggcggggtttggagtttcgtagcgggagattttcggtcggattggcggacgagcgtcgagagatagaagtcgaggagaggaggttaagtcgggcggcgcggggagcgtattgagtaggtaaagtcgtagggtcgttagtatgttttttcgaaattatcggagtcgggttatcgtggttaggggtttcgttttggagatggagtttaaacgcggtcgttttcgatttagtttttttagcgatttgttcgaggtgagagattcgcgtttttgtttttttttttcgcggttttcgggggtagttttagttatttcggtttttttttttcgttcgcgtgtacgtcgaggggcggagacgtacggtttgggtataaattcgacggagttgttgatttaaaaagtaaggtgtggacggtttgtatttttatcggatttatgttgtttatttcgcggtttggttaggattatttgtttgagtt

SEQ ID NO: 2230 - DNA, 780 bp, Artificial Sequence
  chemically treated genomic DNA (Homo sapiens) CpG-island No: 2230
aactcaaacaaataatcctaaccaaaccgcgaaataaacaacataaatccgataaaaatacaaaccgtccacaccttactttttaaatcaacaactccgtcgaatttatacccaaaccgtacgtctccgcccctcgacgtacacgcgaacgaaaaaaaaaaaccgaaataactaaaactacccccgaaaaccgcgaaaaaaaaaaacaaaaacgcgaatctctcacctcgaacaaatcgctaaaaaaactaaatcgaaaacgaccgcgtttaaactccatctccaaaacgaaacccctaaccacgataacccgactccgataatttcgaaaaaacatactaacgaccctacgactttacctactcaatacgctccccgcgccgcccgacttaacctcctctcctcgacttctatctctcgacgctcgtccgccaatccgaccgaaaatctcccgctacgaaactccaaaccccgcccccgaaaacgacacctaaaccgaacaaaacgcgacaacctcctcttccacccccgccaaaaacccaacccgtccgaccaatccctaaacgccaaaccgacctaacccgacgaccccgaaacccccaaaaacgcactacacctcgcgaacactataaaaacgcgttctccctacccgcgcgaatcgcgaacgcctacctaaacttaaaacgaaccgaaaaaccctaccccgccaaccgccccaacctaacaaacctaacttcccgaacgctaaaaaccccgtaactcaaaaatcgccgcgtaaca

SEQ ID NO: 2231 - DNA, 780 bp, Artificial Sequence
  chemically treated genomic DNA (Homo sapiens) CpG-island No: 2231
ggtttaggtagataattttaattaggtcgcggaatgggtagtatggattcgatgaaaatgtagatcgtttatattttattttttaagttaataatttcgtcgggtttgtatttagatcgtgcgttttcgtttttcggcgtgtacgcgggcgagggaaggaggtcgaggtggttggggttgttttcgggagtcgcggaaggggaaggtagggacgcgagttttttatttcgggtaggtcgttgaagaggttgagtcggaagcggtcgcgtttgaattttatttttagggcggagtttttggttacggtgattcggtttcggtggtttcgggagaatatgttggcggttttgcgattttgtttgtttagtgcgtttttcgcgtcgttcggtttagtttttttttttcggtttttgtttttcgacgttcgttcgttagttcggtcgggaatttttcgttgcggggttttaaatttcgttttcggagacgatatttgggtcgggtagggcgcggtaatttttttttttattttcgttaaaggtttagttcgttcggttagtttttgggcgttaagtcgatttggttcgacggtttcggagtttttaggggcgtattgtatttcgcgagtattgtgggagcgcgttttttttgttcgcgcgggtcgcgagcgtttatttggatttgggacggatcgagaagttttgtttcgttagtcgttttaatttggtaagtttggtttttcgggcgttgaaaatttcgtggtttagggatcgtcgcgtagta

SEQ ID NO: 2232 - DNA, 780 bp, Artificial Sequence
  chemically treated genomic DNA (Homo sapiens) CpG-island No: 2232
tactacgcgacgatccctaaaccacgaaattttcaacgcccgaaaaaccaaacttaccaaattaaaacgactaacgaaacaaaacttctcgatccgtcccaaatccaaataaacgctcgcgacccgcgcgaacaaaaaaaacgcgctcccacaatactcgcgaaatacaatacgcccctaaaaactccgaaaccgtcgaaccaaatcgacttaacgcccaaaaactaaccgaacgaactaaacctttaacgaaaataaaaaaaaaaattaccgcgccctacccgacccaaatatcgtctccgaaaacgaaatttaaaaccccgcaacgaaaaattcccgaccgaactaacgaacgaacgtcgaaaaacaaaaaccgaaaaaaaaaaactaaaccgaacgacgcgaaaaacgcactaaacaaacaaaatcgcaaaaccgccaacatattctcccgaaaccaccgaaaccgaatcaccgtaaccaaaaactccgccctaaaaataaaattcaaacgcgaccgcttccgactcaacctcttcaacgacctacccgaaataaaaaactcgcgtccctaccttccccttccgcgactcccgaaaacaaccccaaccacctcgacctccttccctcgcccgcgtacacgccgaaaaacgaaaacgcacgatctaaatacaaacccgacgaaattattaacttaaaaaataaaatataaacgatctacattttcatcgaatccatactacccattccgcgacctaattaaaattatctacctaaacc

SEQ ID NO: 2233 - DNA, 603 bp, Artificial Sequence
  chemically treated genomic DNA (Homo sapiens) CpG-island No: 2233
tttgtttaatacgcgggtcgtcgtattgcgagttgaggggagagtaggtatcgtcgattattttcggggtcgggtgttatgtacgattagaagttacgtcgattaagtttgtttcgttgttgcgaagtcgacgaggcggagtaggcgtgtagagtattatttcgtattcgttaggatgaggatgatatagttcgtagatagtagtcgcgtgcgatagtacgttcgtgtcgcgcggcggtggggcgagagaggttacgtcgcgtagttttagggcgggagtcggcgcgagtacgtcgcgtcgttcggtcgcggttgaggatttgttaggttttttcgtagtttatttacgcgtgcggaggaagcggagtacgcgtggagtcgtgtgagtgtttgcgtttgttcgagtgcgtacgacggagcgtacgtggagtttgcgtttattttacggatcgttgaggggggcgtttggaagttggagatgttgcggaaggtacgttcgtttgcggattcggttgaagaggggttcgggacggcgggttttgaggtgttattttttgagcgacggtatcgttcgtttttatattttttttttattaggttgta

SEQ ID NO: 2234 - DNA, 603 bp, Artificial Sequence
  chemically treated genomic DNA (Homo sapiens) CpG-island No: 2234
tacaacctaataaaaaaaaaatataaaaacgaacgataccgtcgctcaaaaaataacacctcaaaacccgccgtcccgaacccctcttcaaccgaatccgcaaacgaacgtaccttccgcaacatctccaacttccaaacgcccccctcaacgatccgtaaaataaacgcaaactccacgtacgctccgtcgtacgcactcgaacaaacgcaaacactcacacgactccacgcgtactccgcttcctccgcacgcgtaaataaactacgaaaaaacctaacaaatcctcaaccgcgaccgaacgacgcgacgtactcgcgccgactcccgccctaaaactacgcgacgtaacctctctcgccccaccgccgcgcgacacgaacgtactatcgcacgcgactactatctacgaactatatcatcctcatcctaacgaatacgaaataatactctacacgcctactccgcctcgtcgacttcgcaacaacgaaacaaacttaatcgacgtaacttctaatcgtacataacacccgaccccgaaaataatcgacgatacctactctcccctcaactcgcaatacgacgacccgcgtattaaacaaa

SEQ ID NO: 2235 - DNA, 603 bp, Artificial Sequence
  chemically treated genomic DNA (Homo sapiens) CpG-island No: 2235
tgtagtttggtgggggggaggtgtgggggcgggcgatgtcgtcgtttagggggtggtattttaaaattcgtcgtttcgggtttttttttagtcgagttcgtagacgggcgtatttttcgtaatatttttaatttttagacgttttttttagcggttcgtggggtgggcgtaggttttacgtgcgtttcgtcgtgcgtattcggataggcgtaggtatttatacggttttacgcgtgtttcgtttttttcgtacgcgtgagtagattgcgaggaggtttgataggtttttagtcgcggtcgagcgacgcggcgtgttcgcgtcggttttcgttttggggttgcgcgacgtggtttttttcgttttatcgtcgcgcggtacgggcgtgttgtcgtacgcggttgttatttacgagttatgttatttttattttgacgagtgcggggtggtgttttatacgtttgtttcgtttcgtcggtttcgtagtagcgaagtagatttgatcggcgtggtttttagtcgtgtatggtattcgatttcgaaggtagtcggcgatgtttgttttttttttagttcgtaatgcggcggttcgcgtgttggataag

SEQ ID NO: 2236 - DNA, 603 bp, Artificial Sequence
  chemically treated genomic DNA (Homo sapiens) CpG-island No: 2236
cttatccaacacgcgaaccgccgcattacgaactaaaaaaaaaacaaacatcgccgactaccttcgaaatcgaataccatacacgactaaaaaccacgccgatcaaatctacttcgctactacgaaaccgacgaaacgaaacaaacgtataaaacaccaccccgcactcgtcaaaataaaaataacataactcgtaaataacaaccgcgtacgacaacacgcccgtaccgcgcgacgataaaacgaaaaaaaccacgtcgcgcaaccccaaaacgaaaaccgacgcgaacacgccgcgtcgctcgaccgcgactaaaaacctatcaaacctcctcgcaatctactcacgcgtacgaaaaaaacgaaacacgcgtaaaaccgtataaatacctacgcctatccgaatacgcacgacgaaacgcacgtaaaacctacgcccaccccacgaaccgctaaaaaaaacgtctaaaaattaaaaatattacgaaaaatacgcccgtctacgaactcgactaaaaaaaaacccgaaacgacgaattttaaaataccaccccctaaacgacgacatcgcccgcccccacacctcccccccaccaaactaca

SEQ ID NO: 2237 - DNA, 1345 bp, Artificial Sequence
  chemically treated genomic DNA (Homo sapiens) CpG-island No: 2237
agagcgcgttcgttttttggttataggttacgttttgcgtttcggttatcgtacggattaggaaggttagcgagtagacgttgtagtatatggagaggaagatgatggggcgttcggggtattggaagcggtggggttttagtaagaaggtgagtatagtgaaggcggtggagaagaagtatagcgtcgattatacggttatttagattagcgcgaagtttttgtcgcgtcgggattagaatatttcgacgtcgggttcgtagcgcggtgcgtacgagcggtttttttttacgtattggaatttttcggggttttcgtaggtgttattgtcgttcgcgttcgggtttaggttttcgggagggcgcgcgggtcgcggcgttacgggtagtatgtttaggtttttgtggggtttcgcggggtcggtcgtggcgttttcgggcgtttttatgtatagcgcgtgcgggtcgttgcgcgtgggtagtcgggcgtagtcgagcgagttcggttagtcgaagttgaattgttttatgatgggcgcgtagcgtaggcgcgtttgttcgtatatgggtcggtaggcgggaatgggcgtcgagatttggtcggtgtatatgggcgcgtagagcgagtataggaagaagcgtaggtggttgtggtagtcgtattgtattagcggcgcgaatttcgttagttcggtagtcgtttcgttttgcgacgtgtggtttagtaggttgggtatgcgggttaggttgtagtcgatgtcgcggtatatggggatttttatcgtttggtacggcgtagtttcgcgttcgcgtttcgggtcgaagcggtcgatttttagtgtcgcgtcgttcgtcgttagtagttgttatagtagtagcgtttttcgtagaggcgttacggttatttcgggaggttcgggtcgaaggcgggagcgcggtttcggtttattcgggtttagcggtttcgcgtttcggtgtttgttcgttacgtcgcggggcgcgggttatcgttgagtcgtttacgtgtgttcgggcgttttgggtagcgagcgggtagtcgttcgagggataggagtcgtcgagttcgtttagtcgttatcgtcgttgttatcggagtcgtcgttgagttagagtcggcgtaatttttcggggtcgaggttattagttttcggggcggggtttcgggaggatacgtttagggatacgttttttattgggttttaaaggcgtcgcgtttttcggttacgcggagtacggggtggggtcgggtttggtgggtgttcgttcgtttgtttttcgtttatattcggttttttttttttttttgttgtttgggagaggttgcg

SEQ ID NO: 2238 - DNA, 1345 bp, Artificial Sequence
  chemically treated genomic DNA (Homo sapiens) CpG-island No: 2238
cgcaacctctcccaaacaacaaaaaaaaaaaaaaaaccgaatataaacgaaaaacaaacgaacgaacacccaccaaacccgaccccaccccgtactccgcgtaaccgaaaaacgcgacgcctttaaaacccaataaaaaacgtatccctaaacgtatcctcccgaaaccccgccccgaaaactaataacctcgaccccgaaaaattacgccgactctaactcaacgacgactccgataacaacgacgataacgactaaacgaactcgacgactcctatccctcgaacgactacccgctcgctacccaaaacgcccgaacacacgtaaacgactcaacgataacccgcgccccgcgacgtaacgaacaaacaccgaaacgcgaaaccgctaaacccgaataaaccgaaaccgcgctcccgccttcgacccgaacctcccgaaataaccgtaacgcctctacgaaaaacgctactactataacaactactaacgacgaacgacgcgacactaaaaatcgaccgcttcgacccgaaacgcgaacgcgaaactacgccgtaccaaacgataaaaatccccatataccgcgacatcgactacaacctaacccgcatacccaacctactaaaccacacgtcgcaaaacgaaacgactaccgaactaacgaaattcgcgccgctaatacaatacgactaccacaaccacctacgcttcttcctatactcgctctacgcgcccatatacaccgaccaaatctcgacgcccattcccgcctaccgacccatatacgaacaaacgcgcctacgctacgcgcccatcataaaacaattcaacttcgactaaccgaactcgctcgactacgcccgactacccacgcgcaacgacccgcacgcgctatacataaaaacgcccgaaaacgccacgaccgaccccgcgaaaccccacaaaaacctaaacatactacccgtaacgccgcgacccgcgcgccctcccgaaaacctaaacccgaacgcgaacgacaataacacctacgaaaaccccgaaaaattccaatacgtaaaaaaaaaccgctcgtacgcaccgcgctacgaacccgacgtcgaaatattctaatcccgacgcgacaaaaacttcgcgctaatctaaataaccgtataatcgacgctatacttcttctccaccgccttcactatactcaccttcttactaaaaccccaccgcttccaataccccgaacgccccatcatcttcctctccatatactacaacgtctactcgctaaccttcctaatccgtacgataaccgaaacgcaaaacgtaacctataaccaaaaaacgaacgcgctct

SEQ ID NO: 2239 - DNA, 1345 bp, Artificial Sequence
  chemically treated genomic DNA (Homo sapiens) CpG-island No: 2239
cgtagttttttttaggtagtaagggaagggaagaaatcgagtgtaagcggagggtaagcgggcggatatttattaggttcggttttatttcgtgtttcgcgtggtcgggagacgcggcgtttttaaagtttagtgggaggcgtgtttttgggcgtgttttttcggagtttcgtttcgggggttggtagtttcggtttcgggaggttgcgtcggttttggtttagcggcggtttcggtggtagcggcggtggcggttaggcgggttcggcggtttttgtttttcgggcggttgttcgttcgttgtttagggcgttcggatatacgtgggcggtttagcgatggttcgcgtttcgcgacgtggcgggtaggtatcggggcgcgggatcgttgagttcgagtgagtcggggtcgcgttttcgttttcggttcgggtttttcgggatggtcgtggcgtttttgcggggggcgttgttgttgtggtagttgttggcggcgggcggcgcggtattggagatcggtcgtttcgattcggagcgcgggcgcggggttgcgtcgtgttaggcggtggagatttttatgtgtcgcggtatcggttataatttgattcgtatgtttaatttgttgggttatacgtcgtagggcgaggcggttgtcgagttagcggagttcgcgtcgttggtgtagtacggttgttatagttatttgcgtttttttttgtgttcgttttacgcgtttatgtgtatcgattaggtttcgacgtttattttcgtttgtcggtttatgtgcgagtaggcgcgtttgcgttgcgcgtttattatggagtagtttaatttcggttggtcggattcgttcgattgcgttcggttgtttacgcgtaacgattcgtacgcgttgtgtatggaggcgttcgagaacgttacggtcggtttcgcggagttttataagggtttgggtatgttgttcgtggcgtcgcggttcgcgcgttttttcggagatttgggttcgggcgcgggcggtagtggtatttgcgagaatttcgagaagttttagtacgtggagaagagtcgttcgtgcgtatcgcgttgcgggttcggcgtcgaggtgttttggtttcggcgcgataaggatttcgcgttggtttggatggtcgtgtggtcggcgttgtgttttttttttatcgtttttattgtgtttatttttttgttggagttttatcgtttttagtatttcgagcgttttattatttttttttttatgtgttataacgtttattcgttggtttttttgattcgtgcggtggtcggagcgtagagcgtggtttgtgattaggaggcgggcgcgtttt

SEQ ID NO: 2240 - DNA, 1345 bp, Artificial Sequence
  chemically treated genomic DNA (Homo sapiens) CpG-island No: 2240
aaaacgcgcccgcctcctaatcacaaaccacgctctacgctccgaccaccgcacgaatcaaaaaaaccaacgaataaacgttataacacataaaaaaaaaaataataaaacgctcgaaatactaaaaacgataaaactccaacaaaaaaataaacacaataaaaacgataaaaaaaaaacacaacgccgaccacacgaccatccaaaccaacgcgaaatccttatcgcgccgaaaccaaaacacctcgacgccgaacccgcaacgcgatacgcacgaacgactcttctccacgtactaaaacttctcgaaattctcgcaaataccactaccgcccgcgcccgaacccaaatctccgaaaaaacgcgcgaaccgcgacgccacgaacaacatacccaaacccttataaaactccgcgaaaccgaccgtaacgttctcgaacgcctccatacacaacgcgtacgaatcgttacgcgtaaacaaccgaacgcaatcgaacgaatccgaccaaccgaaattaaactactccataataaacgcgcaacgcaaacgcgcctactcgcacataaaccgacaaacgaaaataaacgtcgaaacctaatcgatacacataaacgcgtaaaacgaacacaaaaaaaaacgcaaataactataacaaccgtactacaccaacgacgcgaactccgctaactcgacaaccgcctcgccctacgacgtataacccaacaaattaaacatacgaatcaaattataaccgataccgcgacacataaaaatctccaccgcctaacacgacgcaaccccgcgcccgcgctccgaatcgaaacgaccgatctccaataccgcgccgcccgccgccaacaactaccacaacaacaacgccccccgcaaaaacgccacgaccatcccgaaaaacccgaaccgaaaacgaaaacgcgaccccgactcactcgaactcaacgatcccgcgccccgatacctacccgccacgtcgcgaaacgcgaaccatcgctaaaccgcccacgtatatccgaacgccctaaacaacgaacgaacaaccgcccgaaaaacaaaaaccgccgaacccgcctaaccgccaccgccgctaccaccgaaaccgccgctaaaccaaaaccgacgcaacctcccgaaaccgaaactaccaacccccgaaacgaaactccgaaaaaacacgcccaaaaacacgcctcccactaaactttaaaaacgccgcgtctcccgaccacgcgaaacacgaaataaaaccgaacctaataaatatccgcccgcttaccctccgcttacactcgatttcttcccttcccttactacctaaaaaaaactacg

SEQ ID NO: 2241 - DNA, 589 bp, Artificial Sequence
  chemically treated genomic DNA (Homo sapiens) CpG-island No: 2241
gttgttgacgtttatgaaggagatcgtttcgtagcgcgtgggtcggtagtagggttggttgacgggtcgggagttcgggggcggtcgtagggtttcggcgtttagtaggttggttaggttgaggtcgtgtggagagcgcgcgcgcggtaggagtcgtgtagaagcgaaattattagttcgtcggagcggtggtttaggtcgagcgcgcgtatcggtattagttgcgagcgtagcggtacgtcgtcgttttcgttgttcgagcgcggttgttcgggtttttagttttgtcgcgttttttcggcgaaagagtagattgggggttatagcgtcggggttcggtttaaaaagttgcgtcgtcgtcgggtttttttattgtattacggttcgttttttttttgaatgagatttagttacgcgcgtgtttcgggttagttttcgttcgttttttcgtttttttattattcggtagttgggtcgcggggacgttaggataggcgggggttttatcgcggggggtagggttgcggggcgcggagtttagggaggtttttgcgacgttgtttagtagagttagagcggttagggtggg

SEQ ID NO: 2242 - DNA, 589 bp, Artificial Sequence
  chemically treated genomic DNA (Homo sapiens) CpG-island No: 2242
cccaccctaaccgctctaactctactaaacaacgtcgcaaaaacctccctaaactccgcgccccgcaaccctaccccccgcgataaaacccccgcctatcctaacgtccccgcgacccaactaccgaataataaaaaaacgaaaaaacgaacgaaaactaacccgaaacacgcgcgtaactaaatctcattcaaaaaaaaaacgaaccgtaatacaataaaaaaacccgacgacgacgcaactttttaaaccgaaccccgacgctataacccccaatctactctttcgccgaaaaaacgcgacaaaactaaaaacccgaacaaccgcgctcgaacaacgaaaacgacgacgtaccgctacgctcgcaactaataccgatacgcgcgctcgacctaaaccaccgctccgacgaactaataatttcgcttctacacgactcctaccgcgcgcgcgctctccacacgacctcaacctaaccaacctactaaacgccgaaaccctacgaccgcccccgaactcccgacccgtcaaccaaccctactaccgacccacgcgctacgaaacgatctccttcataaacgtcaacaac

SEQ ID NO: 2243 - DNA, 589 bp, Artificial Sequence
  chemically treated genomic DNA (Homo sapiens) CpG-island No: 2243
tttattttggtcgttttggttttgttgagtagcgtcgtagaggtttttttgggtttcgcgtttcgtagttttgtttttcgcgatagggttttcgtttgttttggcgttttcgcggtttaattgtcgggtagtgagagggcgagggggcgggcgggggttggttcgggatacgcgcgtgattgggttttatttaggggaagaacgggtcgtggtgtagtgaaagagttcggcggcggcgtagttttttgggtcgggtttcggcgttgtgatttttaatttgttttttcgtcggaggggcgcggtagggttgggggttcgggtagtcgcgttcgggtagcgggggcggcggcgtgtcgttgcgttcgtagttggtgtcggtgcgcgcgttcggtttgggttatcgtttcgacgagttggtggtttcgtttttgtacggtttttgtcgcgcgcgcgttttttatacgattttagtttggttagtttattgggcgtcggggttttgcgatcgttttcgggttttcggttcgttagttagttttgttgtcgatttacgcgttacgaagcggttttttttatggacgttaatagt

SEQ ID NO: 2244 - DNA, 589 bp, Artificial Sequence
  chemically treated genomic DNA (Homo sapiens) CpG-island No: 2244
actattaacgtccataaaaaaaaccgcttcgtaacgcgtaaatcgacaacaaaactaactaacgaaccgaaaacccgaaaacgatcgcaaaaccccgacgcccaataaactaaccaaactaaaatcgtataaaaaacgcgcgcgcgacaaaaaccgtacaaaaacgaaaccaccaactcgtcgaaacgataacccaaaccgaacgcgcgcaccgacaccaactacgaacgcaacgacacgccgccgcccccgctacccgaacgcgactacccgaacccccaaccctaccgcgcccctccgacgaaaaaacaaattaaaaatcacaacgccgaaacccgacccaaaaaactacgccgccgccgaactctttcactacaccacgacccgttcttcccctaaataaaacccaatcacgcgcgtatcccgaaccaacccccgcccgccccctcgccctctcactacccgacaattaaaccgcgaaaacgccaaaacaaacgaaaaccctatcgcgaaaaacaaaactacgaaacgcgaaacccaaaaaaacctctacgacgctactcaacaaaaccaaaacgaccaaaataaa

SEQ ID NO: 2245 - DNA, 549 bp, Artificial Sequence
  chemically treated genomic DNA (Homo sapiens) CpG-island No: 2245
gagcgttcggttgaatttcgcggcggtgtttaagtgataacgtagtagtttcgcgcgttttttttcgttttagtcgttattttcgagtaggatttagtgttatcgttagacgcgtaaggagttatttacgttttcgcgtcgcgtttttcgtttagttttggcgcgattgtttaggattttggatcgtcggtgtttttcgttttcgacgaagttattttttttggttgttttagttaggcggtttttgcgtcgtttttcgcgttcgcgcgtttgaggttcggattgcggcgcgcgttcgttagcgattttggcgaagcgaggttggtttcgcgtcggcgcgcgttttcgtcgttttcgtttttttcgtttttttttttcgcgtcgtgtttttgtttttttcggttttttttagcgttttttcgtttttttttttcgtattttttgcgggcgtttttcgttttttttttttttggttaatttttttttgttttgttgttgcgacggtagcgaatgggttttagtcgtcggcgtttcgagggattgggtggt

SEQ ID NO: 2246 - DNA, 549 bp, Artificial Sequence
  chemically treated genomic DNA (Homo sapiens) CpG-island No: 2246
accacccaatccctcgaaacgccgacgactaaaacccattcgctaccgtcgcaacaacaaaacaaaaaaaaattaaccaaaaaaaaaaaaaacgaaaaacgcccgcaaaaaatacgaaaaaaaaaaacgaaaaaacgctaaaaaaaaccgaaaaaaacaaaaacacgacgcgaaaaaaaaaaacgaaaaaaacgaaaacgacgaaaacgcgcgccgacgcgaaaccaacctcgcttcgccaaaatcgctaacgaacgcgcgccgcaatccgaacctcaaacgcgcgaacgcgaaaaacgacgcaaaaaccgcctaactaaaacaaccaaaaaaaataacttcgtcgaaaacgaaaaacaccgacgatccaaaatcctaaacaatcgcgccaaaactaaacgaaaaacgcgacgcgaaaacgtaaataactccttacgcgtctaacgataacactaaatcctactcgaaaataacgactaaaacgaaaaaaaacgcgcgaaactactacgttatcacttaaacaccgccgcgaaattcaaccgaacgctc

SEQ ID NO: 2247 - DNA, 549 bp, Artificial Sequence
  chemically treated genomic DNA (Homo sapiens) CpG-island No: 2247
gttatttagtttttcgaggcgtcggcggttggagtttattcgttgtcgtcgtagtagtagggtaagagggggttggttaggaggggaggaggcggaggacgttcgtagggagtgcgggggagggggacgggaggacgttaaggagagtcgggaggggtaaaagtacggcgcggggagggggagcggagagggcgggagcggcgggggcgcgcgtcggcgcggggttagtttcgtttcgttagggtcgttggcggacgcgcgtcgtagttcgagttttagacgcgcgggcgcgggggacggcgtaggggtcgtttggttggagtagttagaggggatagtttcgtcgagaacggaggatatcggcggtttagggttttgggtagtcgcgttagagttgagcggagggcgcggcgcgagaacgtaagtagttttttgcgcgtttggcggtgatattgggttttgttcgggggtgacggttggagcggaggaggacgcgcgaggttgttgcgttgttatttggatatcgtcgcggggtttagtcgagcgttt

SEQ ID NO: 2248 - DNA, 549 bp, Artificial Sequence
  chemically treated genomic DNA (Homo sapiens) CpG-island No: 2248
aaacgctcgactaaaccccgcgacgatatccaaataacaacgcaacaacctcgcgcgtcctcctccgctccaaccgtcacccccgaacaaaacccaatatcaccgccaaacgcgcaaaaaactacttacgttctcgcgccgcgccctccgctcaactctaacgcgactacccaaaaccctaaaccgccgatatcctccgttctcgacgaaactatcccctctaactactccaaccaaacgacccctacgccgtcccccgcgcccgcgcgtctaaaactcgaactacgacgcgcgtccgccaacgaccctaacgaaacgaaactaaccccgcgccgacgcgcgcccccgccgctcccgccctctccgctccccctccccgcgccgtacttttacccctcccgactctccttaacgtcctcccgtccccctcccccgcactccctacgaacgtcctccgcctcctcccctcctaaccaaccccctcttaccctactactacgacgacaacgaataaactccaaccgccgacgcctcgaaaaactaaataac

SEQ ID NO: 2249 - DNA, 625 bp, Artificial Sequence
  chemically treated genomic DNA (Homo sapiens) CpG-island No: 2249
acgattcggagcgtcggataagggtttagaacgattaattagttttttatcgtttcgtttttgttttttcgcggttatttatcgggatgtaggtcgtagttattagggttgtagcggcgattcgttcgttttcggtaatgacgtttattttaatcggtttgtattagttgagtttttaatataaatattggcgtagtagttaggtcgttatttatttagtttcgtttcgtttcgtttttagcggaagtgacgcgttagaagtttgggtttattcgcgggtcggggtgaggatttttcgtttcgtttaggtttttgtttttttgttaattttcgtttttttttcgtttcgagatatgcgtaatagagtatgacggagcgtaaggcgggaagtcgcgatagacgtgtgtgcgtgcgtgcgtgcgtgcgtgatgcgcgaggcgtggtttgttggtggggcgtgttgtgttttggttggttgtcgggtgtgagagcggtgggatttcgttttgtttttttgggcgggatttcggagtagtgttttggtttgtttgtttgcgggtcgttatttttttttagtagagataagttttttttttcgcgtttttgaagtttttgtttgcgttga

SEQ ID NO: 2250 - DNA, 625 bp, Artificial Sequence
  chemically treated genomic DNA (Homo sapiens) CpG-island No: 2250
tcaacgcaaacaaaaacttcaaaaacgcgaaaaaaaaaacttatctctactaaaaaaaaataacgacccgcaaacaaacaaaccaaaacactactccgaaatcccgcccaaaaaaacaaaacgaaatcccaccgctctcacacccgacaaccaaccaaaacacaacacgccccaccaacaaaccacgcctcgcgcatcacgcacgcacgcacgcacgcacacacgtctatcgcgacttcccgccttacgctccgtcatactctattacgcatatctcgaaacgaaaaaaaaacgaaaattaacaaaaaaacaaaaacctaaacgaaacgaaaaatcctcaccccgacccgcgaataaacccaaacttctaacgcgtcacttccgctaaaaacgaaacgaaacgaaactaaataaataacgacctaactactacgccaatatttatattaaaaactcaactaatacaaaccgattaaaataaacgtcattaccgaaaacgaacgaatcgccgctacaaccctaataactacgacctacatcccgataaataaccgcgaaaaaacaaaaacgaaacgataaaaaactaattaatcgttctaaacccttatccgacgctccgaatcgt

SEQ ID NO: 2251 - DNA, 625 bp, Artificial Sequence
  chemically treated genomic DNA (Homo sapiens) CpG-island No: 2251
ttagcgtaggtaggggttttagggacgcggagagggaggtttatttttgttgaaagggaatagcggttcgtaaataagtaaattaggatattgtttcgaggtttcgtttaggaaggtaaaacgaagttttatcgtttttatattcggtaattaattaaggtatagtacgttttattagtaagttacgtttcgcgtattacgtacgtacgtacgtacgtatatacgtttgtcgcggtttttcgttttgcgtttcgttatgttttattgcgtatatttcggggcgggggaggaacggagattgataaggaggtagaggtttgagcgaggcggaaaatttttatttcggttcgcgggtagatttaaatttttagcgcgttattttcgttgggggcggagcggggcggggttgagtgggtggcgatttagttgttgcgttagtgtttgtgttggaagtttagttgatgtaggtcggttggagtggacgttattgtcgggaacgagcgagtcgtcgttgtagttttagtgattgcggtttgtatttcggtaagtagtcgcgaggggataggggcgggacgataggaggttggttgatcgttttggatttttgttcggcgtttcgggtcgt

SEQ ID NO: 2252 - DNA, 625 bp, Artificial Sequence
  chemically treated genomic DNA (Homo sapiens) CpG-island No: 2252
acgacccgaaacgccgaacaaaaatccaaaacgatcaaccaacctcctatcgtcccgcccctatcccctcgcgactacttaccgaaatacaaaccgcaatcactaaaactacaacgacgactcgctcgttcccgacaataacgtccactccaaccgacctacatcaactaaacttccaacacaaacactaacgcaacaactaaatcgccacccactcaaccccgccccgctccgcccccaacgaaaataacgcgctaaaaatttaaatctacccgcgaaccgaaataaaaattttccgcctcgctcaaacctctacctccttatcaatctccgttcctcccccgccccgaaatatacgcaataaaacataacgaaacgcaaaacgaaaaaccgcgacaaacgtatatacgtacgtacgtacgtacgtaatacgcgaaacgtaacttactaataaaacgtactataccttaattaattaccgaatataaaaacgataaaacttcgttttaccttcctaaacgaaacctcgaaacaatatcctaatttacttatttacgaaccgctattccctttcaacaaaaataaacctccctctccgcgtccctaaaacccctacctacgctaa

SEQ ID NO: 2253 - DNA, 876 bp, Artificial Sequence
  chemically treated genomic DNA (Homo sapiens) CpG-island No: 2253
ggttgcggcggtcgcggtagtagtcgcggttgtcgcggttttggtgttcgattcgtttagttgcggcggttcgtttggttttagcgtttttttttttatttttagtagcgtcgtagtcgtcgtcgtcgtcgtcgtagtcgtcgtttttagttcgtttttcgttaacgattattttgttttttaggttttcggagttttcgggggtagcggcggcggcggcgggggcggcggcggcggttttttcgcgtattcgtaggacggtttttattagtcggtgtttatttttaaggtgtatatttttgtggacgggttgtagggtatttattcgcgggtgggtatggcgtattcgtacgagtcgtggtttaagttttcgtattcgggtttgggtgttgcgggcgaggtgggttcggtcggcgtttttagttggtgggacgtgggggtcggttggatcgacgtgtagaattcgaatagcgcggttgcgttgttcggttcgttgtattttgtcgtcggggggttttaaatttcgttgtattcgtcgttcggaggttataattcggattattcgggtttgagttattcggtttttagtagcggcgttttttcgtatttgtttagtttcgtcgggtagtattttatggacggttttaagttagtgttattcggtttttattcggattcggtttcgtcgtcgttggtcggcgcggggggttttatgttgagcgttgggttttcggcgtcgttggggggtttttcgcgttttttagttcgtcgttatttcggtcgcgttatttgcgattgttttaattgttaggaggtagagcggttgggttttgtcggggcgagtttgcggcgtaagggtttgtatagttgttatat

SEQ ID NO: 2254 - DNA, 876 bp, Artificial Sequence
  chemically treated genomic DNA (Homo sapiens) CpG-island No: 2254
atataacaactatacaaacccttacgccgcaaactcgccccgacaaaacccaaccgctctacctcctaacaattaaaacaatcgcaaataacgcgaccgaaataacgacgaactaaaaaacgcgaaaaaccccccaacgacgccgaaaacccaacgctcaacataaaaccccccgcgccgaccaacgacgacgaaaccgaatccgaataaaaaccgaataacactaacttaaaaccgtccataaaatactacccgacgaaactaaacaaatacgaaaaaacgccgctactaaaaaccgaataactcaaacccgaataatccgaattataacctccgaacgacgaatacaacgaaatttaaaaccccccgacgacaaaatacaacgaaccgaacaacgcaaccgcgctattcgaattctacacgtcgatccaaccgacccccacgtcccaccaactaaaaacgccgaccgaacccacctcgcccgcaacacccaaacccgaatacgaaaacttaaaccacgactcgtacgaatacgccatacccacccgcgaataaataccctacaacccgtccacaaaaatatacaccttaaaaataaacaccgactaataaaaaccgtcctacgaatacgcgaaaaaaccgccgccgccgcccccgccgccgccgccgctacccccgaaaactccgaaaacctaaaaaacaaaataatcgttaacgaaaaacgaactaaaaacgacgactacgacgacgacgacgacgactacgacgctactaaaaataaaaaaaaaaacgctaaaaccaaacgaaccgccgcaactaaacgaatcgaacaccaaaaccgcgacaaccgcgactactaccgcgaccgccgcaacc

SEQ ID NO: 2255 - DNA, 876 bp, Artificial Sequence
  chemically treated genomic DNA (Homo sapiens) CpG-island No: 2255
atgtggtagttgtgtaggtttttgcgtcgtaagttcgtttcggtagggtttagtcgttttgttttttggtagttggggtagtcgtaggtggcgcggtcggagtagcggcgagttgaggagcgcggggagttttttagcggcgtcgaaggtttagcgtttaatatggagtttttcgcgtcggttagcggcgacggggtcgagttcgggtaggagtcgggtagtattggtttgaagtcgtttatgaggtgttgttcggcggggttgagtaggtgcgaggaggcgtcgttgttgaaggtcgagtgatttaggttcgagtaattcgagttgtagttttcgagcggcgagtgtagcgaggtttggagtttttcggcggtagggtgtagcgagtcgggtagcgtagtcgcgttgttcgggttttgtacgtcgatttagtcggtttttacgttttattagttggaggcgtcggtcgagtttatttcgttcgtagtatttaggttcgggtgcgagggtttaaattacgattcgtacgggtgcgttatgtttattcgcgggtagatgttttgtagttcgtttatagaggtgtgtattttggagatgaatatcggttggtgggagtcgttttgcgagtgcgcggaggagtcgtcgtcgtcgttttcgtcgtcgtcgtcgttgttttcggaaatttcgggggtttggaaaatagagtagtcgttggcgaagggcgagttggaggcggcggttgcggcggcggcggcggcggttgcggcgttgttggaggtgagggagaaggcgttggagttaggcgagtcgtcgtagttgaacgagtcggatattagggtcgcggtagtcgcggttgttgtcgcggtcgtcgtagtt

SEQ ID NO: 2256 - DNA, 876 bp, Artificial Sequence
  chemically treated genomic DNA (Homo sapiens) CpG-island No: 2256
aactacgacgaccgcgacaacaaccgcgactaccgcgaccctaatatccgactcgttcaactacgacgactcgcctaactccaacgccttctccctcacctccaacaacgccgcaaccgccgccgccgccgccgcaaccgccgcctccaactcgcccttcgccaacgactactctattttccaaacccccgaaatttccgaaaacaacgacgacgacgacgaaaacgacgacgacgactcctccgcgcactcgcaaaacgactcccaccaaccgatattcatctccaaaatacacacctctataaacgaactacaaaacatctacccgcgaataaacataacgcacccgtacgaatcgtaatttaaaccctcgcacccgaacctaaatactacgaacgaaataaactcgaccgacgcctccaactaataaaacgtaaaaaccgactaaatcgacgtacaaaacccgaacaacgcgactacgctacccgactcgctacaccctaccgccgaaaaactccaaacctcgctacactcgccgctcgaaaactacaactcgaattactcgaacctaaatcactcgaccttcaacaacgacgcctcctcgcacctactcaaccccgccgaacaacacctcataaacgacttcaaaccaatactacccgactcctacccgaactcgaccccgtcgccgctaaccgacgcgaaaaactccatattaaacgctaaaccttcgacgccgctaaaaaactccccgcgctcctcaactcgccgctactccgaccgcgccacctacgactaccccaactaccaaaaaacaaaacgactaaaccctaccgaaacgaacttacgacgcaaaaacctacacaactaccacat

SEQ ID NO: 2257 - DNA, 618 bp, Artificial Sequence
  chemically treated genomic DNA (Homo sapiens) CpG-island No: 2257
tcggggagggtttcgaattggcgattcgtacggttcgtttgtacgtagtagcgaagagtgaggtggtggtttggggttttttcgcgagttttggtttcggttcgggttcgtcgtttttttcgggttgcgggtcggagtagtttatcgtcgcgtttatcgtatataaaggtatcgcggtcgttttcgttcgttgtacggatagcgagcgttattttgtgttttgttttcgttttgtagcgcgtttagcgcgggtaatgtcggttagattcgtttcgttagtttcgggtttttgattttgggtaaatttacggtgggaatgcgcggggagttttttttcgtttcgttcgtttgtgggtttttaaaagatattcgggtcggacggggtgagggatttttttgttttcgtttttttttttcgtttgttttgtagttttttcgtattagttcgttgttttgcgttattttagggtttcggagttcggggaatttgttttattttgttacggggtgtcgcgtttgatttttttgttcgtgttatcggaggttgttgcggcgtggatagatttagatttttttttttgaatttgtttagttttttttttgttttggtttacgatt

SEQ ID NO: 2258 - DNA, 618 bp, Artificial Sequence
  chemically treated genomic DNA (Homo sapiens) CpG-island No: 2258
aatcgtaaaccaaaacaaaaaaaaaactaaacaaattcaaaaaaaaaaatctaaatctatccacgccgcaacaacctccgataacacgaacaaaaaaatcaaacgcgacaccccgtaacaaaataaaacaaattccccgaactccgaaaccctaaaataacgcaaaacaacgaactaatacgaaaaaactacaaaacaaacgaaaaaaaaaaacgaaaacaaaaaaatccctcaccccgtccgacccgaatatcttttaaaaacccacaaacgaacgaaacgaaaaaaaactccccgcgcattcccaccgtaaatttacccaaaatcaaaaacccgaaactaacgaaacgaatctaaccgacattacccgcgctaaacgcgctacaaaacgaaaacaaaacacaaaataacgctcgctatccgtacaacgaacgaaaacgaccgcgatacctttatatacgataaacgcgacgataaactactccgacccgcaacccgaaaaaaacgacgaacccgaaccgaaaccaaaactcgcgaaaaaaccccaaaccaccacctcactcttcgctactacgtacaaacgaaccgtacgaatcgccaattcgaaaccctccccga

SEQ ID NO: 2259 - DNA, 618 bp, Artificial Sequence
  chemically treated genomic DNA (Homo sapiens) CpG-island No: 2259
agtcgtgggttaggatagagagaaagttgaataagtttaggaagaagaatttgagtttgtttacgtcgtagtagttttcggtggtacgggtagaaagattaagcgcggtatttcgtgataggatgggatagatttttcgggtttcgaggttttaggatggcgtagggtagcgggttggtgcgggaaaattatagagtaagcgagggagggaagcgaaggtaggggaattttttatttcgttcggttcgagtgttttttgagagtttataggcgagcggggcggggggaggtttttcgcgtatttttatcgtgggtttgtttaaggttagaggttcgggattggcggggcgggtttggtcggtattgttcgcgttgagcgcgttgtagaacgggagtagggtatagggtggcgttcgttgttcgtgtagcgggcggaggcggtcgcggtgtttttgtgtgcggtgggcgcggcgatgggttgtttcggttcgtagttcgaggggagcggcgggttcgggtcggggttagggttcgcggggagattttagattattattttatttttcgttgttacgtgtaagcggatcgtgcggatcgttagttcggaatttttttcgg

SEQ ID NO: 2260 - DNA, 618 bp, Artificial Sequence
  chemically treated genomic DNA (Homo sapiens) CpG-island No: 2260
ccgaaaaaaattccgaactaacgatccgcacgatccgcttacacgtaacaacgaaaaataaaataataatctaaaatctccccgcgaaccctaaccccgacccgaacccgccgctcccctcgaactacgaaccgaaacaacccatcgccgcgcccaccgcacacaaaaacaccgcgaccgcctccgcccgctacacgaacaacgaacgccaccctataccctactcccgttctacaacgcgctcaacgcgaacaataccgaccaaacccgccccgccaatcccgaacctctaaccttaaacaaacccacgataaaaatacgcgaaaaacctccccccgccccgctcgcctataaactctcaaaaaacactcgaaccgaacgaaataaaaaattcccctaccttcgcttccctccctcgcttactctataattttcccgcaccaacccgctaccctacgccatcctaaaacctcgaaacccgaaaaatctatcccatcctatcacgaaataccgcgcttaatctttctacccgtaccaccgaaaactactacgacgtaaacaaactcaaattcttcttcctaaacttattcaactttctctctatcctaacccacgact

SEQ ID NO: 2261 - DNA, 599 bp, Artificial Sequence
  chemically treated genomic DNA (Homo sapiens) CpG-island No: 2261
tttattttatagcggtcgtaacgtgtcgagagtcgtaagtaaagtgtcgtaaagtagaaggaaggcgggagtttcgattgtaaatattgaggaaagttaggtagtagaggtcgttatggcgaacgtttcgtgggtagaggtttgcgagaaattttaggcggcgttcgttttgtcgcgggtggaattgtataaaaattcggagaaggaattatataagtttaaatatagcgttcgggcgttattggaagaggttaaggcgttgttcggttttgcgtttgaggacgaggatgagcggtttgaggtcgaggatagttcgggtgtcggtgattacgttttggggttgtcggttgaggtggtggagttcgaggacgtcgtcgtttagcgagcggtgaggttggtagttatcgagttttatttcggggtgaattatatcgatacggaggagttgtcggcgggggaggagtatttggtgaaatgtttgcggttgttgcgtaggtatcggttttcgtacgattgtatttttttttgtatttaggcgtaggtgagagcgagttcggttaggtcggtttttgttggtaaatggcgagggatggggagga

SEQ ID NO: 2262 - DNA, 599 bp, Artificial Sequence
  chemically treated genomic DNA (Homo sapiens) CpG-island No: 2262
tcctccccatccctcgccatttaccaacaaaaaccgacctaaccgaactcgctctcacctacgcctaaatacaaaaaaaaatacaatcgtacgaaaaccgatacctacgcaacaaccgcaaacatttcaccaaatactcctcccccgccgacaactcctccgtatcgatataattcaccccgaaataaaactcgataactaccaacctcaccgctcgctaaacgacgacgtcctcgaactccaccacctcaaccgacaaccccaaaacgtaatcaccgacacccgaactatcctcgacctcaaaccgctcatcctcgtcctcaaacgcaaaaccgaacaacgccttaacctcttccaataacgcccgaacgctatatttaaacttatataattccttctccgaatttttatacaattccacccgcgacaaaacgaacgccgcctaaaatttctcgcaaacctctacccacgaaacgttcgccataacgacctctactacctaactttcctcaatatttacaatcgaaactcccgccttccttctactttacgacactttacttacgactctcgacacgttacgaccgctataaaataaa

SEQ ID NO: 2263 - DNA, 599 bp, Artificial Sequence
  chemically treated genomic DNA (Homo sapiens) CpG-island No: 2263
ttttttttatttttcgttatttgttaataggggtcggtttggtcgggttcgtttttatttgcgtttggatgtagagagagatgtagtcgtgcgagagtcggtatttgcgtagtagtcgtaggtattttattaggtgtttttttttcgtcgatagttttttcgtgtcgatgtggtttatttcgaggtggaattcgatgattgttagttttatcgttcgttgggcgacggcgttttcgggttttattattttagtcggtagttttagggcgtggttatcggtattcgggttgttttcggttttaggtcgtttattttcgtttttaggcgtagggtcgagtagcgttttgattttttttagtagcgttcgggcgttgtatttggatttgtatggtttttttttcggatttttatgtagttttattcgcgatagagcgagcgtcgtttggaatttttcgtagatttttgtttacggaacgttcgttatagcggtttttattgtttggttttttttaatgtttgtagtcgggattttcgttttttttttgttttgcgatattttatttacggttttcgatacgttgcggtcgttgtggaatggg

SEQ ID NO: 2264 - DNA, 599 bp, Artificial Sequence
  chemically treated genomic DNA (Homo sapiens) CpG-island No: 2264
cccattccacaacgaccgcaacgtatcgaaaaccgtaaataaaatatcgcaaaacaaaaaaaaaacgaaaatcccgactacaaacattaaaaaaaaccaaacaataaaaaccgctataacgaacgttccgtaaacaaaaatctacgaaaaattccaaacgacgctcgctctatcgcgaataaaactacataaaaatccgaaaaaaaaaccatacaaatccaaatacaacgcccgaacgctactaaaaaaaatcaaaacgctactcgaccctacgcctaaaaacgaaaataaacgacctaaaaccgaaaacaacccgaataccgataaccacgccctaaaactaccgactaaaataataaaacccgaaaacgccgtcgcccaacgaacgataaaactaacaatcatcgaattccacctcgaaataaaccacatcgacacgaaaaaactatcgacgaaaaaaaaacacctaataaaatacctacgactactacgcaaataccgactctcgcacgactacatctctctctacatccaaacgcaaataaaaacgaacccgaccaaaccgacccctattaacaaataacgaaaaataaaaaaaa

SEQ ID NO: 2265 - DNA, 779 bp, Artificial Sequence
  chemically treated genomic DNA (Homo sapiens) CpG-island No: 2265
cgagggtttgtcgggttttttcggtttaagttgtggaaaagtcgatttttaggtcgtcgcgggagattagttttaggggaagggcgacgcggaggagggtcggggtgggagttatgtttttcgttcgagcgtcgggttagacgcgtagtgtttaggttcgagggtttatttcgacgtagagagttaggcggtcgcggtgaattgaggcgttcggtaaatttcgagttttggggttcgattttatttatttcgtcgtcgtcgcgaaagatagtatttatcgttggtagttcggttgttttttgcgggtatttgggtagggtttaggtttatattattgaggcgttattatcgttttcgtcggtcgcgggggtgggggcgtggttattgggtcgtcgtttcgtttattcgagtcgcgcgtgtattttcggagtttcgcgtttttttttgtaaatttgcgtttttggtacggttcggttcggttacgttttttcgcggttcggttgggtcgttcggtagagaaatgaaagtgcgtggtttcgggggtggcggagtcgtttggagacggcggttgcggtttttatagttcggattttgtaggttatcgggtcggttgtttattttttcggggattattgtagaattgtggttgtgcgttcgtcggtttagttttttttttcgggtcgtcgtttgtttgtgatcgttatattgttttttttacggttttgtttttttatttgaaattggcgaggttttaggtttaagtcgtttttttgggtttt

SEQ ID NO: 2266 - DNA, 779 bp, Artificial Sequence
  chemically treated genomic DNA (Homo sapiens) CpG-island No: 2266
aaaacccaaaaaaacgacttaaacctaaaacctcgccaatttcaaataaaaaaacaaaaccgtaaaaaaaacaatataacgatcacaaacaaacgacgacccgaaaaaaaaaactaaaccgacgaacgcacaaccacaattctacaataatccccgaaaaaataaacaaccgacccgataacctacaaaatccgaactataaaaaccgcaaccgccgtctccaaacgactccgccacccccgaaaccacgcactttcatttctctaccgaacgacccaaccgaaccgcgaaaaaacgtaaccgaaccgaaccgtaccaaaaacgcaaatttacaaaaaaaaacgcgaaactccgaaaatacacgcgcgactcgaataaacgaaacgacgacccaataaccacgcccccacccccgcgaccgacgaaaacgataataacgcctcaataatataaacctaaaccctacccaaatacccgcaaaaaacaaccgaactaccaacgataaatactatctttcgcgacgacgacgaaataaataaaatcgaaccccaaaactcgaaatttaccgaacgcctcaattcaccgcgaccgcctaactctctacgtcgaaataaaccctcgaacctaaacactacgcgtctaacccgacgctcgaacgaaaaacataactcccaccccgaccctcctccgcgtcgcccttcccctaaaactaatctcccgcgacgacctaaaaatcgacttttccacaacttaaaccgaaaaaacccgacaaaccctcg

SEQ ID NO: 2267 - DNA, 779 bp, Artificial Sequence
  chemically treated genomic DNA (Homo sapiens) CpG-island No: 2267
ggaatttagggagacgatttgggtttgaagtttcgttaattttaggtgaggaaatagggtcgtggaggagataatgtggcgattataagtaagcggcggttcgaaggaggaggttagatcggcgggcgtatagttatagttttgtagtgattttcgggaaggtgggtagtcggttcggtgatttgtagggttcgagttgtagaagtcgtagtcgtcgtttttaggcgatttcgttattttcggaattacgtatttttatttttttgtcgggcgatttagtcgagtcgcgagggggcgtggtcgggtcgggtcgtattaagagcgtaaatttgtagggggaagcgcggggtttcgggaatgtacgcgcggttcgagtgggcggggcggcggtttaatggttacgtttttattttcgcggtcggcgaaggcggtggtagcgttttagtggtgtgggtttgagttttgtttaggtgttcgtagagagtagtcgggttgttagcggtgagtgttatttttcgcggcgacggcggggtgggtgaggtcgggttttaagattcggggtttgtcgggcgttttagtttatcgcggtcgtttggttttttgcgtcggggtgggttttcgggtttgggtattgcgcgtttggttcgacgttcgggcggaaggtatggtttttatttcggttttttttcgcgtcgttttttttttagagttgatttttcgcggcggtttgagggtcgatttttttatagtttgggtcgagagagttcggtaggttttcg

SEQ ID NO: 2268 - DNA, 779 bp, Artificial Sequence
  chemically treated genomic DNA (Homo sapiens) CpG-island No: 2268
cgaaaacctaccgaactctctcgacccaaactataaaaaaatcgaccctcaaaccgccgcgaaaaatcaactctaaaaaaaaaacgacgcgaaaaaaaaccgaaataaaaaccataccttccgcccgaacgtcgaaccaaacgcgcaatacccaaacccgaaaacccaccccgacgcaaaaaaccaaacgaccgcgataaactaaaacgcccgacaaaccccgaatcttaaaacccgacctcacccaccccgccgtcgccgcgaaaaataacactcaccgctaacaacccgactactctctacgaacacctaaacaaaactcaaacccacaccactaaaacgctaccaccgccttcgccgaccgcgaaaataaaaacgtaaccattaaaccgccgccccgcccactcgaaccgcgcgtacattcccgaaaccccgcgcttccccctacaaatttacgctcttaatacgacccgacccgaccacgccccctcgcgactcgactaaatcgcccgacaaaaaaataaaaatacgtaattccgaaaataacgaaatcgcctaaaaacgacgactacgacttctacaactcgaaccctacaaatcaccgaaccgactacccaccttcccgaaaatcactacaaaactataactatacgcccgccgatctaacctcctccttcgaaccgccgcttacttataatcgccacattatctcctccacgaccctatttcctcacctaaaattaacgaaacttcaaacccaaatcgtctccctaaattcc

SEQ ID NO: 2269 - DNA, 595 bp, Artificial Sequence
  chemically treated genomic DNA (Homo sapiens) CpG-island No: 2269
cgcgttcgtggggcgttaggttgtttcgttttttgtcgttttaagatttattttagtttgaggagaaattatagttttagaattaagtatatttttttcggcggttcggcgtacgagtcgcggggttcgggggtattgggtggaggttcggttattttcgtttcgcgttttacgtttcgggttttttttcgaggttagacgcgttcggattttttttatttcgaatttcgcgcgtgtttggtagggttttggacgcgcgggcgttgtagtagaggggtttggattttgttcgtcgcggtttcgttttcgttttcgttttcgttttttacgcgcgttcggttcgggaaacgtttatcgttgtagttagggcgagggtcgcggttcgcgagagtagttttcgtcgttcgtttagttttttttttaggttaggcgcgggttaggggcgtagtttgtcgtttttgtcgtcggggcgttcggttggggtcgtcgtttattttggcgattcgttagaattagtttttgttttatgataagatcgagattaggttggagtttcgggtgtcgagaaagtttcgtttgatgggttatttaagtt

SEQ ID NO: 2270 - DNA, 595 bp, Artificial Sequence
  chemically treated genomic DNA (Homo sapiens) CpG-island No: 2270
aacttaaataacccatcaaacgaaactttctcgacacccgaaactccaacctaatctcgatcttatcataaaacaaaaactaattctaacgaatcgccaaaataaacgacgaccccaaccgaacgccccgacgacaaaaacgacaaactacgcccctaacccgcgcctaacctaaaaaaaaaactaaacgaacgacgaaaactactctcgcgaaccgcgaccctcgccctaactacaacgataaacgtttcccgaaccgaacgcgcgtaaaaaacgaaaacgaaaacgaaaacgaaaccgcgacgaacaaaatccaaacccctctactacaacgcccgcgcgtccaaaaccctaccaaacacgcgcgaaattcgaaataaaaaaaatccgaacgcgtctaacctcgaaaaaaaacccgaaacgtaaaacgcgaaacgaaaataaccgaacctccacccaatacccccgaaccccgcgactcgtacgccgaaccgccgaaaaaaatatacttaattctaaaactataatttctcctcaaactaaaataaatcttaaaacgacaaaaaacgaaacaacctaacgccccacgaacgcg

SEQ ID NO: 2271 - DNA, 595 bp, Artificial Sequence
  chemically treated genomic DNA (Homo sapiens) CpG-island No: 2271
ggtttgggtggtttattaggcgaggttttttcggtattcgaggttttagtttgatttcggttttattatgaaataaaagttggttttggcgggtcgttagggtgggcggcggttttagtcgggcgtttcggcggtaagagcggtaggttgcgtttttggttcgcgtttagtttggggagagagttgggcgggcggcgggagttgttttcgcgggtcgcggttttcgttttggttgtaacggtaggcgtttttcgggtcggacgcgcgtggggggcgggggcgggggcgggggcgaggtcgcggcgagtaaagtttaggtttttttgttgtagcgttcgcgcgtttagagttttgttagatacgcgcgaggttcgaggtgagagaggttcgggcgcgtttggtttcgaagggagattcgggacgtggggcgcggggcgggagtggtcggatttttatttagtgttttcgggtttcgcgattcgtgcgtcgggtcgtcggagagggtgtatttggttttgaggttgtggtttttttttaggttgagatggattttgaggcggtaaagaacggaatagtttggcgttttacgagcgcg

SEQ ID NO: 2272 - DNA, 595 bp, Artificial Sequence
  chemically treated genomic DNA (Homo sapiens) CpG-island No: 2272
cgcgctcgtaaaacgccaaactattccgttctttaccgcctcaaaatccatctcaacctaaaaaaaaaccacaacctcaaaaccaaatacaccctctccgacgacccgacgcacgaatcgcgaaacccgaaaacactaaataaaaatccgaccactcccgccccgcgccccacgtcccgaatctcccttcgaaaccaaacgcgcccgaacctctctcacctcgaacctcgcgcgtatctaacaaaactctaaacgcgcgaacgctacaacaaaaaaacctaaactttactcgccgcgacctcgcccccgcccccgcccccgccccccacgcgcgtccgacccgaaaaacgcctaccgttacaaccaaaacgaaaaccgcgacccgcgaaaacaactcccgccgcccgcccaactctctccccaaactaaacgcgaaccaaaaacgcaacctaccgctcttaccgccgaaacgcccgactaaaaccgccgcccaccctaacgacccgccaaaaccaacttttatttcataataaaaccgaaatcaaactaaaacctcgaataccgaaaaaacctcgcctaataaaccacccaaacc

SEQ ID NO: 2273 - DNA, 826 bp, Artificial Sequence
  chemically treated genomic DNA (Homo sapiens) CpG-island No: 2273
tggagggttgcgaggggttcgggagttaggattttgcggtttcggttttgttagacgcgagcgaagcggcggcgggggcggggcgggggcgttttcggggttcgaagttgtttttcgaggcgcggcggcgaggatagcggttcggggtgcgttttttttgtttgttttcggtaggcgtcgcgttttcgcgcgtttatttggttttggagaataggaaggtaagtttgattaggttcgtaggtgaatagcgggatattttttttggcgacgttggtaatttgtagtcggtgttttaggatgtggagttttatcgttcgttcgcgtttcgttcgcggtagtttattcgttgggggacgagtcgcggttttcgtttttttcgcgttttgtcggtatcgatagtcggttcggggattcgggagttcggcgttaggcgcggggggcggcggcggtcggatcgggtcggataaaagggaggaggttcgttaagttgcgagggggagttacgggtcgagggaggtagcgtcggcggagtagcggcgcgcgggtgtcggcgcggggagtagttggtgttcgttgtaataaataatttgttatttaaacgtcggtttttattgcgtatgcgcggttcgcgcgcggtttgttaggatttgtagttcgtttgcggggttttttcggtgttgttgttgttgttgtcgtcgtcgggcggtcggagttatcggtagttcgatgtacgggaaatgtaggagagcgggtatttttaggattacggggaaggtcgaggggaggtacggggcgggtggagttagtttgagtttaggcgcgtttt

SEQ ID NO: 2274 - DNA, 826 bp, Artificial Sequence
  chemically treated genomic DNA (Homo sapiens) CpG-island No: 2274
aaaacgcgcctaaactcaaactaactccacccgccccgtacctcccctcgaccttccccgtaatcctaaaaatacccgctctcctacatttcccgtacatcgaactaccgataactccgaccgcccgacgacgacaacaacaacaacaacaccgaaaaaaccccgcaaacgaactacaaatcctaacaaaccgcgcgcgaaccgcgcatacgcaataaaaaccgacgtttaaataacaaattatttattacaacgaacaccaactactccccgcgccgacacccgcgcgccgctactccgccgacgctacctccctcgacccgtaactccccctcgcaacttaacgaacctcctcccttttatccgacccgatccgaccgccgccgccccccgcgcctaacgccgaactcccgaatccccgaaccgactatcgataccgacaaaacgcgaaaaaaacgaaaaccgcgactcgtcccccaacgaataaactaccgcgaacgaaacgcgaacgaacgataaaactccacatcctaaaacaccgactacaaattaccaacgtcgccaaaaaaaatatcccgctattcacctacgaacctaatcaaacttaccttcctattctccaaaaccaaataaacgcgcgaaaacgcgacgcctaccgaaaacaaacaaaaaaaacgcaccccgaaccgctatcctcgccgccgcgcctcgaaaaacaacttcgaaccccgaaaacgcccccgccccgcccccgccgccgcttcgctcgcgtctaacaaaaccgaaaccgcaaaatcctaactcccgaacccctcgcaaccctcca

SEQ ID NO: 2275 - DNA, 826 bp, Artificial Sequence
  chemically treated genomic DNA (Homo sapiens) CpG-island No: 2275
agggcgcgtttaggtttaggttggttttattcgtttcgtgttttttttcggtttttttcgtggttttgagggtgttcgtttttttgtatttttcgtgtatcgggttgtcggtagtttcggtcgttcggcggcggtagtagtagtagtagtatcgggagagtttcgtaggcggattataagttttggtaggtcgcgcgcggatcgcgtatgcgtagtggggatcggcgtttgagtggtaagttgtttgttatagcgaatattagttgtttttcgcgtcggtattcgcgcgtcgttgtttcgtcggcgttgtttttttcgattcgtggttttttttcgtaatttggcgggtttttttttttttgttcggttcggttcggtcgtcgtcgtttttcgcgtttggcgtcgagttttcgggttttcgggtcggttgtcggtgtcggtagggcgcggagggggcgggggtcgcggttcgttttttagcggatgagttgtcgcggacggggcgcgggcggacgatggaattttatattttggagtatcggttgtaagttgttagcgtcgttaaggagagtatttcgttgtttatttacgggtttgattaaatttgtttttttgttttttaagattaggtaagcgcgcggggacgcggcgtttgtcggggatagataaagggggcgtatttcgggtcgttgttttcgtcgtcgcgtttcggaagataatttcgggtttcgggagcgttttcgtttcgttttcgtcgtcgtttcgttcgcgtttgataaagtcggagtcgtagggttttggttttcggatttttcgtaatttttta

SEQ ID NO: 2276 - DNA, 826 bp, Artificial Sequence
  chemically treated genomic DNA (Homo sapiens) CpG-island No: 2276
taaaaaattacgaaaaatccgaaaaccaaaaccctacgactccgactttatcaaacgcgaacgaaacgacgacgaaaacgaaacgaaaacgctcccgaaacccgaaattatcttccgaaacgcgacgacgaaaacaacgacccgaaatacgccccctttatctatccccgacaaacgccgcgtccccgcgcgcttacctaatcttaaaaaacaaaaaaacaaatttaatcaaacccgtaaataaacaacgaaatactctccttaacgacgctaacaacttacaaccgatactccaaaatataaaattccatcgtccgcccgcgccccgtccgcgacaactcatccgctaaaaaacgaaccgcgacccccgccccctccgcgccctaccgacaccgacaaccgacccgaaaacccgaaaactcgacgccaaacgcgaaaaacgacgacgaccgaaccgaaccgaacaaaaaaaaaaaaacccgccaaattacgaaaaaaaaccacgaatcgaaaaaaacaacgccgacgaaacaacgacgcgcgaataccgacgcgaaaaacaactaatattcgctataacaaacaacttaccactcaaacgccgatccccactacgcatacgcgatccgcgcgcgacctaccaaaacttataatccgcctacgaaactctcccgatactactactactactaccgccgccgaacgaccgaaactaccgacaacccgatacacgaaaaatacaaaaaaacgaacaccctcaaaaccacgaaaaaaaccgaaaaaaaacacgaaacgaataaaaccaacctaaacctaaacgcgccct

SEQ ID NO: 2277 - DNA, 661 bp, Artificial Sequence
  chemically treated genomic DNA (Homo sapiens) CpG-island No: 2277
tatttaatgggtatcggatcgttggggcgttgaggatgtcgtttcggggtttttacgaggcggtttcgttacgcgtttcggttatgttttttttatttttagggaggttggacgtcgtggtttttaaagagggcgcgcgagaggggcgatcgcgagtttagtttatttcgagtttttagttcgttttaaggatgtaatatcggattcgtttcggggattgggaaagttttttttacggtttttataggcgtttcgttttttgggtttttaacggttgttttcgacgttgtgttttatttttttcgggcggggcggaaaaaatatttttcgtttttttttttcgtttagtggttttgttaaaggtcgagttcgtgacgttaaagagtttggattaattagagtatatcggattgcgtttttttcgaacgttagtagtagggttagaagggaggtagtcgtttttcgtcgtggtttggcgtggatttcgagcgttggtgtttggcggttttcgatcgttggtgtttggtacgcgttatttcgatgtattaggtaaagttttattacggggtcggcgttttttttcgtgtggagtttatttgtatgtattggttttttaatatgtacggtaggagcggcggtttagtattcggtattggttatt

SEQ ID NO: 2278 - DNA, 661 bp, Artificial Sequence
  chemically treated genomic DNA (Homo sapiens) CpG-island No: 2278
aataaccaataccgaatactaaaccgccgctcctaccgtacatattaaaaaaccaatacatacaaataaactccacacgaaaaaaaacgccgaccccgtaataaaactttacctaatacatcgaaataacgcgtaccaaacaccaacgatcgaaaaccgccaaacaccaacgctcgaaatccacgccaaaccacgacgaaaaacgactacctcccttctaaccctactactaacgttcgaaaaaaacgcaatccgatatactctaattaatccaaactctttaacgtcacgaactcgacctttaacaaaaccactaaacgaaaaaaaaaaacgaaaaatattttttccgccccgcccgaaaaaaataaaacacaacgtcgaaaacaaccgttaaaaacccaaaaaacgaaacgcctataaaaaccgtaaaaaaaactttcccaatccccgaaacgaatccgatattacatccttaaaacgaactaaaaactcgaaataaactaaactcgcgatcgcccctctcgcgcgccctctttaaaaaccacgacgtccaacctccctaaaaataaaaaaaacataaccgaaacgcgtaacgaaaccgcctcgtaaaaaccccgaaacgacatcctcaacgccccaacgatccgatacccattaaata

SEQ ID NO: 2279 - DNA, 661 bp, Artificial Sequence
  chemically treated genomic DNA (Homo sapiens) CpG-island No: 2279
agtggttagtgtcgagtgttgggtcgtcgtttttgtcgtgtatgttggggagttagtatatgtaggtgggttttatacggagaggggcgtcgatttcgtgatagggttttatttggtatatcggggtggcgcgtgttagatattaacggtcggaaatcgttagatattaacgttcggaatttacgttaggttacgacggagggcgattattttttttttgattttgttgttggcgttcggaaaaaacgtagttcggtgtgttttgattggtttaggttttttgacgttacggattcgatttttgatagagttattaggcgaaaaggagagacgggaagtatttttttcgtttcgttcggaaagggtggagtataacgtcgaaagtagtcgttgggagtttaggaggcggggcgtttgtgggagtcgtggagggaatttttttagttttcgaggcggattcggtgttgtatttttggagcgagttgagagttcgaggtgagttgggttcgcggtcgtttttttcgcgcgttttttttaagaattacggcgtttaatttttttggaaatggggggaatatggtcgaggcgcgtggcgaggtcgtttcgtggaggtttcggagcggtatttttagcgttttagcgattcggtgtttattaggtg

SEQ ID NO: 2280 - DNA, 661 bp, Artificial Sequence
  chemically treated genomic DNA (Homo sapiens) CpG-island No: 2280
cacctaataaacaccgaatcgctaaaacgctaaaaataccgctccgaaacctccacgaaacgacctcgccacgcgcctcgaccatattccccccatttccaaaaaaattaaacgccgtaattcttaaaaaaaacgcgcgaaaaaaacgaccgcgaacccaactcacctcgaactctcaactcgctccaaaaatacaacaccgaatccgcctcgaaaactaaaaaaattccctccacgactcccacaaacgccccgcctcctaaactcccaacgactactttcgacgttatactccaccctttccgaacgaaacgaaaaaaatacttcccgtctctccttttcgcctaataactctatcaaaaatcgaatccgtaacgtcaaaaaacctaaaccaatcaaaacacaccgaactacgttttttccgaacgccaacaacaaaatcaaaaaaaaaataatcgccctccgtcgtaacctaacgtaaattccgaacgttaatatctaacgatttccgaccgttaatatctaacacgcgccaccccgatataccaaataaaaccctatcacgaaatcgacgcccctctccgtataaaacccacctacatatactaactccccaacatacacgacaaaaacgacgacccaacactcgacactaaccact

SEQ ID NO: 2281 - DNA, 661 bp, Artificial Sequence
  chemically treated genomic DNA (Homo sapiens) CpG-island No: 2281
gatttcgtgatagggttttatttggtatatcggggtggcgcgtgttagatattaacggtcggaaatcgttagatattaacgttcggaatttacgttaggttacgacggagggcgattattttttttttgattttgttgttggcgttcggaaaaaacgtagttcggtgtgttttgattggtttaggttttttgacgttacggattcgatttttgatagagttattaggcgaaaaggagagacgggaagtatttttttcgtttcgttcggaaagggtggagtataacgtcgaaagtagtcgttgggagtttaggaggcggggcgtttgtgggagtcgtggagggaatttttttagttttcgaggcggattcggtgttgtatttttggagcgagttgagagttcgaggtgagttgggttcgcggtcgtttttttcgcgcgttttttttaagaattacggcgtttaatttttttggaaatggggggaatatggtcgaggcgcgtggcgaggcgtttcgtggagggttcggagcggtatttttagcgttttagcgattcggtgtttattaggtgcgttttgaagtcgaggtaagttttttcggggtgttgggttgcgggtaaagaattcggttttgtgaagagttgggttcggtttgttttaggtt

SEQ ID NO: 2282 - DNA, 661 bp, Artificial Sequence
  chemically treated genomic DNA (Homo sapiens) CpG-island No: 2282
aacctaaaacaaaccgaacccaactcttcacaaaaccgaattctttacccgcaacccaacaccccgaaaaaacttacctcgacttcaaaacgcacctaataaacaccgaatcgctaaaacgctaaaaataccgctccgaaccctccacgaaacgcctcgccacgcgcctcgaccatattccccccatttccaaaaaaattaaacgccgtaattcttaaaaaaaacgcgcgaaaaaaacgaccgcgaacccaactcacctcgaactctcaactcgctccaaaaatacaacaccgaatccgcctcgaaaactaaaaaaattccctccacgactcccacaaacgccccgcctcctaaactcccaacgactactttcgacgttatactccaccctttccgaacgaaacgaaaaaaatacttcccgtctctccttttcgcctaataactctatcaaaaatcgaatccgtaacgtcaaaaaacctaaaccaatcaaaacacaccgaactacgttttttccgaacgccaacaacaaaatcaaaaaaaaaataatcgccctccgtcgtaacctaacgtaaattccgaacgttaatatctaacgatttccgaccgttaatatctaacacgcgccaccccgatataccaaataaaaccctatcacgaaatc

SEQ ID NO: 2283 - DNA, 661 bp, Artificial Sequence
  chemically treated genomic DNA (Homo sapiens) CpG-island No: 2283
ggtttgagataggtcgaatttaattttttatagggtcgaattttttgttcgtagtttagtatttcgaaggagtttgtttcggttttaaggcgtatttaatgggtatcggatcgttggggcgttgaggatgtcgtttcgggttttttacgaggcgtttcgttacgcgtttcggttatgttttttttatttttagggaggttggacgtcgtggtttttaaagagggcgcgcgagaggggcgatcgcgagtttagtttatttcgagtttttagttcgttttaaggatgtaatatcggattcgtttcggggattgggaaagttttttttacggtttttataggcgtttcgttttttgggtttttaacggttgttttcgacgttgtgttttatttttttcgggcggggcggaaaaaatatttttcgtttttttttttcgtttagtggttttgttaaaggtcgagttcgtgacgttaaagagtttggattaattagagtatatcggattgcgtttttttcgaacgttagtagtagggttagaagggaggtagtcgtttttcgtcgtggtttggcgtggatttcgagcgttggtgtttggcggttttcgatcgttggtgtttggtacgcgttatttcgatgtattaggtaaagttttattacggggtt

SEQ ID NO: 2284 - DNA, 661 bp, Artificial Sequence
  chemically treated genomic DNA (Homo sapiens) CpG-island No: 2284
aaccccgtaataaaactttacctaatacatcgaaataacgcgtaccaaacaccaacgatcgaaaaccgccaaacaccaacgctcgaaatccacgccaaaccacgacgaaaaacgactacctcccttctaaccctactactaacgttcgaaaaaaacgcaatccgatatactctaattaatccaaactctttaacgtcacgaactcgacctttaacaaaaccactaaacgaaaaaaaaaaacgaaaaatattttttccgccccgcccgaaaaaaataaaacacaacgtcgaaaacaaccgttaaaaacccaaaaaacgaaacgcctataaaaaccgtaaaaaaaactttcccaatccccgaaacgaatccgatattacatccttaaaacgaactaaaaactcgaaataaactaaactcgcgatcgcccctctcgcgcgccctctttaaaaaccacgacgtccaacctccctaaaaataaaaaaaacataaccgaaacgcgtaacgaaacgcctcgtaaaaaacccgaaacgacatcctcaacgccccaacgatccgatacccattaaatacgccttaaaaccgaaacaaactccttcgaaatactaaactacgaacaaaaaattcgaccctataaaaaattaaattcgacctatctcaaacc

SEQ ID NO: 2285 - DNA, 716 bp, Artificial Sequence
  chemically treated genomic DNA (Homo sapiens) CpG-island No: 2285
tttttagtggcggcgggaggagtgaagttgtcggagtatagtttagcgtttcgtatatttttttcgtagggcggcgggtttaggtcgttgtcggggtcgatttaagtaatttggatttttttttatgtgttgtatttattttagggtcggcgtgttcgtcgtagttttcgtcgttgtttttttcgcgttttttgtcggaattgtagtaggagtacggtttaggtatagcgagagggagaatttcgtttcggttttgtttatattggtttcgcgttcgttaaatttcggtattttttaggcgttcgtacgttggggggttttggtcgcgtcggggagagtgggttttgggtttatattttcgtcgggattcggtgtcgaggtttaggaacgcgggttagatgcgtgggagaggaatcgcgcggtttcgtcgtagcgttgcggattatttttcggtttttttttaggtttttcgattcggattcgttgttttcgtcgtaagtcggttcgtttaggtcgcgttacgatcgaggtcgttaatttcgcgggttaaggcgtcgtattggttgcggagttttatttttagaggtgttagtttatttttcgtggggcggttaattttcgcggttgtacgttttttagttttttagtttttagtaattagtgtttatgcgatttacgtgggtaaagtatatttttgtagatagttttgtatttgg

SEQ ID NO: 2286 - DNA, 716 bp, Artificial Sequence
  chemically treated genomic DNA (Homo sapiens) CpG-island No: 2286
ccaaatacaaaactatctacaaaaatatactttacccacgtaaatcgcataaacactaattactaaaaactaaaaaactaaaaaacgtacaaccgcgaaaattaaccgccccacgaaaaataaactaacacctctaaaaataaaactccgcaaccaatacgacgccttaacccgcgaaattaacgacctcgatcgtaacgcgacctaaacgaaccgacttacgacgaaaacaacgaatccgaatcgaaaaacctaaaaaaaaaccgaaaaataatccgcaacgctacgacgaaaccgcgcgattcctctcccacgcatctaacccgcgttcctaaacctcgacaccgaatcccgacgaaaatataaacccaaaacccactctccccgacgcgaccaaaaccccccaacgtacgaacgcctaaaaaataccgaaatttaacgaacgcgaaaccaatataaacaaaaccgaaacgaaattctccctctcgctatacctaaaccgtactcctactacaattccgacaaaaaacgcgaaaaaaacaacgacgaaaactacgacgaacacgccgaccctaaaataaatacaacacataaaaaaaaatccaaattacttaaatcgaccccgacaacgacctaaacccgccgccctacgaaaaaaatatacgaaacgctaaactatactccgacaacttcactcctcccgccgccactaaaaa

SEQ ID NO: 2287 - DNA, 716 bp, Artificial Sequence
  chemically treated genomic DNA (Homo sapiens) CpG-island No: 2287
ttaggtgtaaggttatttgtagaaatgtgttttgtttacgtggatcgtatggatattaattattaagggttaaggagttgagaaacgtgtagtcgcggagattggtcgttttacggggaataagttggtatttttagaaataaagtttcgtagttaatgcggcgttttggttcgcgggattggcggtttcggtcgtgacgcgatttgggcgggtcgatttgcgacggaggtagcgggttcgggtcgggggatttgagaaggagtcgggaggtgattcgtagcgttgcgacgggatcgcgcgattttttttttacgtatttggttcgcgtttttgggtttcggtatcggatttcggcgggggtgtggatttagggtttatttttttcggcgcggttagggttttttagcgtgcgagcgtttaggggatgtcgaggtttggcgggcgcgggattaatatgggtagggtcgaggcgggattttttttttcgttgtgtttagatcgtatttttgttgtagtttcggtagagagcgcggggagagtagcggcgggagttgcggcgagtacgtcggttttggggtagatgtaatatatgagagggaatttaagttgtttgggtcggtttcggtagcgatttgaattcgtcgttttgcgggaggggtgtgcggagcgttgggttgtgtttcggtaattttatttttttcgtcgttattgggga

SEQ ID NO: 2288 - DNA, 716 bp, Artificial Sequence
  chemically treated genomic DNA (Homo sapiens) CpG-island No: 2288
tccccaataacgacgaaaaaaataaaattaccgaaacacaacccaacgctccgcacacccctcccgcaaaacgacgaattcaaatcgctaccgaaaccgacccaaacaacttaaattccctctcatatattacatctaccccaaaaccgacgtactcgccgcaactcccgccgctactctccccgcgctctctaccgaaactacaacaaaaatacgatctaaacacaacgaaaaaaaaaatcccgcctcgaccctacccatattaatcccgcgcccgccaaacctcgacatcccctaaacgctcgcacgctaaaaaaccctaaccgcgccgaaaaaaataaaccctaaatccacacccccgccgaaatccgataccgaaacccaaaaacgcgaaccaaatacgtaaaaaaaaaatcgcgcgatcccgtcgcaacgctacgaatcacctcccgactccttctcaaatcccccgacccgaacccgctacctccgtcgcaaatcgacccgcccaaatcgcgtcacgaccgaaaccgccaatcccgcgaaccaaaacgccgcattaactacgaaactttatttctaaaaataccaacttattccccgtaaaacgaccaatctccgcgactacacgtttctcaactccttaacccttaataattaatatccatacgatccacgtaaacaaaacacatttctacaaataaccttacacctaa

SEQ ID NO: 2289 - DNA, 684 bp, Artificial Sequence
  chemically treated genomic DNA (Homo sapiens) CpG-island No: 2289
cgcgtttattgcgtatttcgcgcgaattgattataaattatacggatttcgttttttcgttttaagtttcgttttagggaatttttttcgtttttagtttttttttcgggtcgttgagttttatttcgcgtcgttttttttttttagggttaaggagcggttttcgcgcgcgcggttcgttagtattttttcgttttcgggcgcgtacggtcggcgcggcggtttagaagggaagagttcgtcgcgtagtttcggttcgtattttcgtttttggagttttagtcgttcgttttttaaatttcgttcgcgttttgcggagaagcggttttatagttttagtcgttcgtcgtcgtttaagaagttttttagtcggtgagtgttcgttcggatcgggtcgacggggcgggcggcggggtggagcggtcgggtcgcgtcgtttatttatttcgcgtcggtttcgtagggataaggacggcgagggtcgcgtaaggtattttgaggtcgaggttattcgcgttcggcgtcgttttcgtagttattcgtttattcgtaagcggcgtcgggattcgttaagttttatggagtcgcggcgtattattaggtatggagggttttgggggggtcggtggcgtagggttggggtcgttgattcggattagggatagagatttcggttcggggatt

SEQ ID NO: 2290 - DNA, 684 bp, Artificial Sequence
  chemically treated genomic DNA (Homo sapiens) CpG-island No: 2290
aatccccgaaccgaaatctctatccctaatccgaatcaacgaccccaaccctacgccaccgacccccccaaaaccctccatacctaataatacgccgcgactccataaaacttaacgaatcccgacgccgcttacgaataaacgaataactacgaaaacgacgccgaacgcgaataacctcgacctcaaaataccttacgcgaccctcgccgtccttatccctacgaaaccgacgcgaaataaataaacgacgcgacccgaccgctccaccccgccgcccgccccgtcgacccgatccgaacgaacactcaccgactaaaaaacttcttaaacgacgacgaacgactaaaactataaaaccgcttctccgcaaaacgcgaacgaaatttaaaaaacgaacgactaaaactccaaaaacgaaaatacgaaccgaaactacgcgacgaactcttcccttctaaaccgccgcgccgaccgtacgcgcccgaaaacgaaaaaatactaacgaaccgcgcgcgcgaaaaccgctccttaaccctaaaaaaaaaaaacgacgcgaaataaaactcaacgacccgaaaaaaaaactaaaaacgaaaaaaattccctaaaacgaaacttaaaacgaaaaaacgaaatccgtataatttataatcaattcgcgcgaaatacgcaataaacgcg

SEQ ID NO: 2291 - DNA, 684 bp, Artificial Sequence
  chemically treated genomic DNA (Homo sapiens) CpG-island No: 2291
ggttttcgggtcgaggtttttgtttttgattcgggttagcggttttagttttgcgttatcggtttttttaagattttttatatttggtgatgcgtcgcggttttatgaagtttggcgagtttcggcgtcgtttgcggatgggcgagtagttgcgggagcggcgtcgggcgcgggtggtttcggttttagagtgttttgcgcggttttcgtcgtttttgtttttgcggggtcggcgcgaggtaagtgagcgacgcggttcggtcgttttatttcgtcgttcgtttcgtcggttcggttcgggcgggtatttatcggttgaggggttttttgggcgacggcgagcggttggggttgtggggtcgttttttcgtagagcgcgagcgagatttggagggcgagcggttggagttttaggagcgggggtgcgggtcggggttgcgcgacgagttttttttttttgggtcgtcgcgtcggtcgtgcgcgttcggggacggagaggtgttggcgggtcgcgcgcgcgggggtcgttttttggttttggaggagggagacggcgcgggatagggtttagcgattcggaaagggggttgggggcggggagggttttttggggcggggtttagggcggaggggcggggttcgtgtagtttgtggttagttcgcgcggagtgcgtagtgaacgcg

SEQ ID NO: 2292 - DNA, 684 bp, Artificial Sequence
  chemically treated genomic DNA (Homo sapiens) CpG-island No: 2292
cgcgttcactacgcactccgcgcgaactaaccacaaactacacgaaccccgcccctccgccctaaaccccgccccaaaaaaccctccccgcccccaaccccctttccgaatcgctaaaccctatcccgcgccgtctccctcctccaaaaccaaaaaacgacccccgcgcgcgcgacccgccaacacctctccgtccccgaacgcgcacgaccgacgcgacgacccaaaaaaaaaaaactcgtcgcgcaaccccgacccgcacccccgctcctaaaactccaaccgctcgccctccaaatctcgctcgcgctctacgaaaaaacgaccccacaaccccaaccgctcgccgtcgcccaaaaaacccctcaaccgataaatacccgcccgaaccgaaccgacgaaacgaacgacgaaataaaacgaccgaaccgcgtcgctcacttacctcgcgccgaccccgcaaaaacaaaaacgacgaaaaccgcgcaaaacactctaaaaccgaaaccacccgcgcccgacgccgctcccgcaactactcgcccatccgcaaacgacgccgaaactcgccaaacttcataaaaccgcgacgcatcaccaaatataaaaaatcttaaaaaaaccgataacgcaaaactaaaaccgctaacccgaatcaaaaacaaaaacctcgacccgaaaacc

SEQ ID NO: 2293 - DNA, 681 bp, Artificial Sequence
  chemically treated genomic DNA (Homo sapiens) CpG-island No: 2293
ggtagaagggcgtttttttcgttatttttttaatttttagacgttttttttagcggttcggggggtgggcgcgggttttacgtgcgcgtcgttcgtgtttattcggatagggtcgggttatttattcggtttttagcggcgtttcgtttttttcgtagcgtgagttcgttcgtagtagcgcgggtaggttttttagtcgcggtcgtagcgacgtcggcggttgttcgcgttcgggttttcgggcgttggggttgcggcgtagggggtcgtttgtcgttattatcgtcgtcgcggcggttagggtcgggttttcgtacggcggttgtattttgacggagtttacggttatttttatgttttgacggcgttgcggcgtcgggggtttttttttatcgcgttcgttttcgcgcgtcgttcgttttttcgttaggaagcgagaaggcgcgattgcggttcggcgtcgggcgcgttgttagtcgttgttttattggcgcgcgtagcgcgtcgcgcgagtttagcgtcgcgcgtttttttttttttttttttttttttttttttcgtttaggtgcgcgggtttcgtttcgtttcgttttttcgtttgcgaaagttgtttgggatttgtttttttcggattttttattcgggattcgggaggaagagggtattttgggtatcggttta

SEQ ID NO: 2294 - DNA, 681 bp, Artificial Sequence
  chemically treated genomic DNA (Homo sapiens) CpG-island No: 2294
taaaccgatacccaaaataccctcttcctcccgaatcccgaataaaaaatccgaaaaaaacaaatcccaaacaactttcgcaaacgaaaaaacgaaacgaaacgaaacccgcgcacctaaacgaaaaaaaaaaaaaaaaaaaaaaaaaaaaaaacgcgcgacgctaaactcgcgcgacgcgctacgcgcgccaataaaacaacgactaacaacgcgcccgacgccgaaccgcaatcgcgccttctcgcttcctaacgaaaaaacgaacgacgcgcgaaaacgaacgcgataaaaaaaaacccccgacgccgcaacgccgtcaaaacataaaaataaccgtaaactccgtcaaaatacaaccgccgtacgaaaacccgaccctaaccgccgcgacgacgataataacgacaaacgaccccctacgccgcaaccccaacgcccgaaaacccgaacgcgaacaaccgccgacgtcgctacgaccgcgactaaaaaacctacccgcgctactacgaacgaactcacgctacgaaaaaaacgaaacgccgctaaaaaccgaataaataacccgaccctatccgaataaacacgaacgacgcgcacgtaaaacccgcgcccaccccccgaaccgctaaaaaaaacgtctaaaaattaaaaaaataacgaaaaaaacgcccttctacc

SEQ ID NO: 2295 - DNA, 681 bp, Artificial Sequence
  chemically treated genomic DNA (Homo sapiens) CpG-island No: 2295
tgagtcggtgtttaaggtgttttttttttttcgggtttcgagtgggagattcgagggggataggttttaggtagttttcgtaggcgaaagggcggggcggggcggggttcgcgtatttgggcggggaggggaggagagaggaggggaggggaggcgcgcggcgttgagttcgcgcggcgcgttgcgcgcgttaatggggtagcggttggtagcgcgttcggcgtcgagtcgtagtcgcgttttttcgttttttggcgaaggagcggacggcgcgcggaggcgagcgcggtggagaggagttttcggcgtcgtagcgtcgttagggtatgaggatggtcgtgggtttcgttaagatgtagtcgtcgtgcgagagttcggttttggtcgtcgcggcggcggtggtggcggtagacggttttttgcgtcgtagttttagcgttcgggagttcgagcgcgagtagtcgtcggcgtcgttgcggtcgcggttgagggatttgttcgcgttgttgcgagcgggtttacgttgcggaggaagcggagcgtcgttgggggtcgggtgagtggttcggttttgttcgagtgggtacgggcggcgcgtacgtggagttcgcgtttatttttcgggtcgttgaggggggcgtttggaagttggggaggtggcggaagggacgtttttttgtt

SEQ ID NO: 2296 - DNA, 681 bp, Artificial Sequence
  chemically treated genomic DNA (Homo sapiens) CpG-island No: 2296
aacaaaaaaacgtcccttccgccacctccccaacttccaaacgcccccctcaacgacccgaaaaataaacgcgaactccacgtacgcgccgcccgtacccactcgaacaaaaccgaaccactcacccgacccccaacgacgctccgcttcctccgcaacgtaaacccgctcgcaacaacgcgaacaaatccctcaaccgcgaccgcaacgacgccgacgactactcgcgctcgaactcccgaacgctaaaactacgacgcaaaaaaccgtctaccgccaccaccgccgccgcgacgaccaaaaccgaactctcgcacgacgactacatcttaacgaaacccacgaccatcctcataccctaacgacgctacgacgccgaaaactcctctccaccgcgctcgcctccgcgcgccgtccgctccttcgccaaaaaacgaaaaaacgcgactacgactcgacgccgaacgcgctaccaaccgctaccccattaacgcgcgcaacgcgccgcgcgaactcaacgccgcgcgcctcccctcccctcctctctcctcccctccccgcccaaatacgcgaaccccgccccgccccgccctttcgcctacgaaaactacctaaaacctatccccctcgaatctcccactcgaaacccgaaaaaaaaaaaacaccttaaacaccgactca

SEQ ID NO: 2297 - DNA, 523 bp, Artificial Sequence
  chemically treated genomic DNA (Homo sapiens) CpG-island No: 2297
tcgttattatatatattgataatcgatgatattttttcgttttttttattttattatttttttatgaataaatacgattacgacgatattatttattttatatatatataatatttcgattaagattatagtatcgtttatattattatatagttatatatacgatttattatgttacgtttattatttataatagtaatatagatatcgtatattttaaggtacgcgttttttatttttattttttatgatttacgtatatatattatatatcgacggcgaggtattttatatatatattattaatatacgtatatataatttttttatattagttttattatttacgtatacgggcgagttattttttatttaattatagtatatttatattgtttgttttttttttttttatacgaagttcggcgtaaagatagttttatattttgtacgcgtgttttatatacggtttttatagtgtgtgatattttattatgatattatattaaatatttagtagtat

SEQ ID NO: 2298 - DNA, 523 bp, Artificial Sequence
  chemically treated genomic DNA (Homo sapiens) CpG-island No: 2298
atactactaaatatttaatataatatcataataaaatatcacacactataaaaaccgtatataaaacacgcgtacaaaatataaaactatctttacgccgaacttcgtataaaaaaaaaaaaaacaaacaatataaatatactataattaaataaaaaataactcgcccgtatacgtaaataataaaactaatataaaaaaattatatatacgtatattaataatatatatataaaatacctcgccgtcgatatataatatatatacgtaaatcataaaaaataaaaataaaaaacgcgtaccttaaaatatacgatatctatattactattataaataataaacgtaacataataaatcgtatatataactatataataatataaacgatactataatcttaatcgaaatattatatatatataaaataaataatatcgtcgtaatcgtatttattcataaaaaaataataaaataaaaaaaacgaaaaaatatcatcgattatcaatatatataataacga

SEQ ID NO: 2299 - DNA, 523 bp, Artificial Sequence
  chemically treated genomic DNA (Homo sapiens) CpG-island No: 2299
atgttgttaagtgtttgatgtgatattatgatgaggtgttatatattgtgaaggtcgtgtgtgaagtacgcgtgtagagtgtggagttgtttttgcgtcgagtttcgtgtgaagagagagaagatagataatgtagatgtgttgtgattaagtgggagatagttcgttcgtgtgcgtgggtagtgagattagtgtgggagggttgtgtgtgcgtgtgttgatggtgtgtgtatgaggtgtttcgtcgtcgatgtgtggtgtgtgtgcgtaggttatagaggataggagtaaagagcgcgtgttttgggatgtgcgatgtttgtgttgttgttgtaggtggtgagcgtagtatggtgggtcgtgtgtgtggttgtatggtagtgtagacgatgttgtgattttagtcgggatgttgtgtatgtgtggagtgggtggtgtcgtcgtggtcgtgtttgtttataggggagtggtgagatgagagagacgagagagtgttatcggttgttagtgtgtgtagtgacgg

SEQ ID NO: 2300 - DNA, 523 bp, Artificial Sequence
  chemically treated genomic DNA (Homo sapiens) CpG-island No: 2300
ccgtcactacacacactaacaaccgataacactctctcgtctctctcatctcaccactcccctataaacaaacacgaccacgacgacaccacccactccacacatacacaacatcccgactaaaatcacaacatcgtctacactaccatacaaccacacacacgacccaccatactacgctcaccacctacaacaacaacacaaacatcgcacatcccaaaacacgcgctctttactcctatcctctataacctacgcacacacaccacacatcgacgacgaaacacctcatacacacaccatcaacacacgcacacacaaccctcccacactaatctcactacccacgcacacgaacgaactatctcccacttaatcacaacacatctacattatctatcttctctctcttcacacgaaactcgacgcaaaaacaactccacactctacacgcgtacttcacacacgaccttcacaatatataacacctcatcataatatcacatcaaacacttaacaacat

SEQ ID NO: 2301 - DNA, 571 bp, Artificial Sequence
  chemically treated genomic DNA (Homo sapiens) CpG-island No: 2301
ttttacggatggggaagtatacgttttcgttgttcgggaaattttataatatttacgtgtgtgcgagttgttgcgtagattttaaggggggttcgcgaaaaaaggagtgtagaagatagtgatgtatgagatgtgtgggttgagttcgtggtcgtcggtcgcggcgcgttttatggtgtatagattaatgggggaatgtcgttcgcgtgttgggtgatagagattcgtcgagaggcggggtatttgtggtgtgagttgcgcgttgtgtgttgatgagcgagaaatagtgattagtgtggtgagggtgagtgtgtgttggtgaggagtgtgagagtgtgaggacgtgcggattagacgagttttagatagagatggtgagatgttgaagggtggagtgagtgtggttggtgttttagcgtcggaggtagtgtttgatgtgttcgtgaaagtacgtgttgtcgtgtggggcggtgatgcggtagagtggcgagagtgttgagagtaggtgcggatgaagagatttagtacgcgtgttaggttagtagtcgaatgtacgtgttagttcgtttta

SEQ ID NO: 2302 - DNA, 571 bp, Artificial Sequence
  chemically treated genomic DNA (Homo sapiens) CpG-island No: 2302
taaaacgaactaacacgtacattcgactactaacctaacacgcgtactaaatctcttcatccgcacctactctcaacactctcgccactctaccgcatcaccgccccacacgacaacacgtactttcacgaacacatcaaacactacctccgacgctaaaacaccaaccacactcactccacccttcaacatctcaccatctctatctaaaactcgtctaatccgcacgtcctcacactctcacactcctcaccaacacacactcaccctcaccacactaatcactatttctcgctcatcaacacacaacgcgcaactcacaccacaaataccccgcctctcgacgaatctctatcacccaacacgcgaacgacattcccccattaatctatacaccataaaacgcgccgcgaccgacgaccacgaactcaacccacacatctcatacatcactatcttctacactccttttttcgcgaaccccccttaaaatctacgcaacaactcgcacacacgtaaatattataaaatttcccgaacaacgaaaacgtatacttccccatccgtaaaa

SEQ ID NO: 2303 - DNA, 571 bp, Artificial Sequence
  chemically treated genomic DNA (Homo sapiens) CpG-island No: 2303
taagacgagttagtacgtatattcgattgttgatttgatacgcgtattaggtttttttattcgtatttatttttagtattttcgttattttatcgtattatcgttttatacgatagtacgtatttttacgaatatattaagtattgttttcgacgttgagatattagttatatttattttattttttagtattttattatttttatttagagttcgtttagttcgtacgtttttatatttttatattttttattaatatatatttatttttattatattgattattgtttttcgtttattaatatatagcgcgtaatttatattatagatatttcgtttttcgacgaatttttattatttagtacgcgggcggtatttttttattgatttatgtattataaaacgcgtcgcggtcggcggttacgagtttaatttatatattttatgtattattattttttatattttttttttcgcgggttttttttagagtttacgtaataattcgtatatacgtgggtgttgtgggatttttcgaatagcgaaggcgtatatttttttattcgtgaga

SEQ ID NO: 2304 - DNA, 571 bp, Artificial Sequence
  chemically treated genomic DNA (Homo sapiens) CpG-island No: 2304
tctcacgaataaaaaaatatacgccttcgctattcgaaaaatcccacaacacccacgtatatacgaattattacgtaaactctaaaaaaaacccgcgaaaaaaaaaatataaaaaataataatacataaaatatataaattaaactcgtaaccgccgaccgcgacgcgttttataatacataaatcaataaaaaaataccgcccgcgtactaaataataaaaattcgtcgaaaaacgaaatatctataatataaattacgcgctatatattaataaacgaaaaacaataatcaatataataaaaataaatatatattaataaaaaatataaaaatataaaaacgtacgaactaaacgaactctaaataaaaataataaaatactaaaaaataaaataaatataactaatatctcaacgtcgaaaacaatacttaatatattcgtaaaaatacgtactatcgtataaaacgataatacgataaaataacgaaaatactaaaaataaatacgaataaaaaaacctaatacgcgtatcaaatcaacaatcgaatatacgtactaactcgtctta

SEQ ID NO: 2305 - DNA, 724 bp, Artificial Sequence
  chemically treated genomic DNA (Homo sapiens) CpG-island No: 2305
gtagtcggcgcgttgaagtttgtatttcgtcgggggcgtcggggggcgagaagttgttggcgggaggttgttgatagtttcgttgagagggttgagtaggtttttttttaatagagtatagatggtttcgtgtggggtcgcgtcgtaggtgtcgttcgtttgtgcgcggcgcgtggcgagatagtagtttttttcggcgaggcggcgttgatgtggagtaagtgtgtggttttttttttcgttgtgtgtgatacgtttttgtttattacgagcgagagtatttacgagtcgcgtttgagttgtgtttttaaaagtggttgattcgtgagtgcgcgtgcgataggtaggtattacggttagtgttgttttttttcgaagtgtgtgtttagcggggttttgcggcgtaacgtttgcgttgagttgtgagtgtcgtgaagtacggacgtttggtcgtgtgtgatgtttttgatttgtggagacggagtagtttttgtgacgcgcgcgttgcgtcgagtatgatcgtcgtgtattgagcgtatgttcgttttatcgtttgtcgtgtttgtgtatgagttgtcgatgtgcgtcgaggtcgtacgtgtgtcgtagtcgtgtgagtttatcgcgtagtggttgttcgatcgttagatcgtgtttatcgtgttgttcgttgttgtgatgatgttaaagttcgatcgatcgtacgtgatacggtttatcgagg

SEQ ID NO: 2306 - DNA, 724 bp, Artificial Sequence
  chemically treated genomic DNA (Homo sapiens) CpG-island No: 2306
cctcgataaaccgtatcacgtacgatcgatcgaactttaacatcatcacaacaacgaacaacacgataaacacgatctaacgatcgaacaaccactacgcgataaactcacacgactacgacacacgtacgacctcgacgcacatcgacaactcatacacaaacacgacaaacgataaaacgaacatacgctcaatacacgacgatcatactcgacgcaacgcgcgcgtcacaaaaactactccgtctccacaaatcaaaaacatcacacacgaccaaacgtccgtacttcacgacactcacaactcaacgcaaacgttacgccgcaaaaccccgctaaacacacacttcgaaaaaaaacaacactaaccgtaatacctacctatcgcacgcgcactcacgaatcaaccacttttaaaaacacaactcaaacgcgactcgtaaatactctcgctcgtaataaacaaaaacgtatcacacacaacgaaaaaaaaaaccacacacttactccacatcaacgccgcctcgccgaaaaaaactactatctcgccacgcgccgcgcacaaacgaacgacacctacgacgcgaccccacacgaaaccatctatactctattaaaaaaaaacctactcaaccctctcaacgaaactatcaacaacctcccgccaacaacttctcgccccccgacgcccccgacgaaatacaaacttcaacgcgccgactac

SEQ ID NO: 2307 - DNA, 724 bp, Artificial Sequence
  chemically treated genomic DNA (Homo sapiens) CpG-island No: 2307
tttcgatgagtcgtattacgtgcgatcggtcgagttttagtattattataatagcgaatagtacggtagatacgatttgacggtcggataattattacgcgatgaatttatacgattgcgatatacgtgcggtttcgacgtatatcgataatttatatatagatacgatagacgatgagacgaatatgcgtttagtatacgacgattatattcgacgtagcgcgcgcgttataaaagttgtttcgtttttatagattagaagtattatatacgattaggcgttcgtgttttacgatatttataatttaacgtagacgttgcgtcgtagagtttcgttgagtatatatttcgagagagagtaatattaatcgtgatgtttatttatcgtacgcgtatttacgagttagttatttttagaaatatagtttaggcgcgattcgtgagtgttttcgttcgtggtagataagagcgtgttatatatagcgggagaaggggttatatatttgttttatattagcgtcgtttcgtcggagaggattattgtttcgttacgcgtcgcgtatagacgggcggtatttgcggcgcggttttatacggagttatttgtgttttattggaaggagatttgtttagtttttttagcggagttgttaataatttttcgttaatagtttttcgtttttcggcgttttcgacgaggtgtaggttttagcgcgtcgattgt

SEQ ID NO: 2308 - DNA, 724 bp, Artificial Sequence
  chemically treated genomic DNA (Homo sapiens) CpG-island No: 2308
acaatcgacgcgctaaaacctacacctcgtcgaaaacgccgaaaaacgaaaaactattaacgaaaaattattaacaactccgctaaaaaaactaaacaaatctccttccaataaaacacaaataactccgtataaaaccgcgccgcaaataccgcccgtctatacgcgacgcgtaacgaaacaataatcctctccgacgaaacgacgctaatataaaacaaatatataaccccttctcccgctatatataacacgctcttatctaccacgaacgaaaacactcacgaatcgcgcctaaactatatttctaaaaataactaactcgtaaatacgcgtacgataaataaacatcacgattaatattactctctctcgaaatatatactcaacgaaactctacgacgcaacgtctacgttaaattataaatatcgtaaaacacgaacgcctaatcgtatataatacttctaatctataaaaacgaaacaacttttataacgcgcgcgctacgtcgaatataatcgtcgtatactaaacgcatattcgtctcatcgtctatcgtatctatatataaattatcgatatacgtcgaaaccgcacgtatatcgcaatcgtataaattcatcgcgtaataattatccgaccgtcaaatcgtatctaccgtactattcgctattataataatactaaaactcgaccgatcgcacgtaatacgactcatcgaaa

SEQ ID NO: 2309 - DNA, 1372 bp, Artificial Sequence
  chemically treated genomic DNA (Homo sapiens) CpG-island No: 2309
gataaacgtatcgagaattcgcgagtacgattttagtagcgaacgttttcgcggtagtttgtgttcggtttatagttattttggttaaataattggagtttcgtatttcggaagtagcggcggtagttggagaaagtttttttttttattaatttcgagttcgggagagaatcgggagtcggcggaattattttttttcgggatagatttcggaggtgttagttatagtaacgtcgtttttaggtcggttttttatttaggttttatcgcgattttcgtcgtagaggtgtaggtatttaagtttcgcgttcgaaggggtttcgcgcgtttgcggttttagttttagtcggggtcgcgtcggggagcgcgtggggagcggcggtaagtagtatgggttagatacgttgtcgagtttcggttcgtttagtcgttcgtagttagagaggtaggagttcggtcgagcgtttttttcgcgcgggtcgggttgggggcggttagtagttttttcgatcgcggcgtcgtcgtcgtcgtttgtcggtttttttttttcgcgttcgtcgaagtttaggtgtcgaggggggcggggcgggttagggttttcgcgtggcgcgtcgcgtcgagtaatagggcgttttcggtcggttcggcgcgcggcgcgatcgttattcgagcggcgtgggggtttagttaatttatcggttcgtattttagtcgttttcgcgtcgtcgttgtcgtcgttttcggtcgtttttcgtcgtcgttgtttttttttagttataggcgtcgtcgagtagttttatttgtaaattcgtggttcgtagttgagaattggaaatgcgttttttattgtttttcgttttttttttttttttttttttttttcgttttttattttgttttagtttcggtcgttttcgtcgttgttttcgcgcgcgtagttagtcgcgttttagtcgttttttttttttttttttttttttttttttttttttagtcgtcgtcgtcgtcgtcgtttgggcgcgtttttagtcggtttcgcgcgtgcgtcggacgtcggggagcgcgcgttcgggcgcgaggaggtgttatcgttttcggaaagtcgggtttcgtttttttcgtcgcggttgggcgtttaggtggagtttttttttagtttttgagcgtttagattgattgcgttttgcgttcggtcggttcgttttaggggtttcggatttgcgttcgcgagagagggttggtcggatttagttttcgtcgggttttttgggtcgaagtcgtagttgtttgttagtatttacgggtgggtaagatatttttcggggtataaaataggtttcgttttgatttttttgagagttttatatttaag

SEQ ID NO: 2310 - DNA, 1372 bp, Artificial Sequence
  chemically treated genomic DNA (Homo sapiens) CpG-island No: 2310
cttaaatataaaactctcaaaaaaatcaaaacgaaacctattttataccccgaaaaatatcttacccacccgtaaatactaacaaacaactacgacttcgacccaaaaaacccgacgaaaactaaatccgaccaaccctctctcgcgaacgcaaatccgaaacccctaaaacgaaccgaccgaacgcaaaacgcaatcaatctaaacgctcaaaaactaaaaaaaaactccacctaaacgcccaaccgcgacgaaaaaaacgaaacccgactttccgaaaacgataacacctcctcgcgcccgaacgcgcgctccccgacgtccgacgcacgcgcgaaaccgactaaaaacgcgcccaaacgacgacgacgacgacgactaaaaaaaaaaaaaaaaaaaaaaaaaaaaaaaaaaaacgactaaaacgcgactaactacgcgcgcgaaaacaacgacgaaaacgaccgaaactaaaacaaaataaaaaacgaaaaaaaaaaaaaaaaaaaaaaaaaacgaaaaacaataaaaaacgcatttccaattctcaactacgaaccacgaatttacaaataaaactactcgacgacgcctataactaaaaaaaaacaacgacgacgaaaaacgaccgaaaacgacgacaacgacgacgcgaaaacgactaaaatacgaaccgataaattaactaaacccccacgccgctcgaataacgatcgcgccgcgcgccgaaccgaccgaaaacgccctattactcgacgcgacgcgccacgcgaaaaccctaacccgccccgcccccctcgacacctaaacttcgacgaacgcgaaaaaaaaaaaccgacaaacgacgacgacgacgccgcgatcgaaaaaactactaaccgcccccaacccgacccgcgcgaaaaaaacgctcgaccgaactcctacctctctaactacgaacgactaaacgaaccgaaactcgacaacgtatctaacccatactacttaccgccgctccccacgcgctccccgacgcgaccccgactaaaactaaaaccgcaaacgcgcgaaaccccttcgaacgcgaaacttaaatacctacacctctacgacgaaaatcgcgataaaacctaaataaaaaaccgacctaaaaacgacgttactataactaacacctccgaaatctatcccgaaaaaaaataattccgccgactcccgattctctcccgaactcgaaattaataaaaaaaaaaactttctccaactaccgccgctacttccgaaatacgaaactccaattatttaaccaaaataactataaaccgaacacaaactaccgcgaaaacgttcgctactaaaatcgtactcgcgaattctcgatacgtttatc

SEQ ID NO: 2311 - DNA, 1372 bp, Artificial Sequence
  chemically treated genomic DNA (Homo sapiens) CpG-island No: 2311
tttgaatgtaaaatttttagaaaggttagggcggagtttgttttatgtttcgaggagtattttgtttattcgtaaatgttgatagatagttgcgatttcggtttaggagattcggcggggattgggttcgattagttttttttcgcgggcgtaggttcgggatttttgaagcgagtcggtcgggcgtagagcgtagttagtttgggcgtttagaagttgggagggggttttatttgggcgtttagtcgcggcgggaggggcggggttcggtttttcggaggcggtggtattttttcgcgttcgagcgcgcgtttttcgacgttcggcgtacgcgcgaggtcggttgggagcgcgtttaagcggcggcggcggcggcggttggaggaggaggaggaggaggaggaggaggaggagggcggttgaggcgcggttggttgcgcgcgcggaggtagcggcgggggcgatcggagttggggtagagtggggagcgagggagggggaggagagagagggaggcggagggtagtgagagacgtatttttagtttttaattacgagttacgagtttgtagatggggttgttcggcggcgtttgtggttgagggagagtagcggcggcggggagcgatcgggagcggcggtagcggcggcgcggaggcggttgaggtgcgagtcggtgagttaattggatttttacgtcgttcgggtaacggtcgcgtcgcgcgtcgggtcggtcgggggcgttttgttgttcggcgcggcgcgttacgcggggattttggttcgtttcgtttttttcggtatttgggtttcggcgggcgcggggaagagggatcggtaggcggcggcggcggcgtcgcggtcggggaggttgttggtcgtttttagttcggttcgcgcggaaggggcgttcggtcgggtttttgtttttttggttgcgggcggttgggcgggtcggagttcggtaacgtgtttggtttatgttgtttgtcgtcgttttttacgcgtttttcggcgcggtttcgattggggttagggtcgtagacgcgcggggttttttcgggcgcggggtttgggtgtttatatttttgcggcgggagtcgcggtggagtttgaatggagagtcggtttgggggcggcgttgttgtgattgatattttcggggtttgtttcgagagggggtgatttcgtcggttttcggttttttttcgagttcggagttggtaggggaggaggttttttttaattatcgtcgttattttcgaggtacgagattttagttgtttggttaaagtggttgtgggtcgagtataggttgtcgcgggggcgttcgttgttgagatcgtgttcgcggattttcggtacgtttgtt

SEQ ID NO: 2312 - DNA, 1372 bp, Artificial Sequence
  chemically treated genomic DNA (Homo sapiens) CpG-island No: 2312
aacaaacgtaccgaaaatccgcgaacacgatctcaacaacgaacgcccccgcgacaacctatactcgacccacaaccactttaaccaaacaactaaaatctcgtacctcgaaaataacgacgataattaaaaaaaacctcctcccctaccaactccgaactcgaaaaaaaaccgaaaaccgacgaaatcaccccctctcgaaacaaaccccgaaaatatcaatcacaacaacgccgcccccaaaccgactctccattcaaactccaccgcgactcccgccgcaaaaatataaacacccaaaccccgcgcccgaaaaaaccccgcgcgtctacgaccctaaccccaatcgaaaccgcgccgaaaaacgcgtaaaaaacgacgacaaacaacataaaccaaacacgttaccgaactccgacccgcccaaccgcccgcaaccaaaaaaacaaaaacccgaccgaacgccccttccgcgcgaaccgaactaaaaacgaccaacaacctccccgaccgcgacgccgccgccgccgcctaccgatccctcttccccgcgcccgccgaaacccaaataccgaaaaaaacgaaacgaaccaaaatccccgcgtaacgcgccgcgccgaacaacaaaacgcccccgaccgacccgacgcgcgacgcgaccgttacccgaacgacgtaaaaatccaattaactcaccgactcgcacctcaaccgcctccgcgccgccgctaccgccgctcccgatcgctccccgccgccgctactctccctcaaccacaaacgccgccgaacaaccccatctacaaactcgtaactcgtaattaaaaactaaaaatacgtctctcactaccctccgcctccctctctctcctccccctccctcgctccccactctaccccaactccgatcgcccccgccgctacctccgcgcgcgcaaccaaccgcgcctcaaccgccctcctcctcctcctcctcctcctcctcctcctccaaccgccgccgccgccgccgcttaaacgcgctcccaaccgacctcgcgcgtacgccgaacgtcgaaaaacgcgcgctcgaacgcgaaaaaataccaccgcctccgaaaaaccgaaccccgcccctcccgccgcgactaaacgcccaaataaaaccccctcccaacttctaaacgcccaaactaactacgctctacgcccgaccgactcgcttcaaaaatcccgaacctacgcccgcgaaaaaaaactaatcgaacccaatccccgccgaatctcctaaaccgaaatcgcaactatctatcaacatttacgaataaacaaaatactcctcgaaacataaaacaaactccgccctaacctttctaaaaattttacattcaaa

SEQ ID NO: 2313 - DNA, 900 bp, Artificial Sequence
  chemically treated genomic DNA (Homo sapiens) CpG-island No: 2313
cgacgagcgcggaggatcgggaggttttcgggtttgcgtgggtaaggttttgggtttttatcgggtacggtttatgcgtttcggggataggggtggttgtgcggtgtcgcggcggtcggcggggttttttttttagtaggggtggggacgttgagttacggatttgttatcgttttgtattttttcgagttttcgggggttaaagtaaaagcgaaagcgaatgcgattggcggggcggtaggttttagagtagcgttcgttattttttttcggtttgggtagcgttcgttcggggagtttagcggtgttttgtggagttgtcgttatggtttcgcggcgggcgcgcggttgtcggattttcggtttttcggcgttgttattgttgttgttgtttcggtcgtcggcgacgcggggtagggagttgggagtaggggcgttcgggcgggatttggaagggggtcgggacgtggagttggagggaatcgggcgttttattttttcgggtcgtgcgggggcgtcggtgttttcgggagcgcggtgcgcgtaggtttaggtcggggaggggacgcggcgtcgggtaggagggatacgtgtcgggagtcggggtcgtagggagagcgtcgtcgttgcgttcgggttatttacgtaagggagcgggcggtttggttggggttttcgaggtcgaggttaggagtagttttgagaagttcgttttggttacgggagcgcggagtcggcggcgtttagtagtttggagatacgggcgagtgcgttttttttaggcgtttggattgtagggcgggtgttgtatagtacgcggttttcggaggggttcgggagaaattatttttttcgatttttaggtaaaagtaaattatgttagtgggagttgggagggtg

SEQ ID NO: 2314 - DNA, 900 bp, Artificial Sequence
  chemically treated genomic DNA (Homo sapiens) CpG-island No: 2314
caccctcccaactcccactaacataatttacttttacctaaaaatcgaaaaaaataatttctcccgaacccctccgaaaaccgcgtactatacaacacccgccctacaatccaaacgcctaaaaaaaacgcactcgcccgtatctccaaactactaaacgccgccgactccgcgctcccgtaaccaaaacgaacttctcaaaactactcctaacctcgacctcgaaaaccccaaccaaaccgcccgctcccttacgtaaataacccgaacgcaacgacgacgctctccctacgaccccgactcccgacacgtatccctcctacccgacgccgcgtcccctccccgacctaaacctacgcgcaccgcgctcccgaaaacaccgacgcccccgcacgacccgaaaaaataaaacgcccgattccctccaactccacgtcccgacccccttccaaatcccgcccgaacgcccctactcccaactccctaccccgcgtcgccgacgaccgaaacaacaacaacaataacaacgccgaaaaaccgaaaatccgacaaccgcgcgcccgccgcgaaaccataacgacaactccacaaaacaccgctaaactccccgaacgaacgctacccaaaccgaaaaaaaataacgaacgctactctaaaacctaccgccccgccaatcgcattcgctttcgcttttactttaacccccgaaaactcgaaaaaatacaaaacgataacaaatccgtaactcaacgtccccacccctactaaaaaaaaaaccccgccgaccgccgcgacaccgcacaaccacccctatccccgaaacgcataaaccgtacccgataaaaacccaaaaccttacccacgcaaacccgaaaacctcccgatcctccgcgctcgtcg

SEQ ID NO: 2315 - DNA, 900 bp, Artificial Sequence
  chemically treated genomic DNA (Homo sapiens) CpG-island No: 2315
tatttttttagtttttattgatataatttatttttgtttgggagtcgggaggagtagtttttttcggattttttcgaggatcgcgtgttatgtaatattcgttttgtagtttaggcgtttgggagaagcgtattcgttcgtgtttttaaattgttggacgtcgtcggtttcgcgttttcgtggttaaaacgggttttttagaattgtttttgatttcggtttcggagattttagttaggtcgttcgtttttttacgtgggtgattcgggcgtagcggcggcgttttttttgcgatttcggttttcggtacgtgttttttttgttcggcgtcgcgtttttttttcggtttgggtttgcgcgtatcgcgttttcgagggtatcgacgttttcgtacggttcggggagatggggcgttcggttttttttagttttacgtttcggtttttttttaagtttcgttcgggcgtttttgtttttagttttttatttcgcgtcgtcggcggtcggagtagtagtagtagtagtagcgtcgggagatcgagggttcggtagtcgcgcgttcgtcgcggggttatggcggtagttttataggatatcgttggatttttcgggcgagcgttgtttaggtcggggggaggtggcgagcgttgttttgggatttgtcgtttcgttagtcgtattcgttttcgtttttgttttggttttcgagggttcggagaggtgtaaagcggtgatagattcgtgatttagcgtttttatttttgttggggaaggagtttcgtcggtcgtcgcggtatcgtatagttatttttgttttcgggacgtatgggtcgtgttcggtggggatttaggattttatttacgtaagttcgggagtttttcggtttttcgcgttcgtcg

SEQ ID NO: 2316 - DNA, 900 bp, Artificial Sequence
  chemically treated genomic DNA (Homo sapiens) CpG-island No: 2316
cgacgaacgcgaaaaaccgaaaaactcccgaacttacgtaaataaaatcctaaatccccaccgaacacgacccatacgtcccgaaaacaaaaataactatacgataccgcgacgaccgacgaaactccttccccaacaaaaataaaaacgctaaatcacgaatctatcaccgctttacacctctccgaaccctcgaaaaccaaaacaaaaacgaaaacgaatacgactaacgaaacgacaaatcccaaaacaacgctcgccacctccccccgacctaaacaacgctcgcccgaaaaatccaacgatatcctataaaactaccgccataaccccgcgacgaacgcgcgactaccgaaccctcgatctcccgacgctactactactactactactccgaccgccgacgacgcgaaataaaaaactaaaaacaaaaacgcccgaacgaaacttaaaaaaaaaccgaaacgtaaaactaaaaaaaaccgaacgccccatctccccgaaccgtacgaaaacgtcgataccctcgaaaacgcgatacgcgcaaacccaaaccgaaaaaaaaacgcgacgccgaacaaaaaaaacacgtaccgaaaaccgaaatcgcaaaaaaaacgccgccgctacgcccgaatcacccacgtaaaaaaacgaacgacctaactaaaatctccgaaaccgaaatcaaaaacaattctaaaaaacccgttttaaccacgaaaacgcgaaaccgacgacgtccaacaatttaaaaacacgaacgaatacgcttctcccaaacgcctaaactacaaaacgaatattacataacacgcgatcctcgaaaaaatccgaaaaaaactactcctcccgactcccaaacaaaaataaattatatcaataaaaactaaaaaaata

SEQ ID NO: 2317 - DNA, 581 bp, Artificial Sequence
  chemically treated genomic DNA (Homo sapiens) CpG-island No: 2317
aggcgtcgcgggttttcgggttgggttatcgttcgggtcgggtcgggttgcgcggggaggcgtcgggcgggatatcgtgcggtcgggtagggagaagtcgagggcgagtgggatttttcgtttttttacgtaatttgtttcgcgcgtttcgaattcggtagaatcgttttttacgttttcggttttgttttcggtagagtcgtttttttaaattttcggtttagttcgtaggcgggttgtttttttatagtttcggtttgtttcgcgtgggagaagtcgcggtttcgggtacggggcggtttttttttagggacggagcggttcgggatgagtacggaggggtttggggattcgagagcgttggcgttcgtcgttttggagttgtagcggttcgtacgtgattcgggattgaatacgtaagggagtggggcgcgtcgttatatcgtaaagttttaaagtggagggttcgggagggcgcgtatagtttcgttcggcgtcgtgtagggtggtttttgaggtagttaggtttaagcgtgatttgtttcgtacgcgtttttagggtcgttttagtttttagtttt

SEQ ID NO: 2318 - DNA, 581 bp, Artificial Sequence
  chemically treated genomic DNA (Homo sapiens) CpG-island No: 2318
aaaactaaaaactaaaacgaccctaaaaacgcgtacgaaacaaatcacgcttaaacctaactacctcaaaaaccaccctacacgacgccgaacgaaactatacgcgccctcccgaaccctccactttaaaactttacgatataacgacgcgccccactcccttacgtattcaatcccgaatcacgtacgaaccgctacaactccaaaacgacgaacgccaacgctctcgaatccccaaacccctccgtactcatcccgaaccgctccgtccctaaaaaaaaaccgccccgtacccgaaaccgcgacttctcccacgcgaaacaaaccgaaactataaaaaaacaacccgcctacgaactaaaccgaaaatttaaaaaaacgactctaccgaaaacaaaaccgaaaacgtaaaaaacgattctaccgaattcgaaacgcgcgaaacaaattacgtaaaaaaacgaaaaatcccactcgccctcgacttctccctacccgaccgcacgatatcccgcccgacgcctccccgcgcaacccgacccgacccgaacgataacccaacccgaaaacccgcgacgcct

SEQ ID NO: 2319 - DNA, 581 bp, Artificial Sequence
  chemically treated genomic DNA (Homo sapiens) CpG-island No: 2319
ggggttggaggttggggcggttttgaggacgcgtgcggggtaggttacgtttgggtttggttgttttaggagttattttgtacggcgtcgggcgaggttgtgcgcgttttttcggattttttattttggggttttgcggtgtagcggcgcgttttatttttttacgtgtttagtttcgaattacgtacgggtcgttgtagttttaggacggcggacgttagcgttttcggatttttaggttttttcgtgtttatttcggatcgtttcgtttttgaggaaaaatcgtttcgtgttcggaatcgcggttttttttacgcggggtaggtcggggttgtgagggggtagttcgtttgcggattaggtcgggggtttgaggaggcggttttgtcggggataaagtcgggggcgtgaggggcggttttgtcgggttcggggcgcgcggggtaagttgcgtgaagaggcggaaagttttattcgttttcggtttttttttgttcggtcgtacggtgtttcgttcggcgttttttcgcgtagttcggttcgattcgggcgatggtttagttcggggattcgcggcgttt

SEQ ID NO: 2320 - DNA, 581 bp, Artificial Sequence
  chemically treated genomic DNA (Homo sapiens) CpG-island No: 2320
aaacgccgcgaatccccgaactaaaccatcgcccgaatcgaaccgaactacgcgaaaaaacgccgaacgaaacaccgtacgaccgaacaaaaaaaaaccgaaaacgaataaaactttccgcctcttcacgcaacttaccccgcgcgccccgaacccgacaaaaccgcccctcacgcccccgactttatccccgacaaaaccgcctcctcaaacccccgacctaatccgcaaacgaactaccccctcacaaccccgacctaccccgcgtaaaaaaaaccgcgattccgaacacgaaacgatttttcctcaaaaacgaaacgatccgaaataaacacgaaaaaacctaaaaatccgaaaacgctaacgtccgccgtcctaaaactacaacgacccgtacgtaattcgaaactaaacacgtaaaaaaataaaacgcgccgctacaccgcaaaaccccaaaataaaaaatccgaaaaaacgcgcacaacctcgcccgacgccgtacaaaataactcctaaaacaaccaaacccaaacgtaacctaccccgcacgcgtcctcaaaaccgccccaacctccaacccc

SEQ ID NO: 2321 - DNA, 831 bp, Artificial Sequence
  chemically treated genomic DNA (Homo sapiens) CpG-island No: 2321
tcgttttcgtttttcgatcgtcgttgtttcgcggggattcggggagttcgaaggaattttgggaaagtttttcgtttcgtttcggttcgagcggaagcgcggatggggcgtggttcggtagttgtggtcgcgtttttatcgattgcgtatttcgattggcgttagtggtcgttcgttagtacgtttttttcggtttcgcgtttcgattggtcgcgggggtcgttagttcggtttcggcggcgggcgtttttcggggttgcggcggggcggagttcgcggaggaagtcggcgggcgtttcgggttttaggtttcggttagaggaggagttcgttgtcgggggacgttgggttgagcggtcggcggcgcgggttcggcggcggcggtagcggggttcgggttcggagcgttatagtgcgtgaggtcgtagacgtggtagggagtgtgggaggggtttcgtcgtgtggaaaatttaattttcggggttttgcgcggggggttcgggttcggggtggggtagcgggggtttcgggggcgcgaggttgggttcgggtaagcgcgggcgtgggggttcggtcgttcgggtcgtgggtaggtggagggcgcggcgggggtgcgcgggggaggttagggcgtttattgaattcggtcgggagcggttttcgcgttgtttttcgaggttaggaaggcgtagcgtgtgggttttcggggttgaaggggtaagcgcggggacgtggtttcggttgttaggaggttaggttttttcgtttattttgacgttttgattttgggtaagttatttttcgttgttttttgtttttgtgttatcggta

SEQ ID NO: 2322 - DNA, 831 bp, Artificial Sequence
  chemically treated genomic DNA (Homo sapiens) CpG-island No: 2322
taccgataacacaaaaacaaaaaacaacgaaaaataacttacccaaaatcaaaacgtcaaaataaacgaaaaaacctaacctcctaacaaccgaaaccacgtccccgcgcttaccccttcaaccccgaaaacccacacgctacgccttcctaacctcgaaaaacaacgcgaaaaccgctcccgaccgaattcaataaacgccctaacctcccccgcgcacccccgccgcgccctccacctacccacgacccgaacgaccgaacccccacgcccgcgcttacccgaacccaacctcgcgcccccgaaacccccgctaccccaccccgaacccgaaccccccgcgcaaaaccccgaaaattaaattttccacacgacgaaacccctcccacactccctaccacgtctacgacctcacgcactataacgctccgaacccgaaccccgctaccgccgccgccgaacccgcgccgccgaccgctcaacccaacgtcccccgacaacgaactcctcctctaaccgaaacctaaaacccgaaacgcccgccgacttcctccgcgaactccgccccgccgcaaccccgaaaaacgcccgccgccgaaaccgaactaacgacccccgcgaccaatcgaaacgcgaaaccgaaaaaaacgtactaacgaacgaccactaacgccaatcgaaatacgcaatcgataaaaacgcgaccacaactaccgaaccacgccccatccgcgcttccgctcgaaccgaaacgaaacgaaaaactttcccaaaattccttcgaactccccgaatccccgcgaaacaacgacgatcgaaaaacgaaaacga

SEQ ID NO: 2323 - DNA, 831 bp, Artificial Sequence
  chemically treated genomic DNA (Homo sapiens) CpG-island No: 2323
tatcgatgatataggggtagagggtagcgaaaaatgatttgtttaaggttaaaacgttagagtagacgggaaagtttggttttttagtagtcgaggttacgttttcgcgtttgtttttttagtttcgaggatttatacgttgcgtttttttggtttcggggggtagcgcgggggtcgttttcgatcgagtttagtgagcgttttggtttttttcgcgtattttcgtcgcgttttttatttgtttacggttcggacggtcgagtttttacgttcgcgtttgttcgagtttagtttcgcgttttcggggttttcgttgttttatttcgggttcggatttttcgcgtaggatttcggaggttaagttttttatacggcggagttttttttatattttttgttacgtttgcggttttacgtattgtggcgtttcggattcggatttcgttgtcgtcgtcgtcgggttcgcgtcgtcggtcgtttagtttagcgtttttcggtagcgagttttttttttggtcgggatttggagttcgagacgttcgtcgatttttttcgcgagtttcgtttcgtcgtagtttcgggaagcgttcgtcgtcggagtcggattgacggttttcgcgattaatcgggacgcgagatcggagggggcgtgttgacggacggttattaacgttaatcgaaatgcgtaatcggtgggggcgcggttatagttatcgggttacgttttattcgcgttttcgttcgggtcggggcggagcgggaaatttttttagagttttttcgagtttttcgagttttcgcggagtagcggcggtcgaggggcggggacgg

SEQ ID NO: 2324 - DNA, 831 bp, Artificial Sequence
  chemically treated genomic DNA (Homo sapiens) CpG-island No: 2324
ccgtccccgcccctcgaccgccgctactccgcgaaaactcgaaaaactcgaaaaaactctaaaaaaatttcccgctccgccccgacccgaacgaaaacgcgaataaaacgtaacccgataactataaccgcgcccccaccgattacgcatttcgattaacgttaataaccgtccgtcaacacgccccctccgatctcgcgtcccgattaatcgcgaaaaccgtcaatccgactccgacgacgaacgcttcccgaaactacgacgaaacgaaactcgcgaaaaaaatcgacgaacgtctcgaactccaaatcccgaccaaaaaaaaaactcgctaccgaaaaacgctaaactaaacgaccgacgacgcgaacccgacgacgacgacaacgaaatccgaatccgaaacgccacaatacgtaaaaccgcaaacgtaacaaaaaatataaaaaaaactccgccgtataaaaaacttaacctccgaaatcctacgcgaaaaatccgaacccgaaataaaacaacgaaaaccccgaaaacgcgaaactaaactcgaacaaacgcgaacgtaaaaactcgaccgtccgaaccgtaaacaaataaaaaacgcgacgaaaatacgcgaaaaaaaccaaaacgctcactaaactcgatcgaaaacgacccccgcgctaccccccgaaaccaaaaaaacgcaacgtataaatcctcgaaactaaaaaaacaaacgcgaaaacgtaacctcgactactaaaaaaccaaactttcccgtctactctaacgttttaaccttaaacaaatcatttttcgctaccctctacccctatatcatcgata

SEQ ID NO: 2325 - DNA, 629 bp, Artificial Sequence
  chemically treated genomic DNA (Homo sapiens) CpG-island No: 2325
tggtgcgaaagtcgtagaatagaagtgtggacgatttgtagaggatgggacgtcgattgtgagagagggtggagatgcgtggttgagagaagaggttgcggagaggggtcggagcgttagagtcgtggtgcgcggtggagaaggagttgagtgtagaggtagagacgggtgggagagattgttgagggcgagggagacgtgttttggcgtgtcgcggagtggtgaggaggtaggggtataaaaaggatgtttgtagaagaggcgtttgtgaaagatagagggatgtggggtgagagcgatgggagggatgtgggggggatggtggaagagttgttatgtggtaagttgtgggaggatatggttgggcgtaggcgcggggatgggagtagttagtagttggtgttgagcgggatgaagagagggaggagatgagggtgaagtggtagcggcgagagtgtttggtgggggagcggaggagtgcgagtgggcggcggaggagaggaggatgaaggggaaggggatcgagagaggattggtggagtagagaggacgagagatacgaagagaggatggcgaggagtggatagggagggaagagacgagggcgtaggggagaggagcgagttagg

SEQ ID NO: 2326 - DNA, 629 bp, Artificial Sequence
  chemically treated genomic DNA (Homo sapiens) CpG-island No: 2326
cctaactcgctcctctcccctacgccctcgtctcttccctccctatccactcctcgccatcctctcttcgtatctctcgtcctctctactccaccaatcctctctcgatccccttccccttcatcctcctctcctccgccgcccactcgcactcctccgctcccccaccaaacactctcgccgctaccacttcaccctcatctcctccctctcttcatcccgctcaacaccaactactaactactcccatccccgcgcctacgcccaaccatatcctcccacaacttaccacataacaactcttccaccatcccccccacatccctcccatcgctctcaccccacatccctctatctttcacaaacgcctcttctacaaacatcctttttatacccctacctcctcaccactccgcgacacgccaaaacacgtctccctcgccctcaacaatctctcccacccgtctctacctctacactcaactccttctccaccgcgcaccacgactctaacgctccgacccctctccgcaacctcttctctcaaccacgcatctccaccctctctcacaatcgacgtcccatcctctacaaatcgtccacacttctattctacgactttcgcacca

SEQ ID NO: 2327 - DNA, 629 bp, Artificial Sequence
  chemically treated genomic DNA (Homo sapiens) CpG-island No: 2327
tttagttcgttttttttttttgcgttttcgttttttttttttttatttatttttcgttatttttttttcgtgtttttcgttttttttattttattagttttttttcgattttttttttttttatttttttttttttcgtcgtttattcgtattttttcgtttttttattaggtattttcgtcgttgttattttatttttattttttttttttttttatttcgtttaatattagttattgattgtttttattttcgcgtttacgtttagttatgtttttttataatttattatataataatttttttattattttttttatattttttttatcgtttttattttatatttttttgttttttataaacgttttttttataaatattttttttgtatttttatttttttattatttcgcggtacgttaaaatacgtttttttcgtttttaatagttttttttattcgtttttgtttttatatttagttttttttttatcgcgtattacgattttaacgtttcgattttttttcgtagtttttttttttaattacgtatttttatttttttttataatcggcgttttattttttataagtcgtttatatttttgttttgcggttttcgtatta

SEQ ID NO: 2328 - DNA, 629 bp, Artificial Sequence
  chemically treated genomic DNA (Homo sapiens) CpG-island No: 2328
taatacgaaaaccgcaaaacaaaaatataaacgacttataaaaaataaaacgccgattataaaaaaaaataaaaatacgtaattaaaaaaaaaaactacgaaaaaaaatcgaaacgttaaaatcgtaatacgcgataaaaaaaaaactaaatataaaaacaaaaacgaataaaaaaaactattaaaaacgaaaaaaacgtattttaacgtaccgcgaaataataaaaaaataaaaatacaaaaaaaatatttataaaaaaaacgtttataaaaaacaaaaaaatataaaataaaaacgataaaaaaaatataaaaaaaataataaaaaaattattatataataaattataaaaaaacataactaaacgtaaacgcgaaaataaaaacaatcaataactaatattaaacgaaataaaaaaaaaaaaaaaataaaaataaaataacaacgacgaaaatacctaataaaaaaacgaaaaaatacgaataaacgacgaaaaaaaaaaaaataaaaaaaaaaaaaatcgaaaaaaaactaataaaataaaaaaaacgaaaaacacgaaaaaaaaataacgaaaaataaataaaaaaaaaaaaaacgaaaacgcaaaaaaaaaaaacgaactaaa

SEQ ID NO: 2329 - DNA, 515 bp, Artificial Sequence
  chemically treated genomic DNA (Homo sapiens) CpG-island No: 2329
cgtatagcgacggtcggcgttaggtcgtcgaggatatatacgggttaggtttaggtttcgtcgttttttcgttttcgttattatttttcgttcggtttttttggttttagcgtcgtcggtttcggggtttacgttcgggggtttcggttcgagtttttattcggttcgcgtgaattttgggtcgtatagttttcgttcgtttaggtgttggttcgggtagttagcgtttagtttcgtagattcggtgattttcgtttattagaggttaaagtttgggaacgagagtaagcgatgatttgaagaggcgtaggaagttagggtagtgcggaggtggcgcgtatgtgtaagtacgtacgcgcgaatacgtacgtagggagaggtgtatacgcgtaggagtgtatcggaagttcgtttttcgggatatttattatcggttttaggataagtaacggattttattttttatgagtttatgcgttttttaagtttaggggtcgttttaaatgtttttattt

SEQ ID NO: 2330 - DNA, 515 bp, Artificial Sequence
  chemically treated genomic DNA (Homo sapiens) CpG-island No: 2330
aaataaaaacatttaaaacgacccctaaacttaaaaaacgcataaactcataaaaaataaaatccgttacttatcctaaaaccgataataaatatcccgaaaaacgaacttccgatacactcctacgcgtatacacctctccctacgtacgtattcgcgcgtacgtacttacacatacgcgccacctccgcactaccctaacttcctacgcctcttcaaatcatcgcttactctcgttcccaaactttaacctctaataaacgaaaatcaccgaatctacgaaactaaacgctaactacccgaaccaacacctaaacgaacgaaaactatacgacccaaaattcacgcgaaccgaataaaaactcgaaccgaaacccccgaacgtaaaccccgaaaccgacgacgctaaaaccaaaaaaaccgaacgaaaaataataacgaaaacgaaaaaacgacgaaacctaaacctaacccgtatatatcctcgacgacctaacgccgaccgtcgctatacg

SEQ ID NO: 2331 - DNA, 515 bp, Artificial Sequence
  chemically treated genomic DNA (Homo sapiens) CpG-island No: 2331
gggtagagatatttaagacggtttttaaatttggggagcgtataggtttatgggaaatagagttcgttatttgttttgggatcggtggtgggtgtttcgggaggcggattttcggtgtatttttgcgcgtgtgtatttttttttgcgtgcgtgttcgcgcgtgcgtgtttgtatatgcgcgttattttcgtattgttttggttttttgcgtttttttaggttatcgtttgttttcgtttttaggttttggtttttagtggacgagaattatcgagtttgcggggttggacgttgattgttcgggttagtatttaggcgggcgggagttgtgcggtttagggtttacgcgggtcgggtagaggttcgagtcgggattttcgagcgtgaatttcggagtcggcggcgttggggttagaggggtcgggcgggaggtggtggcggaggcgaaggggcgacgggatttgggtttggttcgtgtgtgttttcggcggtttggcgtcggtcgtcgttgtacg

SEQ ID NO: 2332 - DNA, 515 bp, Artificial Sequence
  chemically treated genomic DNA (Homo sapiens) CpG-island No: 2332
cgtacaacgacgaccgacgccaaaccgccgaaaacacacacgaaccaaacccaaatcccgtcgccccttcgcctccgccaccacctcccgcccgacccctctaaccccaacgccgccgactccgaaattcacgctcgaaaatcccgactcgaacctctacccgacccgcgtaaaccctaaaccgcacaactcccgcccgcctaaatactaacccgaacaatcaacgtccaaccccgcaaactcgataattctcgtccactaaaaaccaaaacctaaaaacgaaaacaaacgataacctaaaaaaacgcaaaaaaccaaaacaatacgaaaataacgcgcatatacaaacacgcacgcgcgaacacgcacgcaaaaaaaaatacacacgcgcaaaaatacaccgaaaatccgcctcccgaaacacccaccaccgatcccaaaacaaataacgaactctatttcccataaacctatacgctccccaaatttaaaaaccgtcttaaatatctctaccc

SEQ ID NO: 2333 - DNA, 785 bp, Artificial Sequence
  chemically treated genomic DNA (Homo sapiens) CpG-island No: 2333
gagtaggcgtatttttgttattgagtcgagttttcggagttcgcgtcgcgtcgtcggttattatgaagcgtagcgttttttcgcgttgaatgtttattagttttattttggtagttagcgttcgcgatagtttaggcgtcgcgtttatttgtcgcggggttcggcggtgcgcggggtagttgtcgcgtcgggttcgggcgaggcgcgtcggtgttatatgtcgcgtacgtcgtttattacgtataggtttatgttgcgtagcgagaagtttttgcgaacgcgggttttggtggtcgcgtgcgtggatacgtttttcgagtttcgcgagtggtcgtaggcgtcgttttgagtgtagaggtgttcgcgagtttcggttttatggtttttgcgtttacggtcgcgtttcgagtcgtcggtttagttattagtacgcggcgtattttttcgtcgaagacgtttaggaagttggcggcgaagtggcgggagaaggaggcgtcggcgtcgggcgtgtcgtaagttgggttgtttcgtaggaaacggtagaatttgtgcgtaaagtttacggcggtcgtttgcgtatgtagttcgtagaattgtcgttagttcgggatcgggatcgggattgggatcggggcggttgcggcggggttagggtcggtattatttatggttttcgttttatcgtagttatttgcggtttcgggcgagaagagcgcgtagtgatttttaggtttgtgattaatgcgtttatttgttttttttttttagtttttttaggatttttt

SEQ ID NO: 2334 - DNA, 785 bp, Artificial Sequence
  chemically treated genomic DNA (Homo sapiens) CpG-island No: 2334
aaaaaatcctaaaaaaactaaaaaaaaaaaacaaataaacgcattaatcacaaacctaaaaatcactacgcgctcttctcgcccgaaaccgcaaataactacgataaaacgaaaaccataaataataccgaccctaaccccgccgcaaccgccccgatcccaatcccgatcccgatcccgaactaacgacaattctacgaactacatacgcaaacgaccgccgtaaactttacgcacaaattctaccgtttcctacgaaacaacccaacttacgacacgcccgacgccgacgcctccttctcccgccacttcgccgccaacttcctaaacgtcttcgacgaaaaaatacgccgcgtactaataactaaaccgacgactcgaaacgcgaccgtaaacgcaaaaaccataaaaccgaaactcgcgaacacctctacactcaaaacgacgcctacgaccactcgcgaaactcgaaaaacgtatccacgcacgcgaccaccaaaacccgcgttcgcaaaaacttctcgctacgcaacataaacctatacgtaataaacgacgtacgcgacatataacaccgacgcgcctcgcccgaacccgacgcgacaactaccccgcgcaccgccgaaccccgcgacaaataaacgcgacgcctaaactatcgcgaacgctaactaccaaaataaaactaataaacattcaacgcgaaaaaacgctacgcttcataataaccgacgacgcgacgcgaactccgaaaactcgactcaataacaaaaatacgcctactc

SEQ ID NO: 2335 - DNA, 785 bp, Artificial Sequence
  chemically treated genomic DNA (Homo sapiens) CpG-island No: 2335
agagagttttaggggagttggaaggaggggataggtgggcgtattgattataggtttgaaagttattgcgcgtttttttcgttcgaagtcgtaggtggttgcgatgggacggaagttatgaatggtgtcggttttggtttcgtcgtagtcgtttcggttttagtttcggtttcggtttcggattggcggtagttttgcgagttgtatgcgtaggcggtcgtcgtggattttgcgtataagttttgtcgttttttgcgggataatttagtttacgatacgttcgacgtcggcgtttttttttttcgttatttcgtcgttaattttttggacgttttcggcgaggaggtgcgtcgcgtgttggtggttgggtcgacgattcggggcgcggtcgtgagcgtagaggttatggagtcggagttcgcggatatttttgtatttaaggcggcgtttacggttattcgcggagttcggaggacgtgtttacgtacgcggttattaaggttcgcgttcgtaagggtttttcgttgcgtaatatgagtttgtgcgtggtggacggcgtgcgcgatatgtggtatcggcgcgtttcgttcgagttcgacgcggtagttgtttcgcgtatcgtcgagtttcgcgataagtggacgcggcgtttgagttgtcgcggacgttggttgttaaggtggagttggtggatatttaacgcgagggggcgttgcgttttatggtggtcgacgacgcggcgcgggtttcgggggttcggtttagtggtagaagtgcgtttgttt

SEQ ID NO: 2336 - DNA, 785 bp, Artificial Sequence
  chemically treated genomic DNA (Homo sapiens) CpG-island No: 2336
aaacaaacgcacttctaccactaaaccgaacccccgaaacccgcgccgcgtcgtcgaccaccataaaacgcaacgccccctcgcgttaaatatccaccaactccaccttaacaaccaacgtccgcgacaactcaaacgccgcgtccacttatcgcgaaactcgacgatacgcgaaacaactaccgcgtcgaactcgaacgaaacgcgccgataccacatatcgcgcacgccgtccaccacgcacaaactcatattacgcaacgaaaaacccttacgaacgcgaaccttaataaccgcgtacgtaaacacgtcctccgaactccgcgaataaccgtaaacgccgccttaaatacaaaaatatccgcgaactccgactccataacctctacgctcacgaccgcgccccgaatcgtcgacccaaccaccaacacgcgacgcacctcctcgccgaaaacgtccaaaaaattaacgacgaaataacgaaaaaaaaaaacgccgacgtcgaacgtatcgtaaactaaattatcccgcaaaaaacgacaaaacttatacgcaaaatccacgacgaccgcctacgcatacaactcgcaaaactaccgccaatccgaaaccgaaaccgaaactaaaaccgaaacgactacgacgaaaccaaaaccgacaccattcataacttccgtcccatcgcaaccacctacgacttcgaacgaaaaaaacgcgcaataactttcaaacctataatcaatacgcccacctatcccctccttccaactcccctaaaactctct

SEQ ID NO: 2337 - DNA, 1129 bp, Artificial Sequence
  chemically treated genomic DNA (Homo sapiens) CpG-island No: 2337
gcggtttttcgtttcgttcgggatggggatcggggagtagattttagtcgggggcgttttttttttttcgcgcgttttttttttttttattcgcgtatataaagacgatacgcgcggattaaggcgcgtgcggtcgttttttttcgggtagcggtgcgtatatagcgtacgttttcggggatagataggggtttcgggggaaggattagggagcgaggaattgggtataaggaggttatatttataggcgcgtagttgcggtcgagcgggttggggcgtcggttgagcgttgttcggatcgcggtcgggtttttcgggttcggtggtttatggttcgcggcggattgggttttttttttcgtttatcgtttcgaaggtttttgcgttttcgcggtttcggcgcgtttttcgcgcggttttttggtagtcgagtcgcgcgttttaagtttagtttaagtaaggtttttcgtcggagacgcgcgtttcgtttcgtttcgttttcgttttcgtcgcgagtttcgattcgttttttttcgcgcgttttgtttcgttttttttcgtttttatttcgcgtttagttttttttcggttattcgcggagttcgagcggcgcggtggtcggtgtttgttggtttttcgtagttgcggtgtcgagattgttcggttttggggttcggagagaggggttaggagtcggtttcgagtcgttttatttgggcgggggtttttatgtcgtcgagtcggtttaggttaggcgcgggatttttattttttttcgtggaggttatttttcgagttcgcggtggtggtggtttcgggagcgcggagcgtggggtcgggggaatgttttgcgtggcgggtgtatgggacgcggacgttttcgaagcgtttttcgttgacgggtgtttcgcgggagtcgtcgttgtggttagatttttcgtagtagggataatgggagtttggaggaggtttggatgtcgtaacggaggaagtcgacgtttggtttttataaatttcgagggcgttattacgtttttttttgtagtttttcggtgcgggaaatcgttttcgggttatagggcgggacggttttttgagcgtagtgtttttattatttagttttcgttgt

SEQ ID NO: 2338 - DNA, 1129 bp, Artificial Sequence
  chemically treated genomic DNA (Homo sapiens) CpG-island No: 2338
acaacgaaaactaaataataaaaacactacgctcaaaaaaccgtcccgccctataacccgaaaacgatttcccgcaccgaaaaactacaaaaaaaaacgtaataacgccctcgaaatttataaaaaccaaacgtcgacttcctccgttacgacatccaaacctcctccaaactcccattatccctactacgaaaaatctaaccacaacgacgactcccgcgaaacacccgtcaacgaaaaacgcttcgaaaacgtccgcgtcccatacacccgccacgcaaaacattcccccgaccccacgctccgcgctcccgaaaccaccaccaccgcgaactcgaaaaataacctccacgaaaaaaaataaaaatcccgcgcctaacctaaaccgactcgacgacataaaaacccccgcccaaataaaacgactcgaaaccgactcctaacccctctctccgaaccccaaaaccgaacaatctcgacaccgcaactacgaaaaaccaacaaacaccgaccaccgcgccgctcgaactccgcgaataaccgaaaaaaaactaaacgcgaaataaaaacgaaaaaaaacgaaacaaaacgcgcgaaaaaaaacgaatcgaaactcgcgacgaaaacgaaaacgaaacgaaacgaaacgcgcgtctccgacgaaaaaccttacttaaactaaacttaaaacgcgcgactcgactaccaaaaaaccgcgcgaaaaacgcgccgaaaccgcgaaaacgcaaaaaccttcgaaacgataaacgaaaaaaaaaacccaatccgccgcgaaccataaaccaccgaacccgaaaaacccgaccgcgatccgaacaacgctcaaccgacgccccaacccgctcgaccgcaactacgcgcctataaatataacctccttatacccaattcctcgctccctaatccttcccccgaaacccctatctatccccgaaaacgtacgctatatacgcaccgctacccgaaaaaaaacgaccgcacgcgccttaatccgcgcgtatcgtctttatatacgcgaataaaaaaaaaaaaaacgcgcgaaaaaaaaaaaacgcccccgactaaaatctactccccgatccccatcccgaacgaaacgaaaaaccgc

SEQ ID NO: 2339 - DNA, 1129 bp, Artificial Sequence
  chemically treated genomic DNA (Homo sapiens) CpG-island No: 2339
atagcgaaggttgggtggtgggggtattgcgtttagggggtcgtttcgttttgtggttcgggggcgatttttcgtatcggagggttgtagggaggggcgtggtggcgttttcgagatttatgagaattaggcgtcgatttttttcgttgcgatatttaggttttttttaggtttttattgtttttgttgcggagagtttggttatagcggcggttttcgcgaagtattcgttagcgaggggcgtttcgagggcgttcgcgttttatatattcgttacgtaggatattttttcggttttacgtttcgcgttttcggggttattattatcgcgggttcgaggggtggtttttacgaggaggagtgggagtttcgcgtttggtttgggtcggttcggcgatatggggattttcgtttagatggggcgattcggagtcggtttttaattttttttttcgggttttaggatcgggtagtttcggtatcgtagttgcggggagttagtaagtatcggttatcgcgtcgttcgggtttcgcggatggtcgggggggggttgagcgcgaagtgggggcgggagggggcggggtaggacgcgcgagggggggcgggtcggggttcgcggcgggggcgggggcggggcggggcgggacgcgcgttttcggcggggggttttgtttgggttgggtttggagcgcgcgattcggttgttagagagtcgcgcgggggacgcgtcgggatcgcgagagcgtaggagttttcgaggcggtgaacgagggagggagtttagttcgtcgcgggttatgagttatcgggttcggggagttcggtcgcggttcgggtagcgtttagtcggcgttttagttcgttcggtcgtagttgcgcgtttgtaggtatggtttttttatatttagtttttcgttttttggtttttttttcgggatttttgtttgttttcggggacgtgcgttgtgtgcgtatcgttgttcgaaggagagcggtcgtacgcgttttggttcgcgcgtgtcgtttttgtgtgcgcgggtgggagggaggagggcgcgcgagggaggggaggcgttttcggttgggatttgtttttcgatttttatttcgggcggggcggggagtcgt

SEQ ID NO: 2340 - DNA, 1129 bp, Artificial Sequence
  chemically treated genomic DNA (Homo sapiens) CpG-island No: 2340
acgactccccgccccgcccgaaataaaaatcgaaaaacaaatcccaaccgaaaacgcctcccctccctcgcgcgccctcctccctcccacccgcgcacacaaaaacgacacgcgcgaaccaaaacgcgtacgaccgctctccttcgaacaacgatacgcacacaacgcacgtccccgaaaacaaacaaaaatcccgaaaaaaaaaccaaaaaacgaaaaactaaatataaaaaaaccatacctacaaacgcgcaactacgaccgaacgaactaaaacgccgactaaacgctacccgaaccgcgaccgaactccccgaacccgataactcataacccgcgacgaactaaactccctccctcgttcaccgcctcgaaaactcctacgctctcgcgatcccgacgcgtcccccgcgcgactctctaacaaccgaatcgcgcgctccaaacccaacccaaacaaaaccccccgccgaaaacgcgcgtcccgccccgccccgcccccgcccccgccgcgaaccccgacccgccccccctcgcgcgtcctaccccgccccctcccgcccccacttcgcgctcaacccccccccgaccatccgcgaaacccgaacgacgcgataaccgatacttactaactccccgcaactacgataccgaaactacccgatcctaaaacccgaaaaaaaaaattaaaaaccgactccgaatcgccccatctaaacgaaaatccccatatcgccgaaccgacccaaaccaaacgcgaaactcccactcctcctcgtaaaaaccacccctcgaacccgcgataataataaccccgaaaacgcgaaacgtaaaaccgaaaaaatatcctacgtaacgaatatataaaacgcgaacgccctcgaaacgcccctcgctaacgaatacttcgcgaaaaccgccgctataaccaaactctccgcaacaaaaacaataaaaacctaaaaaaaacctaaatatcgcaacgaaaaaaatcgacgcctaattctcataaatctcgaaaacgccaccacgcccctccctacaaccctccgatacgaaaaatcgcccccgaaccacaaaacgaaacgaccccctaaacgcaatacccccaccacccaaccttcgctat

SEQ ID NO: 2341 - DNA, 982 bp, Artificial Sequence
  chemically treated genomic DNA (Homo sapiens) CpG-island No: 2341
tgcgtaaagcggtttaggggtttaggtcgcgggttgggtttgggtcgcggggttggtggaggtcgtaggtcgcgcgggtcgtagagtgggtttgggtcgcggttttggatttgggtttcgggtcggtgtaggtcgcggatcgtggagggggtttgggttgcgggtttaggttcggttcggggtcggtgtaggtcgcggttaagtttaggttacggtgttcgtagcgtttgtttcgttcgatttcgtttaggtttttgcggtttagtttggttgttcgttttagggtcgcggttttttagaatttttattcgataggtttttttcggttggcggttttttttaggcggtggatgatgttgtttaagttcgcggttttttttttgcgtagggggttgtcgcgcgagtttcgggcgttcgcggtttcggggaggtcgaaaaggttttgtagcgagttgggtttgcggggggcgttgttgttgttgttgttgttgggcggcggcgcggagttcggggttcggggttttttttcggcgcggcggcggttgaggtagcggcgttttcgggggtcgcgggcgcggcggtggcggtcgcggaggcggggttgggtaggggtcgggttttttacggggtttttttcgtggtcgtcgtcgcgggcgtcgttcgggttcggggttttcgagggcggcggtttcgtttgtttcgtcggtcgcggtattttttttcgttcggtttttttttgagatttgggtttttcggtgtcggcgttgtttgggtttttagtggtttttacgtcgtcgtagttgtcgtttttcgagttgggcgtcgttcggtcgttgcgggtcgagggtgagtcgttggcgttcgtttggttttgattttcggtttgaatttttttaatgaatagttttttgcggattcgagatttataagataataagcggcggggacgtgaggggggtgttgttggggaaagggtttttgg

SEQ ID NO: 2342 - DNA, 982 bp, Artificial Sequence
  chemically treated genomic DNA (Homo sapiens) CpG-island No: 2342
ccaaaaaccctttccccaacaacacccccctcacgtccccgccgcttattatcttataaatctcgaatccgcaaaaaactattcattaaaaaaattcaaaccgaaaatcaaaaccaaacgaacgccaacgactcaccctcgacccgcaacgaccgaacgacgcccaactcgaaaaacgacaactacgacgacgtaaaaaccactaaaaacccaaacaacgccgacaccgaaaaacccaaatctcaaaaaaaaaccgaacgaaaaaaaataccgcgaccgacgaaacaaacgaaaccgccgccctcgaaaaccccgaacccgaacgacgcccgcgacgacgaccacgaaaaaaaccccgtaaaaaacccgacccctacccaaccccgcctccgcgaccgccaccgccgcgcccgcgacccccgaaaacgccgctacctcaaccgccgccgcgccgaaaaaaaaccccgaaccccgaactccgcgccgccgcccaacaacaacaacaacaacaacgccccccgcaaacccaactcgctacaaaaccttttcgacctccccgaaaccgcgaacgcccgaaactcgcgcgacaaccccctacgcaaaaaaaaaaccgcgaacttaaacaacatcatccaccgcctaaaaaaaaccgccaaccgaaaaaaacctatcgaataaaaattctaaaaaaccgcgaccctaaaacgaacaaccaaactaaaccgcaaaaacctaaacgaaatcgaacgaaacaaacgctacgaacaccgtaacctaaacttaaccgcgacctacaccgaccccgaaccgaacctaaacccgcaacccaaaccccctccacgatccgcgacctacaccgacccgaaacccaaatccaaaaccgcgacccaaacccactctacgacccgcgcgacctacgacctccaccaaccccgcgacccaaacccaacccgcgacctaaacccctaaaccgctttacgca

SEQ ID NO: 2343 - DNA, 982 bp, Artificial Sequence
  chemically treated genomic DNA (Homo sapiens) CpG-island No: 2343
ttagaggttttttttttagtagtattttttttacgttttcgtcgtttgttgttttgtaggtttcggattcgtagagaattgtttattgaggaaatttaggtcgggagttagggttaggcgggcgttagcgatttattttcggttcgtagcggtcgggcggcgtttagttcggagggcgatagttgcgacggcgtggaggttattgagggtttaggtagcgtcgatatcgaggagtttaagttttagggagaggtcgagcgggaggaggtgtcgcggtcggcggagtagacggagtcgtcgttttcggggatttcgggttcggacgacgttcgcgacgacgattacgagggaggtttcgtggaaggttcggtttttgtttagtttcgttttcgcgatcgttatcgtcgcgttcgcggttttcgaggacgtcgttattttagtcgtcgtcgcgtcgggggagggtttcgggtttcgagtttcgcgtcgtcgtttagtaatagtagtagtagtagcgtttttcgtaggtttagttcgttgtagagttttttcggttttttcgaggtcgcgggcgttcgggattcgcgcgataattttttgcgtaagaagaaggtcgcgaatttgaatagtattatttatcgtttggagaaggtcgttagtcgggaggaatttatcgaatgggagttttgaggggtcgcggttttggggcgggtagttaggttgggtcgtaagggtttggacggggtcggacggggtaggcgttgcggatatcgtggtttgggtttggtcgcggtttgtatcgatttcgggtcggatttgagttcgtagtttagattttttttacggttcgcggtttgtatcgattcgaggtttagatttaaggtcgcggtttagatttattttgcggttcgcgcgatttgcggtttttattaatttcgcggtttagatttagttcgcggtttggatttttggatcgttttgcgta

SEQ ID NO: 2344 - DNA, 982 bp, Artificial Sequence
  chemically treated genomic DNA (Homo sapiens) CpG-island No: 2344
tacgcaaaacgatccaaaaatccaaaccgcgaactaaatctaaaccgcgaaattaataaaaaccgcaaatcgcgcgaaccgcaaaataaatctaaaccgcgaccttaaatctaaacctcgaatcgatacaaaccgcgaaccgtaaaaaaaatctaaactacgaactcaaatccgacccgaaatcgatacaaaccgcgaccaaacccaaaccacgatatccgcaacgcctaccccgtccgaccccgtccaaacccttacgacccaacctaactacccgccccaaaaccgcgacccctcaaaactcccattcgataaattcctcccgactaacgaccttctccaaacgataaataatactattcaaattcgcgaccttcttcttacgcaaaaaattatcgcgcgaatcccgaacgcccgcgacctcgaaaaaaccgaaaaaactctacaacgaactaaacctacgaaaaacgctactactactactattactaaacgacgacgcgaaactcgaaacccgaaaccctcccccgacgcgacgacgactaaaataacgacgtcctcgaaaaccgcgaacgcgacgataacgatcgcgaaaacgaaactaaacaaaaaccgaaccttccacgaaacctccctcgtaatcgtcgtcgcgaacgtcgtccgaacccgaaatccccgaaaacgacgactccgtctactccgccgaccgcgacacctcctcccgctcgacctctccctaaaacttaaactcctcgatatcgacgctacctaaaccctcaataacctccacgccgtcgcaactatcgccctccgaactaaacgccgcccgaccgctacgaaccgaaaataaatcgctaacgcccgcctaaccctaactcccgacctaaatttcctcaataaacaattctctacgaatccgaaacctacaaaacaacaaacgacgaaaacgtaaaaaaaatactactaaaaaaaaaacctctaa

SEQ ID NO: 2345 - DNA, 535 bp, Artificial Sequence
  chemically treated genomic DNA (Homo sapiens) CpG-island No: 2345
tttcgtagttttgtaattttaatcgttaggcgattcgtttttcgaaacgtattaagggtcgagttttgtttttcgagatgttttatttttaggtttcgtttttcgagatattttattttcgggttttgtttttcgagacgttttaataatttagtttcgtttttcgagacgcgttaattttagattttgtttttcgaggcgttttaataattaggttcggcgggtggagatgttttaattttaggtttcgtttttcgagcgttataatagtcgggttttattttttgaggtgttttaacggttaggtttcgttttgaaggcgttgtaataattaggtttcgtttttaggcgttttaacggttaggtttagtcgtttgaggttttttaacggttaggtcgcgttttcgcgtgcgtgcgcggttcggtagagtcgtgcgggcgttcgcgtatttattagttgaggtggtagtggttttattaatatggagttttcgtagatgtcggagtttatggggttgtcggtgttgtttgggtt

SEQ ID NO: 2346 - DNA, 535 bp, Artificial Sequence
  chemically treated genomic DNA (Homo sapiens) CpG-island No: 2346
aacccaaacaacaccgacaaccccataaactccgacatctacgaaaactccatattaataaaaccactaccacctcaactaataaatacgcgaacgcccgcacgactctaccgaaccgcgcacgcacgcgaaaacgcgacctaaccgttaaaaaacctcaaacgactaaacctaaccgttaaaacgcctaaaaacgaaacctaattattacaacgccttcaaaacgaaacctaaccgttaaaacacctcaaaaaataaaacccgactattataacgctcgaaaaacgaaacctaaaattaaaacatctccacccgccgaacctaattattaaaacgcctcgaaaaacaaaatctaaaattaacgcgtctcgaaaaacgaaactaaattattaaaacgtctcgaaaaacaaaacccgaaaataaaatatctcgaaaaacgaaacctaaaaataaaacatctcgaaaaacaaaactcgacccttaatacgtttcgaaaaacgaatcgcctaacgattaaaattacaaaactacgaaa

SEQ ID NO: 2347 - DNA, 535 bp, Artificial Sequence
  chemically treated genomic DNA (Homo sapiens) CpG-island No: 2347
agtttaagtaatatcgatagttttatgagtttcgatatttgcgagagttttatgttggtggaattattgttattttagttagtgagtacgcgggcgttcgtacggttttgtcgggtcgcgtacgtacgcgggggcgcggtttggtcgttggggagttttaagcggttgggtttggtcgttagagcgtttgggggcggagtttggttgttataacgtttttagggcggggtttggtcgttaaagtattttaaggggtggggttcggttgttgtggcgttcgaggggcggggtttggagttagagtatttttattcgtcgagtttagttattagagcgtttcgagaggtagagtttggagttagcgcgtttcgaggggcggggttgggttgttagagcgtttcgaggggtagaattcggaggtagagtgtttcgaggggcggggtttggaagtagaatatttcgaggggtagggttcgatttttggtgcgtttcgaggggcgggtcgtttggcggttgagattgtagggttgcggag

SEQ ID NO: 2348 - DNA, 535 bp, Artificial Sequence
  chemically treated genomic DNA (Homo sapiens) CpG-island No: 2348
ctccgcaaccctacaatctcaaccgccaaacgacccgcccctcgaaacgcaccaaaaatcgaaccctacccctcgaaatattctacttccaaaccccgcccctcgaaacactctacctccgaattctacccctcgaaacgctctaacaacccaaccccgcccctcgaaacgcgctaactccaaactctacctctcgaaacgctctaataactaaactcgacgaataaaaatactctaactccaaaccccgcccctcgaacgccacaacaaccgaaccccaccccttaaaatactttaacgaccaaaccccgccctaaaaacgttataacaaccaaactccgcccccaaacgctctaacgaccaaacccaaccgcttaaaactccccaacgaccaaaccgcgcccccgcgtacgtacgcgacccgacaaaaccgtacgaacgcccgcgtactcactaactaaaataacaataattccaccaacataaaactctcgcaaatatcgaaactcataaaactatcgatattacttaaact

SEQ ID NO: 2349 - DNA, 768 bp, Artificial Sequence
  chemically treated genomic DNA (Homo sapiens) CpG-island No: 2349
tataagtacgtgcgtttaattcgtttcgtatttcggttcgggtagggggtttaggggattttcggggtatttaggagggacgtttcgggcggggcgcgtaggcgcgttgaggtcgtgagttttaaggggcgggcgggtgcgcgcgttttttcgcgtacgcgcgtacggagggggcgacggtcgttgtgacgttgcggcggcggcgggcgggcggcggcgcgtgaggcgcgcgattttcggtgttttgggagtagtgtttcggttttcgtcgttttcgtcgtcgttatgtcgggtcggtcggttcgggcggagattcgtagtcgggttaaggacgatattaagaaggtgatggcggttatcgagaaagtgcggaaatggtgaggggtcggagtttagggggttggcgggggtcgcggatttaggttttgaggagcgtgggattggcgggttaggtgggagtcgatcggtcggcgttgggggaggggggtgcgggagaaggcgggaggagggcgtcgttggcgtcggcgtgaggttagagggcgcgtcggtcgcggttaattagcggttttttcggttcgcgggttcgtttatttgttgcggttgttgtcgcgcgtcgtttgggaggggatttcggttttcggttcggattggagttgtttggcgtcggtgttcgcgttcggtttagttcggggttcgtttttttttttttttgggtagtggtttcgtttgcgtttttaggtttttttttgataatagcgagtagttttg

SEQ ID NO: 2350 - DNA, 768 bp, Artificial Sequence
  chemically treated genomic DNA (Homo sapiens) CpG-island No: 2350
caaaactactcgctattatcaaaaaaaaacctaaaaacgcaaacgaaaccactacccaaaaaaaaaaaaaaacgaaccccgaactaaaccgaacgcgaacaccgacgccaaacaactccaatccgaaccgaaaaccgaaatcccctcccaaacgacgcgcgacaacaaccgcaacaaataaacgaacccgcgaaccgaaaaaaccgctaattaaccgcgaccgacgcgccctctaacctcacgccgacgccaacgacgccctcctcccgccttctcccgcacccccctcccccaacgccgaccgatcgactcccacctaacccgccaatcccacgctcctcaaaacctaaatccgcgacccccgccaaccccctaaactccgacccctcaccatttccgcactttctcgataaccgccatcaccttcttaatatcgtccttaacccgactacgaatctccgcccgaaccgaccgacccgacataacgacgacgaaaacgacgaaaaccgaaacactactcccaaaacaccgaaaatcgcgcgcctcacgcgccgccgcccgcccgccgccgccgcaacgtcacaacgaccgtcgccccctccgtacgcgcgtacgcgaaaaaacgcgcgcacccgcccgccccttaaaactcacgacctcaacgcgcctacgcgccccgcccgaaacgtccctcctaaataccccgaaaatcccctaaaccccctacccgaaccgaaatacgaaacgaattaaacgcacgtacttata

SEQ ID NO: 2351 - DNA, 768 bp, Artificial Sequence
  chemically treated genomic DNA (Homo sapiens) CpG-island No: 2351
tagggttattcgttattattaagaggaagtttggaaacgtaggcggggttattgtttaggaagaggggagggcgggtttcgggttgggtcgggcgcgggtatcgacgttaggtagttttagttcgggtcggaagtcggaatttttttttaggcggcgcgcggtagtagtcgtagtaggtgggcgggttcgcgagtcgggaggatcgttgattggtcgcggtcggcgcgttttttgattttacgtcgacgttagcggcgtttttttttcgttttttttcgtattttttttttttagcgtcggtcggtcggtttttatttgattcgttagttttacgttttttagggtttggattcgcgattttcgttagttttttaagtttcggttttttattattttcgtattttttcgatggtcgttattatttttttgatgtcgtttttggttcggttgcgggttttcgttcggatcgatcggttcgatatggcggcggcgggagcggcgggggtcggggtattgtttttaagatatcggggatcgcgcgttttacgcgtcgtcgttcgttcgtcgtcgtcgtagcgttatagcggtcgtcgtttttttcgtgcgcgcgtgcgcgagaaagcgcgcgtattcgttcgttttttggggtttacggttttagcgcgtttgcgcgtttcgttcggggcgttttttttgagtgtttcgggagttttttgagttttttattcgggtcggggtgcgaggcgggttgggcgtacgtgtttgtg

SEQ ID NO: 2352 - DNA, 768 bp, Artificial Sequence
  chemically treated genomic DNA (Homo sapiens) CpG-island No: 2352
cacaaacacgtacgcccaacccgcctcgcaccccgacccgaataaaaaactcaaaaaactcccgaaacactcaaaaaaaacgccccgaacgaaacgcgcaaacgcgctaaaaccgtaaaccccaaaaaacgaacgaatacgcgcgctttctcgcgcacgcgcgcacgaaaaaaacgacgaccgctataacgctacgacgacgacgaacgaacgacgacgcgtaaaacgcgcgatccccgatatcttaaaaacaataccccgacccccgccgctcccgccgccgccatatcgaaccgatcgatccgaacgaaaacccgcaaccgaaccaaaaacgacatcaaaaaaataataacgaccatcgaaaaaatacgaaaataataaaaaaccgaaacttaaaaaactaacgaaaatcgcgaatccaaaccctaaaaaacgtaaaactaacgaatcaaataaaaaccgaccgaccgacgctaaaaaaaaaaaatacgaaaaaaaacgaaaaaaaaacgccgctaacgtcgacgtaaaatcaaaaaacgcgccgaccgcgaccaatcaacgatcctcccgactcgcgaacccgcccacctactacgactactaccgcgcgccgcctaaaaaaaaattccgacttccgacccgaactaaaactacctaacgtcgatacccgcgcccgacccaacccgaaacccgccctcccctcttcctaaacaataaccccgcctacgtttccaaacttcctcttaataataacgaataacccta

SEQ ID NO: 2353 - DNA, 1283 bp, Artificial Sequence
  chemically treated genomic DNA (Homo sapiens) CpG-island No: 2353
tattttcgggcgtggtcgagtacggcgtttttaagaagggggaggcgtttaagaggaaagataaagtttttggtcgcgcgtttatttttttttttcggcgtattatacggatagtggtgttcggatgtcggtgtcgtcgtcggtgatagatggcgtagtatttgtatatgcgaggggttttttcggtttgatttttttgagttttcgttttttttatttttcgttgttttttatttttaattttgtcgtcggaggttcgtacgtttattacgggcgtttatataacgtgattttttatttttttagattgttttttagtgcgttgtaatttaattacgcgataggggtaggggggcgggatttaggcgcggagcggtagttttttcgagttaataggttgtgagcgttgattagtttttcgtttattggagtattcgttatcggcgttacgggggagtaagttagtgtgtgcgttggtcgggttcgggggaggaggggaatttttcgttattttttaataatttttttcggtgttgttgaggaggagtcgtgattgtcggtcgtcgggattcgaagcggaggtcggcggggggttgttgggaggcgcggcggtgtgcgcgggagttttgcgtcgtggcgtttcgttttatgattgtcgcgcggtcgcgtcggcggtgagggagtcggagttcgcgtcgtttttttatttttttttttttttattttattttcgggcgtttggcgttcgtttcgggtcgcggggtttagtgttgcgtcgcggggtcggttttagtagtcgttagtttttatcgtcgtcgtcgcgatggcgtcgtttttgggtcgtaagtttttttcgttggtgaagtcgttgttcggagaggagtcgttttttattatttcgtatatttaggaggtttttcgtattcgggagtatttttttttagtcgcgcgggtcgggttgggtcgggttgggtcggggtagggtttggggttcgcgagattaggttagtcgcgtattttcggttcggggtagttgttagcgcgtttcggtcgttcgcgggtttggaggttgagttttagtttgcgttcgtcgatttttttaggggattcggcggggggcgcgtatcggttttggaaggagaagggttcgtttcggtcgttttcggggtttcgtattttgtttcggggtttcgtcggcgaggagcgtattttttatttttattatttttttcgggttggttttaggttttgaggattcgagagggaggaggaggcgtggggag

SEQ ID NO: 2354 - DNA, 1283 bp, Artificial Sequence
  chemically treated genomic DNA (Homo sapiens) CpG-island No: 2354
ctccccacgcctcctcctccctctcgaatcctcaaaacctaaaaccaacccgaaaaaaataataaaaataaaaaatacgctcctcgccgacgaaaccccgaaacaaaatacgaaaccccgaaaacgaccgaaacgaacccttctccttccaaaaccgatacgcgccccccgccgaatcccctaaaaaaatcgacgaacgcaaactaaaactcaacctccaaacccgcgaacgaccgaaacgcgctaacaactaccccgaaccgaaaatacgcgactaacctaatctcgcgaaccccaaaccctaccccgacccaacccgacccaacccgacccgcgcgactaaaaaaaaatactcccgaatacgaaaaacctcctaaatatacgaaataataaaaaacgactcctctccgaacaacgacttcaccaacgaaaaaaacttacgacccaaaaacgacgccatcgcgacgacgacgataaaaactaacgactactaaaaccgaccccgcgacgcaacactaaaccccgcgacccgaaacgaacgccaaacgcccgaaaataaaataaaaaaaaaaaaaaataaaaaaacgacgcgaactccgactccctcaccgccgacgcgaccgcgcgacaatcataaaacgaaacgccacgacgcaaaactcccgcgcacaccgccgcgcctcccaacaaccccccgccgacctccgcttcgaatcccgacgaccgacaatcacgactcctcctcaacaacaccgaaaaaaattattaaaaaataacgaaaaattcccctcctcccccgaacccgaccaacgcacacactaacttactcccccgtaacgccgataacgaatactccaataaacgaaaaactaatcaacgctcacaacctattaactcgaaaaaactaccgctccgcgcctaaatcccgcccccctacccctatcgcgtaattaaattacaacgcactaaaaaacaatctaaaaaaataaaaaatcacgttatataaacgcccgtaataaacgtacgaacctccgacgacaaaattaaaaataaaaaacaacgaaaaataaaaaaaacgaaaactcaaaaaaatcaaaccgaaaaaacccctcgcatatacaaatactacgccatctatcaccgacgacgacaccgacatccgaacaccactatccgtataatacgccgaaaaaaaaaaataaacgcgcgaccaaaaactttatctttcctcttaaacgcctcccccttcttaaaaacgccgtactcgaccacgcccgaaaata

SEQ ID NO: 2355 - DNA, 1283 bp, Artificial Sequence
  chemically treated genomic DNA (Homo sapiens) CpG-island No: 2355
ttttttacgtttttttttttttttcgggtttttaaggtttaaagttaattcggggaaggtaatggggatgggggatgcgtttttcgtcggcgaggtttcgggataaagtgcggggtttcgggggcggtcgaagcgggtttttttttttttagggtcggtgcgcgtttttcgtcggattttttggaaggatcggcgggcgtaggttgagatttagtttttaggttcgcgagcggtcggggcgcgttgatagttgtttcgggtcggggatgcgcggttgatttggtttcgcgagttttaggttttatttcggtttagttcggtttagttcggttcgcgcggttggaaaaggatattttcgggtgcggaaggttttttgagtgtgcgggatggtgaagagcggttttttttcgggtaacggttttattagcgggaagggtttgcggtttaggagcggcgttatcgcggcggcggcggtggggattggcggttgttggggtcggtttcgcggcgtagtattaggtttcgcggttcggagcgagcgttaggcgttcgggggtggggtgggggaagggaggggtgagagggcggcgcgaatttcggtttttttatcgtcggcgcggtcgcgcgatagttatggagcggaacgttacggcgtagagttttcgcgtatatcgtcgcgttttttagtagtttttcgtcgattttcgtttcgggtttcggcggtcggtagttacgatttttttttagtagtatcggaggaaattattgaaaaatggcgggagattttttttttttttcgggttcggttaacgtatatattaatttgttttttcgtggcgtcggtggcgaatgttttaataggcggagagttggttagcgtttatagtttattggttcggaggagttgtcgtttcgcgtttgggtttcgtttttttgtttttgtcgcgtagttgggttgtagcgtattagagggtagtttgaagaggtgaaaggttacgttatgtaagcgttcgtgataggcgtgcgggttttcgacggtagagttaaaagtgggggatagcgggggatggagaggacgagaatttaaagaggttaagtcggagaagtttttcgtatatatagatattgcgttatttgttatcgacggcgatatcgatattcgggtattattgttcgtgtggtgcgtcggagggggagggtgagcgcgcggttaggggttttgtttttttttttgggcgtttttttttttttaaaggcgtcgtgttcggttacgttcggggatg

SEQ ID NO: 2356 - DNA, 1283 bp, Artificial Sequence
  chemically treated genomic DNA (Homo sapiens) CpG-island No: 2356
catccccgaacgtaaccgaacacgacgcctttaaaaaaaaaaaaacgcccaaaaaaaaaaacaaaacccctaaccgcgcgctcaccctccccctccgacgcaccacacgaacaataatacccgaatatcgatatcgccgtcgataacaaataacgcaatatctatatatacgaaaaacttctccgacttaacctctttaaattctcgtcctctccatcccccgctatcccccacttttaactctaccgtcgaaaacccgcacgcctatcacgaacgcttacataacgtaacctttcacctcttcaaactaccctctaatacgctacaacccaactacgcgacaaaaacaaaaaaacgaaacccaaacgcgaaacgacaactcctccgaaccaataaactataaacgctaaccaactctccgcctattaaaacattcgccaccgacgccacgaaaaaacaaattaatatatacgttaaccgaacccgaaaaaaaaaaaaaatctcccgccatttttcaataatttcctccgatactactaaaaaaaaatcgtaactaccgaccgccgaaacccgaaacgaaaatcgacgaaaaactactaaaaaacgcgacgatatacgcgaaaactctacgccgtaacgttccgctccataactatcgcgcgaccgcgccgacgataaaaaaaccgaaattcgcgccgccctctcacccctcccttcccccaccccacccccgaacgcctaacgctcgctccgaaccgcgaaacctaatactacgccgcgaaaccgaccccaacaaccgccaatccccaccgccgccgccgcgataacgccgctcctaaaccgcaaacccttcccgctaataaaaccgttacccgaaaaaaaaccgctcttcaccatcccgcacactcaaaaaaccttccgcacccgaaaatatccttttccaaccgcgcgaaccgaactaaaccgaactaaaccgaaataaaacctaaaactcgcgaaaccaaatcaaccgcgcatccccgacccgaaacaactatcaacgcgccccgaccgctcgcgaacctaaaaactaaatctcaacctacgcccgccgatccttccaaaaaatccgacgaaaaacgcgcaccgaccctaaaaaaaaaaaaacccgcttcgaccgcccccgaaaccccgcactttatcccgaaacctcgccgacgaaaaacgcatcccccatccccattaccttccccgaattaactttaaaccttaaaaacccgaaaaaaaaaaaaaaacgtaaaaaa

SEQ ID NO: 2357 - DNA, 510 bp, Artificial Sequence
  chemically treated genomic DNA (Homo sapiens) CpG-island No: 2357
taggacgacggggcggaggaggggatcgacgagattagagtagttcggtggcgaggaagggtaggcggggttggcgcgttggtcgggttcggaggcgggttcgggcggtcgtggggcggggcggggcggagcggcggcggttgagttgttggttgagattttggggcggaaacggagtggggcggttggggaggcgaggggcgggtcggggcggagatcgggaggtttttttttaggtcgtatttggtcgagtcgattgattcgttggcgaattaagtagatgttgggcgttatattgcgtgcgtcgcgtttttttttttgcggtttagtttttggtattcggtttttttttgcgtacgcgtgtacgcgtgcgttcgttgggttcgcgtcgcgttttcggattcgcgcgattgcgaagagttttgattcgggggcgtttacgttcgtttttgcgtagtttgggggcgttggttttagagatatttttatttgatttcgagtttattatag

SEQ ID NO: 2358 - DNA, 510 bp, Artificial Sequence
  chemically treated genomic DNA (Homo sapiens) CpG-island No: 2358
ctataataaactcgaaatcaaataaaaatatctctaaaaccaacgcccccaaactacgcaaaaacgaacgtaaacgcccccgaatcaaaactcttcgcaatcgcgcgaatccgaaaacgcgacgcgaacccaacgaacgcacgcgtacacgcgtacgcaaaaaaaaaccgaataccaaaaactaaaccgcaaaaaaaaaaacgcgacgcacgcaatataacgcccaacatctacttaattcgccaacgaatcaatcgactcgaccaaatacgacctaaaaaaaaacctcccgatctccgccccgacccgcccctcgcctccccaaccgccccactccgtttccgccccaaaatctcaaccaacaactcaaccgccgccgctccgccccgccccgccccacgaccgcccgaacccgcctccgaacccgaccaacgcgccaaccccgcctacccttcctcgccaccgaactactctaatctcgtcgatcccctcctccgccccgtcgtccta

SEQ ID NO: 2359 - DNA, 510 bp, Artificial Sequence
  chemically treated genomic DNA (Homo sapiens) CpG-island No: 2359
ttgtggtgagttcggggttaagtgagggtgtttttgaggttagcgtttttaagttgcgtaggagcgggcgtgggcgttttcgggttagggtttttcgtagtcgcgcgggttcggaagcgcggcgcgggtttaacgagcgtacgcgtatacgcgtgcgtaggggaagatcgagtgttaggggttgaatcgtagggaagggggcgcggcgtacgtagtatggcgtttaatatttatttggttcgttagcggattagtcgattcggttaggtgcggtttgaggagaagtttttcggttttcgtttcggttcgtttttcgtttttttagtcgttttatttcgttttcgttttagagttttagttagtagtttaatcgtcgtcgtttcgtttcgtttcgttttacggtcgttcgggttcgttttcgagttcggttagcgcgttagtttcgtttgttttttttcgttatcgggttgttttggtttcgtcggttttttttttcgtttcgtcgttttg

SEQ ID NO: 2360 - DNA, 510 bp, Artificial Sequence
  chemically treated genomic DNA (Homo sapiens) CpG-island No: 2360
caaaacgacgaaacgaaaaaaaaaaccgacgaaaccaaaacaacccgataacgaaaaaaaacaaacgaaactaacgcgctaaccgaactcgaaaacgaacccgaacgaccgtaaaacgaaacgaaacgaaacgacgacgattaaactactaactaaaactctaaaacgaaaacgaaataaaacgactaaaaaaacgaaaaacgaaccgaaacgaaaaccgaaaaacttctcctcaaaccgcacctaaccgaatcgactaatccgctaacgaaccaaataaatattaaacgccatactacgtacgccgcgcccccttccctacgattcaacccctaacactcgatcttcccctacgcacgcgtatacgcgtacgctcgttaaacccgcgccgcgcttccgaacccgcgcgactacgaaaaaccctaacccgaaaacgcccacgcccgctcctacgcaacttaaaaacgctaacctcaaaaacaccctcacttaaccccgaactcaccacaa

SEQ ID NO: 2361 - DNA, 655 bp, Artificial Sequence
  chemically treated genomic DNA (Homo sapiens) CpG-island No: 2361
gtaatttttttttaggtaggttttaagttgttttttcgggtgttcgggttgtgtacgttgttttttcgtcgtcggttcgagtcgcgatcgtcgcgcgtttgggggtttcggcggttttcggtgatttgcggcgtcgggttttttttttgcgttttttcggggtttttgttttttttgtagggttcgttatggagcgcgcggcgggtgcgttcggagatgttttttcgggtcgggttttcgaaagtagagtttcgggggttcgttgggatcgtggtatgtcgggcggtggttcgcgcgcggagatttcggcgtcgcggggggatcgtgtcggggtttttcggttcgcgttcgagtcgtcgtcgtgtttaaggggcgagtgtttgtttgttatttttcgttcggaggagcggcgtatttttagggttcgtttcgtacgtgttagttcggcgttcgcggcgtcgggatagtttcgggattttgttaggtggatgttgtgcgtagtcggagttaggttgaaggtgagcggcgtgtgggttagaagtttcgaggttgtaggcgcggagggaattcgggatgtcggggggtgttcggggtttcgcggtttagaatgttttagggcggtttggtgttttgggaggggataggagggtttttt

SEQ ID NO: 2362 - DNA, 655 bp, Artificial Sequence
  chemically treated genomic DNA (Homo sapiens) CpG-island No: 2362
aaaaaaccctcctatcccctcccaaaacaccaaaccgccctaaaacattctaaaccgcgaaaccccgaacaccccccgacatcccgaattccctccgcgcctacaacctcgaaacttctaacccacacgccgctcaccttcaacctaactccgactacgcacaacatccacctaacaaaatcccgaaactatcccgacgccgcgaacgccgaactaacacgtacgaaacgaaccctaaaaatacgccgctcctccgaacgaaaaataacaaacaaacactcgccccttaaacacgacgacgactcgaacgcgaaccgaaaaaccccgacacgatccccccgcgacgccgaaatctccgcgcgcgaaccaccgcccgacataccacgatcccaacgaacccccgaaactctactttcgaaaacccgacccgaaaaaacatctccgaacgcacccgccgcgcgctccataacgaaccctacaaaaaaaacaaaaaccccgaaaaaacgcaaaaaaaaaacccgacgccgcaaatcaccgaaaaccgccgaaacccccaaacgcgcgacgatcgcgactcgaaccgacgacgaaaaaacaacgtacacaacccgaacacccgaaaaaacaacttaaaacctacctaaaaaaaaattac

SEQ ID NO: 2363 - DNA, 655 bp, Artificial Sequence
  chemically treated genomic DNA (Homo sapiens) CpG-island No: 2363
gaggaatttttttatttttttttagagtattaggtcgttttagagtattttaagtcgcgggatttcgggtatttttcgatatttcgggtttttttcgcgtttgtaatttcgggatttttggtttatacgtcgtttatttttaatttggtttcggttacgtataatatttatttggtagagtttcggggttgtttcggcgtcgcgggcgtcgagttggtacgtgcggggcggattttaagggtgcgtcgttttttcgggcggggggtggtaggtaggtattcgttttttgggtacggcggcgattcgggcgcgggtcggggagtttcggtacggttttttcgcggcgtcgggattttcgcgcgcggattatcgttcggtatgttacggttttaacgggttttcggggttttgttttcgagaattcggttcgagaaggtattttcgagcgtattcgtcgcgcgttttatggcgggttttgtagagagggtagaagtttcgaggggacgtaaggaagggattcggcgtcgtaggttatcgggggtcgtcggagtttttaggcgcgcggcgatcgcggttcggatcggcggcggggaggtagcgtatatagttcgggtattcgggggaatagtttggggtttgtttaggggaaagttgt

SEQ ID NO: 2364 - DNA, 655 bp, Artificial Sequence
  chemically treated genomic DNA (Homo sapiens) CpG-island No: 2364
acaactttcccctaaacaaaccccaaactattcccccgaatacccgaactatatacgctacctccccgccgccgatccgaaccgcgatcgccgcgcgcctaaaaactccgacgacccccgataacctacgacgccgaatcccttccttacgtcccctcgaaacttctaccctctctacaaaacccgccataaaacgcgcgacgaatacgctcgaaaataccttctcgaaccgaattctcgaaaacaaaaccccgaaaacccgttaaaaccgtaacataccgaacgataatccgcgcgcgaaaatcccgacgccgcgaaaaaaccgtaccgaaactccccgacccgcgcccgaatcgccgccgtacccaaaaaacgaatacctacctaccaccccccgcccgaaaaaacgacgcacccttaaaatccgccccgcacgtaccaactcgacgcccgcgacgccgaaacaaccccgaaactctaccaaataaatattatacgtaaccgaaaccaaattaaaaataaacgacgtataaaccaaaaatcccgaaattacaaacgcgaaaaaaacccgaaatatcgaaaaatacccgaaatcccgcgacttaaaatactctaaaacgacctaatactctaaaaaaaaataaaaaaattcctc

SEQ ID NO: 2365 - DNA, 504 bp, Artificial Sequence
  chemically treated genomic DNA (Homo sapiens) CpG-island No: 2365
atgtatagcgcggttaaattggattcgatagtatcggaaacggcgatttttatttggggcgttgcggatatacgagtcgaggttgttttttaggaagtaaataaaaaaaggggggaaaagggggggaaagaaagaaagagaaaaaggagggcgagtggcgagtaggggtttcggtcgttatttatacgtttcgaagcgtgttcgtttttcgcgcggggttttcggtcgtcgttttcggttatcggttgtttttcggtggtttaggtttcggatttcgcggtcggttcggcgcggcgtatcgttttttaggtgcgtatttcgttttcgtcgtcgacgtcgttattaagggcgggttgtttttcggaacgttttttttttgagggtttggggaagggaggtcgttcggtcgtagcgggaggtggtttttcgggatattcggcgtttcgaggcgaggtattttcgaatttcgatttttgttggtaggattagaggtgtgagggtggg

SEQ ID NO: 2366 - DNA, 504 bp, Artificial Sequence
  chemically treated genomic DNA (Homo sapiens) CpG-island No: 2366
cccaccctcacacctctaatcctaccaacaaaaatcgaaattcgaaaatacctcgcctcgaaacgccgaatatcccgaaaaaccacctcccgctacgaccgaacgacctcccttccccaaaccctcaaaaaaaaaacgttccgaaaaacaacccgcccttaataacgacgtcgacgacgaaaacgaaatacgcacctaaaaaacgatacgccgcgccgaaccgaccgcgaaatccgaaacctaaaccaccgaaaaacaaccgataaccgaaaacgacgaccgaaaaccccgcgcgaaaaacgaacacgcttcgaaacgtataaataacgaccgaaacccctactcgccactcgccctcctttttctctttctttctttcccccccttttcccccctttttttatttacttcctaaaaaacaacctcgactcgtatatccgcaacgccccaaataaaaatcgccgtttccgatactatcgaatccaatttaaccgcgctatacat

SEQ ID NO: 2367 - DNA, 504 bp, Artificial Sequence
  chemically treated genomic DNA (Homo sapiens) CpG-island No: 2367
tttatttttatatttttggttttgttagtagggatcggggttcgggggtgtttcgtttcggggcgtcgggtgtttcggggggttatttttcgttgcggtcgggcggttttttttttttaggtttttaggaggaggacgtttcgaaaggtaattcgtttttaatggcggcgtcggcggcgggggcggggtacgtatttgaagggcggtgcgtcgcgtcgggtcggtcgcggagttcgaagtttgggttatcggggagtagtcgatggtcgagggcggcggtcgagagtttcgcgcgggggacgagtacgtttcggggcgtgtgggtggcggtcgaagtttttgttcgttattcgtttttttttttttttttttttttttttttttttttttttttttttttttgtttgttttttggaaggtagtttcgattcgtgtgttcgtagcgttttaagtgggagtcgtcgttttcggtgttgtcgaatttaatttagtcgcgttgtgtat

SEQ ID NO: 2368 - DNA, 504 bp, Artificial Sequence
  chemically treated genomic DNA (Homo sapiens) CpG-island No: 2368
atacacaacgcgactaaattaaattcgacaacaccgaaaacgacgactcccacttaaaacgctacgaacacacgaatcgaaactaccttccaaaaaacaaacaaaaaaaaaaaaaaaaaaaaaaaaaaaaaaaaaaaaaaaaaaaaaaaaacgaataacgaacaaaaacttcgaccgccacccacacgccccgaaacgtactcgtcccccgcgcgaaactctcgaccgccgccctcgaccatcgactactccccgataacccaaacttcgaactccgcgaccgacccgacgcgacgcaccgcccttcaaatacgtaccccgcccccgccgccgacgccgccattaaaaacgaattacctttcgaaacgtcctcctcctaaaaacctaaaaaaaaaaaaccgcccgaccgcaacgaaaaataaccccccgaaacacccgacgccccgaaacgaaacacccccgaaccccgatccctactaacaaaaccaaaaatataaaaataaa

SEQ ID NO: 2369 - DNA, 617 bp, Artificial Sequence
  chemically treated genomic DNA (Homo sapiens) CpG-island No: 2369
gcgttgggcgatagggacgcggggagagagcgataagttggaagtaagggttgtttgtaaaattttcggttttttagcggtaattttgcgggaaagattatttttttttcggtttcgcgtcgggtttattttcgtgtgtttcgatttttgcgttttaggtttgggcggcgtcgttgtatttcggttgtcgggcgcgttgtagttttcgttttttcgtacgcggcgttcgttcgttcgcgttgttttttttcggtaggcgggcggtttcggcgggcgggcgggcgcggattgtaggtgtttttttgttgtttttggcggtcgcgggcgcgcgagttttatcgagtcggtttcgggagttcgagcgttcgtttttttttcgttttttttttttttttttttcgtcgttttttttttatttcgtttttttttttttttttttttttttagaatatttaatgtcggaacgtttcgaagatgacgtcggagcgttttcgaatttcgtgtttttcggttgttgttgtcgaaggaatagggaaaaagtaataagaaggaagagtaatggcgatattggatcgtaaagtgtttagttcggaggcgtttttgggtaaattttggtt

SEQ ID NO: 2370 - DNA, 617 bp, Artificial Sequence
  chemically treated genomic DNA (Homo sapiens) CpG-island No: 2370
aaccaaaatttacccaaaaacgcctccgaactaaacactttacgatccaatatcgccattactcttccttcttattactttttccctattccttcgacaacaacaaccgaaaaacacgaaattcgaaaacgctccgacgtcatcttcgaaacgttccgacattaaatattctaaaaaaaaaaaaaaaaaaaaaaaaacgaaataaaaaaaaaacgacgaaaaaaaaaaaaaaaaaaaacgaaaaaaaaacgaacgctcgaactcccgaaaccgactcgataaaactcgcgcgcccgcgaccgccaaaaacaacaaaaaaacacctacaatccgcgcccgcccgcccgccgaaaccgcccgcctaccgaaaaaaaacaacgcgaacgaacgaacgccgcgtacgaaaaaacgaaaactacaacgcgcccgacaaccgaaatacaacgacgccgcccaaacctaaaacgcaaaaatcgaaacacacgaaaataaacccgacgcgaaaccgaaaaaaaaataatctttcccgcaaaattaccgctaaaaaaccgaaaattttacaaacaacccttacttccaacttatcgctctctccccgcgtccctatcgcccaacgc

SEQ ID NO: 2371 - DNA, 617 bp, Artificial Sequence
  chemically treated genomic DNA (Homo sapiens) CpG-island No: 2371
gattagggtttgtttagaaacgttttcggattgggtattttgcgatttagtgtcgttattgttttttttttttgttgttttttttttgttttttcggtagtagtagtcgagagatacgggattcgagaacgtttcgacgttattttcggaacgtttcgatattgagtgttttgaaagggggagggagggaggaagggcgggatgggaggagggcggcggaggaggaggggagagggagcggaggaggggcgggcgttcgggttttcggagtcggttcggtggggttcgcgcgttcgcggtcgttaggggtagtagagaggtatttgtagttcgcgttcgttcgttcgtcggggtcgttcgtttgtcggggaggggtagcgcggacgggcgagcgtcgcgtgcgggagagcgaaggttgtagcgcgttcggtagtcgggatgtagcggcgtcgtttaagtttggggcgtaggggtcggggtatacggggataggttcgacgcggggtcgaaggaagggtggtttttttcgtagagttgtcgttggaggatcgaaagttttgtaggtagtttttgtttttagtttgtcgtttttttttcgcgtttttgtcgtttaacgt

SEQ ID NO: 2372 - DNA, 617 bp, Artificial Sequence
  chemically treated genomic DNA (Homo sapiens) CpG-island No: 2372
acgttaaacgacaaaaacgcgaaaaaaaaacgacaaactaaaaacaaaaactacctacaaaactttcgatcctccaacgacaactctacgaaaaaaaccacccttccttcgaccccgcgtcgaacctatccccgtataccccgacccctacgccccaaacttaaacgacgccgctacatcccgactaccgaacgcgctacaaccttcgctctcccgcacgcgacgctcgcccgtccgcgctacccctccccgacaaacgaacgaccccgacgaacgaacgaacgcgaactacaaatacctctctactacccctaacgaccgcgaacgcgcgaaccccaccgaaccgactccgaaaacccgaacgcccgcccctcctccgctccctctcccctcctcctccgccgccctcctcccatcccgcccttcctccctccctccccctttcaaaacactcaatatcgaaacgttccgaaaataacgtcgaaacgttctcgaatcccgtatctctcgactactactaccgaaaaaacaaaaaaaaaacaacaaaaaaaaaaaacaataacgacactaaatcgcaaaatacccaatccgaaaacgtttctaaacaaaccctaatc

SEQ ID NO: 2373 - DNA, 1314 bp, Artificial Sequence
  chemically treated genomic DNA (Homo sapiens) CpG-island No: 2373
gcgagtttacgcgggatatttttcggtttatagttttatcggttttttttacgcggtattttttaattcgggagtttacgcgggttatttttcggtttatcgtttcgtttgtttttacgcggtaggttttttatagacggacgtttttttaattcggattcgtttaggagttttagtcgttttacgatggtttttagaggtcgggcgggattatttttggtggatcgcggttttagcgtttttttcgtttgggtttttcgtttcgggtttcgggtttcgtcgtttattcggagaggtttatttttgttttacgcgtttaggtcgttttacgtttttattttcggtttttcgttcgttcgtcgcgtttttatcggtttcgttcggttttcgtagtcgtaagtagtagtcgttagattcgcgtcggcgtcgtttgtttttaattgttcgtcggtagttttcgcgtagcgcgtttcgttttgatttcgttttcgcgacgcggacgcgtagtcgattggtttgcggggcgttagggcggagttttttcgtttcgcggtttgaaagcgtaagatcgagttttgattggtgaacggacggagaaggggcgggagtaggtaggtagttgcgtaggatataaatttgtgtagcgttcggttcgttgggcggggcgtcggtttgttgagcgaggtaatgttttaggcgaagttaaggttcgttgggcggggttagattttgggcggggagtcggttcgttgggtggggttaggttttgggcggggagtcggttcgttgggcggggttaggttttgggcggggagtcggttcgttgggcggggttaggttttgggcggggagtcggttcgttgggcggggttaggttttgggcggggagtcggttcgttgggcggggttaggttttgggcggggagtcggttcgttgggcggggttaggttttgggcggggagtcggttcgttgggcggggttaggttttgggcggggagtcggttcgttgggcggggttaggttttgggcggggagtcggttcgttgggcggggttaggttttgggcggggagtcggttcgttgggcggggttaggttttgggcggggagtcggttcgttgggcggggttaggttttgggcgaggtttaggttcgttgggcgcggataggtgttgggcgaggtttaggtttgttgggcgcggataggtgttgggcgaggtttaggtttgttgggcgcggataggtgttgggcgaggtttggttcgttgggcggggataggttttggttcgggttttgtcggttgtttttgtat

SEQ ID NO: 2374 - DNA, 1314 bp, Artificial Sequence
  chemically treated genomic DNA (Homo sapiens) CpG-island No: 2374
atacaaaaacaaccgacaaaacccgaaccaaaacctatccccgcccaacgaaccaaacctcgcccaacacctatccgcgcccaacaaacctaaacctcgcccaacacctatccgcgcccaacaaacctaaacctcgcccaacacctatccgcgcccaacgaacctaaacctcgcccaaaacctaaccccgcccaacgaaccgactccccgcccaaaacctaaccccgcccaacgaaccgactccccgcccaaaacctaaccccgcccaacgaaccgactccccgcccaaaacctaaccccgcccaacgaaccgactccccgcccaaaacctaaccccgcccaacgaaccgactccccgcccaaaacctaaccccgcccaacgaaccgactccccgcccaaaacctaaccccgcccaacgaaccgactccccgcccaaaacctaaccccgcccaacgaaccgactccccgcccaaaacctaaccccgcccaacgaaccgactccccgcccaaaacctaaccccgcccaacgaaccgactccccgcccaaaacctaaccccacccaacgaaccgactccccgcccaaaatctaaccccgcccaacgaaccttaacttcgcctaaaacattacctcgctcaacaaaccgacgccccgcccaacgaaccgaacgctacacaaatttatatcctacgcaactacctacctactcccgccccttctccgtccgttcaccaatcaaaactcgatcttacgctttcaaaccgcgaaacgaaaaaactccgccctaacgccccgcaaaccaatcgactacgcgtccgcgtcgcgaaaacgaaatcaaaacgaaacgcgctacgcgaaaactaccgacgaacaattaaaaacaaacgacgccgacgcgaatctaacgactactacttacgactacgaaaaccgaacgaaaccgataaaaacgcgacgaacgaacgaaaaaccgaaaataaaaacgtaaaacgacctaaacgcgtaaaacaaaaataaacctctccgaataaacgacgaaacccgaaacccgaaacgaaaaacccaaacgaaaaaaacgctaaaaccgcgatccaccaaaaataatcccgcccgacctctaaaaaccatcgtaaaacgactaaaactcctaaacgaatccgaattaaaaaaacgtccgtctataaaaaacctaccgcgtaaaaacaaacgaaacgataaaccgaaaaataacccgcgtaaactcccgaattaaaaaataccgcgtaaaaaaaaccgataaaactataaaccgaaaaatatcccgcgtaaactcgc

SEQ ID NO: 2375 - DNA, 1314 bp, Artificial Sequence
  chemically treated genomic DNA (Homo sapiens) CpG-island No: 2375
gtgtaaggatagtcggtaaggttcgggttaagatttattttcgtttagcgagttaggtttcgtttagtatttattcgcgtttagtaagtttaggtttcgtttagtatttattcgcgtttagtaagtttaggtttcgtttagtatttattcgcgtttagcgagtttagatttcgtttaagatttagtttcgtttagcgagtcgatttttcgtttaggatttagtttcgtttagcgagtcgatttttcgtttaggatttagtttcgtttagcgagtcgatttttcgtttaggatttagtttcgtttagcgagtcgatttttcgtttaggatttagtttcgtttagcgagtcgatttttcgtttaggatttagtttcgtttagcgagtcgatttttcgtttaggatttagtttcgtttagcgagtcgatttttcgtttaggatttagtttcgtttagcgagtcgatttttcgtttaggatttagtttcgtttagcgagtcgatttttcgtttaggatttagtttcgtttagcgagtcgatttttcgtttaggatttagttttatttaacgagtcgatttttcgtttaagatttagtttcgtttagcgagttttggtttcgtttaggatattgtttcgtttagtaagtcgacgtttcgtttaacgagtcgagcgttgtatagatttatattttacgtagttgtttgtttgttttcgtttttttttcgttcgtttattaattagaattcgattttgcgtttttaggtcgcgggacgggaaggtttcgttttggcgtttcgtaggttaatcgattgcgcgttcgcgtcgcgggggcggggttagggcggggcgcgttgcgcgggggttgtcggcgggtagttgggagtaggcgacgtcgacgcgagtttggcggttgttgtttgcgattgcggaggtcgggcgaggtcggtgaggacgcggcgggcgagcgagaggtcgagggtgaggacgtgaagcggtttgggcgcgtggggtaggggtgggttttttcgggtgggcggcgaagttcgaggttcgaggcgagaggtttaggcggggggggcgttgaggtcgcggtttattagagatggtttcgttcggtttttgaaggttatcgtgaggcggttggagtttttaggcgggttcgggttagaggagcgttcgtttgtagggagtttgtcgcgtgggggtaggcggggcggtgggtcggggagtggttcgcgtggattttcgggttgaggggtgtcgcgtggaggaggtcggtggggttgtagatcggggagtgtttcgcgtggattcgt

SEQ ID NO: 2376 - DNA, 1314 bp, Artificial Sequence
  chemically treated genomic DNA (Homo sapiens) CpG-island No: 2376
acgaatccacgcgaaacactccccgatctacaaccccaccgacctcctccacgcgacacccctcaacccgaaaatccacgcgaaccactccccgacccaccgccccgcctacccccacgcgacaaactccctacaaacgaacgctcctctaacccgaacccgcctaaaaactccaaccgcctcacgataaccttcaaaaaccgaacgaaaccatctctaataaaccgcgacctcaacgccccccccgcctaaacctctcgcctcgaacctcgaacttcgccgcccacccgaaaaaacccacccctaccccacgcgcccaaaccgcttcacgtcctcaccctcgacctctcgctcgcccgccgcgtcctcaccgacctcgcccgacctccgcaatcgcaaacaacaaccgccaaactcgcgtcgacgtcgcctactcccaactacccgccgacaacccccgcgcaacgcgccccgccctaaccccgcccccgcgacgcgaacgcgcaatcgattaacctacgaaacgccaaaacgaaaccttcccgtcccgcgacctaaaaacgcaaaatcgaattctaattaataaacgaacgaaaaaaaaacgaaaacaaacaaacaactacgtaaaatataaatctatacaacgctcgactcgttaaacgaaacgtcgacttactaaacgaaacaatatcctaaacgaaaccaaaactcgctaaacgaaactaaatcttaaacgaaaaatcgactcgttaaataaaactaaatcctaaacgaaaaatcgactcgctaaacgaaactaaatcctaaacgaaaaatcgactcgctaaacgaaactaaatcctaaacgaaaaatcgactcgctaaacgaaactaaatcctaaacgaaaaatcgactcgctaaacgaaactaaatcctaaacgaaaaatcgactcgctaaacgaaactaaatcctaaacgaaaaatcgactcgctaaacgaaactaaatcctaaacgaaaaatcgactcgctaaacgaaactaaatcctaaacgaaaaatcgactcgctaaacgaaactaaatcctaaacgaaaaatcgactcgctaaacgaaactaaatcctaaacgaaaaatcgactcgctaaacgaaactaaatcttaaacgaaatctaaactcgctaaacgcgaataaatactaaacgaaacctaaacttactaaacgcgaataaatactaaacgaaacctaaacttactaaacgcgaataaatactaaacgaaacctaactcgctaaacgaaaataaatcttaacccgaaccttaccgactatccttacac

SEQ ID NO: 2377 - DNA, 556 bp, Artificial Sequence
  chemically treated genomic DNA (Homo sapiens) CpG-island No: 2377
aatacggggttgagggtggggatgtacggggaggggagcgagagattgtgagtgagtttgaagagtagttattgaggggtgtggagtgataggatggacgaaggacggtttatcggatagatacgggggtgaatggagatgcgcgaggtggatcgatggttggtagagagtttcgtgaggtggtcgtggatgggtgagtgagagtggaggataaaagcgtcggtcggtacgagttagtagagtgcggagagcggtagttcggatgtgtcgtaggagagagatagttgtagcgtagcgtacgagaagtattcgtgtgtgggtgtatacggaggttatacgagagcgtgcgagagtgtgtgattgagcgagagaggtgagagtacgcgtcgagagtaaggtaagtgtagtgatcgcgtgcgagcgtagttttacggtcgagtttagtgtagtagagcggggattgcgtttgatgaatgtgatagcgcgttagaagtgggagcgaaaaagtgaagagagagaagttagattatgggtaagtattcgttattggcgtata

SEQ ID NO: 2378 - DNA, 556 bp, Artificial Sequence
  chemically treated genomic DNA (Homo sapiens) CpG-island No: 2378
tatacgccaataacgaatacttacccataatctaacttctctctcttcactttttcgctcccacttctaacgcgctatcacattcatcaaacgcaatccccgctctactacactaaactcgaccgtaaaactacgctcgcacgcgatcactacacttaccttactctcgacgcgtactctcacctctctcgctcaatcacacactctcgcacgctctcgtataacctccgtatacacccacacacgaatacttctcgtacgctacgctacaactatctctctcctacgacacatccgaactaccgctctccgcactctactaactcgtaccgaccgacgcttttatcctccactctcactcacccatccacgaccacctcacgaaactctctaccaaccatcgatccacctcgcgcatctccattcacccccgtatctatccgataaaccgtccttcgtccatcctatcactccacacccctcaataactactcttcaaactcactcacaatctctcgctcccctccccgtacatccccaccctcaaccccgtatt

SEQ ID NO: 2379 - DNA, 556 bp, Artificial Sequence
  chemically treated genomic DNA (Homo sapiens) CpG-island No: 2379
tatgcgttaatagcggatatttatttatggtttaatttttttttttttattttttcgtttttatttttggcgcgttattatatttattaggcgtagttttcgttttattgtattgaattcgatcgtgagattacgttcgtacgcggttattatatttgttttgttttcggcgcgtatttttatttttttcgtttaattatatattttcgtacgttttcgtgtgattttcgtgtatatttatatacgagtatttttcgtgcgttacgttgtagttattttttttttgcgatatattcgagttgtcgtttttcgtattttattaattcgtatcgatcggcgtttttattttttatttttatttatttatttacggttattttacgggattttttattagttatcggtttatttcgcgtatttttatttattttcgtgtttgttcggtggatcgtttttcgtttattttgttattttatattttttaatggttgttttttaagtttatttataatttttcgttttttttttcgtatatttttatttttaatttcgtgtt

SEQ ID NO: 2380 - DNA, 556 bp, Artificial Sequence
  chemically treated genomic DNA (Homo sapiens) CpG-island No: 2380
aacacgaaattaaaaataaaaatatacgaaaaaaaaaacgaaaaattataaataaacttaaaaaacaaccattaaaaaatataaaataacaaaataaacgaaaaacgatccaccgaacaaacacgaaaataaataaaaatacgcgaaataaaccgataactaataaaaaatcccgtaaaataaccgtaaataaataaataaaaataaaaaataaaaacgccgatcgatacgaattaataaaatacgaaaaacgacaactcgaatatatcgcaaaaaaaaaataactacaacgtaacgcacgaaaaatactcgtatataaatatacacgaaaatcacacgaaaacgtacgaaaatatataattaaacgaaaaaaataaaaatacgcgccgaaaacaaaacaaatataataaccgcgtacgaacgtaatctcacgatcgaattcaatacaataaaacgaaaactacgcctaataaatataataacgcgccaaaaataaaaacgaaaaaataaaaaaaaaaaaattaaaccataaataaatatccgctattaacgcata

SEQ ID NO: 2381 - DNA, 1141 bp, Artificial Sequence
  chemically treated genomic DNA (Homo sapiens) CpG-island No: 2381
gaggttcggtcgtttaggttttatttggagaagaaaattttcgtaatttggttgggggaggggggatgcgggtataggttgtgttttttacgtcgcgtagacgtagaggttatttttgggtcggagagttttcgtggagtggtattttagcgtttttcgtacgtcggggtcgttttgtcgggttgacgggggttttttcgggtggtcgtcggcggcgggtttcgagttagatcgggaagcggggagtagtttttagttcgcgagcgcggggtcggggtagattggaggtcgggcgggtttcgtcgagggtggggcggggtcgggcgtacgggggcggatttcggcgcgttttcggtcgttcggtggtttcggggtcgcggcggtttttttgtcgggtcgcgtcggacgattggtttcgggcggcggtttcggcggtttgtggacggacgggtgggtcgaggtataggttttacggtcgtcgtttttcgtttttgttcgcgtagagttcgcgttatggtcgtttcgtcgggttcgggtagcgttaattcgcggaagtttagtgagaagatcgcgttgtatacgtagagataggtcgaggagacgcgggttttcgagtagtttatgatcgattttattttgtcgcgggtgagggttcgggtcggcgcgggcgggggcggttacggtcgcgggcgggattcgcgcggcgggtgagaggttgcggggttaaggcgatggcggggtcgggcgggggtcgcgttcgggaatcggcggttgggagggggatcggagcggtcgcggtttcggcgttttttcgtttggcgatattcgttagtcgttcgcgatttcgggttgaggtgggagggtcgttcggtttcgtgtgcgggaagatgggtaggggtgaagttcgtggaggcgggcggtcgtgcgagggcggtttgagggggaggaggacgaggagtttcgagaggaaatcgtaaatagttcggaggtcggtcgggtggcgcggcgcggtttttggtcgtttcgaatattttttattatcgagttttgttgttttgtcggcgtggaaggtcgcgggtattttagggttttacgcgttcgtggggggagttttgtgtataagtttatttagggttcggtt

SEQ ID NO: 2382 - DNA, 1141 bp, Artificial Sequence
  chemically treated genomic DNA (Homo sapiens) CpG-island No: 2382
aaccgaaccctaaataaacttatacacaaaactccccccacgaacgcgtaaaaccctaaaatacccgcgaccttccacgccgacaaaacaacaaaactcgataataaaaaatattcgaaacgaccaaaaaccgcgccgcgccacccgaccgacctccgaactatttacgatttcctctcgaaactcctcgtcctcctccccctcaaaccgccctcgcacgaccgcccgcctccacgaacttcacccctacccatcttcccgcacacgaaaccgaacgaccctcccacctcaacccgaaatcgcgaacgactaacgaatatcgccaaacgaaaaaacgccgaaaccgcgaccgctccgatccccctcccaaccgccgattcccgaacgcgacccccgcccgaccccgccatcgccttaaccccgcaacctctcacccgccgcgcgaatcccgcccgcgaccgtaaccgcccccgcccgcgccgacccgaaccctcacccgcgacaaaataaaatcgatcataaactactcgaaaacccgcgtctcctcgacctatctctacgtatacaacgcgatcttctcactaaacttccgcgaattaacgctacccgaacccgacgaaacgaccataacgcgaactctacgcgaacaaaaacgaaaaacgacgaccgtaaaacctatacctcgacccacccgtccgtccacaaaccgccgaaaccgccgcccgaaaccaatcgtccgacgcgacccgacaaaaaaaccgccgcgaccccgaaaccaccgaacgaccgaaaacgcgccgaaatccgcccccgtacgcccgaccccgccccaccctcgacgaaacccgcccgacctccaatctaccccgaccccgcgctcgcgaactaaaaactactccccgcttcccgatctaactcgaaacccgccgccgacgaccacccgaaaaaacccccgtcaacccgacaaaacgaccccgacgtacgaaaaacgctaaaataccactccacgaaaactctccgacccaaaaataacctctacgtctacgcgacgtaaaaaacacaacctatacccgcatcccccctcccccaaccaaattacgaaaattttcttctccaaataaaacctaaacgaccgaacctc

SEQ ID NO: 2383 - DNA, 1141 bp, Artificial Sequence
  chemically treated genomic DNA (Homo sapiens) CpG-island No: 2383
ggtcgggttttggatggatttgtgtatagagttttttttacgagcgcgtgggattttggggtgttcgcggttttttacgtcggtagaatagtagggttcgatggtgggggatgttcggagcgattagaagtcgcgtcgcgttattcggtcggttttcgagttgtttgcgattttttttcggggtttttcgttttttttttttttaggtcgttttcgtacggtcgttcgtttttacgggttttatttttgtttattttttcgtatacggggtcgggcgatttttttattttagttcgggatcgcgaacggttagcgggtgtcgttaggcggggaaacgtcgaggtcgcggtcgtttcggttttttttttagtcgtcggttttcgggcgcggttttcgttcggtttcgttatcgttttggtttcgtaattttttattcgtcgcgcgggtttcgttcgcggtcgtggtcgttttcgttcgcgtcggttcgggtttttattcgcgatagggtgaggtcggttatgagttgttcgaaggttcgcgttttttcggtttgtttttgcgtgtgtagcgcgatttttttattgaattttcgcgggttggcgttgttcgagttcggcgaggcggttatggcgcggattttgcgcgggtagaagcgggagacggcggtcgtggggtttgtatttcggtttattcgttcgtttataggtcgtcggggtcgtcgttcgaagttagtcgttcggcgcgattcggtagaggagtcgtcgcggtttcggagttatcgagcggtcgggagcgcgtcgaggttcgttttcgtgcgttcggtttcgttttattttcggcggggttcgttcggtttttagtttgtttcggtttcgcgttcgcgggttgagggttgtttttcgtttttcggtttggttcgggattcgtcgtcggcggttattcggagggattttcgttagttcgataaagcggtttcggcgtacggggaacgttggggtgttattttacggagatttttcgatttagggatggtttttgcgtttacgcgacgtggagaatatagtttgtgttcgtatttttttttttttagttaaattacgaagatttttttttttaggtggaatttgggcgatcggatttt

SEQ ID NO: 2384 - DNA, 1141 bp, Artificial Sequence
  chemically treated genomic DNA (Homo sapiens) CpG-island No: 2384
aaaatccgatcgcccaaattccacctaaaaaaaaaaatcttcgtaatttaactaaaaaaaaaaaaatacgaacacaaactatattctccacgtcgcgtaaacgcaaaaaccatccctaaatcgaaaaatctccgtaaaataacaccccaacgttccccgtacgccgaaaccgctttatcgaactaacgaaaatccctccgaataaccgccgacgacgaatcccgaaccaaaccgaaaaacgaaaaacaaccctcaacccgcgaacgcgaaaccgaaacaaactaaaaaccgaacgaaccccgccgaaaataaaacgaaaccgaacgcacgaaaacgaacctcgacgcgctcccgaccgctcgataactccgaaaccgcgacgactcctctaccgaatcgcgccgaacgactaacttcgaacgacgaccccgacgacctataaacgaacgaataaaccgaaatacaaaccccacgaccgccgtctcccgcttctacccgcgcaaaatccgcgccataaccgcctcgccgaactcgaacaacgccaacccgcgaaaattcaataaaaaaatcgcgctacacacgcaaaaacaaaccgaaaaaacgcgaaccttcgaacaactcataaccgacctcaccctatcgcgaataaaaacccgaaccgacgcgaacgaaaacgaccacgaccgcgaacgaaacccgcgcgacgaataaaaaattacgaaaccaaaacgataacgaaaccgaacgaaaaccgcgcccgaaaaccgacgactaaaaaaaaaaccgaaacgaccgcgacctcgacgtttccccgcctaacgacacccgctaaccgttcgcgatcccgaactaaaataaaaaaatcgcccgaccccgtatacgaaaaaataaacaaaaataaaacccgtaaaaacgaacgaccgtacgaaaacgacctaaaaaaaaaaaaaacgaaaaaccccgaaaaaaaatcgcaaacaactcgaaaaccgaccgaataacgcgacgcgacttctaatcgctccgaacatcccccaccatcgaaccctactattctaccgacgtaaaaaaccgcgaacaccccaaaatcccacgcgctcgtaaaaaaaactctatacacaaatccatccaaaacccgacc

SEQ ID NO: 2385 - DNA, 804 bp, Artificial Sequence
  chemically treated genomic DNA (Homo sapiens) CpG-island No: 2385
gaagttaggatcgtgtcgcgttatcgttaggatatggagttattgtcgttatcgtttcgcgacgtagatttgacggttttcgacggttttttttgtttttttgttataacggacgatttttatgacgattcgtgtttcgatttttcggatttgcgttttttcgaagatttggattcgcgtttgatgtacgtgggcgcgtttttgaaattcgaagagtattcgtattttttcgcggcggtgtattcggtttcgggcgtacgtgaggacgagtatgtgcgcgcgtttagcgggtattattaggcgggtcgttgtttattgtgggtttgtaaggcgtgtaagcgtaagattattaacgtcgatcgtcgtaaggtcgttattatgcgcgagcggcgtcgtttgagtaaagtaaatgaggtttttgagatatttaagcgttgtacgtcgagtaatttaaattagcggttgtttaaggtggagattttgcgtaacgttattcgttatatcgagggtttgtaggttttgttgcgcgattaggacgtcgcgttttttggcgtcgtagtcgttttttatgcgtcgggttcgttgttttcgggtcgcggcggcgagtattatagcggcgatttcgacgcgtttagttcgcgttttaattgtttcgacggtatggtaaggtcgggattttaggaagtgaggaagttagggcggcgttcgggatattagggacgcgttttcgagggcggggagttggttttgcgggaggtttgggttaggatttttttcgagagagaggatttttttgttttgggt

SEQ ID NO: 2386 - DNA, 804 bp, Artificial Sequence
  chemically treated genomic DNA (Homo sapiens) CpG-island No: 2386
acccaaaacaaaaaaatcctctctctcgaaaaaaatcctaacccaaacctcccgcaaaaccaactccccgccctcgaaaacgcgtccctaatatcccgaacgccgccctaacttcctcacttcctaaaatcccgaccttaccataccgtcgaaacaattaaaacgcgaactaaacgcgtcgaaatcgccgctataatactcgccgccgcgacccgaaaacaacgaacccgacgcataaaaaacgactacgacgccaaaaaacgcgacgtcctaatcgcgcaacaaaacctacaaaccctcgatataacgaataacgttacgcaaaatctccaccttaaacaaccgctaatttaaattactcgacgtacaacgcttaaatatctcaaaaacctcatttactttactcaaacgacgccgctcgcgcataataacgaccttacgacgatcgacgttaataatcttacgcttacacgccttacaaacccacaataaacaacgacccgcctaataatacccgctaaacgcgcgcacatactcgtcctcacgtacgcccgaaaccgaatacaccgccgcgaaaaaatacgaatactcttcgaatttcaaaaacgcgcccacgtacatcaaacgcgaatccaaatcttcgaaaaaacgcaaatccgaaaaatcgaaacacgaatcgtcataaaaatcgtccgttataacaaaaaaacaaaaaaaaccgtcgaaaaccgtcaaatctacgtcgcgaaacgataacgacaataactccatatcctaacgataacgcgacacgatcctaacttc

SEQ ID NO: 2387 - DNA, 804 bp, Artificial Sequence
  chemically treated genomic DNA (Homo sapiens) CpG-island No: 2387
gtttaggataagggggttttttttttcgggaaggattttggtttaaatttttcgtaaggttagtttttcgttttcggaaacgcgtttttgatatttcgagcgtcgttttaatttttttattttttggggtttcggttttattatgtcgtcggagtagttggagcgcgggttggacgcgtcggagtcgtcgttgtagtgttcgtcgtcgcggttcgggggtagcgggttcggcgtatagaaggcggttgcggcgttagggggcgcggcgttttggtcgcgtagtagagtttgtaggttttcgatatagcggatggcgttgcgtaggatttttattttgggtaatcgttggtttggattgttcgacgtgtagcgtttgagtgttttaaaggttttatttattttgtttaggcggcgtcgttcgcgtatggtggcggttttgcggcggtcggcgttggtggttttgcgtttgtacgttttgtaggtttatagtaggtagcggttcgtttggtggtgttcgttgggcgcgcgtatatgttcgtttttacgtgcgttcggggtcgggtgtatcgtcgcggggaagtgcgagtgtttttcgggttttaggagcgcgtttacgtgtattaggcgcgggtttaggttttcgaagaagcgtaggttcggggagtcgaaatacgggtcgttatagaagtcgttcgttgtggtaaaggagtagagagagtcgtcgggggtcgttaggtttacgtcgcggagcggtggcgatagtagttttatattttggcggtggcgcggtacggttttggtttt

SEQ ID NO: 2388 - DNA, 804 bp, Artificial Sequence
  chemically treated genomic DNA (Homo sapiens) CpG-island No: 2388
aaaaccaaaaccgtaccgcgccaccgccaaaatataaaactactatcgccaccgctccgcgacgtaaacctaacgacccccgacgactctctctactcctttaccacaacgaacgacttctataacgacccgtatttcgactccccgaacctacgcttcttcgaaaacctaaacccgcgcctaatacacgtaaacgcgctcctaaaacccgaaaaacactcgcacttccccgcgacgatacacccgaccccgaacgcacgtaaaaacgaacatatacgcgcgcccaacgaacaccaccaaacgaaccgctacctactataaacctacaaaacgtacaaacgcaaaaccaccaacgccgaccgccgcaaaaccgccaccatacgcgaacgacgccgcctaaacaaaataaataaaacctttaaaacactcaaacgctacacgtcgaacaatccaaaccaacgattacccaaaataaaaatcctacgcaacgccatccgctatatcgaaaacctacaaactctactacgcgaccaaaacgccgcgccccctaacgccgcaaccgccttctatacgccgaacccgctacccccgaaccgcgacgacgaacactacaacgacgactccgacgcgtccaacccgcgctccaactactccgacgacataataaaaccgaaaccccaaaaaataaaaaaattaaaacgacgctcgaaatatcaaaaacgcgtttccgaaaacgaaaaactaaccttacgaaaaatttaaaccaaaatccttcccgaaaaaaaaaacccccttatcctaaac

SEQ ID NO: 2389 - DNA, 951 bp, Artificial Sequence
  chemically treated genomic DNA (Homo sapiens) CpG-island No: 2389
tggcgtttttcgagggcggatcgtgggcgggtttttcgggagtagtaggagtcgcgcggggcgggcgtttttagcgtcgaggttgagggaggtcgggttcggtgcggggttaggaggggggcgcggaattagggttttttaggatttagcgcggcgttttttttcgggggcgagtgcggttgcgcgcgtcgtgtgttcgtgttcggagagcggcgggttggacgcggatcgcgcgaacgagtaggcgacgggcgagtagtaagcggagtagtagttcgggcggtagtagcgtcgcggcggcggcggtagcggtcgtttcgcgtttcgttttatcggtttcgttggttttatttcgtcgcgttcggattcgttattttcgtattttcgttcgattttcgtagttttcgtttcggtcggtagcgtttatcgtttgttcgaagcgaggagcggagtgcggggcgtagaggtatcggagttagtgttcgtcggtttcgtaaattaaatttagttaggagaattttcgtttggtttcgtgtagtatcgcgacgtcgaggaggttttggataatttcggcggcgtttttttggataatagcgtcgacgacgcggacgtcgacggtattggcgattcgggcgacggcgaggacgagttggatatgattaaacgattggcgtttagtgattttacggatggtcggtttggcggtttttggcgtcgttgataatcgcgtattttggcgtttttcgaggattcgtattcgtttcgttacgtacgggtaaatgataatttatttattagaagagcggggttggaaggtagcgttttgtgttttttcgtaggtaggaatggatcggagaattagcgtttagggagtttaaaatcgaaagggggtgtgtttatatgtgtgtacgtattaaggtaatatatgaagtgtgttcgtcgggttttggt

SEQ ID NO: 2390 - DNA, 951 bp, Artificial Sequence
  chemically treated genomic DNA (Homo sapiens) CpG-island No: 2390
accaaaacccgacgaacacacttcatatattaccttaatacgtacacacatataaacacaccccctttcgattttaaactccctaaacgctaattctccgatccattcctacctacgaaaaaacacaaaacgctaccttccaaccccgctcttctaataaataaattatcatttacccgtacgtaacgaaacgaatacgaatcctcgaaaaacgccaaaatacgcgattatcaacgacgccaaaaaccgccaaaccgaccatccgtaaaatcactaaacgccaatcgtttaatcatatccaactcgtcctcgccgtcgcccgaatcgccaataccgtcgacgtccgcgtcgtcgacgctattatccaaaaaaacgccgccgaaattatccaaaacctcctcgacgtcgcgatactacacgaaaccaaacgaaaattctcctaactaaatttaatttacgaaaccgacgaacactaactccgatacctctacgccccgcactccgctcctcgcttcgaacaaacgataaacgctaccgaccgaaacgaaaactacgaaaatcgaacgaaaatacgaaaataacgaatccgaacgcgacgaaataaaaccaacgaaaccgataaaacgaaacgcgaaacgaccgctaccgccgccgccgcgacgctactaccgcccgaactactactccgcttactactcgcccgtcgcctactcgttcgcgcgatccgcgtccaacccgccgctctccgaacacgaacacacgacgcgcgcaaccgcactcgcccccgaaaaaaaacgccgcgctaaatcctaaaaaaccctaattccgcgcccccctcctaaccccgcaccgaacccgacctccctcaacctcgacgctaaaaacgcccgccccgcgcgactcctactactcccgaaaaacccgcccacgatccgccctcgaaaaacgcca

SEQ ID NO: 2391 - DNA, 951 bp, Artificial Sequence
  chemically treated genomic DNA (Homo sapiens) CpG-island No: 2391
attagaattcggcggatatattttatatgttattttggtacgtgtatatatgtgaatatattttttttcgattttgaattttttaggcgttagtttttcggtttatttttgtttgcggggaggtataggacgttgttttttagtttcgtttttttgatgggtaaattgttatttattcgtgcgtagcgggacgagtacgggttttcgaagagcgttaagatgcgcggttgttagcggcgttaaaagtcgttagatcggttattcgtggagttattgagcgttagtcgtttggttatgtttagttcgttttcgtcgtcgttcgagtcgttagtgtcgtcggcgttcgcgtcgtcggcgttgttgtttagaggagcgtcgtcgaagttgtttagagttttttcggcgtcgcggtgttgtacggggttaggcgggggtttttttggttgggtttgatttgcggggtcggcgggtattggtttcggtgtttttgcgtttcgtatttcgtttttcgtttcgggtaggcggtgggcgttgtcggtcgagacgggggttgcggaggtcgggcggggatgcgggggtggcgggttcgggcgcggcgaggtgaggttagcgaggtcggtgaggcgaggcgcggagcggtcgttgtcgtcgtcgtcgcgacgttgttgtcgttcgggttgttgtttcgtttgttgttcgttcgtcgtttgttcgttcgcgcggttcgcgtttagttcgtcgtttttcggatacgggtatacggcgcgcgtagtcgtattcgttttcggaggaaggcgtcgcgttgggttttaaaaagttttgatttcgcgttttttttttagtttcgtatcgagttcggttttttttaatttcggcgttgggggcgttcgtttcgcgcggtttttgttgttttcgggggattcgtttacggttcgttttcggggaacgtta

SEQ ID NO: 2392 - DNA, 951 bp, Artificial Sequence
  chemically treated genomic DNA (Homo sapiens) CpG-island No: 2392
taacgttccccgaaaacgaaccgtaaacgaatcccccgaaaacaacaaaaaccgcgcgaaacgaacgcccccaacgccgaaattaaaaaaaaccgaactcgatacgaaactaaaaaaaaaacgcgaaatcaaaactttttaaaacccaacgcgacgccttcctccgaaaacgaatacgactacgcgcgccgtatacccgtatccgaaaaacgacgaactaaacgcgaaccgcgcgaacgaacaaacgacgaacgaacaacaaacgaaacaacaacccgaacgacaacaacgtcgcgacgacgacgacaacgaccgctccgcgcctcgcctcaccgacctcgctaacctcacctcgccgcgcccgaacccgccacccccgcatccccgcccgacctccgcaacccccgtctcgaccgacaacgcccaccgcctacccgaaacgaaaaacgaaatacgaaacgcaaaaacaccgaaaccaatacccgccgaccccgcaaatcaaacccaaccaaaaaaacccccgcctaaccccgtacaacaccgcgacgccgaaaaaactctaaacaacttcgacgacgctcctctaaacaacaacgccgacgacgcgaacgccgacgacactaacgactcgaacgacgacgaaaacgaactaaacataaccaaacgactaacgctcaataactccacgaataaccgatctaacgacttttaacgccgctaacaaccgcgcatcttaacgctcttcgaaaacccgtactcgtcccgctacgcacgaataaataacaatttacccatcaaaaaaacgaaactaaaaaacaacgtcctatacctccccgcaaacaaaaataaaccgaaaaactaacgcctaaaaaattcaaaatcgaaaaaaaatatattcacatatatacacgtaccaaaataacatataaaatatatccgccgaattctaat

SEQ ID NO: 2393 - DNA, 585 bp, Artificial Sequence
  chemically treated genomic DNA (Homo sapiens) CpG-island No: 2393
ggttttatttagagtttttttagagtcgcgttgcgtttcgttcgtacgtaaatttcgtttttttgcgtttttttattcgtagcgtttaggattttagaaagggtttgtttcgcgcgaatttttagtcgttgggatttatttggttattaggtttatagatttcgtagtcgttgagagttagagaagagttcggagagcgttatggttcggggacgtcggggtcgggaagcgtcgtggttcgggaggacgttgttttcgtagtagcgcgagggaggggtaggatcggggcggttgtttcgcgggttcggaacgggaattggttgcgattatagtcgtagtcgcgtttttttgttggcgcgtttaagagtttgtcggttgttgggagaggtcgtcgaagggcgggggcggttaaggtagggttttacggtgttgttattcgttcgggtttggcgcgggggggcgagagaagttgcgcgtagagggacgttcggtgcgagagggtgagtttttggttatcgcgtagggtcgagtggataggtttaagttcgtttagaggtgatatatttgggaatttgtggtgttatt

SEQ ID NO: 2394 - DNA, 585 bp, Artificial Sequence
  chemically treated genomic DNA (Homo sapiens) CpG-island No: 2394
aataacaccacaaattcccaaatatatcacctctaaacgaacttaaacctatccactcgaccctacgcgataaccaaaaactcaccctctcgcaccgaacgtccctctacgcgcaacttctctcgcccccccgcgccaaacccgaacgaataacaacaccgtaaaaccctaccttaaccgcccccgcccttcgacgacctctcccaacaaccgacaaactcttaaacgcgccaacaaaaaaacgcgactacgactataatcgcaaccaattcccgttccgaacccgcgaaacaaccgccccgatcctacccctccctcgcgctactacgaaaacaacgtcctcccgaaccacgacgcttcccgaccccgacgtccccgaaccataacgctctccgaactcttctctaactctcaacgactacgaaatctataaacctaataaccaaataaatcccaacgactaaaaattcgcgcgaaacaaaccctttctaaaatcctaaacgctacgaataaaaaaacgcaaaaaaacgaaatttacgtacgaacgaaacgcaacgcgactctaaaaaaactctaaataaaacc

SEQ ID NO: 2395 - DNA, 585 bp, Artificial Sequence
  chemically treated genomic DNA (Homo sapiens) CpG-island No: 2395
gatggtattataaatttttaagtgtgttatttttgggcgaatttgggtttgtttattcggttttgcgcggtggttaggggtttattttttcgtatcgggcgtttttttgcgcgtagtttttttcgttttttcgcgttagattcgggcgaatggtagtatcgtgggattttgttttgatcgttttcgtttttcggcggttttttttagtagtcggtaggtttttgggcgcgttaatagaggggcgcggttgcggttgtagtcgtagttagttttcgtttcgggttcgcgaggtagtcgtttcggttttgtttttttttcgcgttattgcgggagtagcgttttttcgggttacggcgtttttcggtttcggcgttttcggattatggcgtttttcgggtttttttttagtttttagcggttgcgaagtttgtaaatttggtggttaagtaagttttagcgattggggattcgcgcggggtaggttttttttgaggttttgggcgttgcgagtgaggaggcgtagggaggcgggatttgcgtgcgggcggaacgtagcgcggttttggaggagttttgggtggaatt

SEQ ID NO: 2396 - DNA, 585 bp, Artificial Sequence
  chemically treated genomic DNA (Homo sapiens) CpG-island No: 2396
aattccacccaaaactcctccaaaaccgcgctacgttccgcccgcacgcaaatcccgcctccctacgcctcctcactcgcaacgcccaaaacctcaaaaaaaacctaccccgcgcgaatccccaatcgctaaaacttacttaaccaccaaatttacaaacttcgcaaccgctaaaaactaaaaaaaaacccgaaaaacgccataatccgaaaacgccgaaaccgaaaaacgccgtaacccgaaaaaacgctactcccgcaataacgcgaaaaaaaaacaaaaccgaaacgactacctcgcgaacccgaaacgaaaactaactacgactacaaccgcaaccgcgcccctctattaacgcgcccaaaaacctaccgactactaaaaaaaaccgccgaaaaacgaaaacgatcaaaacaaaatcccacgatactaccattcgcccgaatctaacgcgaaaaaacgaaaaaaactacgcgcaaaaaaacgcccgatacgaaaaaataaacccctaaccaccgcgcaaaaccgaataaacaaacccaaattcgcccaaaaataacacacttaaaaatttataataccatc

SEQ ID NO: 2397 - DNA, 597 bp, Artificial Sequence
  chemically treated genomic DNA (Homo sapiens) CpG-island No: 2397
agagcgacgaggtgagggaagaaaaaaggggcgggtaagagagagttgggaattttaaagcgttaattgcgtgcgcggcgtacgcgtatttgggatcggcggagggtgttgggtttttaggttttacgtttgagggttgtcgtttgtttttcggttcggtcgggaatagcgagggttttcgttgttttgtcgtcgggttttgcgtcgttttattgttttttcggttgagtatttattattcgattgtttcgtttttttatggtgttggatcgagcgtatagtagtacgtcgagggaaatcgggtcggagagattgtcgaagagggtttgtcgtaggtttttttgtcgtttttttatttcgtttagagagcggtattacgcggattcgacggtcgcgttttgttatagcgttttttatttttgtggaggataggtcggttttagagatcgttgtagttggcggagcgtttgtaggagttcggtcgtttattaggtatttaagagtaggcgacgttgcgtttttgtatcggagttttattaaggtagttcgttttagtttggttttggattgttttgtttttttttatttttttttttt

SEQ ID NO: 2398 - DNA, 597 bp, Artificial Sequence
  chemically treated genomic DNA (Homo sapiens) CpG-island No: 2398
aaaaaaaaaaaataaaaaaaaacaaaacaatccaaaaccaaactaaaacgaactaccttaataaaactccgatacaaaaacgcaacgtcgcctactcttaaatacctaataaacgaccgaactcctacaaacgctccgccaactacaacgatctctaaaaccgacctatcctccacaaaaataaaaaacgctataacaaaacgcgaccgtcgaatccgcgtaataccgctctctaaacgaaataaaaaaacgacaaaaaaacctacgacaaaccctcttcgacaatctctccgacccgatttccctcgacgtactactatacgctcgatccaacaccataaaaaaacgaaacaatcgaataataaatactcaaccgaaaaaacaataaaacgacgcaaaacccgacgacaaaacaacgaaaaccctcgctattcccgaccgaaccgaaaaacaaacgacaaccctcaaacgtaaaacctaaaaacccaacaccctccgccgatcccaaatacgcgtacgccgcgcacgcaattaacgctttaaaattcccaactctctcttacccgccccttttttcttccctcacctcgtcgctct

SEQ ID NO: 2399 - DNA, 597 bp, Artificial Sequence
  chemically treated genomic DNA (Homo sapiens) CpG-island No: 2399
aaaaaaaaagaatggaagaaagtaaaataatttaaggttaaattgaagcgagttgttttggtggggtttcggtgtagaagcgtagcgtcgtttgtttttgggtgtttaatgaacgatcggatttttgtaggcgtttcgttaattgtagcgatttttggagtcggtttgttttttatagagatagggggcgttgtagtagagcgcggtcgtcgagttcgcgtggtgtcgttttttaggcggagtggggaggcggtaagaggatttgcggtaggtttttttcggtagttttttcggttcggtttttttcggcgtgttattgtgcgttcgatttagtattatggggaagcgggataatcgggtggtgagtatttagtcgggaaaatagtggggcgacgtagggttcggcggtaggatagcgagaattttcgttgttttcggtcgggtcggagggtaagcggtagtttttagacgtggggtttggagatttagtatttttcgtcgattttagatgcgcgtgcgtcgcgtacgtagttggcgttttagggtttttagtttttttttgttcgttttttttttttttttttatttcgtcgtttt

SEQ ID NO: 2400 - DNA, 597 bp, Artificial Sequence
  chemically treated genomic DNA (Homo sapiens) CpG-island No: 2400
aaaacgacgaaataaaaaaaaaaaaaaaaaacgaacaaaaaaaaactaaaaaccctaaaacgccaactacgtacgcgacgcacgcgcatctaaaatcgacgaaaaatactaaatctccaaaccccacgtctaaaaactaccgcttaccctccgacccgaccgaaaacaacgaaaattctcgctatcctaccgccgaaccctacgtcgccccactattttcccgactaaatactcaccacccgattatcccgcttccccataatactaaatcgaacgcacaataacacgccgaaaaaaaccgaaccgaaaaaactaccgaaaaaaacctaccgcaaatcctcttaccgcctccccactccgcctaaaaaacgacaccacgcgaactcgacgaccgcgctctactacaacgccccctatctctataaaaaacaaaccgactccaaaaatcgctacaattaacgaaacgcctacaaaaatccgatcgttcattaaacacccaaaaacaaacgacgctacgcttctacaccgaaaccccaccaaaacaactcgcttcaatttaaccttaaattattttactttcttccattcttttttttt

SEQ ID NO: 2401 - DNA, 581 bp, Artificial Sequence
  chemically treated genomic DNA (Homo sapiens) CpG-island No: 2401
aggaggcggcggcggcggcggcggcggcggcggagggcggggagggagcgcgcgcgtggttcgcggcgttcgggtttttttttagttttcgatttcggttcgcgacgcgtcgttttttagtcgtcgtcgttcgtttcgtagttgggatttatttcgggtttggggattcggcgggcgggagaagcgggggttttcggcgcggtttggaaggagcgagaaagtaaaagtaaggcgagtagtattttaagtttttttaatttcgttttttgcggcggtaggcgttttgttgtttagcgcgtttttttcgagttcgagagtggttgaaagaaaagggattgggcgggggtcggggcggaggaagagagagtgcgagggagcgaggagagttcggtaatatttgttaaaatttgggggaggaggagcgcggggaggaggaggaagaggaggagagaagggaaggagggagcgcgcgggaggggagcgcggagtcgagggataatttttttatttcgtgagtagtgtaggcggtgttaggtcggggcggggggtttttttatttagtacggggtattaggtcggga

SEQ ID NO: 2402 - DNA, 581 bp, Artificial Sequence
  chemically treated genomic DNA (Homo sapiens) CpG-island No: 2402
tcccgacctaataccccgtactaaataaaaaaaccccccgccccgacctaacaccgcctacactactcacgaaataaaaaaattatccctcgactccgcgctcccctcccgcgcgctccctccttcccttctctcctcctcttcctcctcctccccgcgctcctcctcccccaaattttaacaaatattaccgaactctcctcgctccctcgcactctctcttcctccgccccgacccccgcccaatcccttttctttcaaccactctcgaactcgaaaaaaacgcgctaaacaacaaaacgcctaccgccgcaaaaaacgaaattaaaaaaacttaaaatactactcgccttacttttactttctcgctccttccaaaccgcgccgaaaacccccgcttctcccgcccgccgaatccccaaacccgaaataaatcccaactacgaaacgaacgacgacgactaaaaaacgacgcgtcgcgaaccgaaatcgaaaactaaaaaaaaacccgaacgccgcgaaccacgcgcgcgctccctccccgccctccgccgccgccgccgccgccgccgccgcctcct

SEQ ID NO: 2403 - DNA, 581 bp, Artificial Sequence
  chemically treated genomic DNA (Homo sapiens) CpG-island No: 2403
tttcggtttggtgtttcgtgttgggtggagaagtttttcgtttcgatttggtatcgtttgtattatttacggggtggaaaagttgtttttcggtttcgcgtttttttttcgcgcgttttttttttttttttttttttttttttttttttttttttcgcgtttttttttttttaagttttaatagatgttgtcggatttttttcgttttttcgtatttttttttttttcgtttcggttttcgtttagtttttttttttttagttattttcgggttcggaggggacgcgttgagtagtaggacgtttgtcgtcgtagggggcgaagttgggaaaatttggagtgttgttcgttttatttttgttttttcgttttttttaggtcgcgtcgggagttttcgtttttttcgttcgtcgggtttttaagttcggagtgggttttagttgcgaggcgggcggcggcggttgggaggcggcgcgtcgcgggtcggggtcgggggttgggggggagttcgggcgtcgcgagttacgcgcgcgtttttttttcgtttttcgtcgtcgtcgtcgtcgtcgtcgtcgtttttt

SEQ ID NO: 2404 - DNA, 581 bp, Artificial Sequence
  chemically treated genomic DNA (Homo sapiens) CpG-island No: 2404
aaaaaacgacgacgacgacgacgacgacgacgaaaaacgaaaaaaaaacgcgcgcgtaactcgcgacgcccgaactcccccccaacccccgaccccgacccgcgacgcgccgcctcccaaccgccgccgcccgcctcgcaactaaaacccactccgaacttaaaaacccgacgaacgaaaaaaacgaaaactcccgacgcgacctaaaaaaaacgaaaaaacaaaaataaaacgaacaacactccaaattttcccaacttcgccccctacgacgacaaacgtcctactactcaacgcgtcccctccgaacccgaaaataactaaaaaaaaaaaaactaaacgaaaaccgaaacgaaaaaaaaaaaaatacgaaaaaacgaaaaaaatccgacaacatctattaaaacttaaaaaaaaaaaaacgcgaaaaaaaaaaaaaaaaaaaaaaaaaaaaaaaaaaaaaaaacgcgcgaaaaaaaaacgcgaaaccgaaaaacaacttttccaccccgtaaataatacaaacgataccaaatcgaaacgaaaaacttctccacccaacacgaaacaccaaaccgaaa

SEQ ID NO: 2405 - DNA, 931 bp, Artificial Sequence
  chemically treated genomic DNA (Homo sapiens) CpG-island No: 2405
acgattttcgaaattgatgtcggagttgtacgagcgggagggagcgggtaggggtagcgttatcggcgcgttcgtatattcgtattcgcgtatattcgtcgtttttatttattcgcgtcgttttttcgtttttttcgcgcgtttcgcggtcgttcgcgtcgtattatgttcgcggcgggcgtatttcgcgtttagttcggtcgttcgcggtagtcgtagtcgttcgcggtcgcgcggagcggggagtcgttagtttgcgtttcgttcgcgggtttatgggaagttcggggatttgatagtcgttgtcgtcgtaggtacgtttcgttcgaagttttttgtttcgcggatttcgtagttcgtttttgcggtcgcgttcgcgttttcggggttagaggtggtttttagcgtggggacgggatggagtgaaaatggttgttaaaaggcgtttagatttagagagtcgtcggtgaggcgttcgagtaaggtttgtattcgttttttttttttggaaggtttttttcgaagagttcgattcgcggatcggtcggagacggattggagaattttatttttcggaggggggacgaagtttgtcgtagtggtggcggcgtttttcgttttcgtttttatttaaagggtttagaagaatttcgcgagtttcgtacgcgtttggtttttttttttgcgcggtggcgttttacggttcgggtttcgggcgcgtacggcgttcgggatgggcggaaggaggcgggaggtatggtgggtgcgcgcggggattttcgtcgcgggggtcgtcgtcgttggggtttttttagttcgggttatgtttcggagggcgggggtgtggtgtgagcggatggagagaggcgcgttttcgtcgttatagaggaaaagtgaaagttgtattatttgtatatgatttgggattttt

SEQ ID NO: 2406 - DNA, 931 bp, Artificial Sequence
  chemically treated genomic DNA (Homo sapiens) CpG-island No: 2406
aaaaatcccaaatcatatacaaataatacaactttcacttttcctctataacgacgaaaacgcgcctctctccatccgctcacaccacacccccgccctccgaaacataacccgaactaaaaaaaccccaacgacgacgacccccgcgacgaaaatccccgcgcgcacccaccatacctcccgcctccttccgcccatcccgaacgccgtacgcgcccgaaacccgaaccgtaaaacgccaccgcgcaaaaaaaaaaaccaaacgcgtacgaaactcgcgaaattcttctaaaccctttaaataaaaacgaaaacgaaaaacgccgccaccactacgacaaacttcgtcccccctccgaaaaataaaattctccaatccgtctccgaccgatccgcgaatcgaactcttcgaaaaaaaccttccaaaaaaaaaaaacgaatacaaaccttactcgaacgcctcaccgacgactctctaaatctaaacgccttttaacaaccattttcactccatcccgtccccacgctaaaaaccacctctaaccccgaaaacgcgaacgcgaccgcaaaaacgaactacgaaatccgcgaaacaaaaaacttcgaacgaaacgtacctacgacgacaacgactatcaaatccccgaacttcccataaacccgcgaacgaaacgcaaactaacgactccccgctccgcgcgaccgcgaacgactacgactaccgcgaacgaccgaactaaacgcgaaatacgcccgccgcgaacataatacgacgcgaacgaccgcgaaacgcgcgaaaaaaacgaaaaaacgacgcgaataaataaaaacgacgaatatacgcgaatacgaatatacgaacgcgccgataacgctacccctacccgctccctcccgctcgtacaactccgacatcaatttcgaaaatcgt

SEQ ID NO: 2407 - DNA, 931 bp, Artificial Sequence
  chemically treated genomic DNA (Homo sapiens) CpG-island No: 2407
gagaattttaaattatatatagatggtataatttttattttttttttatgacgacgaaggcgcgtttttttttattcgtttatattatattttcgtttttcgaagtatagttcgggttggagaagttttagcggcggcggttttcgcggcggaggttttcgcgcgtatttattatgtttttcgttttttttcgtttatttcgagcgtcgtgcgcgttcgaagttcgagtcgtagagcgttatcgcgtaaaggaaggagttaggcgcgtgcggggttcgcggagtttttttgaattttttggatgggggcggaggcgaggggcgtcgttattattgcggtaaatttcgtttttttttcgggaggtgaaattttttaattcgttttcggtcggttcgcgggtcggatttttcggaaaggattttttaggaggagggagcgaatgtaagttttgttcggacgttttatcggcggttttttaaatttgggcgttttttgatagttatttttattttatttcgtttttacgttggggattatttttggtttcggaggcgcgggcgcggtcgtaggagcgggttgcggggttcgcgaaataaagaatttcgagcgggacgtatttgcggcggtagcggttgttaagttttcgaattttttatagattcgcggacggggcgtaggttggcggtttttcgtttcgcgcggtcgcgggcggttacggttatcgcgagcggtcgggttgggcgcggggtgcgttcgtcgcgggtatggtgcggcgcgggcggtcgcggggcgcgcggggaaggcgggagagcggcgcgggtgagtgggagcggcgggtgtgcgcgagtgcgagtgtgcgagcgcgtcggtggcgttgtttttgttcgttttttttcgttcgtgtagtttcggtattagtttcggggatcgt

SEQ ID NO: 2408 - DNA, 931 bp, Artificial Sequence
  chemically treated genomic DNA (Homo sapiens) CpG-island No: 2408
acgatccccgaaactaataccgaaactacacgaacgaaaaaaaacgaacaaaaacaacgccaccgacgcgctcgcacactcgcactcgcgcacacccgccgctcccactcacccgcgccgctctcccgccttccccgcgcgccccgcgaccgcccgcgccgcaccatacccgcgacgaacgcaccccgcgcccaacccgaccgctcgcgataaccgtaaccgcccgcgaccgcgcgaaacgaaaaaccgccaacctacgccccgtccgcgaatctataaaaaattcgaaaacttaacaaccgctaccgccgcaaatacgtcccgctcgaaattctttatttcgcgaaccccgcaacccgctcctacgaccgcgcccgcgcctccgaaaccaaaaataatccccaacgtaaaaacgaaataaaataaaaataactatcaaaaaacgcccaaatttaaaaaaccgccgataaaacgtccgaacaaaacttacattcgctccctcctcctaaaaaatcctttccgaaaaatccgacccgcgaaccgaccgaaaacgaattaaaaaatttcacctcccgaaaaaaaaacgaaatttaccgcaataataacgacgcccctcgcctccgcccccatccaaaaaattcaaaaaaactccgcgaaccccgcacgcgcctaactccttcctttacgcgataacgctctacgactcgaacttcgaacgcgcacgacgctcgaaataaacgaaaaaaaacgaaaaacataataaatacgcgcgaaaacctccgccgcgaaaaccgccgccgctaaaacttctccaacccgaactatacttcgaaaaacgaaaatataatataaacgaataaaaaaaaacgcgccttcgtcgtcataaaaaaaaaataaaaattataccatctatatataatttaaaattctc

SEQ ID NO: 2409 - DNA, 661 bp, Artificial Sequence
  chemically treated genomic DNA (Homo sapiens) CpG-island No: 2409
gttgatcgtgtttagtaggaaggatagttcgatcgagaggtcgtttagtatggagaagagtagttcgaaggttacgttttcggattcggcgtttagcgttaggaagtattaggatttcgggtattgtacggtgtagcgatttacgtttagtaggggtagtaggtttagcgttagcgcggtcgtttatattagttttacggtggtttaggcgcggcgttgcgaggcgatcgtcgggcgcgagaagggtcgggtgatatttaggtagcgttttgaggttatggcggtttttagtagtagcggggataggtcgaagaagattatgacgacgtttatgaagcgatagagacggtagttagggtttacggcgtgttattcgaagagcgcggcgtgttgggatattacgatggtatcggttattagtagttttaggaagtcggtgaggacgaggtcgtagaggaaggtgaggaaggaggagcgcgtgtgcgaatttttttgtcgcgcgttcgttagtacgtttagggttagtaggttggaggttaggtttattacgtagaaggaggcggcgaattagggcgaggcgattagtcgttttttttttagggtaatgtttgtgggtcggaaatagggttttagggaattgtcgttgggttatatggtttcg

SEQ ID NO: 2410 - DNA, 661 bp, Artificial Sequence
  chemically treated genomic DNA (Homo sapiens) CpG-island No: 2410
cgaaaccatataacccaacgacaattccctaaaaccctatttccgacccacaaacattaccctaaaaaaaaaacgactaatcgcctcgccctaattcgccgcctccttctacgtaataaacctaacctccaacctactaaccctaaacgtactaacgaacgcgcgacaaaaaaattcgcacacgcgctcctccttcctcaccttcctctacgacctcgtcctcaccgacttcctaaaactactaataaccgataccatcgtaatatcccaacacgccgcgctcttcgaataacacgccgtaaaccctaactaccgtctctatcgcttcataaacgtcgtcataatcttcttcgacctatccccgctactactaaaaaccgccataacctcaaaacgctacctaaatatcacccgacccttctcgcgcccgacgatcgcctcgcaacgccgcgcctaaaccaccgtaaaactaatataaacgaccgcgctaacgctaaacctactacccctactaaacgtaaatcgctacaccgtacaatacccgaaatcctaatacttcctaacgctaaacgccgaatccgaaaacgtaaccttcgaactactcttctccatactaaacgacctctcgatcgaactatccttcctactaaacacgatcaac

SEQ ID NO: 2411 - DNA, 661 bp, Artificial Sequence
  chemically treated genomic DNA (Homo sapiens) CpG-island No: 2411
cggagttatgtggtttaacggtagttttttggggttttgttttcggtttataaatattattttggaggagagacggttgatcgtttcgttttggttcgtcgtttttttttgcgtggtgggtttggtttttaatttgttggttttgagcgtgttggcgggcgcgcggtaggggggttcgtatacgcgtttttttttttttatttttttttgcggtttcgtttttatcgattttttggggttgttggtgatcggtattatcgtggtgttttagtacgtcgcgtttttcgagtggtacgtcgtggattttggttgtcgtttttgtcgttttatgggcgtcgttatgatttttttcggtttgttttcgttgttgttgggggtcgttatggttttagagcgttatttgggtattattcggtttttttcgcgttcggcggtcgtttcgtagcgtcgcgtttgggttatcgtggggttggtgtgggcggtcgcgttggcgttgggtttgttgtttttgttgggcgtgggtcgttatatcgtgtaatattcggggttttggtgttttttgacgttgggcgtcgagttcggggacgtggttttcgggttgtttttttttatgttgggcggtttttcggtcgggttgttttttttgttgaatacggttagt

SEQ ID NO: 2412 - DNA, 661 bp, Artificial Sequence
  chemically treated genomic DNA (Homo sapiens) CpG-island No: 2412
actaaccgtattcaacaaaaaaaacaacccgaccgaaaaaccgcccaacataaaaaaaaacaacccgaaaaccacgtccccgaactcgacgcccaacgtcaaaaaacaccaaaaccccgaatattacacgatataacgacccacgcccaacaaaaacaacaaacccaacgccaacgcgaccgcccacaccaaccccacgataacccaaacgcgacgctacgaaacgaccgccgaacgcgaaaaaaaccgaataatacccaaataacgctctaaaaccataacgacccccaacaacaacgaaaacaaaccgaaaaaaatcataacgacgcccataaaacgacaaaaacgacaaccaaaatccacgacgtaccactcgaaaaacgcgacgtactaaaacaccacgataataccgatcaccaacaaccccaaaaaatcgataaaaacgaaaccgcaaaaaaaaataaaaaaaaaaaaacgcgtatacgaacccccctaccgcgcgcccgccaacacgctcaaaaccaacaaattaaaaaccaaacccaccacgcaaaaaaaaacgacgaaccaaaacgaaacgatcaaccgtctctcctccaaaataatatttataaaccgaaaacaaaaccccaaaaaactaccgttaaaccacataactccg

SEQ ID NO: 2413 - DNA, 589 bp, Artificial Sequence
  chemically treated genomic DNA (Homo sapiens) CpG-island No: 2413
tatcgtcgatagcggtagcgtttgaagtgaaattatagttggaagatgtcgttggtaaattggtagcggaagtcgtggcggtgcgagtatttttattcgcggttgacgattttgaaagcgatgttttcgtagggcggtttcgcgtggaagcgtaggatggcgaaatttttgttgtcggcgtaggtttttaggaagtattcgggcgtggagcgtttgtcgatgaggtcggggtagaagatgttgaatttgtatttttgtacgattttgggcggtgggttgttaaagtcgtagtgcgtttggttgtatttgttttattcgaagttcgtgtgtacgcggttgaagaagcgcggtttgcgtggtcggtatttgtcggtttataggtaggttttgtcggtgagtggtatttttacgttgaattgcgtttcgttttggtttatgttttttttggttcgtcggaagaagatgttttcggcgttttcgttggcgttttttgcgggcgggacggcgtttattcgggtttcggtttttttttgggttttggttttttttttagtttttttggtaggggcggtcgttggtgtttttcgta

SEQ ID NO: 2414 - DNA, 589 bp, Artificial Sequence
  chemically treated genomic DNA (Homo sapiens) CpG-island No: 2414
tacgaaaaacaccaacgaccgcccctaccaaaaaaactaaaaaaaaaaccaaaacccaaaaaaaaaccgaaacccgaataaacgccgtcccgcccgcaaaaaacgccaacgaaaacgccgaaaacatcttcttccgacgaaccaaaaaaaacataaaccaaaacgaaacgcaattcaacgtaaaaataccactcaccgacaaaacctacctataaaccgacaaataccgaccacgcaaaccgcgcttcttcaaccgcgtacacacgaacttcgaataaaacaaatacaaccaaacgcactacgactttaacaacccaccgcccaaaatcgtacaaaaatacaaattcaacatcttctaccccgacctcatcgacaaacgctccacgcccgaatacttcctaaaaacctacgccgacaacaaaaatttcgccatcctacgcttccacgcgaaaccgccctacgaaaacatcgctttcaaaatcgtcaaccgcgaataaaaatactcgcaccgccacgacttccgctaccaatttaccaacgacatcttccaactataatttcacttcaaacgctaccgctatcgacgata

SEQ ID NO: 2415 - DNA, 589 bp, Artificial Sequence
  chemically treated genomic DNA (Homo sapiens) CpG-island No: 2415
tgcgggaggtattagcggtcgtttttgttagagaggttaggagggaggttaggatttagggggaggtcgaggttcgggtgaacgtcgtttcgttcgtaggagacgttagcgagagcgtcgaggatattttttttcggcgggttaaggagggtatgggttaggacgaggcgtagtttagcgtggagatgttatttatcggtaaggtttatttgtgggtcgataagtatcggttacgtaagtcgcgtttttttaatcgcgtgtatacgggtttcgagtggaataagtataattagacgtattacgattttgataatttatcgtttaagatcgtgtagggatataagtttaatattttttatttcgattttatcgataagcgttttacgttcgagtattttttggaggtttgcgtcgataataaggatttcgttattttgcgtttttacgcggggtcgttttacgaggatatcgtttttaagatcgttaatcgcgagtgggaatattcgtatcgttacggttttcgttgttagtttgttaacggtattttttagttgtggttttattttaagcgttatcgttatcggcggtg

SEQ ID NO: 2416 - DNA, 589 bp, Artificial Sequence
  chemically treated genomic DNA (Homo sapiens) CpG-island No: 2416
caccgccgataacgataacgcttaaaataaaaccacaactaaaaaataccgttaacaaactaacaacgaaaaccgtaacgatacgaatattcccactcgcgattaacgatcttaaaaacgatatcctcgtaaaacgaccccgcgtaaaaacgcaaaataacgaaatccttattatcgacgcaaacctccaaaaaatactcgaacgtaaaacgcttatcgataaaatcgaaataaaaaatattaaacttatatccctacacgatcttaaacgataaattatcaaaatcgtaatacgtctaattatacttattccactcgaaacccgtatacacgcgattaaaaaaacgcgacttacgtaaccgatacttatcgacccacaaataaaccttaccgataaataacatctccacgctaaactacgcctcgtcctaacccataccctccttaacccgccgaaaaaaaatatcctcgacgctctcgctaacgtctcctacgaacgaaacgacgttcacccgaacctcgacctccccctaaatcctaacctccctcctaacctctctaacaaaaacgaccgctaatacctcccgca

SEQ ID NO: 2417 - DNA, 1038 bp, Artificial Sequence
  chemically treated genomic DNA (Homo sapiens) CpG-island No: 2417
ggcgcgcggcggttcgagagattttattttggggttttaacgttttgggtttttttagttcgaggtttttatttacgtttcggcgatttttttattcgtagtagttagcgttggaagaaaggaacgcgtcggcggttttaggttttcggtttcggttttttttagttcggggttttttcgtttcggttttcggttatattgattcgaaagaggcgcgtagtggtcgcggagcgtagggcggtttagtttagcgcgtcgagcgttagtagtagtagttcgggcggcgttaggtgcgcgtgtttagttaggtcgcgacgcgttagtttttagtcgtagttcgtgtagtttcgcgtcgtcgttagcgcgttgttttagtcgcgttgtattagttgcgcgtagttcggtatgggttcgggtttcgtcggtttcgtcgcgggtttcgtcgtcgttatatcgttcgttcgttcgtcgtgttcgtcgtttgcgttcgttcgcggtagtcgacggagtcgcgcgtttcgcgttacgcgtcgtagttgggtcgggggcgcgcgggcgggagagcggagggcggaggggcgggatcggcgtaagtttcgtttcgttgggggcgcggttggggggcggttagcggggacgcggggcgttttggaggcgggttcgcgtttttgttcgttttttagtagagaaatttaggcgcgggggtcggagttgggggttcgttggatttggatttcgagagatttcgcgtatcgtcgtgtcgcgtttttatgtttgtttcgcgcgtttttcgtttttttattttatcgcgtcgtgttcgtgacggggggtacgggggatattagtaggtagttttttcgattggcgattttcgtttttttcggttttttagtacgttacgtcgttttcgttttatcgtttcggttcgtttcgattttatcgtttttggagttttcgtttttttttaaggattcgaggtttggtacgttttggtatagttttgggattatttcgtggttttttcgtatttaggaggcg

SEQ ID NO: 2418 - DNA, 1038 bp, Artificial Sequence
  chemically treated genomic DNA (Homo sapiens) CpG-island No: 2418
cgcctcctaaatacgaaaaaaccacgaaataatcccaaaactataccaaaacgtaccaaacctcgaatccttaaaaaaaaacgaaaactccaaaaacgataaaatcgaaacgaaccgaaacgataaaacgaaaacgacgtaacgtactaaaaaaccgaaaaaaacgaaaatcgccaatcgaaaaaactacctactaatatcccccgtaccccccgtcacgaacacgacgcgataaaataaaaaaacgaaaaacgcgcgaaacaaacataaaaacgcgacacgacgatacgcgaaatctctcgaaatccaaatccaacgaacccccaactccgacccccgcgcctaaatttctctactaaaaaacgaacaaaaacgcgaacccgcctccaaaacgccccgcgtccccgctaaccgccccccaaccgcgcccccaacgaaacgaaacttacgccgatcccgcccctccgccctccgctctcccgcccgcgcgcccccgacccaactacgacgcgtaacgcgaaacgcgcgactccgtcgactaccgcgaacgaacgcaaacgacgaacacgacgaacgaacgaacgatataacgacgacgaaacccgcgacgaaaccgacgaaacccgaacccataccgaactacgcgcaactaatacaacgcgactaaaacaacgcgctaacgacgacgcgaaactacacgaactacgactaaaaactaacgcgtcgcgacctaactaaacacgcgcacctaacgccgcccgaactactactactaacgctcgacgcgctaaactaaaccgccctacgctccgcgaccactacgcgcctctttcgaatcaatataaccgaaaaccgaaacgaaaaaaccccgaactaaaaaaaaccgaaaccgaaaacctaaaaccgccgacgcgttcctttcttccaacgctaactactacgaataaaaaaatcgccgaaacgtaaataaaaacctcgaactaaaaaaacccaaaacgttaaaaccccaaaataaaatctctcgaaccgccgcgcgcc

SEQ ID NO: 2419 - DNA, 1038 bp, Artificial Sequence
  chemically treated genomic DNA (Homo sapiens) CpG-island No: 2419
cgttttttgaatgcgggagggttacgggatggttttaagattgtgttaaggcgtgttaggtttcgggtttttgagaaggagcgagggttttaagaacggtgaggtcggagcgggtcggggcgatggagcgggagcggcgtggcgtgttggagggtcgggagaagcgggggtcgttagtcgaggggattgtttgttagtgtttttcgtgtttttcgttacgggtacggcgcggtggggtgggggagcggggggcgcgcggggtaggtatgggggcgcgatacggcggtgcgcggggtttttcggggtttaggtttaacgggtttttagtttcggttttcgcgtttgggtttttttgttgggaaacgggtaggggcgcgggttcgtttttagggcgtttcgcgttttcgttggtcgttttttagtcgcgtttttagcggggcggagtttgcgtcggtttcgttttttcgtttttcgttttttcgttcgcgcgttttcggtttagttgcggcgcgtgacgcggggcgcgcggtttcgtcggttatcgcgggcgggcgtaggcgacgggtacggcgggcgagcgggcggtatggcggcggcggggttcgcggcggggtcgacggggttcgagtttatgtcgagttacgcgtagttagtgtagcgcggttggggtagcgcgttggcggcggcgcggggttgtacggattgcggttgggggttggcgcgtcgcggtttggttgagtacgcgtatttggcgtcgttcgagttgttgttgttggcgttcggcgcgttgggttggatcgttttgcgtttcgcggttattgcgcgtttttttcgggttagtgtggtcgggggtcgggacgaggggatttcggattgggggaagtcgggatcggggatttggggtcgtcggcgcgttttttttttttagcgttggttgttgcggatgaaggggtcgtcggaacgtgggtgggggtttcgggttggagaggtttaggacgttggagttttaggataaggtttttcgggtcgtcgcgcgtt

SEQ ID NO: 2420 - DNA, 1038 bp, Artificial Sequence
  chemically treated genomic DNA (Homo sapiens) CpG-island No: 2420
aacgcgcgacgacccgaaaaaccttatcctaaaactccaacgtcctaaacctctccaacccgaaacccccacccacgttccgacgaccccttcatccgcaacaaccaacgctaaaaaaaaaaaacgcgccgacgaccccaaatccccgatcccgacttcccccaatccgaaatcccctcgtcccgacccccgaccacactaacccgaaaaaaacgcgcaataaccgcgaaacgcaaaacgatccaacccaacgcgccgaacgccaacaacaacaactcgaacgacgccaaatacgcgtactcaaccaaaccgcgacgcgccaacccccaaccgcaatccgtacaaccccgcgccgccgccaacgcgctaccccaaccgcgctacactaactacgcgtaactcgacataaactcgaaccccgtcgaccccgccgcgaaccccgccgccgccataccgcccgctcgcccgccgtacccgtcgcctacgcccgcccgcgataaccgacgaaaccgcgcgccccgcgtcacgcgccgcaactaaaccgaaaacgcgcgaacgaaaaaacgaaaaacgaaaaaacgaaaccgacgcaaactccgccccgctaaaaacgcgactaaaaaacgaccaacgaaaacgcgaaacgccctaaaaacgaacccgcgcccctacccgtttcccaacaaaaaaacccaaacgcgaaaaccgaaactaaaaacccgttaaacctaaaccccgaaaaaccccgcgcaccgccgtatcgcgcccccatacctaccccgcgcgccccccgctcccccaccccaccgcgccgtacccgtaacgaaaaacacgaaaaacactaacaaacaatcccctcgactaacgacccccgcttctcccgaccctccaacacgccacgccgctcccgctccatcgccccgacccgctccgacctcaccgttcttaaaaccctcgctccttctcaaaaacccgaaacctaacacgccttaacacaatcttaaaaccatcccgtaaccctcccgcattcaaaaaacg

SEQ ID NO: 2421 - DNA, 578 bp, Artificial Sequence
  chemically treated genomic DNA (Homo sapiens) CpG-island No: 2421
tttaagtcgattttcggtcggcgcgtttcgttttagaaggttttggtataggcgggcggtgtcgggcgttagtttttgcgggcgtgggtcggttagggcgcgtgggtttggggattcggggttacggtcgttacgtgagtttattttcgaggcggtagcgtggtcggtattcgttcgttggtttggttcggcgagcgtgggcggcgaacgggttttcgtcggatgtacgttggtgggatttagggttagagggcgtcgtcggggaaggttatttagacgcgcggttcgtcgggtttttacgcggtcgtttttgtattttcgttcgtaagttcgggtcgtttttcgtcgttagtcgtaggcgtttttggattttcggtttcgcgttttttagtttagatttgttcggtattcgtttgtgcggttttttttgttcgttcgtttattagttaggttcgcgtcggtcgttcgcgattttttttcgcggtcgggttgtcggggtttttcgttcgttttttttttagcgttttttttttagttttttaggggtttggttttcgtcgtttagggcgtaaggaagt

SEQ ID NO: 2422 - DNA, 578 bp, Artificial Sequence
  chemically treated genomic DNA (Homo sapiens) CpG-island No: 2422
acttccttacgccctaaacgacgaaaaccaaacccctaaaaaactaaaaaaaaaacgctaaaaaaaaaacgaacgaaaaaccccgacaacccgaccgcgaaaaaaaatcgcgaacgaccgacgcgaacctaactaataaacgaacgaacaaaaaaaaccgcacaaacgaataccgaacaaatctaaactaaaaaacgcgaaaccgaaaatccaaaaacgcctacgactaacgacgaaaaacgacccgaacttacgaacgaaaatacaaaaacgaccgcgtaaaaacccgacgaaccgcgcgtctaaataaccttccccgacgacgccctctaaccctaaatcccaccaacgtacatccgacgaaaacccgttcgccgcccacgctcgccgaaccaaaccaacgaacgaataccgaccacgctaccgcctcgaaaataaactcacgtaacgaccgtaaccccgaatccccaaacccacgcgccctaaccgacccacgcccgcaaaaactaacgcccgacaccgcccgcctataccaaaaccttctaaaacgaaacgcgccgaccgaaaatcgacttaaa

SEQ ID NO: 2423 - DNA, 578 bp, Artificial Sequence
  chemically treated genomic DNA (Homo sapiens) CpG-island No: 2423
gtttttttgcgttttggacggcgggggttaggtttttggggagttgagagggaggcgttgagggaggagcgggcgaggggtttcggtagttcggtcgcggggagggatcgcgagcggtcggcgcgggtttggttggtgagcgggcgggtagagaaggtcgtataggcgggtgtcgaataggtttgggttggggagcgcgaggtcgagggtttagagacgtttgcggttggcggcgagaggcggttcgggtttgcgggcggaagtgtaagggcggtcgcgtggaggttcggcgggtcgcgcgtttaggtgatttttttcggcggcgttttttggttttggattttattagcgtgtattcggcggggattcgttcgtcgtttacgttcgtcggattaggttagcgggcgggtgtcggttacgttgtcgtttcggggatgagtttacgtgacgatcgtggtttcgagtttttaggtttacgcgttttggtcggtttacgttcgtagaagttggcgttcggtatcgttcgtttgtgttagagttttttagagcggaacgcgtcggtcgagagtcgatttagg

SEQ ID NO: 2424 - DNA, 578 bp, Artificial Sequence
  chemically treated genomic DNA (Homo sapiens) CpG-island No: 2424
cctaaatcgactctcgaccgacgcgttccgctctaaaaaactctaacacaaacgaacgataccgaacgccaacttctacgaacgtaaaccgaccaaaacgcgtaaacctaaaaactcgaaaccacgatcgtcacgtaaactcatccccgaaacgacaacgtaaccgacacccgcccgctaacctaatccgacgaacgtaaacgacgaacgaatccccgccgaatacacgctaataaaatccaaaaccaaaaaacgccgccgaaaaaaatcacctaaacgcgcgacccgccgaacctccacgcgaccgcccttacacttccgcccgcaaacccgaaccgcctctcgccgccaaccgcaaacgtctctaaaccctcgacctcgcgctccccaacccaaacctattcgacacccgcctatacgaccttctctacccgcccgctcaccaaccaaacccgcgccgaccgctcgcgatccctccccgcgaccgaactaccgaaacccctcgcccgctcctccctcaacgcctccctctcaactccccaaaaacctaacccccgccgtccaaaacgcaaaaaaac

SEQ ID NO: 2425 - DNA, 581 bp, Artificial Sequence
  chemically treated genomic DNA (Homo sapiens) CpG-island No: 2425
gtggcggcgggttcggaggcggttacggcgggggttgcgacgcggaggtagggagtcgagttagggagcggagtcgagcgagcggttgggttaagggcggggcggcgcggacggcggcggcgcggattcgtttttttttttgcgcgttcggttcggcgcgtttcgtttttaggtttcgttcgggatagcgtttaggtcgggttagggtttttatttcgttagcgagtcgcgtttttattttttcgggtttcgttgtttcggtagtagatataggagtttgcgggcgtgttgcgggcgcgcgggaggatttgcgtgagtcggggtacggggaggcgtcggattgacgtgtgtatcgtgtgtgcgtgcgtagggatacgcgggtttttgttggaaatttcggttttagtggtagcgttcgggaagggggaggaggtttttcgattttttgagttgtggttcggaggtttttgcgttaatggaagacgcgcggggtttttgggttttttgtttggttttcgcgttgttagatttttcgggagttgatgtggtcggcgttggatttaagtttcgtttgggtggat

SEQ ID NO: 2426 - DNA, 581 bp, Artificial Sequence
  chemically treated genomic DNA (Homo sapiens) CpG-island No: 2426
atccacccaaacgaaacttaaatccaacgccgaccacatcaactcccgaaaaatctaacaacgcgaaaaccaaacaaaaaacccaaaaaccccgcgcgtcttccattaacgcaaaaacctccgaaccacaactcaaaaaatcgaaaaacctcctcccccttcccgaacgctaccactaaaaccgaaatttccaacaaaaacccgcgtatccctacgcacgcacacacgatacacacgtcaatccgacgcctccccgtaccccgactcacgcaaatcctcccgcgcgcccgcaacacgcccgcaaactcctatatctactaccgaaacaacgaaacccgaaaaaataaaaacgcgactcgctaacgaaataaaaaccctaacccgacctaaacgctatcccgaacgaaacctaaaaacgaaacgcgccgaaccgaacgcgcaaaaaaaaaaacgaatccgcgccgccgccgtccgcgccgccccgcccttaacccaaccgctcgctcgactccgctccctaactcgactccctacctccgcgtcgcaacccccgccgtaaccgcctccgaacccgccgccac

SEQ ID NO: 2427 - DNA, 581 bp, Artificial Sequence
  chemically treated genomic DNA (Homo sapiens) CpG-island No: 2427
gtttatttaggcgaggtttgggtttagcgtcggttatattaattttcgggggatttagtagcgcggaggttaagtaggaggtttaggagtttcgcgcgttttttattagcgtagggattttcgggttatagtttagagaatcggaaggtttttttttttttttcgagcgttgttattggggtcgaggtttttagtaagaattcgcgtgtttttgcgtacgtatatacggtgtatacgttagttcggcgttttttcgtgtttcgatttacgtaggttttttcgcgcgttcgtaatacgttcgtaggtttttgtgtttgttgtcggggtagcggggttcggaagggtaagaacgcggttcgttagcgggatggggattttggttcggtttggacgttgtttcgggcggggtttgggggcggagcgcgtcgggtcgggcgcgtaggaggggaggcgggttcgcgtcgtcgtcgttcgcgtcgtttcgtttttggtttagtcgttcgttcggtttcgttttttggttcggttttttgttttcgcgtcgtagttttcgtcgtagtcgttttcgagttcgtcgttat

SEQ ID NO: 2428 - DNA, 581 bp, Artificial Sequence
  chemically treated genomic DNA (Homo sapiens) CpG-island No: 2428
ataacgacgaactcgaaaacgactacgacgaaaactacgacgcgaaaacaaaaaaccgaaccaaaaaacgaaaccgaacgaacgactaaaccaaaaacgaaacgacgcgaacgacgacgacgcgaacccgcctcccctcctacgcgcccgacccgacgcgctccgcccccaaaccccgcccgaaacaacgtccaaaccgaaccaaaatccccatcccgctaacgaaccgcgttcttacccttccgaaccccgctaccccgacaacaaacacaaaaacctacgaacgtattacgaacgcgcgaaaaaacctacgtaaatcgaaacacgaaaaaacgccgaactaacgtatacaccgtatatacgtacgcaaaaacacgcgaattcttactaaaaacctcgaccccaataacaacgctcgaaaaaaaaaaaaaaaccttccgattctctaaactataacccgaaaatccctacgctaataaaaaacgcgcgaaactcctaaacctcctacttaacctccgcgctactaaatcccccgaaaattaatataaccgacgctaaacccaaacctcgcctaaataaac

SEQ ID NO: 2429 - DNA, 1437 bp, Artificial Sequence
  chemically treated genomic DNA (Homo sapiens) CpG-island No: 2429
gtcggagtacgcggttatttaggtcgaatttcgattcggattcggtacgcggtttcggcgagggcgggcgggagtgttttttttcgggatagtcggattttcgtcgatttttgggcggcggggagggttttaggttcggttttttcgggttttcgtacgcgatgcgcggtttttgtagttgtttcgtgtttcgagacgcgttcgaggtttcggatttttaagcggttatcgcgtcgttagtttcgttgtttagggatatttcggttttagtttttcgcgcgtttattttttcggttttacgcgcgttagttattcgcgtttttcgtcgttttcgggtttcgttcgttcggtttatcgcggtttagttcgtttcggagttcggttttatttattcgcgcgcggtggtggcgggatttcgggttcggttttcggagcggcgcggcgcggttcgggtttatgcgtttagcggtagcgcggcgggcgggattcggcgggggcgcggttcggggcggtttttatttcggcggttgcggttcggcggttcggaggcggacgcggggtaggtcgcgggggcgtcgtaggggtttagtcgttagtttttattcgttcgtttcgcgtggacgcggtttcgggtcgatttcggtcggttttggcggcggtagcggttacgatcgtttttcgagttagagttcgagttagagcgtcgaagtttaggttcgagcgttttcgtcggcggcgttcggaagtgcgggggcggggtcggggcgcggggacgaggtgagagcgcggggcggggttttaatacggggcggggtcggtagcgcggggacgaggtaaagggtgtggggcggggttttaggcgcggggcggggttgaaagcgcgaggataaagtgaggagcgtggggcggggtcgatagcgaggggataggtgaggagcgcggggcggggtcggggcgtgggcggggtcggaagcgagaagacgaggtgaagagttcggggcggggtttcgggcgtggggcggggattagggagtaaggcggggttcgtttcgagtagaagaggtaaagagcgtggggcggggttttcggcgcggggcggggtcggaagcgagaagacgagttgagaaatatgggtcggggtttttgtatggtcgggagagggcgtggttagtgtttgtcgggggcggggcgtgtcgggggcgcggtcgcgtcgttttttcgaggggcggtgcggaagcggagttcgggaggttttggttttttagagagcggagtgggagaggcggcgttgtaggtttttggaatggtcgcggtcgtggggagtattgggcggattgcgcgtttcgaagggcgtacgtggggcgtagtttttttttgtcgttagtatatcggagggtagttagggggttgtaggtttcggggttttttgtttagtcg

SEQ ID NO: 2430 - DNA, 1437 bp, Artificial Sequence
  chemically treated genomic DNA (Homo sapiens) CpG-island No: 2430
cgactaaacaaaaaaccccgaaacctacaaccccctaactaccctccgatatactaacgacaaaaaaaaactacgccccacgtacgcccttcgaaacgcgcaatccgcccaatactccccacgaccgcgaccattccaaaaacctacaacgccgcctctcccactccgctctctaaaaaaccaaaacctcccgaactccgcttccgcaccgcccctcgaaaaaacgacgcgaccgcgcccccgacacgccccgcccccgacaaacactaaccacgccctctcccgaccatacaaaaaccccgacccatatttctcaactcgtcttctcgcttccgaccccgccccgcgccgaaaaccccgccccacgctctttacctcttctactcgaaacgaaccccgccttactccctaatccccgccccacgcccgaaaccccgccccgaactcttcacctcgtcttctcgcttccgaccccgcccacgccccgaccccgccccgcgctcctcacctatcccctcgctatcgaccccgccccacgctcctcactttatcctcgcgctttcaaccccgccccgcgcctaaaaccccgccccacaccctttacctcgtccccgcgctaccgaccccgccccgtattaaaaccccgccccgcgctctcacctcgtccccgcgccccgaccccgcccccgcacttccgaacgccgccgacgaaaacgctcgaacctaaacttcgacgctctaactcgaactctaactcgaaaaacgatcgtaaccgctaccgccgccaaaaccgaccgaaatcgacccgaaaccgcgtccacgcgaaacgaacgaataaaaactaacgactaaacccctacgacgcccccgcgacctaccccgcgtccgcctccgaaccgccgaaccgcaaccgccgaaataaaaaccgccccgaaccgcgcccccgccgaatcccgcccgccgcgctaccgctaaacgcataaacccgaaccgcgccgcgccgctccgaaaaccgaacccgaaatcccgccaccaccgcgcgcgaataaataaaaccgaactccgaaacgaactaaaccgcgataaaccgaacgaacgaaacccgaaaacgacgaaaaacgcgaataactaacgcgcgtaaaaccgaaaaaataaacgcgcgaaaaactaaaaccgaaatatccctaaacaacgaaactaacgacgcgataaccgcttaaaaatccgaaacctcgaacgcgtctcgaaacacgaaacaactacaaaaaccgcgcatcgcgtacgaaaacccgaaaaaaccgaacctaaaaccctccccgccgcccaaaaatcgacgaaaatccgactatcccgaaaaaaaacactcccgcccgccctcgccgaaaccgcgtaccgaatccgaatcgaaattcgacctaaataaccgcgtactccgac

SEQ ID NO: 2431 - DNA, 1437 bp, Artificial Sequence
  chemically treated genomic DNA (Homo sapiens) CpG-island No: 2431
cggttgggtagggagtttcgaggtttgtagttttttgattgtttttcgatgtattggcggtagaaaagggttgcgttttacgtgcgtttttcggggcgcgtagttcgtttagtgttttttacggtcgcggttattttaaggatttgtaacgtcgttttttttatttcgttttttgggaagttaaagtttttcgggtttcgttttcgtatcgtttttcgggaagacggcgcgatcgcgttttcggtacgtttcgttttcggtaggtattgattacgttttttttcggttatgtagagatttcggtttatgttttttaattcgttttttcgttttcggtttcgtttcgcgtcggaggtttcgttttacgttttttattttttttgttcgaggcgggtttcgttttattttttggttttcgttttacgttcgaggtttcgtttcgagttttttatttcgttttttcgttttcggtttcgtttacgtttcggtttcgtttcgcgttttttatttgttttttcgttgtcggtttcgttttacgttttttattttattttcgcgtttttagtttcgtttcgcgtttgaagtttcgttttatattttttatttcgttttcgcgttgtcggtttcgtttcgtgttgaggtttcgtttcgcgtttttatttcgttttcgcgtttcggtttcgttttcgtattttcggacgtcgtcggcgggggcgttcgggtttgggtttcggcgttttggttcgggttttggttcgggaggcgatcgtggtcgttgtcgtcgttagagtcggtcggagtcggttcggagtcgcgtttacgcggagcgggcgggtgggagttggcggttgggtttttgcggcgttttcgcggtttgtttcgcgttcgttttcgggtcgtcgagtcgtagtcgtcgagatgggggtcgtttcgggtcgcgttttcgtcgggtttcgttcgtcgcgttgtcgttgagcgtatgggttcggatcgcgtcgcgtcgtttcgggagtcgggttcggggtttcgttattatcgcgcgcgggtgagtagggtcgggtttcggggcgggttaggtcgcggtaggtcgggcgggcgggattcggaagcggcggggggcgcgggtggttgacgcgcgtgggatcgagggggtgggcgcgcggggagttggggtcggggtgtttttgggtagcgggattggcggcgcggtggtcgtttggaggttcgaggtttcgggcgcgtttcggggtacggagtagttgtaggggtcgcgtatcgcgtgcgggggttcgggagagtcgggtttggagtttttttcgtcgtttagaagtcggcgggagttcggttgtttcggaggaggatattttcgttcgttttcgtcgaggtcgcgtgtcgggttcgggtcggggttcggtttgagtagtcgcgtgtttcggt

SEQ ID NO: 2432 - DNA, 1437 bp, Artificial Sequence
  chemically treated genomic DNA (Homo sapiens) CpG-island No: 2432
accgaaacacgcgactactcaaaccgaaccccgacccgaacccgacacgcgacctcgacgaaaacgaacgaaaatatcctcctccgaaacaaccgaactcccgccgacttctaaacgacgaaaaaaactccaaacccgactctcccgaacccccgcacgcgatacgcgacccctacaactactccgtaccccgaaacgcgcccgaaacctcgaacctccaaacgaccaccgcgccgccaatcccgctacccaaaaacaccccgaccccaactccccgcgcgcccaccccctcgatcccacgcgcgtcaaccacccgcgccccccgccgcttccgaatcccgcccgcccgacctaccgcgacctaacccgccccgaaacccgaccctactcacccgcgcgcgataataacgaaaccccgaacccgactcccgaaacgacgcgacgcgatccgaacccatacgctcaacgacaacgcgacgaacgaaacccgacgaaaacgcgacccgaaacgacccccatctcgacgactacgactcgacgacccgaaaacgaacgcgaaacaaaccgcgaaaacgccgcaaaaacccaaccgccaactcccacccgcccgctccgcgtaaacgcgactccgaaccgactccgaccgactctaacgacgacaacgaccacgatcgcctcccgaaccaaaacccgaaccaaaacgccgaaacccaaacccgaacgcccccgccgacgacgtccgaaaatacgaaaacgaaaccgaaacgcgaaaacgaaataaaaacgcgaaacgaaacctcaacacgaaacgaaaccgacaacgcgaaaacgaaataaaaaatataaaacgaaacttcaaacgcgaaacgaaactaaaaacgcgaaaataaaataaaaaacgtaaaacgaaaccgacaacgaaaaaacaaataaaaaacgcgaaacgaaaccgaaacgtaaacgaaaccgaaaacgaaaaaacgaaataaaaaactcgaaacgaaacctcgaacgtaaaacgaaaaccaaaaaataaaacgaaacccgcctcgaacaaaaaaaataaaaaacgtaaaacgaaacctccgacgcgaaacgaaaccgaaaacgaaaaaacgaattaaaaaacataaaccgaaatctctacataaccgaaaaaaaacgtaatcaatacctaccgaaaacgaaacgtaccgaaaacgcgatcgcgccgtcttcccgaaaaacgatacgaaaacgaaacccgaaaaactttaacttcccaaaaaacgaaataaaaaaaacgacgttacaaatccttaaaataaccgcgaccgtaaaaaacactaaacgaactacgcgccccgaaaaacgcacgtaaaacgcaacccttttctaccgccaatacatcgaaaaacaatcaaaaaactacaaacctcgaaactccctacccaaccg

SEQ ID NO: 2433 - DNA, 894 bp, Artificial Sequence
  chemically treated genomic DNA (Homo sapiens) CpG-island No: 2433
ttttagcgcgatttttataaattgttttgattttttaacgttttttcgttggcgtttattgggttaggcgtttacgttatcgttgcgcgtcgggcggcggcgatttttcgttttttgattttgacgttagagcggcgtcggtttcggcggttgaggaaagtaggaggaggtggcggcggcgggaagatgtaagttggggcggaattcgattgtattcgtgtttcgggggttgttcggtaggttcggtaggacgtttcgtgaagtcggtttattttttagtttcgtagtgcggcggtggtttggtagcgcggtgcgggtttcgagaagaaagagtgtggttcggggcgggcggagtgggaggtgtcgaggtcgtggttcggaagtggtcggggtcgttgcggacggaagggcgtttgtgtttcgttcgttcggcggtggtttagttaggttcgcgggatttagattagcggggagcgcggttttcgtttttggggttttttcgtcgggtcggagatttaagtttttaacgttaggttttgttttggaagcgttcgcggttcggcgtttggacgggggagttgtgagtgaacgcggacgggtagcggcgaggtcggcgtgtcgggtcggtgtcggcgggcgcggagtttttttgtgggatgcggtggaaggtcggtcgatttttttttcggagttattaatttaaacgtgtatttcgcgaacgtttttcggattttcgtgtgtaattatcggcgttaggtcgtggggatacggtttattatggatcgagtacggtggtcgagtttagtttgatgggttattttagaggggcggatacgggaaggttaagtttgttggaggagaaacgtggagtaggttttttgttttgatttcgta

SEQ ID NO: 2434 - DNA, 894 bp, Artificial Sequence
  chemically treated genomic DNA (Homo sapiens) CpG-island No: 2434
tacgaaatcaaaacaaaaaacctactccacgtttctcctccaacaaacttaaccttcccgtatccgcccctctaaaataacccatcaaactaaactcgaccaccgtactcgatccataataaaccgtatccccacgacctaacgccgataattacacacgaaaatccgaaaaacgttcgcgaaatacacgtttaaattaataactccgaaaaaaaaatcgaccgaccttccaccgcatcccacaaaaaaactccgcgcccgccgacaccgacccgacacgccgacctcgccgctacccgtccgcgttcactcacaactcccccgtccaaacgccgaaccgcgaacgcttccaaaacaaaacctaacgttaaaaacttaaatctccgacccgacgaaaaaaccccaaaaacgaaaaccgcgctccccgctaatctaaatcccgcgaacctaactaaaccaccgccgaacgaacgaaacacaaacgcccttccgtccgcaacgaccccgaccacttccgaaccacgacctcgacacctcccactccgcccgccccgaaccacactctttcttctcgaaacccgcaccgcgctaccaaaccaccgccgcactacgaaactaaaaaataaaccgacttcacgaaacgtcctaccgaacctaccgaacaacccccgaaacacgaatacaatcgaattccgccccaacttacatcttcccgccgccgccacctcctcctactttcctcaaccgccgaaaccgacgccgctctaacgtcaaaatcaaaaaacgaaaaatcgccgccgcccgacgcgcaacgataacgtaaacgcctaacccaataaacgccaacgaaaaaacgttaaaaaatcaaaacaatttataaaaatcgcgctaaaa

SEQ ID NO: 2435 - DNA, 894 bp, Artificial Sequence
  chemically treated genomic DNA (Homo sapiens) CpG-island No: 2435
tgcggaattaagataaaaagtttattttacgttttttttttaataaatttaattttttcgtattcgtttttttggggtaatttattaaattgagttcggttatcgtgttcggtttatagtgggtcgtatttttacggtttagcgtcgataattgtatacgggagttcgggaaacgttcgcggagtatacgtttgaattaatgatttcgaaggggggatcggtcgattttttatcgtattttataaagaaatttcgcgttcgtcgatatcggttcgatacgtcgatttcgtcgttattcgttcgcgtttatttataattttttcgtttaggcgtcgggtcgcgagcgtttttagggtagggtttggcgttgggggtttgggttttcggttcggcgggagggttttaagggcggaggtcgcgtttttcgttggtttgagtttcgcgggtttggttgggttatcgtcgagcggacgaagtataggcgttttttcgttcgtagcggtttcgattattttcgggttacggtttcgatattttttatttcgttcgtttcgggttatatttttttttttcggagttcgtatcgcgttgttaggttatcgtcgtattgcggggttgaggagtggatcggttttacgaggcgttttgtcgggtttgtcgggtagttttcgaaatacggatgtagtcggatttcgttttaatttatattttttcgtcgtcgttatttttttttgttttttttagtcgtcgaggtcggcgtcgttttgacgttagagttaaggagcgggaagtcgtcgtcgttcggcgcgtagcgatgacgtaaacgtttggtttaatgggcgttagcgaggaagcgttaaagagttaaggtagtttgtgggagtcgcgttgggg

SEQ ID NO: 2436 - DNA, 894 bp, Artificial Sequence
  chemically treated genomic DNA (Homo sapiens) CpG-island No: 2436
ccccaacgcgactcccacaaactaccttaactctttaacgcttcctcgctaacgcccattaaaccaaacgtttacgtcatcgctacgcgccgaacgacgacgacttcccgctccttaactctaacgtcaaaacgacgccgacctcgacgactaaaaaaaacaaaaaaaaataacgacgacgaaaaaatataaattaaaacgaaatccgactacatccgtatttcgaaaactacccgacaaacccgacaaaacgcctcgtaaaaccgatccactcctcaaccccgcaatacgacgataacctaacaacgcgatacgaactccgaaaaaaaaaaatataacccgaaacgaacgaaataaaaaatatcgaaaccgtaacccgaaaataatcgaaaccgctacgaacgaaaaaacgcctatacttcgtccgctcgacgataacccaaccaaacccgcgaaactcaaaccaacgaaaaacgcgacctccgcccttaaaaccctcccgccgaaccgaaaacccaaacccccaacgccaaaccctaccctaaaaacgctcgcgacccgacgcctaaacgaaaaaattataaataaacgcgaacgaataacgacgaaatcgacgtatcgaaccgatatcgacgaacgcgaaatttctttataaaatacgataaaaaatcgaccgatccccccttcgaaatcattaattcaaacgtatactccgcgaacgtttcccgaactcccgtatacaattatcgacgctaaaccgtaaaaatacgacccactataaaccgaacacgataaccgaactcaatttaataaattaccccaaaaaaacgaatacgaaaaaattaaatttattaaaaaaaaaacgtaaaataaactttttatcttaattccgca

SEQ ID NO: 2437 - DNA, 560 bp, Artificial Sequence
  chemically treated genomic DNA (Homo sapiens) CpG-island No: 2437
gcggcgagcggttgtttcggtcggtaggtggaggcgttgattagtttttgggaacggggcgggatttagttgggggggtttcgttttttttttaggaggcgagtttagttcgcgatttttatttcgcgcgttgcggttaagatggcgttggtggtttttgtgcgagtttcggcgcgcgttttgtttcgcgcgggtgcgaaattcggggtgggtagggatcgggtcggggtcggggttaggatcgggaattaacgggtttttttacgttgatttcgtaggggttcggttttcgggcgcggttttcgggcggacggagcgggcggtcggcggcggagacggcgcgcggcgtttcgggagttagcgggtgttggtggagtcggacgcgggcgtaggtgagcggggcggcgtcgagggagggcgggcgtggggttaggattcgcgggggttcgcgttcgcggggtgttgtcggagaattacgtttgtcgacgttcggtttgtgtttagaatttaagtttcgaaatagaattttgtcgttttatttgggttcgttcgttatgaga

SEQ ID NO: 2438 - DNA, 560 bp, Artificial Sequence
  chemically treated genomic DNA (Homo sapiens) CpG-island No: 2438
tctcataacgaacgaacccaaataaaacgacaaaattctatttcgaaacttaaattctaaacacaaaccgaacgtcgacaaacgtaattctccgacaacaccccgcgaacgcgaacccccgcgaatcctaaccccacgcccgccctccctcgacgccgccccgctcacctacgcccgcgtccgactccaccaacacccgctaactcccgaaacgccgcgcgccgtctccgccgccgaccgcccgctccgtccgcccgaaaaccgcgcccgaaaaccgaacccctacgaaatcaacgtaaaaaaacccgttaattcccgatcctaaccccgaccccgacccgatccctacccaccccgaatttcgcacccgcgcgaaacaaaacgcgcgccgaaactcgcacaaaaaccaccaacgccatcttaaccgcaacgcgcgaaataaaaatcgcgaactaaactcgcctcctaaaaaaaaaacgaaacccccccaactaaatcccgccccgttcccaaaaactaatcaacgcctccacctaccgaccgaaacaaccgctcgccgc

SEQ ID NO: 2439 - DNA, 560 bp, Artificial Sequence
  chemically treated genomic DNA (Homo sapiens) CpG-island No: 2439
ttttatgacgaacgaatttaggtagagcggtaaggttttgtttcgaaatttgggttttaaatataaatcgagcgtcgatagacgtggtttttcgatagtatttcgcgagcgcggattttcgcgggttttgattttacgttcgttttttttcggcgtcgtttcgtttatttgcgttcgcgttcggttttattagtattcgttggttttcgaagcgtcgcgcgtcgttttcgtcgtcggtcgttcgtttcgttcgttcgaaggtcgcgttcgggagtcgggtttttgcgaagttagcgtgggggagttcgttagttttcggttttggtttcggtttcggttcgatttttgtttatttcgggtttcgtattcgcgcggagtagaacgcgcgtcgggattcgtatagaagttattagcgttattttgatcgtaacgcgcgggataaaggtcgcgggttgagttcgttttttggggagggggcggagtttttttaattaggtttcgtttcgtttttagaggttggttaacgtttttatttatcggtcgaaatagtcgttcgtcgt

SEQ ID NO: 2440 - DNA, 560 bp, Artificial Sequence
  chemically treated genomic DNA (Homo sapiens) CpG-island No: 2440
acgacgaacgactatttcgaccgataaataaaaacgttaaccaacctctaaaaacgaaacgaaacctaattaaaaaaactccgccccctccccaaaaaacgaactcaacccgcgacctttatcccgcgcgttacgatcaaaataacgctaataacttctatacgaatcccgacgcgcgttctactccgcgcgaatacgaaacccgaaataaacaaaaatcgaaccgaaaccgaaaccaaaaccgaaaactaacgaactcccccacgctaacttcgcaaaaacccgactcccgaacgcgaccttcgaacgaacgaaacgaacgaccgacgacgaaaacgacgcgcgacgcttcgaaaaccaacgaatactaataaaaccgaacgcgaacgcaaataaacgaaacgacgccgaaaaaaaacgaacgtaaaatcaaaacccgcgaaaatccgcgctcgcgaaatactatcgaaaaaccacgtctatcgacgctcgatttatatttaaaacccaaatttcgaaacaaaaccttaccgctctacctaaattcgttcgtcataaaa

SEQ ID NO: 2441 - DNA, 696 bp, Artificial Sequence
  chemically treated genomic DNA (Homo sapiens) CpG-island No: 2441
attacgttcggttgtagattatttttacggttatttattttgttattcgttatttttttcgtcgaatttgttgcgtaggcgtattttcgtttttttcgtgtcgattgtttcggttatttttacggagggcgaaggtattttcggagtatttttggaaagggggaggtgtttttttagtggttaagtacgttttttttagatatttttacgtgattttttttcgtcgagttttaggttgcgtgtgagcgtatttacgatcggggcgcgatgattttattcgtgcgcgagtgcgcgcggcgtatgttcggcgtgtcggtttttaggcgtttgatgagtttatagttgggcggtggtgttagcggtttcgttggcgttcgtgggtttttttcggatttatatacggaaatacgtaattattcggggatttagacgttcgtttatacgtattatttttgggcgggttgtgcggtttaggttttttttcgggatcggttcgtgtttcgtttcgtgtttcgtttcgtatttgtgcggcgttagttggtttcgtagtttgcggcgtagagaggttgggtttgtaggcgtagtagttttagaggtcgcgttgggttgagagtgcgggtcggtagaggttggcggggagtagtcggggttatgttgggtaaggattatatgttggttattattttggttaattgt

SEQ ID NO: 2442 - DNA, 696 bp, Artificial Sequence
  chemically treated genomic DNA (Homo sapiens) CpG-island No: 2442
acaattaaccaaaataataaccaacatataatccttacccaacataaccccgactactccccgccaacctctaccgacccgcactctcaacccaacgcgacctctaaaactactacgcctacaaacccaacctctctacgccgcaaactacgaaaccaactaacgccgcacaaatacgaaacgaaacacgaaacgaaacacgaaccgatcccgaaaaaaaacctaaaccgcacaacccgcccaaaaataatacgtataaacgaacgtctaaatccccgaataattacgtatttccgtatataaatccgaaaaaaacccacgaacgccaacgaaaccgctaacaccaccgcccaactataaactcatcaaacgcctaaaaaccgacacgccgaacatacgccgcgcgcactcgcgcacgaataaaatcatcgcgccccgatcgtaaatacgctcacacgcaacctaaaactcgacgaaaaaaaatcacgtaaaaatatctaaaaaaaacgtacttaaccactaaaaaaacacctccccctttccaaaaatactccgaaaataccttcgccctccgtaaaaataaccgaaacaatcgacacgaaaaaaacgaaaatacgcctacgcaacaaattcgacgaaaaaaataacgaataacaaaataaataaccgtaaaaataatctacaaccgaacgtaat

SEQ ID NO: 2443 - DNA, 696 bp, Artificial Sequence
  chemically treated genomic DNA (Homo sapiens) CpG-island No: 2443
gtagttgattagaatgatggttagtatgtaatttttgtttagtataatttcggttgtttttcgttagtttttgtcggttcgtatttttagtttagcgcgatttttggagttattgcgtttgtaagtttagtttttttgcgtcgtaggttgcggggttagttggcgtcgtataaatacggggcgggatacggggcgggatacgggtcggtttcgggggagggtttgagtcgtatagttcgtttaggggtggtgcgtgtaaacgggcgtttggattttcgaatggttgcgtgttttcgtgtgtgggttcgggggaggtttacgaacgttagcgaaatcgttgatattatcgtttaattatgaatttattaggcgtttgaagatcgatacgtcgaatatgcgtcgcgcgtattcgcgtacgagtgagattatcgcgtttcggtcgtgagtgcgtttatacgtagtttgagattcgacgggagggggttacgtggaagtatttgagagaggcgtatttggttattaggaaagtatttttttttttttaaaaatgtttcggaagtgttttcgtttttcgtaaagatggtcggggtagtcggtacgagggaggcggggatgcgtttgcgtaataagttcggcggggaagatggcggatgataaggtgagtggtcgtgggggtgatttgtagtcgggcgtggt

SEQ ID NO: 2444 - DNA, 696 bp, Artificial Sequence
  chemically treated genomic DNA (Homo sapiens) CpG-island No: 2444
accacgcccgactacaaatcacccccacgaccactcaccttatcatccgccatcttccccgccgaacttattacgcaaacgcatccccgcctccctcgtaccgactaccccgaccatctttacgaaaaacgaaaacacttccgaaacatttttaaaaaaaaaaaaatactttcctaataaccaaatacgcctctctcaaatacttccacgtaaccccctcccgtcgaatctcaaactacgtataaacgcactcacgaccgaaacgcgataatctcactcgtacgcgaatacgcgcgacgcatattcgacgtatcgatcttcaaacgcctaataaattcataattaaacgataatatcaacgatttcgctaacgttcgtaaacctcccccgaacccacacacgaaaacacgcaaccattcgaaaatccaaacgcccgtttacacgcaccacccctaaacgaactatacgactcaaaccctcccccgaaaccgacccgtatcccgccccgtatcccgccccgtatttatacgacgccaactaaccccgcaacctacgacgcaaaaaaactaaacttacaaacgcaataactccaaaaatcgcgctaaactaaaaatacgaaccgacaaaaactaacgaaaaacaaccgaaattatactaaacaaaaattacatactaaccatcattctaatcaactac

SEQ ID NO: 2445 - DNA, 814 bp, Artificial Sequence
  chemically treated genomic DNA (Homo sapiens) CpG-island No: 2445
tcgcgtttttgcgtatttttcggtattcggcgtaggtcgtcggttagggtatatacgcgttttcgtttgttcgtcggttcgtaaggttcgggttgcggcggtcgcgggcgcgggaggcggaggcgtaggcgtcgggtttcgtggtagttcggtttagtttcgtttcgttttatttttcggttttttttttcgtttagtcgtgttttttcgtcgagtttcgtcgttagtttcgtgttttgttcggttcgtacgtcgttcgttatcgcggtttttcgggcgggaaggttgcgtcggttttcgttaagggggaggcgttatttcgtttcggggcggttgttttgttgggatttttgggtcggttataaagttttttttcgttgattcggagggacgggagtcgggtgcgcgacggcggttttttatttttgtatttagtcgttcgtttcgttttttttttttttttttttgttttttttttttttttatttttcgagggttcgtatatttcgcgggcgggaaggtgtcgttttcggggcggataaaggggtaggtcgggcgggaggggttgtagtcggtacgcgcggtcgcgggagggttcgtttcgtttcgggtcgtcgatttgatatttgttgggtagtttgcgcggtttggggcgaaggttagcgggcggcggggtgggaagcgttagcgtaggggcgtgtgttcgggagggggtcgcggataggttaggcggtttgggatttattttattcgggtaatagtgatttattgtttcgttagcgtttttttttaggttttaattggattttaaaga

SEQ ID NO: 2446 - DNA, 814 bp, Artificial Sequence
  chemically treated genomic DNA (Homo sapiens) CpG-island No: 2446
tctttaaaatccaattaaaacctaaaaaaaaacgctaacgaaacaataaatcactattacccgaataaaataaatcccaaaccgcctaacctatccgcgaccccctcccgaacacacgcccctacgctaacgcttcccaccccgccgcccgctaaccttcgccccaaaccgcgcaaactacccaacaaatatcaaatcgacgacccgaaacgaaacgaaccctcccgcgaccgcgcgtaccgactacaacccctcccgcccgacctacccctttatccgccccgaaaacgacaccttcccgcccgcgaaatatacgaaccctcgaaaaataaaaaaaaaaaaaaaacaaaaaaaaaaaaaaaaaaaacgaaacgaacgactaaatacaaaaataaaaaaccgccgtcgcgcacccgactcccgtccctccgaatcaacgaaaaaaaactttataaccgacccaaaaatcccaacaaaacaaccgccccgaaacgaaataacgcctcccccttaacgaaaaccgacgcaaccttcccgcccgaaaaaccgcgataacgaacgacgtacgaaccgaacaaaacacgaaactaacgacgaaactcgacgaaaaaacacgactaaacgaaaaaaaaaaccgaaaaataaaacgaaacgaaactaaaccgaactaccacgaaacccgacgcctacgcctccgcctcccgcgcccgcgaccgccgcaacccgaaccttacgaaccgacgaacaaacgaaaacgcgtatataccctaaccgacgacctacgccgaataccgaaaaatacgcaaaaacgcga

SEQ ID NO: 2447 - DNA, 814 bp, Artificial Sequence
  chemically treated genomic DNA (Homo sapiens) CpG-island No: 2447
tttttaaagtttagttaagatttgaaaggggacgttagcgaagtagtaggttattattgttcgggtggggtgggttttaagtcgtttgatttgttcgcgattttttttcgaatatacgtttttgcgttggcgttttttatttcgtcgttcgttggttttcgttttaggtcgcgtaggttgtttagtaggtgttaggtcggcggttcggggcgaggcgggttttttcgcggtcgcgcgtgtcggttatagtttttttcgttcggtttgtttttttgttcgtttcgagggcggtattttttcgttcgcggggtgtgcgagttttcggggggtgggagaggaggagggatagggagggaaggaggaggagcggggcgggcggttgagtgtaggggtggggagtcgtcgtcgcgtattcgattttcgttttttcgggttagcggagaggggttttgtgatcggtttaggagttttagtaagataatcgtttcggggcggggtggcgttttttttttggcgggagtcggcgtagttttttcgttcggggagtcgcggtggcgagcggcgtacgggtcgggtagagtacggagttggcggcggagttcggcgggagagtacggttaagcggaggggagggtcggagggtggggcggggcggggttgggtcgggttgttacggagttcggcgtttgcgttttcgtttttcgcgttcgcggtcgtcgtagttcgggttttgcgggtcggcgagtaggcggggacgcgtgtgtgttttggtcggcgatttgcgtcgggtgtcgggaggtgcgtagaggcgcgg

SEQ ID NO: 2448 - DNA, 814 bp, Artificial Sequence
  chemically treated genomic DNA (Homo sapiens) CpG-island No: 2448
ccgcgcctctacgcacctcccgacacccgacgcaaatcgccgaccaaaacacacacgcgtccccgcctactcgccgacccgcaaaacccgaactacgacgaccgcgaacgcgaaaaacgaaaacgcaaacgccgaactccgtaacaacccgacccaaccccgccccgccccaccctccgaccctcccctccgcttaaccgtactctcccgccgaactccgccgccaactccgtactctacccgacccgtacgccgctcgccaccgcgactccccgaacgaaaaaactacgccgactcccgccaaaaaaaaaacgccaccccgccccgaaacgattatcttactaaaactcctaaaccgatcacaaaacccctctccgctaacccgaaaaaacgaaaatcgaatacgcgacgacgactccccacccctacactcaaccgcccgccccgctcctcctccttccctccctatccctcctcctctcccaccccccgaaaactcgcacaccccgcgaacgaaaaaataccgccctcgaaacgaacaaaaaaacaaaccgaacgaaaaaaactataaccgacacgcgcgaccgcgaaaaaacccgcctcgccccgaaccgccgacctaacacctactaaacaacctacgcgacctaaaacgaaaaccaacgaacgacgaaataaaaaacgccaacgcaaaaacgtatattcgaaaaaaaatcgcgaacaaatcaaacgacttaaaacccaccccacccgaacaataataacctactacttcgctaacgtcccctttcaaatcttaactaaactttaaaaa

SEQ ID NO: 2449 - DNA, 623 bp, Artificial Sequence
  chemically treated genomic DNA (Homo sapiens) CpG-island No: 2449
ttttcgttgcgtttaggtttcgggtgttgcggcgggcgtatttttaggtagggagaggggtggtcgtcgttttcgaagttcgttttttgtcgggatgtttggaggaagtggtttttgggtttgaattcggtgagcgcggtttcgtttttttttcgttaatttttcgttttcgaggagcgttcgttttttattaggggttaggtttttttcgggacgtttcgcgatttcgggtcgcgggtttttggaatttatgggggtacggtttattttcggacgtttttttttcgtttttagttttaatttcggcgttttcgtagcggttgtatgtgtagttggagggagcgggttaaagtttggtaggacgcgtttttaatttcgttattttttgtattattcgcgataggattaagaggattttgcgtaggcgtagagcggaggtcgaggtggcggtgacgtagggtttagcgttttttgaagggttaaagtttaattcgagcgtaggcgtagagcggaggtcgaggtggtcgcggggcggggtagaagggtttttgtggggtttagatagttttttcgcgtaggtgtagaagttaggttgcggtgttggagtggcgggttgcgggttt

SEQ ID NO: 2450 - DNA, 623 bp, Artificial Sequence
  chemically treated genomic DNA (Homo sapiens) CpG-island No: 2450
aaacccgcaacccgccactccaacaccgcaacctaacttctacacctacgcgaaaaaactatctaaaccccacaaaaacccttctaccccgccccgcgaccacctcgacctccgctctacgcctacgctcgaattaaactttaacccttcaaaaaacgctaaaccctacgtcaccgccacctcgacctccgctctacgcctacgcaaaatcctcttaatcctatcgcgaataatacaaaaaataacgaaattaaaaacgcgtcctaccaaactttaacccgctccctccaactacacatacaaccgctacgaaaacgccgaaattaaaactaaaaacgaaaaaaaaacgtccgaaaataaaccgtacccccataaattccaaaaacccgcgacccgaaatcgcgaaacgtcccgaaaaaaacctaacccctaataaaaaacgaacgctcctcgaaaacgaaaaattaacgaaaaaaaaacgaaaccgcgctcaccgaattcaaacccaaaaaccacttcctccaaacatcccgacaaaaaacgaacttcgaaaacgacgaccacccctctccctacctaaaaatacgcccgccgcaacacccgaaacctaaacgcaacgaaaa

SEQ ID NO: 2451 - DNA, 623 bp, Artificial Sequence
  chemically treated genomic DNA (Homo sapiens) CpG-island No: 2451
gggttcgtaattcgttattttagtatcgtagtttggtttttgtatttgcgcgaggaaattatttgggttttataggagtttttttgtttcgtttcgcggttatttcggttttcgttttgcgtttgcgttcggattgagttttgattttttagggagcgttgggttttgcgttatcgttatttcggttttcgttttgcgtttgcgtaggatttttttggttttatcgcgagtggtgtagagaatggcgggattgggagcgcgttttgttaggttttgattcgttttttttaattgtatatgtagtcgttgcggggacgtcggggttggggttgggggcggggaaggagcgttcgggagtgggtcgtgtttttatggattttagaaattcgcggttcggagtcgcggggcgtttcgagggagatttggtttttggtgggaggcgggcgtttttcgagggcggggagttggcgggaagaggacgaggtcgcgtttatcggatttagatttagaaattattttttttaggtatttcggtaagaaacgggtttcggagacggcggttatttttttttttgtttaggagtgcgttcgtcgtagtattcggggtttgaacgtaacgggag

SEQ ID NO: 2452 - DNA, 623 bp, Artificial Sequence
  chemically treated genomic DNA (Homo sapiens) CpG-island No: 2452
ctcccgttacgttcaaaccccgaatactacgacgaacgcactcctaaacaaaaaaaaaaataaccgccgtctccgaaacccgtttcttaccgaaatacctaaaaaaaataatttctaaatctaaatccgataaacgcgacctcgtcctcttcccgccaactccccgccctcgaaaaacgcccgcctcccaccaaaaaccaaatctccctcgaaacgccccgcgactccgaaccgcgaatttctaaaatccataaaaacacgacccactcccgaacgctccttccccgcccccaaccccaaccccgacgtccccgcaacgactacatatacaattaaaaaaaacgaatcaaaacctaacaaaacgcgctcccaatcccgccattctctacaccactcgcgataaaaccaaaaaaatcctacgcaaacgcaaaacgaaaaccgaaataacgataacgcaaaacccaacgctccctaaaaaatcaaaactcaatccgaacgcaaacgcaaaacgaaaaccgaaataaccgcgaaacgaaacaaaaaaactcctataaaacccaaataatttcctcgcgcaaatacaaaaaccaaactacgatactaaaataacgaattacgaaccc

SEQ ID NO: 2453 - DNA, 1890 bp, Artificial Sequence
  chemically treated genomic DNA (Homo sapiens) CpG-island No: 2453
cgttcgttgtttttcgggtacggtttgttttagcgggcgcgggcgggcgtagtggttagggacgtcgaagttttaagtttggtcgatttcggtttgtttggtgttcgagtggggtcggggcgggcggagagcgaggttgcgggaggtagcggtggtaggagcgggtgggcgggggcgttgacgttagattcgggttcgggcgtcggcggtcgtttttttgttatattttggtggtcgcgttcgtagtcgggtcgggtcgtgcgtcgcgtagtttggtagtttcgcgcgtagttatcggggagcgggcgggagttatgtagcggttttgagtattaggggtcggcgttgaggagcgcgcgcggcgggagggtagtcgagtatggagttgagtttggagagtttggggggtttgtatagcgtggtttacgcgtaggcgggcgagttgttgagttcgggttacgcgcgttcggcggcggcgtagtatcgcggtttggtggcgttcgggcgttcgggtttggtggtcggtatggcgagtttgttggacggcggcggcggcggcggcggtgggggcgtcgggggcgcgggcggcgcgggtagcgcgggcggcggcgcggattttcgcggggaattggcgggttcgttgtattcggtaatgggtatggtttgcgaggcgtcgggtttgggcggtatttatacgacgtttacgtttttgtagtatttgtcgtcgttcgcggtcgtggtcgataagttttattagtacgcggcggtcgcggtcgtggtcggggcgtacggcggttatttttacgcgtattcgtattcggcggtcgcgtcgttttcgttattttcgtcgtagcgtttggcggttagcgtgagcggtagttttatttttatgcgcgacgagcgggcggcgttcgttttcgtgggttatttttacggattttacggtaaggagttgttcgttatggggtcgtcgttgtcgtcgttgtttaacgcgttgtcgttcgcgttgtacggcgtttcgtagttttcgtcgtcgttattattttcgtcgttggtcgtttacggttcgttaggttatttggttggggataagttgttgtcgttcgtcgttttcgagtcgtacgtcgcgttgttgggacgcgcggaggacgtattggttcgcgggttgttcggaggcggcggcggtataggtagcggcggagcgggtagcgggagcgtcgcggggttgttggcgtcgttgggcgggttggcggcggtcggggcgtacgggtcgtacgggggaggcggcggtttcggcgggagcggcggcggttttagcgcgggcgtagcggtcgaggagattaatattaaggaggtggcgtagcgtattacggcggagttgaagcgttatagtatttcgtaggtaattttcgcgtagcggattttgtgtcgtttttagggtacgtttttcgatttgttgcgtaattttaagtcgtggagtaagtttaaattcggtcgcgagatttttcgtaggatgtggaagtggttgtaggagttagagttttagcgtatgtcggcgttgcgtttggtaggtaggagcgtggcgcgtagggttagattttgggggcgtcggttttggattttcgagtatttagcggggcggcggtcgatgttcggggttagcgttttaagtttcgttcgtgcgtttcggtagttcgggattttttattaggaagttagatcgcgattcgcgtcgttgttcgtttgtatcgttgttaaaagggagaaagggattgtgtcgttttttcgtttttcggtcgtcgtttttgtttttttcgggagcgcgtaggggttttttagtttttgttagattgttgggaggtttcgagtttttttttaagtagtttttag

SEQ ID NO: 2454 - DNA, 1890 bp, Artificial Sequence
  chemically treated genomic DNA (Homo sapiens) CpG-island No: 2454
ctaaaaactacttaaaaaaaaactcgaaacctcccaacaatctaacaaaaactaaaaaacccctacgcgctcccgaaaaaaacaaaaacgacgaccgaaaaacgaaaaaacgacacaatccctttctcccttttaacaacgatacaaacgaacaacgacgcgaatcgcgatctaacttcctaataaaaaatcccgaactaccgaaacgcacgaacgaaacttaaaacgctaaccccgaacatcgaccgccgccccgctaaatactcgaaaatccaaaaccgacgcccccaaaatctaaccctacgcgccacgctcctacctaccaaacgcaacgccgacatacgctaaaactctaactcctacaaccacttccacatcctacgaaaaatctcgcgaccgaatttaaacttactccacgacttaaaattacgcaacaaatcgaaaaacgtaccctaaaaacgacacaaaatccgctacgcgaaaattacctacgaaatactataacgcttcaactccgccgtaatacgctacgccacctccttaatattaatctcctcgaccgctacgcccgcgctaaaaccgccgccgctcccgccgaaaccgccgcctcccccgtacgacccgtacgccccgaccgccgccaacccgcccaacgacgccaacaaccccgcgacgctcccgctacccgctccgccgctacctataccgccgccgcctccgaacaacccgcgaaccaatacgtcctccgcgcgtcccaacaacgcgacgtacgactcgaaaacgacgaacgacaacaacttatccccaaccaaataacctaacgaaccgtaaacgaccaacgacgaaaataataacgacgacgaaaactacgaaacgccgtacaacgcgaacgacaacgcgttaaacaacgacgacaacgacgaccccataacgaacaactccttaccgtaaaatccgtaaaaataacccacgaaaacgaacgccgcccgctcgtcgcgcataaaaataaaactaccgctcacgctaaccgccaaacgctacgacgaaaataacgaaaacgacgcgaccgccgaatacgaatacgcgtaaaaataaccgccgtacgccccgaccacgaccgcgaccgccgcgtactaataaaacttatcgaccacgaccgcgaacgacgacaaatactacaaaaacgtaaacgtcgtataaataccgcccaaacccgacgcctcgcaaaccatacccattaccgaatacaacgaacccgccaattccccgcgaaaatccgcgccgccgcccgcgctacccgcgccgcccgcgcccccgacgcccccaccgccgccgccgccgccgccgtccaacaaactcgccataccgaccaccaaacccgaacgcccgaacgccaccaaaccgcgatactacgccgccgccgaacgcgcgtaacccgaactcaacaactcgcccgcctacgcgtaaaccacgctatacaaaccccccaaactctccaaactcaactccatactcgactaccctcccgccgcgcgcgctcctcaacgccgacccctaatactcaaaaccgctacataactcccgcccgctccccgataactacgcgcgaaactaccaaactacgcgacgcacgacccgacccgactacgaacgcgaccaccaaaatataacaaaaaaacgaccgccgacgcccgaacccgaatctaacgtcaacgcccccgcccacccgctcctaccaccgctacctcccgcaacctcgctctccgcccgccccgaccccactcgaacaccaaacaaaccgaaatcgaccaaacttaaaacttcgacgtccctaaccactacgcccgcccgcgcccgctaaaacaaaccgtacccgaaaaacaacgaacg

SEQ ID NO: 2455 - DNA, 1890 bp, Artificial Sequence
  chemically treated genomic DNA (Homo sapiens) CpG-island No: 2455
ttgagggttgtttggggagaggttcggagttttttagtagtttaataaggattagagaatttttacgcgttttcgaaaggggtagaagcggcgatcggggggcggggaggcggtataattttttttttttttttggtaacggtataaacgggtagcggcgcggatcgcggtttagttttttgatagggggtttcgggttgtcggggcgtacgggcggggtttggggcgttggtttcgggtatcggtcgtcgtttcgttaggtgttcgggagtttagagtcggcgtttttagggtttggttttgcgcgttacgtttttatttgttaagcgtagcgtcgatatgcgttggaattttggtttttgtagttatttttatattttgcggaaggtttcgcggtcggatttgagtttgttttacggtttggggttgcgtagtaggtcggagagcgtgttttgagagcgatataggattcgttgcgcgaagattgtttgcgggatgttgtagcgttttagtttcgtcgtgatgcgttgcgttatttttttggtgttgattttttcggtcgttgcgttcgcgttggggtcgtcgtcgttttcgtcggggtcgtcgtttttttcgtgcggttcgtgcgtttcggtcgtcgttagttcgtttagcggcgttagtagtttcgcggcgttttcgttgttcgtttcgtcgttgtttgtgtcgtcgtcgttttcgggtagttcgcgggttagtgcgtttttcgcgcgttttagtagcgcggcgtgcggttcgaaggcggcgggcggtagtagtttgtttttagttaggtggtttggcgggtcgtaggcggttagcggcgggggtggtggcggcggcgggggttgcggggcgtcgtgtagcgcgggcggtagcgcgttgggtagcggcgatagcggcgattttatggcgggtagttttttgtcgtagggttcgtagaggtggtttacggaggcgagcgtcgttcgttcgtcgcgtatgagggtgaagttgtcgtttacgttggtcgttagacgttgcggcgggggtggcgggggcggcgcggtcgtcgggtgcgggtgcgcgtggggatggtcgtcgtgcgtttcggttacggtcgcggtcgtcgcgtgttggtggaatttgtcggttacggtcgcgagcggcggtaggtgttgtaggggcgtgagcgtcgtgtaggtgtcgtttaggttcggcgtttcgtaggttatgtttattgtcgggtgtagcgggttcgttagtttttcgcggaagttcgcgtcgtcgttcgcgttgttcgcgtcgttcgcgttttcggcgtttttatcgtcgtcgtcgtcgtcgtcgtttagtaggttcgttatgtcggttattaggttcgggcgttcgggcgttattaggtcgcggtgttgcgtcgtcgtcgagcgcgcgtggttcgggtttagtagttcgttcgtttgcgcgtgggttacgttgtgtaggttttttaggttttttaggtttagttttatgttcggttgttttttcgtcgcgcgcgttttttagcgtcggtttttagtgtttaaggtcgttgtatgattttcgttcgtttttcggtggttgcgcgcgaggttgttaggttgcgcggcgtacggttcggttcggttgcgagcgcggttattaggatgtggtaggggagcggtcgtcggcgttcgggttcgggtttgacgttagcgttttcgtttattcgtttttgttatcgttgtttttcgtagtttcgtttttcgttcgtttcggttttattcgagtattaagtaggtcgaagtcggttagatttggggtttcggcgtttttggttattgcgttcgttcgcgttcgttggggtaggtcgtattcgggggatagcgggcg

SEQ ID NO: 2456 - DNA, 1890 bp, Artificial Sequence
  chemically treated genomic DNA (Homo sapiens) CpG-island No: 2456
cgcccgctatcccccgaatacgacctaccccaacgaacgcgaacgaacgcaataaccaaaaacgccgaaaccccaaatctaaccgacttcgacctacttaatactcgaataaaaccgaaacgaacgaaaaacgaaactacgaaaaacaacgataacaaaaacgaataaacgaaaacgctaacgtcaaacccgaacccgaacgccgacgaccgctcccctaccacatcctaataaccgcgctcgcaaccgaaccgaaccgtacgccgcgcaacctaacaacctcgcgcgcaaccaccgaaaaacgaacgaaaatcatacaacgaccttaaacactaaaaaccgacgctaaaaaacgcgcgcgacgaaaaaacaaccgaacataaaactaaacctaaaaaacctaaaaaacctacacaacgtaacccacgcgcaaacgaacgaactactaaacccgaaccacgcgcgctcgacgacgacgcaacaccgcgacctaataacgcccgaacgcccgaacctaataaccgacataacgaacctactaaacgacgacgacgacgacgacgataaaaacgccgaaaacgcgaacgacgcgaacaacgcgaacgacgacgcgaacttccgcgaaaaactaacgaacccgctacacccgacaataaacataacctacgaaacgccgaacctaaacgacacctacacgacgctcacgcccctacaacacctaccgccgctcgcgaccgtaaccgacaaattccaccaacacgcgacgaccgcgaccgtaaccgaaacgcacgacgaccatccccacgcgcacccgcacccgacgaccgcgccgcccccgccacccccgccgcaacgtctaacgaccaacgtaaacgacaacttcaccctcatacgcgacgaacgaacgacgctcgcctccgtaaaccacctctacgaaccctacgacaaaaaactacccgccataaaatcgccgctatcgccgctacccaacgcgctaccgcccgcgctacacgacgccccgcaacccccgccgccgccaccacccccgccgctaaccgcctacgacccgccaaaccacctaactaaaaacaaactactaccgcccgccgccttcgaaccgcacgccgcgctactaaaacgcgcgaaaaacgcactaacccgcgaactacccgaaaacgacgacgacacaaacaacgacgaaacgaacaacgaaaacgccgcgaaactactaacgccgctaaacgaactaacgacgaccgaaacgcacgaaccgcacgaaaaaaacgacgaccccgacgaaaacgacgacgaccccaacgcgaacgcaacgaccgaaaaaatcaacaccaaaaaaataacgcaacgcatcacgacgaaactaaaacgctacaacatcccgcaaacaatcttcgcgcaacgaatcctatatcgctctcaaaacacgctctccgacctactacgcaaccccaaaccgtaaaacaaactcaaatccgaccgcgaaaccttccgcaaaatataaaaataactacaaaaaccaaaattccaacgcatatcgacgctacgcttaacaaataaaaacgtaacgcgcaaaaccaaaccctaaaaacgccgactctaaactcccgaacacctaacgaaacgacgaccgatacccgaaaccaacgccccaaaccccgcccgtacgccccgacaacccgaaaccccctatcaaaaaactaaaccgcgatccgcgccgctacccgtttataccgttaccaaaaaaaaaaaaaaaattataccgcctccccgccccccgatcgccgcttctacccctttcgaaaacgcgtaaaaattctctaatccttattaaactactaaaaaactccgaacctctccccaaacaaccctcaa

SEQ ID NO: 2457 - DNA, 865 bp, Artificial Sequence
  chemically treated genomic DNA (Homo sapiens) CpG-island No: 2457
ggaatcggaggggtgagcgtagtttttggtatttcgagtttttcgtagggcgttggggcgttgaggatgataaattcggattacgttgttcgtttgttttttgtcgggttcgttgtttacgtcgtggtttcgtcgcgcggtttcgcggtcgcggggtttacgtcgttaattttgcgtatttgtcgcgttttaggtgttttgggggtcgcgtttatattatcggatttcgtttggggcgtaagaggtggcgggggcgagggtcgcggggttattaggtttcggtttaggtttttagtttcggtcgttgcgtaaatgaaaagcggttaagtggcggtaaatcgcggcggttagggggagacggtcggatgcgtttttatttttatttaatacggcgacgttttaacgttggtgttcggaaagggaattttgttttcgtttcgttttcgtattattttaatttcgtagtagaggattcgtcgttttttttatttcggtatttttatttttcgtttcgcgagtatcgcgggtttttttaggttttttttaaggagaattttgcgtttcgggtttttcgtcgcgtttgttcggttcggggcgggttacgcgttttcgtaggtgtcgagtgttttgtcgggcgtcggggttaggatagagacggggatagggagggagaaagattcgtaggtgtagacggagagggagggggagacggggagatggagagagagggaggggtcgcgagataaaattagagagtggggagggagagatcgggagcgggagaaatagacggggagaagagaaaaagaagtttagaaaggaatagaggtgaaggagagacgaaaagagaggtagagagattaaa

SEQ ID NO: 2458 - DNA, 865 bp, Artificial Sequence
  chemically treated genomic DNA (Homo sapiens) CpG-island No: 2458
tttaatctctctacctctcttttcgtctctccttcacctctattcctttctaaacttctttttctcttctccccgtctatttctcccgctcccgatctctccctccccactctctaattttatctcgcgacccctccctctctctccatctccccgtctccccctccctctccgtctacacctacgaatctttctccctccctatccccgtctctatcctaaccccgacgcccgacaaaacactcgacacctacgaaaacgcgtaacccgccccgaaccgaacaaacgcgacgaaaaacccgaaacgcaaaattctccttaaaaaaaacctaaaaaaacccgcgatactcgcgaaacgaaaaataaaaataccgaaataaaaaaaacgacgaatcctctactacgaaattaaaataatacgaaaacgaaacgaaaacaaaattccctttccgaacaccaacgttaaaacgtcgccgtattaaataaaaataaaaacgcatccgaccgtctccccctaaccgccgcgatttaccgccacttaaccgcttttcatttacgcaacgaccgaaactaaaaacctaaaccgaaacctaataaccccgcgaccctcgcccccgccacctcttacgccccaaacgaaatccgataatataaacgcgacccccaaaacacctaaaacgcgacaaatacgcaaaattaacgacgtaaaccccgcgaccgcgaaaccgcgcgacgaaaccacgacgtaaacaacgaacccgacaaaaaacaaacgaacaacgtaatccgaatttatcatcctcaacgccccaacgccctacgaaaaactcgaaataccaaaaactacgctcacccctccgattcc

SEQ ID NO: 2459 - DNA, 865 bp, Artificial Sequence
  chemically treated genomic DNA (Homo sapiens) CpG-island No: 2459
tttggtttttttgttttttttttcgttttttttttatttttgtttttttttgggtttttttttttttttttttcgtttgtttttttcgttttcggtttttttttttttattttttggttttgtttcgcgatttttttttttttttttattttttcgttttttttttttttttcgtttgtatttgcgggtttttttttttttttgttttcgtttttgttttggtttcggcgttcggtaggatattcggtatttgcggaaacgcgtggttcgtttcgagtcgggtaagcgcgacgggagattcggggcgtaaagttttttttggaggaggtttggggaggttcgcggtgttcgcggagcggggaatggggatgtcggagtagaaagggcggcgagttttttgttgcggggttgaaatggtgcgggggcggggcgggggtagagtttttttttcgagtattagcgttggggcgtcgtcgtgttaggtggagatggggacgtattcggtcgtttttttttaatcgtcgcgatttgtcgttatttaatcgttttttatttgcgtagcgatcggaattaaaggtttgggtcggagtttagtgatttcgcggttttcgttttcgttattttttacgttttaggcggagttcggtggtgtagacgcggtttttagggtatttgagacgcgataggtgcgtaaggttgacggcgtgaatttcgcggtcgcggggtcgcgcggcggggttacggcgtgggtagcggattcggtagagagtaggcgggtagcgtggttcgggtttattatttttaacgttttagcgttttgcgggaggttcggggtgttaggagttgcgtttattttttcggtttt

SEQ ID NO: 2460 - DNA, 865 bp, Artificial Sequence
  chemically treated genomic DNA (Homo sapiens) CpG-island No: 2460
aaaaccgaaaaaataaacgcaactcctaacaccccgaacctcccgcaaaacgctaaaacgttaaaaataataaacccgaaccacgctacccgcctactctctaccgaatccgctacccacgccgtaaccccgccgcgcgaccccgcgaccgcgaaattcacgccgtcaaccttacgcacctatcgcgtctcaaataccctaaaaaccgcgtctacaccaccgaactccgcctaaaacgtaaaaaataacgaaaacgaaaaccgcgaaatcactaaactccgacccaaacctttaattccgatcgctacgcaaataaaaaacgattaaataacgacaaatcgcgacgattaaaaaaaaacgaccgaatacgtccccatctccacctaacacgacgacgccccaacgctaatactcgaaaaaaaaactctacccccgccccgcccccgcaccatttcaaccccgcaacaaaaaactcgccgccctttctactccgacatccccattccccgctccgcgaacaccgcgaacctccccaaacctcctccaaaaaaaactttacgccccgaatctcccgtcgcgcttacccgactcgaaacgaaccacgcgtttccgcaaataccgaatatcctaccgaacgccgaaaccaaaacaaaaacgaaaacaaaaaaaaaaaaaaacccgcaaatacaaacgaaaaaaaaaaaaaaaacgaaaaaataaaaaaaaaaaaaaaaatcgcgaaacaaaaccaaaaaataaaaaaaaaaaaaccgaaaacgaaaaaaacaaacgaaaaaaaaaaaaaaaaaaacccaaaaaaaaacaaaaataaaaaaaaaacgaaaaaaaaaacaaaaaaaccaaa

SEQ ID NO: 2461 - DNA, 572 bp, Artificial Sequence
  chemically treated genomic DNA (Homo sapiens) CpG-island No: 2461
tgtcgcggattaagttttgtagatttttgtcgaatatgcggtcgatgttgttttttattattttgagggttatcgcggcggtttacgggtttttgtttcgggaggttcgcggttgggcgtcgtgagggggttcggggttcgtgtttgtcgttcgcggagcgtcgcgttgtcggtcgttgcggcggggtaagtttttaggttagggcggcggcggggtttaaggatcgcggtagaggcggcgattcgttcggtaggtgtcgcgatttcgtttcgggttttttgtaaatggcggataagatggcggcgggttagttgacgacgagcgttcggttttagtcgagtcggtttcggaagtttcgttttttagaaagtttcgtttcgttattttttcggtagggagacgttgcgtttttttgacgacgataggtagtttaatggaaatgtggtattttttttttttgcgcgcggtttcgtttttttcggttttaaaatttgcgtttttattggttagtggttttcggaatttcgttttttttttagttttgagttttagttacgttttttagaggttg

SEQ ID NO: 2462 - DNA, 572 bp, Artificial Sequence
  chemically treated genomic DNA (Homo sapiens) CpG-island No: 2462
caacctctaaaaaacgtaactaaaactcaaaactaaaaaaaaaacgaaattccgaaaaccactaaccaataaaaacgcaaattttaaaaccgaaaaaaacgaaaccgcgcgcaaaaaaaaaaaataccacatttccattaaactacctatcgtcgtcaaaaaaacgcaacgtctccctaccgaaaaaataacgaaacgaaactttctaaaaaacgaaacttccgaaaccgactcgactaaaaccgaacgctcgtcgtcaactaacccgccgccatcttatccgccatttacaaaaaacccgaaacgaaatcgcgacacctaccgaacgaatcgccgcctctaccgcgatccttaaaccccgccgccgccctaacctaaaaacttaccccgccgcaacgaccgacaacgcgacgctccgcgaacgacaaacacgaaccccgaaccccctcacgacgcccaaccgcgaacctcccgaaacaaaaacccgtaaaccgccgcgataaccctcaaaataataaaaaacaacatcgaccgcatattcgacaaaaatctacaaaacttaatccgcgaca

SEQ ID NO: 2463 - DNA, 572 bp, Artificial Sequence
  chemically treated genomic DNA (Homo sapiens) CpG-island No: 2463
tagtttttaaggggcgtggttagggtttagaattaggaagaaggcggagtttcggaggttattgattaatgagagcgtaagttttggggtcggaaaaggcggggtcgcgcgtaggagaaagaggtgttatatttttattggattatttgtcgtcgttagggaaacgtagcgtttttttgtcggggaggtggcggggcggggttttttgggaggcggggttttcggggtcggttcggttgggatcgggcgttcgtcgttagttgattcgtcgttattttgttcgttatttgtaaggggttcggagcgggatcgcggtatttgtcgagcgggtcgtcgtttttgtcgcggtttttggatttcgtcgtcgttttggtttgggagtttgtttcgtcgtagcggtcggtagcgcggcgtttcgcgggcggtaggtacgggtttcgggtttttttacggcgtttagtcgcgggtttttcgaggtaaaagttcgtgggtcgtcgcgatggtttttaagatggtgaagggtagtatcgatcgtatgttcgataagaatttgtaggatttggttcgcggta

SEQ ID NO: 2464 - DNA, 572 bp, Artificial Sequence
  chemically treated genomic DNA (Homo sapiens) CpG-island No: 2464
taccgcgaaccaaatcctacaaattcttatcgaacatacgatcgatactacccttcaccatcttaaaaaccatcgcgacgacccacgaacttttacctcgaaaaacccgcgactaaacgccgtaaaaaaacccgaaacccgtacctaccgcccgcgaaacgccgcgctaccgaccgctacgacgaaacaaactcccaaaccaaaacgacgacgaaatccaaaaaccgcgacaaaaacgacgacccgctcgacaaataccgcgatcccgctccgaaccccttacaaataacgaacaaaataacgacgaatcaactaacgacgaacgcccgatcccaaccgaaccgaccccgaaaaccccgcctcccaaaaaaccccgccccgccacctccccgacaaaaaaacgctacgtttccctaacgacgacaaataatccaataaaaatataacacctctttctcctacgcgcgaccccgccttttccgaccccaaaacttacgctctcattaatcaataacctccgaaactccgccttcttcctaattctaaaccctaaccacgccccttaaaaacta

SEQ ID NO: 2465 - DNA, 1066 bp, Artificial Sequence
  chemically treated genomic DNA (Homo sapiens) CpG-island No: 2465
tgttcggcgttttttttttgggacgggattcgaattcgttattcgacgggttcgtttatagggttttttcgggttttcgtttcgggtcggcgagtgggggaaggggtcggtcgagggtaatcgaggacgtgcgtgcgtacgttcgtgcgtgcgtggattcgggcgggcgggcgagtttacggggcggggcgtcgagggggtggcgcgcgcgggtcggttcgttgggcggcgggtacgcgtcggcgttttcgtttcgggtttttttagcgcgcggggcgagtggtttcgttcggttttcggtttattgtgttcgttttacgtcggtttaagatggcggaggcgttggaggtttcgggtttgtgattataaagagggagtcgggggtcgggtcggatcggagcgcggcggcggcggcggcggcggtcgaggtcgaggttaggttttttttttttagtttttcgtttttttttttcgttcgttttttttcgtttatcggcggtttcgttttttttttaatcgttcgtttagtatggtgcggcggtcgcgcgcgcggatatgggggagaagttggagttgagattgaagtcgttcgtgggggttgagttcgtcgtttattcgtggtcgttgtcggtttacgtgagtgtcgttttttatcgtttttatttttcggttttttttttttcgtcgtttttggggatattttaaatttttttaagtcgcgtttatcggttttttttgcggaacggagattttggattttattgtcgttgttttattttcgttgtttttcggtcgagggtttcgcggttgtttttcgtagggtgggagtttcgcgcgtttggggtgggagcgggagtcggcgttttcgagttttatcgcggtgtcgttgttttcgtcgggttgtttcgggcgcggaacggaaggggtaattcgtgtcggtcgcgttttgattggaagttcgttcgttcgtttcgttcgttttcggcgttgttagtgtgttcgtcgttttatttttttttttgagggtatttttttttgttttttttttttttttttttaaaaattg

SEQ ID NO: 2466 - DNA, 1066 bp, Artificial Sequence
  chemically treated genomic DNA (Homo sapiens) CpG-island No: 2466
caatttttaaaaaaaaaaaaaaaaaaaacaaaaaaaaataccctcaaaaaaaaaaataaaacgacgaacacactaacaacgccgaaaacgaacgaaacgaacgaacgaacttccaatcaaaacgcgaccgacacgaattaccccttccgttccgcgcccgaaacaacccgacgaaaacaacgacaccgcgataaaactcgaaaacgccgactcccgctcccaccccaaacgcgcgaaactcccaccctacgaaaaacaaccgcgaaaccctcgaccgaaaaacaacgaaaataaaacaacgacaataaaatccaaaatctccgttccgcaaaaaaaaccgataaacgcgacttaaaaaaatttaaaatatccccaaaaacgacgaaaaaaaaaaaaccgaaaaataaaaacgataaaaaacgacactcacgtaaaccgacaacgaccacgaataaacgacgaactcaacccccacgaacgacttcaatctcaactccaacttctcccccatatccgcgcgcgcgaccgccgcaccatactaaacgaacgattaaaaaaaaaacgaaaccgccgataaacgaaaaaaaacgaacgaaaaaaaaaaacgaaaaactaaaaaaaaaaaacctaacctcgacctcgaccgccgccgccgccgccgccgcgctccgatccgacccgacccccgactccctctttataatcacaaacccgaaacctccaacgcctccgccatcttaaaccgacgtaaaacgaacacaataaaccgaaaaccgaacgaaaccactcgccccgcgcgctaaaaaaacccgaaacgaaaacgccgacgcgtacccgccgcccaacgaaccgacccgcgcgcgccaccccctcgacgccccgccccgtaaactcgcccgcccgcccgaatccacgcacgcacgaacgtacgcacgcacgtcctcgattaccctcgaccgaccccttcccccactcgccgacccgaaacgaaaacccgaaaaaaccctataaacgaacccgtcgaataacgaattcgaatcccgtcccaaaaaaaaaacgccgaaca

SEQ ID NO: 2467 - DNA, 1066 bp, Artificial Sequence
  chemically treated genomic DNA (Homo sapiens) CpG-island No: 2467
taatttttaaaaagaagagaagaggagataggaaaggatgtttttaaaaagaaaaataaggcggcggatatattgatagcgtcgggaacgagcggggcgggcgggcgggtttttagttaaaacgcggtcggtacgagttatttttttcgtttcgcgttcgggatagttcggcgggggtaacggtatcgcggtagggttcgggggcgtcggttttcgtttttattttaggcgcgcggggtttttattttgcgggaaatagtcgcggggttttcggtcgggaagtaacgggggtggagtagcgatagtggagtttagggttttcgtttcgtaggggggatcggtgagcgcggtttgggggggtttggggtgtttttaggggcggcggaggaggggaggtcgggaggtagggacggtggagggcggtatttacgtagatcggtagcggttacgggtagacggcgggtttagtttttacgggcgattttagttttagttttagttttttttttatgttcgcgcgcgcggtcgtcgtattatgttaggcgggcggttgggggaggggcggggtcgtcggtgggcggaggagggcgggcgggagggaggggcgggaggttgaggggagggggtttggtttcggtttcggtcgtcgtcgtcgtcgtcgtcgcgtttcggttcggttcggttttcgattttttttttgtagttataggttcggggtttttagcgttttcgttattttgggtcggcgtgaagcgagtataatgagtcgggggtcgggcggaattattcgtttcgcgcgttaggggagttcggagcgaagacgtcggcgcgtgttcgtcgtttagcgggtcgattcgcgcgcgttattttttcggcgtttcgtttcgtggattcgttcgttcgttcgaatttacgtacgtacgaacgtacgtacgtacgttttcggttgttttcggtcgatttttttttttattcgtcggttcgaagcggggattcggggagattttgtgggcgggttcgtcggatagcgggttcgaatttcgttttaggaggaggacgtcggata

SEQ ID NO: 2468 - DNA, 1066 bp, Artificial Sequence
  chemically treated genomic DNA (Homo sapiens) CpG-island No: 2468
tatccgacgtcctcctcctaaaacgaaattcgaacccgctatccgacgaacccgcccacaaaatctccccgaatccccgcttcgaaccgacgaataaaaaaaaaaatcgaccgaaaacaaccgaaaacgtacgtacgtacgttcgtacgtacgtaaattcgaacgaacgaacgaatccacgaaacgaaacgccgaaaaaataacgcgcgcgaatcgacccgctaaacgacgaacacgcgccgacgtcttcgctccgaactcccctaacgcgcgaaacgaataattccgcccgacccccgactcattatactcgcttcacgccgacccaaaataacgaaaacgctaaaaaccccgaacctataactacaaaaaaaaaatcgaaaaccgaaccgaaccgaaacgcgacgacgacgacgacgacgaccgaaaccgaaaccaaaccccctcccctcaacctcccgcccctccctcccgcccgccctcctccgcccaccgacgaccccgcccctcccccaaccgcccgcctaacataatacgacgaccgcgcgcgcgaacataaaaaaaaaactaaaactaaaactaaaatcgcccgtaaaaactaaacccgccgtctacccgtaaccgctaccgatctacgtaaataccgccctccaccgtccctacctcccgacctcccctcctccgccgcccctaaaaacaccccaaacccccccaaaccgcgctcaccgatcccccctacgaaacgaaaaccctaaactccactatcgctactccacccccgttacttcccgaccgaaaaccccgcgactatttcccgcaaaataaaaaccccgcgcgcctaaaataaaaacgaaaaccgacgcccccgaaccctaccgcgataccgttacccccgccgaactatcccgaacgcgaaacgaaaaaaataactcgtaccgaccgcgttttaactaaaaacccgcccgcccgccccgctcgttcccgacgctatcaatatatccgccgccttatttttctttttaaaaacatcctttcctatctcctcttctcttctttttaaaaatta

SEQ ID NO: 2469 - DNA, 581 bp, Artificial Sequence
  chemically treated genomic DNA (Homo sapiens) CpG-island No: 2469
gcgcggggtaatttttttcggttgaggatggggtcgcgggttgggggttttgggcggtagggtcgtagggtgtaggtgaggggtttttaggtttgcgggcgcgttttacgtcgggtttcggtacggttatttatttgggcggtttcgtcgcggatacggcgcgggttgcggcgcgggggtcgttcggagtcgatacgagtagtcgtcgtcgtcgtcgtcgtcgtcgtcgtcgtttttcgggtttcgtcgtgcgcgtcgtcgtcgcgcgtaatcgttcgtcggttttttcggcgcgtttggcgggggcgcgcgggggttgcgttgggtcgcgtgcgcggcggttggggtcgtaggtgtgagaggttacgtgggcgtaggtgcggggatattgggagcgcgggtgtagaattttttcgtgcgtatttcgggcgtttcgtgttcgaggattttttgtttttacggtttgggtgagtttgcggagacggtcgtgtcgtgtaataaacgtaggggtattttaagtgtagtaggttgtttcgtgtggaattttttggaagttattatcgttttttttgtttttcgtt

SEQ ID NO: 2470 - DNA, 581 bp, Artificial Sequence
  chemically treated genomic DNA (Homo sapiens) CpG-island No: 2470
aacgaaaaacaaaaaaaacgataataacttccaaaaaattccacacgaaacaacctactacacttaaaatacccctacgtttattacacgacacgaccgtctccgcaaactcacccaaaccgtaaaaacaaaaaatcctcgaacacgaaacgcccgaaatacgcacgaaaaaattctacacccgcgctcccaatatccccgcacctacgcccacgtaacctctcacacctacgaccccaaccgccgcgcacgcgacccaacgcaacccccgcgcgcccccgccaaacgcgccgaaaaaaccgacgaacgattacgcgcgacgacgacgcgcacgacgaaacccgaaaaacgacgacgacgacgacgacgacgacgacgactactcgtatcgactccgaacgacccccgcgccgcaacccgcgccgtatccgcgacgaaaccgcccaaataaataaccgtaccgaaacccgacgtaaaacgcgcccgcaaacctaaaaacccctcacctacaccctacgaccctaccgcccaaaacccccaacccgcgaccccatcctcaaccgaaaaaaattaccccgcgc

SEQ ID NO: 2471 - DNA, 581 bp, Artificial Sequence
  chemically treated genomic DNA (Homo sapiens) CpG-island No: 2471
gacggggggtagaggaggcgatggtagtttttagaaggttttatacggaataatttgttgtatttggggtgtttttgcgtttattgtacggtacggtcgttttcgtaggtttatttaggtcgtggggataggaggttttcggatacgaagcgttcgggatgcgtacggaggggttttgtattcgcgtttttagtgttttcgtatttgcgtttacgtggttttttatatttgcggttttagtcgtcgcgtacgcggtttagcgtagttttcgcgcgttttcgttaggcgcgtcgaggagatcggcgggcggttgcgcgcggcggcggcgcgtacggcggagttcgggaggcggcggcggcggcggcggcggcggcggcggttgttcgtgtcggtttcgggcggttttcgcgtcgtagttcgcgtcgtgttcgcggcggagtcgtttaggtgagtggtcgtgtcggggttcggcgtggggcgcgttcgtagatttggggattttttatttgtattttgcgattttgtcgtttaaagtttttaattcgcgattttatttttagtcgggggaaattgtttcgcgt

SEQ ID NO: 2472 - DNA, 581 bp, Artificial Sequence
  chemically treated genomic DNA (Homo sapiens) CpG-island No: 2472
acgcgaaacaatttcccccgactaaaaataaaatcgcgaattaaaaactttaaacgacaaaatcgcaaaatacaaataaaaaatccccaaatctacgaacgcgccccacgccgaaccccgacacgaccactcacctaaacgactccgccgcgaacacgacgcgaactacgacgcgaaaaccgcccgaaaccgacacgaacaaccgccgccgccgccgccgccgccgccgccgcctcccgaactccgccgtacgcgccgccgccgcgcgcaaccgcccgccgatctcctcgacgcgcctaacgaaaacgcgcgaaaactacgctaaaccgcgtacgcgacgactaaaaccgcaaatataaaaaaccacgtaaacgcaaatacgaaaacactaaaaacgcgaatacaaaacccctccgtacgcatcccgaacgcttcgtatccgaaaacctcctatccccacgacctaaataaacctacgaaaacgaccgtaccgtacaataaacgcaaaaacaccccaaatacaacaaattattccgtataaaaccttctaaaaactaccatcgcctcctctaccccccgtc

SEQ ID NO: 2473 - DNA, 610 bp, Artificial Sequence
  chemically treated genomic DNA (Homo sapiens) CpG-island No: 2473
atttggagcgcggttcgagttttacgtttttcggttttagatttcgtcgcgcgtttatcgttattttgtcgcgtcgtgtggtttttcgtaggtatcgtttcgcgttttttgattttttttacgcgtatgcgcggcgtatgcgtggttcggggtttcggggcgttgttgggaaatatttgtcgttggttgcggcgggtatcggtcgatatggcggtagcggtggcggttgcgttggcgcggtttttggcggtttttttgtttttcgcggtttaggtgagcgcggtatcggtttcgacggtatcgcgggttgcggtttttcggtttttttgttttcgggttacgcgtaggaacgatttcgttcggttcgttttgggggtttagtttcggggattcgtcgttttcgcgttgtcggtcggcggtgtcggggttcggtcgtgattttgcgggtttgttttcggtttttttttttttttcgtttcggaggtttttcgtcgttgtagcgttatttattttttatcgggtttgaaatttgtgttttttttatttttcggttttgttttttcgtttcggggtttttagttgtcgtcggggacgttttttttcggttttg

SEQ ID NO: 2474 - DNA, 610 bp, Artificial Sequence
  chemically treated genomic DNA (Homo sapiens) CpG-island No: 2474
caaaaccgaaaaaaaacgtccccgacgacaactaaaaaccccgaaacgaaaaaacaaaaccgaaaaataaaaaaaacacaaatttcaaacccgataaaaaataaataacgctacaacgacgaaaaacctccgaaacgaaaaaaaaaaaaaaaccgaaaacaaacccgcaaaatcacgaccgaaccccgacaccgccgaccgacaacgcgaaaacgacgaatccccgaaactaaacccccaaaacgaaccgaacgaaatcgttcctacgcgtaacccgaaaacaaaaaaaccgaaaaaccgcaacccgcgataccgtcgaaaccgataccgcgctcacctaaaccgcgaaaaacaaaaaaaccgccaaaaaccgcgccaacgcaaccgccaccgctaccgccatatcgaccgatacccgccgcaaccaacgacaaatatttcccaacaacgccccgaaaccccgaaccacgcatacgccgcgcatacgcgtaaaaaaaatcaaaaaacgcgaaacgatacctacgaaaaaccacacgacgcgacaaaataacgataaacgcgcgacgaaatctaaaaccgaaaaacgtaaaactcgaaccgcgctccaaat

SEQ ID NO: 2475 - DNA, 610 bp, Artificial Sequence
  chemically treated genomic DNA (Homo sapiens) CpG-island No: 2475
tagagtcggagagaggcgttttcggcggtaattggagatttcgaaacggagaagtagaatcggaggatggagggggtataaattttagattcggtgggaagtgagtggcgttgtagcggcggagggttttcgaggcggggaaaggagaggagtcggggatagattcgtaaggttacggtcgagtttcggtatcgtcggtcgataacgcggggacggcggattttcgaggttggatttttaagacgggtcgagcggggtcgtttttgcgcgtagttcggggatagagaggtcgaagggtcgtagttcgcggtgtcgtcgggatcggtgtcgcgtttatttgggtcgcgaggagtagaaaggtcgttaaaagtcgcgttagcgtagtcgttatcgttgtcgttatgtcggtcggtgttcgtcgtaattaacggtagatgttttttagtaacgtttcgagatttcgggttacgtatgcgtcgcgtatgcgcgtgggggaggttaaagggcgcggggcggtgtttgcgaagagttatacggcgcgataagatggcggtgagcgcgcggcggaatttggagtcggggggcgtggagttcgggtcgcgttttaggt

SEQ ID NO: 2476 - DNA, 610 bp, Artificial Sequence
  chemically treated genomic DNA (Homo sapiens) CpG-island No: 2476
acctaaaacgcgacccgaactccacgccccccgactccaaattccgccgcgcgctcaccgccatcttatcgcgccgtataactcttcgcaaacaccgccccgcgccctttaacctcccccacgcgcatacgcgacgcatacgtaacccgaaatctcgaaacgttactaaaaaacatctaccgttaattacgacgaacaccgaccgacataacgacaacgataacgactacgctaacgcgacttttaacgacctttctactcctcgcgacccaaataaacgcgacaccgatcccgacgacaccgcgaactacgacccttcgacctctctatccccgaactacgcgcaaaaacgaccccgctcgacccgtcttaaaaatccaacctcgaaaatccgccgtccccgcgttatcgaccgacgataccgaaactcgaccgtaaccttacgaatctatccccgactcctctcctttccccgcctcgaaaaccctccgccgctacaacgccactcacttcccaccgaatctaaaatttataccccctccatcctccgattctacttctccgtttcgaaatctccaattaccgccgaaaacgcctctctccgactcta

SEQ ID NO: 2477 - DNA, 772 bp, Artificial Sequence
  chemically treated genomic DNA (Homo sapiens) CpG-island No: 2477
gggtttgaatcggggcgaatattttcgttttttgatttcgatttttttgagttagaagggatttttcgatttttcgatttgtgtttatattaaggcggtggttttaagacgacgcgggggttttggtgcgtatttacgtgtagtcggatgcgttgggtgagtttttatattcggtagatgtaagggaaaaattgtattatttagaaggtattgttttttgcgtcggtcgcggattttgggttattgacgatttaggataggagagttttttgcgggttagggcggcggaggcgggattttcgttttttcgtgtgacgttattttcgtgggtcggtttggttttgaaatagtgtggggtttagagcgttgggtgggcgcgttttgcggtttgagtagggacgggtagtgaagcggttacgtttttttttcgcgttttggcgggagtttgacgtttcgttttttttttaacgaggtgttttatcggcgttcgtcgaggtttaggttttcgtagtcgtttttcgtttttttagtttcgacgttgcgttttgggttttgtgcgtatttttttcgggggaaaattgaggttcggagtgcgaaagttagtcgaggtcgtttcgtttaggatagagaagggttgtggtcggttgattcgcggtattttcgggatggcggcggcgtggatggtttcggcgtaggtgagtggacgaggtttcggttttgttgttgttgtgttatttttagaggtttcgtgggtaggttggaagttaagata

SEQ ID NO: 2478 - DNA, 772 bp, Artificial Sequence
  chemically treated genomic DNA (Homo sapiens) CpG-island No: 2478
tatcttaacttccaacctacccacgaaacctctaaaaataacacaacaacaacaaaaccgaaacctcgtccactcacctacgccgaaaccatccacgccgccgccatcccgaaaataccgcgaatcaaccgaccacaacccttctctatcctaaacgaaacgacctcgactaactttcgcactccgaacctcaattttcccccgaaaaaaatacgcacaaaacccaaaacgcaacgtcgaaactaaaaaaacgaaaaacgactacgaaaacctaaacctcgacgaacgccgataaaacacctcgttaaaaaaaaaacgaaacgtcaaactcccgccaaaacgcgaaaaaaaaacgtaaccgcttcactacccgtccctactcaaaccgcaaaacgcgcccacccaacgctctaaaccccacactatttcaaaaccaaaccgacccacgaaaataacgtcacacgaaaaaacgaaaatcccgcctccgccgccctaacccgcaaaaaactctcctatcctaaatcgtcaataacccaaaatccgcgaccgacgcaaaaaacaataccttctaaataatacaatttttcccttacatctaccgaatataaaaactcacccaacgcatccgactacacgtaaatacgcaccaaaacccccgcgtcgtcttaaaaccaccgccttaatataaacacaaatcgaaaaatcgaaaaatcccttctaactcaaaaaaatcgaaatcaaaaaacgaaaatattcgccccgattcaaaccc

SEQ ID NO: 2479 - DNA, 772 bp, Artificial Sequence
  chemically treated genomic DNA (Homo sapiens) CpG-island No: 2479
tgttttggtttttagtttgtttacgaggtttttagaaatagtatagtagtagtaaggtcgaaatttcgtttatttatttgcgtcggagttatttacgtcgtcgttatttcgggaatgtcgcggattagtcgattatagtttttttttgttttgggcggggcgatttcggttgattttcgtatttcgagttttagttttttttcgaaaaaaatgcgtataaggtttaaggcgtagcgtcggggttgaggagacggagggcggttgcggaggtttaggtttcggcgggcgtcggtgggatatttcgttaggggagaagcggggcgttaggttttcgttaagacgcgaagaaggggcgtaatcgttttattattcgtttttgtttaggtcgtagaacgcgtttatttagcgttttaggttttatattgttttagggttaaatcggtttacggagatgacgttatacgaagaagcggaagtttcgttttcgtcgttttggttcgtagaaaatttttttgttttgggtcgttaatggtttagagttcgcggtcgacgtaaggggtagtgttttttgggtaatgtagttttttttttatatttatcgggtgtgggaatttatttagcgtattcgattgtacgtaagtgcgtattagaattttcgcgtcgttttagggttatcgttttagtataggtataagtcggagggtcgaaaggttttttttagtttaggaaaatcgaggttaggaggcggggatattcgtttcgatttagattt

SEQ ID NO: 2480 - DNA, 772 bp, Artificial Sequence
  chemically treated genomic DNA (Homo sapiens) CpG-island No: 2480
aaatctaaatcgaaacgaatatccccgcctcctaacctcgattttcctaaactaaaaaaaacctttcgaccctccgacttatacctatactaaaacgataaccctaaaacgacgcgaaaattctaatacgcacttacgtacaatcgaatacgctaaataaattcccacacccgataaatataaaaaaaaaactacattacccaaaaaacactaccccttacgtcgaccgcgaactctaaaccattaacgacccaaaacaaaaaaattttctacgaaccaaaacgacgaaaacgaaacttccgcttcttcgtataacgtcatctccgtaaaccgatttaaccctaaaacaatataaaacctaaaacgctaaataaacgcgttctacgacctaaacaaaaacgaataataaaacgattacgccccttcttcgcgtcttaacgaaaacctaacgccccgcttctcccctaacgaaatatcccaccgacgcccgccgaaacctaaacctccgcaaccgccctccgtctcctcaaccccgacgctacgccttaaaccttatacgcatttttttcgaaaaaaaactaaaactcgaaatacgaaaatcaaccgaaatcgccccgcccaaaacaaaaaaaaactataatcgactaatccgcgacattcccgaaataacgacgacgtaaataactccgacgcaaataaataaacgaaatttcgaccttactactactatactatttctaaaaacctcgtaaacaaactaaaaaccaaaaca

SEQ ID NO: 2481 - DNA, 833 bp, Artificial Sequence
  chemically treated genomic DNA (Homo sapiens) CpG-island No: 2481
gtcgcgtgcgcgttttcgttatcgcgtttgggtcgagtcgagcgggatcgagcggggtcgaacggagtcgagcggagtcgagtttggtcgggtcgagttcgttatatttttataatttcgggcggtttcgtttcggttttcggttgcgcgtttttttttttacgtcggcgtaattaaattcgcgggtttttcgttttcgtttcgtttcgtttttttcgcgttcgtcgacgtttcgtttaggtcgttagtttcgtttttatggtgggcgcgtttggtcgtcggttttttttattggtcgtatcgtttgttcgtcgcgggttgcgtttttagtttgttaggttgttcggcgttgtcgttcggttgcggcggttgcggttggcggtggttgcggcggcggcgcgggttgagtgcggtcgcgcgggagttcgcggttggcgcggttcgagcggggattcggcggttcgttaggcggcggtcgaggcggggcgggtcggttcggggtcgagggtcggtggtcgaggtcggagggtcgcggcgggcggcggtcgaggcggtttcggttagggtcgggtcgggggtcggggggcggcggcgggtaggcggtcgcgtcggtcggggtcgggacgatgattttggagtttatgatggcgtgttgtttgagcgatgaggtgaaggagtttaagcggattaacgtcgagatcgagaagtagttgcggcgggataagcgcgacgttcggcgcgagtttaagttgttgttgttcggtgagtgcggttttcgggtttgtcggttgcgggttttgttttgtttgtgtttgttttgtttgttcgggtcg

SEQ ID NO: 2482 - DNA, 833 bp, Artificial Sequence
  chemically treated genomic DNA (Homo sapiens) CpG-island No: 2482
cgacccgaacaaacaaaacaaacacaaacaaaacaaaacccgcaaccgacaaacccgaaaaccgcactcaccgaacaacaacaacttaaactcgcgccgaacgtcgcgcttatcccgccgcaactacttctcgatctcgacgttaatccgcttaaactccttcacctcatcgctcaaacaacacgccatcataaactccaaaatcatcgtcccgaccccgaccgacgcgaccgcctacccgccgccgccccccgacccccgacccgaccctaaccgaaaccgcctcgaccgccgcccgccgcgaccctccgacctcgaccaccgaccctcgaccccgaaccgacccgccccgcctcgaccgccgcctaacgaaccgccgaatccccgctcgaaccgcgccaaccgcgaactcccgcgcgaccgcactcaacccgcgccgccgccgcaaccaccgccaaccgcaaccgccgcaaccgaacgacaacgccgaacaacctaacaaactaaaaacgcaacccgcgacgaacaaacgatacgaccaataaaaaaaaccgacgaccaaacgcgcccaccataaaaacgaaactaacgacctaaacgaaacgtcgacgaacgcgaaaaaaacgaaacgaaacgaaaacgaaaaacccgcgaatttaattacgccgacgtaaaaaaaaaaacgcgcaaccgaaaaccgaaacgaaaccgcccgaaattataaaaatataacgaactcgacccgaccaaactcgactccgctcgactccgttcgaccccgctcgatcccgctcgactcgacccaaacgcgataacgaaaacgcgcacgcgac

SEQ ID NO: 2483 - DNA, 833 bp, Artificial Sequence
  chemically treated genomic DNA (Homo sapiens) CpG-island No: 2483
cgattcggataggtagggtaggtataggtagggtagggttcgtagtcggtaggttcgggggtcgtatttatcgagtagtagtagtttgagttcgcgtcgggcgtcgcgtttgtttcgtcgtagttgtttttcgatttcggcgttgattcgtttggatttttttattttatcgtttaggtaatacgttattatggattttagagttatcgtttcggtttcggtcgacgcggtcgtttgttcgtcgtcgtttttcggttttcggttcggttttggtcggagtcgtttcggtcgtcgttcgtcgcggtttttcggtttcggttatcggttttcggtttcgggtcggttcgtttcgtttcggtcgtcgtttggcgagtcgtcgggttttcgttcgggtcgcgttagtcgcggattttcgcgcggtcgtatttagttcgcgtcgtcgtcgtagttatcgttaatcgtagtcgtcgtaatcgagcgatagcgtcggataatttagtaggttgggagcgtagttcgcgacgggtagacggtgcggttaatgggaggggtcggcggttaagcgcgtttattatgggggcgggattagcggtttgggcggggcgtcggcgggcgcgaaaggggcggggcggggcgagggcggggggttcgcgggtttggttgcgtcgacgtgggaagggggacgcgtagtcgggagtcggggcggggtcgttcgggattgtgggaatgtggcggattcggttcggttaggttcggtttcgttcggtttcgttcggtttcgttcggtttcgttcggttcggtttaggcgcggtggcggaggcgcgtacgcggt

SEQ ID NO: 2484 - DNA, 833 bp, Artificial Sequence
  chemically treated genomic DNA (Homo sapiens) CpG-island No: 2484
accgcgtacgcgcctccgccaccgcgcctaaaccgaaccgaacgaaaccgaacgaaaccgaacgaaaccgaacgaaaccgaacctaaccgaaccgaatccgccacattcccacaatcccgaacgaccccgccccgactcccgactacgcgtcccccttcccacgtcgacgcaaccaaacccgcgaaccccccgccctcgccccgccccgcccctttcgcgcccgccgacgccccgcccaaaccgctaatcccgcccccataataaacgcgcttaaccgccgacccctcccattaaccgcaccgtctacccgtcgcgaactacgctcccaacctactaaattatccgacgctatcgctcgattacgacgactacgattaacgataactacgacgacgacgcgaactaaatacgaccgcgcgaaaatccgcgactaacgcgacccgaacgaaaacccgacgactcgccaaacgacgaccgaaacgaaacgaaccgacccgaaaccgaaaaccgataaccgaaaccgaaaaaccgcgacgaacgacgaccgaaacgactccgaccaaaaccgaaccgaaaaccgaaaaacgacgacgaacaaacgaccgcgtcgaccgaaaccgaaacgataactctaaaatccataataacgtattacctaaacgataaaataaaaaaatccaaacgaatcaacgccgaaatcgaaaaacaactacgacgaaacaaacgcgacgcccgacgcgaactcaaactactactactcgataaatacgacccccgaacctaccgactacgaaccctaccctacctatacctaccctacctatccgaatcg

SEQ ID NO: 2485 - DNA, 505 bp, Artificial Sequence
  chemically treated genomic DNA (Homo sapiens) CpG-island No: 2485
ttgttgagcggtaaggtcgttaaggttcgggatcgcgaggtcgattttaagaatggttataatttttttatttttgcggcggtcgtgtttttcggaagtttttttagcggtttcggtttggtttcggcggcgtttttcgtaggcggcgcggcgtttttcgtttagacgtatcggttttttttgggttttttttcgtcgggatcgtagttcgcgttcggttttatgtttttgtaggttaatttcggtttcgtggtcggttttttcgtgttgtagtcgttgtttagttttgtgtcggtcgtcgtaggtttggtgtacgtgtcgttcgttgttattagattgattaattcgtacgttatgggtagttttttcggggtggtaggcggtatagttggaggtaggtagggcggtcgttcgttcgtttttcgtttcggttttcgtcggaggtttttttttttgtaggttttttttcgtatttttttgtagtaggagttgagttgtaggtttt

SEQ ID NO: 2486 - DNA, 505 bp, Artificial Sequence
  chemically treated genomic DNA (Homo sapiens) CpG-island No: 2486
aaaacctacaactcaactcctactacaaaaaaatacgaaaaaaaacctacaaaaaaaaaaacctccgacgaaaaccgaaacgaaaaacgaacgaacgaccgccctacctacctccaactataccgcctaccaccccgaaaaaactacccataacgtacgaattaatcaatctaataacaacgaacgacacgtacaccaaacctacgacgaccgacacaaaactaaacaacgactacaacacgaaaaaaccgaccacgaaaccgaaattaacctacaaaaacataaaaccgaacgcgaactacgatcccgacgaaaaaaaacccaaaaaaaaccgatacgtctaaacgaaaaacgccgcgccgcctacgaaaaacgccgccgaaaccaaaccgaaaccgctaaaaaaacttccgaaaaacacgaccgccgcaaaaataaaaaaattataaccattcttaaaatcgacctcgcgatcccgaaccttaacgaccttaccgctcaacaa

SEQ ID NO: 2487 - DNA, 505 bp, Artificial Sequence
  chemically treated genomic DNA (Homo sapiens) CpG-island No: 2487
gggatttgtagtttagtttttgttgtaagagagtgcggaagggaatttgtaaaggaaggggttttcggcgggggtcggggcggggggcggacggacggtcgttttgtttatttttaattgtgtcgtttgttatttcggaaaagttgtttatggcgtgcgagttggttagtttggtggtagcggacgatacgtgtattaggtttgcggcggtcggtatagagttgaatagcgattgtagtacggaggagtcggttacggagtcgaggttggtttgtagggatatggggtcgagcgcgaattgcggtttcggcgggaaggggtttaggaaggatcggtgcgtttgggcggaggacgtcgcgtcgtttgcggaggacgtcgtcggggttaggtcggggtcgttgaggaggttttcgggaggtacggtcgtcgtagagatgaagaggttgtggttatttttgaggtcgatttcgcggtttcgggttttggcggttttgtcgtttagtag

SEQ ID NO: 2488 - DNA, 505 bp, Artificial Sequence
  chemically treated genomic DNA (Homo sapiens) CpG-island No: 2488
ctactaaacgacaaaaccgccaaaacccgaaaccgcgaaatcgacctcaaaaataaccacaacctcttcatctctacgacgaccgtacctcccgaaaacctcctcaacgaccccgacctaaccccgacgacgtcctccgcaaacgacgcgacgtcctccgcccaaacgcaccgatccttcctaaaccccttcccgccgaaaccgcaattcgcgctcgaccccatatccctacaaaccaacctcgactccgtaaccgactcctccgtactacaatcgctattcaactctataccgaccgccgcaaacctaatacacgtatcgtccgctaccaccaaactaaccaactcgcacgccataaacaacttttccgaaataacaaacgacacaattaaaaataaacaaaacgaccgtccgtccgccccccgccccgacccccgccgaaaaccccttcctttacaaattcccttccgcactctcttacaacaaaaactaaactacaaatccc

SEQ ID NO: 2489 - DNA, 673 bp, Artificial Sequence
  chemically treated genomic DNA (Homo sapiens) CpG-island No: 2489
ggggggtcggagggcggagggcgggttattacgagtttggtcgagtcgttgtttgtgtttggtgttcgtatacgtttggcggcgtcgtttcgtttttttttttgtgagtttgcggttgttgttttgcgtttgtttggatgttgtcgtttgttgaagttgcgttttttttttttatttgtaggtgtttttaattacgcggtgtttttcgtttttgtttattcgtttggagttcgtgtcggtcgcggggttgtatgtggtagcgttatattgggttcgagttcgttgtaggcggcggttagcgtttcggttttttttttttaggtttcggtttcggttgagattcggtcgtttttttcgttttcgttttcgtttttttcgttgttttcgtttgcgtatttgggtcggtttttcgcggggtcgttcgttttttacgttttttttttatttaacgtcgttttgtttttttttttaacgttgttggtttttaattttgagttcgcgtttttgtagagtttcgcgtttttttcgtttaattaagtttttttgttttttatttttgttgtttttttgtcgtttgttaacgtttttttgtttattaagtttatttttttttcgtataagggcgttcgttttttttttacggtgtattattagtttttgtttcggttggttt

SEQ ID NO: 2490 - DNA, 673 bp, Artificial Sequence
  chemically treated genomic DNA (Homo sapiens) CpG-island No: 2490
aaaccaaccgaaacaaaaactaataatacaccgtaaaaaaaaaacgaacgcccttatacgaaaaaaaaataaacttaataaacaaaaaaacgttaacaaacgacaaaaaaacaacaaaaataaaaaacaaaaaaacttaattaaacgaaaaaaacgcgaaactctacaaaaacgcgaactcaaaattaaaaaccaacaacgttaaaaaaaaaaacaaaacgacgttaaataaaaaaaaaacgtaaaaaacgaacgaccccgcgaaaaaccgacccaaatacgcaaacgaaaacaacgaaaaaaacgaaaacgaaaacgaaaaaaacgaccgaatctcaaccgaaaccgaaacctaaaaaaaaaaaaccgaaacgctaaccgccgcctacaacgaactcgaacccaatataacgctaccacatacaaccccgcgaccgacacgaactccaaacgaataaacaaaaacgaaaaacaccgcgtaattaaaaacacctacaaataaaaaaaaaaaacgcaacttcaacaaacgacaacatccaaacaaacgcaaaacaacaaccgcaaactcacaaaaaaaaaaacgaaacgacgccgccaaacgtatacgaacaccaaacacaaacaacgactcgaccaaactcgtaataacccgccctccgccctccgacccccc

SEQ ID NO: 2491 - DNA, 673 bp, Artificial Sequence
  chemically treated genomic DNA (Homo sapiens) CpG-island No: 2491
gggttagtcggggtaggggttggtggtgtatcgtgaaggaggggcgggcgtttttgtgcgggagggaggtgagtttgatagataaagaggcgttagtaggcggtagagaggtagtagaggtggggggtaagaaagtttggttaggcgggagggacgcgaggttttgtagaagcgcgggtttagggttagaggttagtagcgttgggggaggaggtaaggcggcgttaggtggagggggggcgtggaggacgggcggtttcgcgggggatcggtttaggtgcgtaggcgggggtagcgggggaggcggaggcggaggcggagggggcggtcgggttttaatcgaggtcggggtttgaaaggaagaggtcgaggcgttggtcgtcgtttgtagcgggttcgggtttagtgtggcgttgttatatgtagtttcgcggtcgatacgggttttaaacggatgagtagaggcggagggtatcgcgtggttaaagatatttgtaaataggagagaaaaacgtagttttaataagcggtagtatttaggtaagcgtagagtagtagtcgtaggtttataaaaagggaagcgaaacggcgtcgttaggcgtgtgcgggtattaagtataagtagcggttcggttaggttcgtggtggttcgtttttcgtttttcggtttttt

SEQ ID NO: 2492 - DNA, 673 bp, Artificial Sequence
  chemically treated genomic DNA (Homo sapiens) CpG-island No: 2492
aaaaaaccgaaaaacgaaaaacgaaccaccacgaacctaaccgaaccgctacttatacttaatacccgcacacgcctaacgacgccgtttcgcttccctttttataaacctacgactactactctacgcttacctaaatactaccgcttattaaaactacgtttttctctcctatttacaaatatctttaaccacgcgataccctccgcctctactcatccgtttaaaacccgtatcgaccgcgaaactacatataacaacgccacactaaacccgaacccgctacaaacgacgaccaacgcctcgacctcttcctttcaaaccccgacctcgattaaaacccgaccgccccctccgcctccgcctccgcctcccccgctacccccgcctacgcacctaaaccgatcccccgcgaaaccgcccgtcctccacgccccccctccacctaacgccgccttacctcctcccccaacgctactaacctctaaccctaaacccgcgcttctacaaaacctcgcgtccctcccgcctaaccaaactttcttaccccccacctctactacctctctaccgcctactaacgcctctttatctatcaaactcacctccctcccgcacaaaaacgcccgcccctccttcacgatacaccaccaacccctaccccgactaaccc

SEQ ID NO: 2493 - DNA, 1319 bp, Artificial Sequence
  chemically treated genomic DNA (Homo sapiens) CpG-island No: 2493
tacgggcgtcgggacggggtagtgagtattcggttttcgaggggtttagtttgggattcgttcgcgcgttcgggacgtttttatttcggtttcgtttgttcgaaagtagaagaggaaatttattattagttttattagtcgtcgttttagtattgcgggtatagcgcgtatttaggggcgtaggtagttttcgttcggatttcggtttttcgttttcggcgtttcgattcggatttcggttttcggtattttcgtttagatttcggtttcggtttttcgtttttggtattgtttcggtttttcgggtttcgtttatcgttgttttttttggggttttttatgtttagttcggtcgttatttcggtcggttgtcgggatagagtttgtagttttttttcgttgtatcgtatggtttcgcggggaacgggaattcgggtcgcgttttttcggtcgtcgttttcgtttaggttggggtcggcgttaaaaatgttttagggcgtagatacggaagtatttttagggttagtgcgtttgcgtattttgggttagttatgtcgttcgttttcgttgcgtggcgttggcgattcgtggttgttggcgtgggcggggtatcggttggtaggagagacggatcgttgttatataattattaaattgaaataaatcggattaaggtggaatagaattaaggtattttagcgatggttggtatttttttttagagcggttaggcgtaggcggagggagcgataacgtcgttcggagagtgttagtcgttttttcgcgaaagttggtttcgtgcggtcgtagcggatcgagggttcgttgagagcgttgtgcgtacgcgtagtttgttttttaggtcgcgtttttagtttttttttttttagttttttttttcgcgtttcgggattttttgatttacgtcgttgggcgggttaggtatgcgtatattagagggttcgttttatttgtttcggaagtgttttttttgttcgtcgttcgttaaacgaagtcgtggaggtggcgaaacgaggaggagataacgcggttttgggttttggtgaggagtagaggcggttgagggcggcggtcgacgcggatcgggggttttttgggggatagcggacgtaggagagaggcgtttgcgataggtcgcgggtcgagggtggggcggcggcgtcgttttttttttttttttcgtgagcgttcggttttgtgtattttgaggtttcgcgttgggcgggtttggagggtcgggttcgttaggaattttatttttaaatttttgttgggaggtcgcgcgcggggttttacgt

SEQ ID NO: 2494 - DNA, 1319 bp, Artificial Sequence
  chemically treated genomic DNA (Homo sapiens) CpG-island No: 2494
acgtaaaaccccgcgcgcgacctcccaacaaaaatttaaaaataaaattcctaacgaacccgaccctccaaacccgcccaacgcgaaacctcaaaatacacaaaaccgaacgctcacgaaaaaaaaaaaaaaaacgacgccgccgccccaccctcgacccgcgacctatcgcaaacgcctctctcctacgtccgctatcccccaaaaaacccccgatccgcgtcgaccgccgccctcaaccgcctctactcctcaccaaaacccaaaaccgcgttatctcctcctcgtttcgccacctccacgacttcgtttaacgaacgacgaacaaaaaaaacacttccgaaacaaataaaacgaaccctctaatatacgcatacctaacccgcccaacgacgtaaatcaaaaaatcccgaaacgcgaaaaaaaaaactaaaaaaaaaaaaactaaaaacgcgacctaaaaaacaaactacgcgtacgcacaacgctctcaacgaaccctcgatccgctacgaccgcacgaaaccaactttcgcgaaaaaacgactaacactctccgaacgacgttatcgctccctccgcctacgcctaaccgctctaaaaaaaaataccaaccatcgctaaaataccttaattctattccaccttaatccgatttatttcaatttaataattatataacaacgatccgtctctcctaccaaccgataccccgcccacgccaacaaccacgaatcgccaacgccacgcaacgaaaacgaacgacataactaacccaaaatacgcaaacgcactaaccctaaaaatacttccgtatctacgccctaaaacatttttaacgccgaccccaacctaaacgaaaacgacgaccgaaaaaacgcgacccgaattcccgttccccgcgaaaccatacgatacaacgaaaaaaaactacaaactctatcccgacaaccgaccgaaataacgaccgaactaaacataaaaaaccccaaaaaaaacaacgataaacgaaacccgaaaaaccgaaacaataccaaaaacgaaaaaccgaaaccgaaatctaaacgaaaataccgaaaaccgaaatccgaatcgaaacgccgaaaacgaaaaaccgaaatccgaacgaaaactacctacgcccctaaatacgcgctatacccgcaatactaaaacgacgactaataaaactaataataaatttcctcttctactttcgaacaaacgaaaccgaaataaaaacgtcccgaacgcgcgaacgaatcccaaactaaacccctcgaaaaccgaatactcactaccccgtcccgacgcccgta

SEQ ID NO: 2495 - DNA, 1319 bp, Artificial Sequence
  chemically treated genomic DNA (Homo sapiens) CpG-island No: 2495
gcgtgaggtttcgcgcgcggttttttaataggagtttggaaatagagtttttggcgggttcgattttttaggttcgtttagcgcggggttttaggatgtataaggtcggacgtttacgggaggagggaggggagcgacgtcgtcgttttattttcggttcgcggtttgtcgtaagcgttttttttttacgttcgttgttttttagggaattttcggttcgcgtcggtcgtcgtttttaatcgtttttattttttattagagtttaaggtcgcgttatttttttttcgtttcgttatttttacgatttcgtttggcgaacggcgggtaaagaaagtattttcggggtaaatgagacgggttttttggtgtgcgtatgtttggttcgtttagcggcgtgagttagagggtttcgaggcgcgaaggaaaaggttggagggggagaggttgaaagcgcggtttggaaggtaaattgcgcgtgcgtataacgtttttaacgaattttcggttcgttgcggtcgtacggggttaattttcgcgagggagcggttgatatttttcgggcgacgttatcgtttttttcgtttgcgtttggtcgttttagaaaggggtgttagttatcgttggggtgttttgattttgttttattttggttcggtttattttagtttaatggttatgtaataacggttcgttttttttattaatcggtatttcgtttacgttagtagttacgggtcgttagcgttacgtagcggaggcgggcggtatggttggtttaaggtgcgtaggcgtattagttttgggggtgttttcgtgtttgcgttttgagatatttttggcgtcggttttagtttgagcggggacggcggtcgggagggcgcggttcgggttttcgtttttcgcggagttatgcggtataacgagaaggagttgtaggttttgtttcggtagtcggtcgagatggcggtcgagttgggtatgaggggttttaagaagggtagcggtgagcgggattcgggagatcgagatagtgttaggggcgggaggtcggggtcggggtttgggcgggggtgtcggaggtcggagttcgggtcggggcgtcggggacgggaggtcggggttcgggcgggggttgtttgcgtttttgagtgcgcgttgtgttcgtagtgttgaagcggcggttggtgaagttggtggtgaatttttttttttattttcggatagacgaggtcgaggtaggggcgtttcgggcgcgcgggcgggttttaggttgggtttttcggaggtcgggtgtttattgtttcgtttcggcgttcgtg

SEQ ID NO: 2496 - DNA, 1319 bp, Artificial Sequence
  chemically treated genomic DNA (Homo sapiens) CpG-island No: 2496
cacgaacgccgaaacgaaacaataaacacccgacctccgaaaaacccaacctaaaacccgcccgcgcgcccgaaacgcccctacctcgacctcgtctatccgaaaataaaaaaaaaaattcaccaccaacttcaccaaccgccgcttcaacactacgaacacaacgcgcactcaaaaacgcaaacaacccccgcccgaaccccgacctcccgtccccgacgccccgacccgaactccgacctccgacacccccgcccaaaccccgaccccgacctcccgcccctaacactatctcgatctcccgaatcccgctcaccgctacccttcttaaaacccctcatacccaactcgaccgccatctcgaccgactaccgaaacaaaacctacaactccttctcgttataccgcataactccgcgaaaaacgaaaacccgaaccgcgccctcccgaccgccgtccccgctcaaactaaaaccgacgccaaaaatatctcaaaacgcaaacacgaaaacacccccaaaactaatacgcctacgcaccttaaaccaaccataccgcccgcctccgctacgtaacgctaacgacccgtaactactaacgtaaacgaaataccgattaataaaaaaaacgaaccgttattacataaccattaaactaaaataaaccgaaccaaaataaaacaaaatcaaaacaccccaacgataactaacacccctttctaaaacgaccaaacgcaaacgaaaaaaacgataacgtcgcccgaaaaatatcaaccgctccctcgcgaaaattaaccccgtacgaccgcaacgaaccgaaaattcgttaaaaacgttatacgcacgcgcaatttaccttccaaaccgcgctttcaacctctccccctccaaccttttccttcgcgcctcgaaaccctctaactcacgccgctaaacgaaccaaacatacgcacaccaaaaaacccgtctcatttaccccgaaaatactttctttacccgccgttcgccaaacgaaatcgtaaaaataacgaaacgaaaaaaaaataacgcgaccttaaactctaataaaaaataaaaacgattaaaaacgacgaccgacgcgaaccgaaaattccctaaaaaacaacgaacgtaaaaaaaaaacgcttacgacaaaccgcgaaccgaaaataaaacgacgacgtcgctcccctccctcctcccgtaaacgtccgaccttatacatcctaaaaccccgcgctaaacgaacctaaaaaatcgaacccgccaaaaactctatttccaaactcctattaaaaaaccgcgcgcgaaacctcacgc

SEQ ID NO: 2497 - DNA, 2026 bp, Artificial Sequence
  chemically treated genomic DNA (Homo sapiens) CpG-island No: 2497
tagtcgcgtgtttatttatcgtagattttcggttgagtatcgttcggttgtaggtattgttgttcggcgacgattatcgttgttttatacggatgatttcggttttgtttttgttgtcgcggttcgagttcgcgtcgttgtttgcgtacggttagttggatatcgtgtttttttcgtcgtttaggtgcgcgtaggtatcgggatacggggtaggagcgggcgggggcggcgtggtttcgtggtcgtttttaatttttttaattgcgggttttaggttattcgcggaattcgaggagtcgttatttagcgtagatttttttttggagacgtttacgcgtttggtgcgggcgttgcgggttttttcggttcgggttttcgcgtcgcgtttggttttggattcggacgcgttggtcggtttttcgtagggtttagttaatttgtcggatttcgcggcgttggagcgtttattcgacggcgaggagtcgttgttgttgttgttgaggtttattgcggttattatcggggattttgcgtttttgtacgattttacgtcggcgtcgtgggttacggttttggcgcgtcgcgtggttgttgaattgtaagcggcggttgtcgagttgcgaagtttttcgggtttgttttcggttatagtttcgttgttggcgcgtttgttcgcgttttgtttaggtggtttcggcggtttcggcgattttttgcgagcgttgttgtttttgaaggcgttgtagggtttgcgcgtggagtggcgcgggcgggattcgcgcgggtcgggtcgggtatagcgtagcgcgggggttatcgtcgtcgacgggtcgtgcgcgttgcgcgagtttagcgtagattttcgcgtcgagcgtttcgtatttattttcgagatttattaggttaataattgttagggcgtgtgcggttggttttagttcgatcgtaattcgcgttacggtaattacgtggtgttgttgttgaagatgtaggttcgtggggtcgttttggcgcgtttattttgttgcgtgtttatcgtttacgcgggtaagttgtttattagtttgtcggaggagcgtattagcgcgtattacgtgtttaatatggtggttatcgagtgtggttgtcggtgatttttgcgtcgcgcggatttttgtttcgagggttcggacgcgttttagttcgcgtttttttttatatttattcggattttaagtatcgttttaataaagattagtaagtaatcggttggggtgttcgtgcgtgttagggggttcgtgggattttttttgtcgttttttttcgcgtacggttcgggttcgttttgtagcgttcgttgttttttttttgtttgaagcgttttattatcgttttttaggtttcggatttggtgtcgggtttaggcgtaaaggagtaggtgattttgcggtcgtagtattcgttttatttcgttagagtcgcggggcgtttagaaggggtttttggatttcggcgcggggtcggtttagtttcgttttttgtttgcgcggagtttttggcgatttttaggtcgttgtttttcgtcgggacgtttcggggatatttaggtttgtttttttttgggttcggcgtttttggagtttcgtgtttacggtcggtggtttttttcgcgtgatttttagcgttggggtagggtttttcggggttttttggcggttcgtggtttttttttttttcgcggttttttttttttaggtttttttttttttcgcggttttttttttcgcggtttttttttttttcgaggtttttttttgggttttcggtttgcgagggttatacggttttttcggacggttttttcggtggtttcgtcgggttttttttcgtcgttttttgtagtttttcgattttcgggaattttgggtttgatttttgtttcggttcggggcgtaggcggcgttgatggaggcgtttgggtttcgaatttaggttgtaagatagagtggggttttggggtaagcgtttatttttttttcggttcggg

SEQ ID NO: 2498 - DNA, 2026 bp, Artificial Sequence
  chemically treated genomic DNA (Homo sapiens) CpG-island No: 2498
cccgaaccgaaaaaaaaataaacgcttaccccaaaaccccactctatcttacaacctaaattcgaaacccaaacgcctccatcaacgccgcctacgccccgaaccgaaacaaaaatcaaacccaaaattcccgaaaatcgaaaaactacaaaaaacgacgaaaaaaaacccgacgaaaccaccgaaaaaaccgtccgaaaaaaccgtataaccctcgcaaaccgaaaacccaaaaaaaaacctcgaaaaaaaaaaaaaccgcgaaaaaaaaaaccgcgaaaaaaaaaaaaacctaaaaaaaaaaaaccgcgaaaaaaaaaaaaaccacgaaccgccaaaaaaccccgaaaaaccctaccccaacgctaaaaatcacgcgaaaaaaaccaccgaccgtaaacacgaaactccaaaaacgccgaacccaaaaaaaaacaaacctaaatatccccgaaacgtcccgacgaaaaacaacgacctaaaaatcgccaaaaactccgcgcaaacaaaaaacgaaactaaaccgaccccgcgccgaaatccaaaaaccccttctaaacgccccgcgactctaacgaaataaaacgaatactacgaccgcaaaatcacctactcctttacgcctaaacccgacaccaaatccgaaacctaaaaaacgataataaaacgcttcaaacaaaaaaaaaacaacgaacgctacaaaacgaacccgaaccgtacgcgaaaaaaaacgacaaaaaaaatcccacgaaccccctaacacgcacgaacaccccaaccgattacttactaatctttattaaaacgatacttaaaatccgaataaatataaaaaaaaacgcgaactaaaacgcgtccgaaccctcgaaacaaaaatccgcgcgacgcaaaaatcaccgacaaccacactcgataaccaccatattaaacacgtaatacgcgctaatacgctcctccgacaaactaataaacaacttacccgcgtaaacgataaacacgcaacaaaataaacgcgccaaaacgaccccacgaacctacatcttcaacaacaacaccacgtaattaccgtaacgcgaattacgatcgaactaaaaccaaccgcacacgccctaacaattattaacctaataaatctcgaaaataaatacgaaacgctcgacgcgaaaatctacgctaaactcgcgcaacgcgcacgacccgtcgacgacgataacccccgcgctacgctatacccgacccgacccgcgcgaatcccgcccgcgccactccacgcgcaaaccctacaacgccttcaaaaacaacaacgctcgcaaaaaatcgccgaaaccgccgaaaccacctaaacaaaacgcgaacaaacgcgccaacaacgaaactataaccgaaaacaaacccgaaaaacttcgcaactcgacaaccgccgcttacaattcaacaaccacgcgacgcgccaaaaccgtaacccacgacgccgacgtaaaatcgtacaaaaacgcaaaatccccgataataaccgcaataaacctcaacaacaacaacaacgactcctcgccgtcgaataaacgctccaacgccgcgaaatccgacaaattaactaaaccctacgaaaaaccgaccaacgcgtccgaatccaaaaccaaacgcgacgcgaaaacccgaaccgaaaaaacccgcaacgcccgcaccaaacgcgtaaacgtctccaaaaaaaaatctacgctaaataacgactcctcgaattccgcgaataacctaaaacccgcaattaaaaaaattaaaaacgaccacgaaaccacgccgcccccgcccgctcctaccccgtatcccgatacctacgcgcacctaaacgacgaaaaaaacacgatatccaactaaccgtacgcaaacaacgacgcgaactcgaaccgcgacaacaaaaacaaaaccgaaatcatccgtataaaacaacgataatcgtcgccgaacaacaatacctacaaccgaacgatactcaaccgaaaatctacgataaataaacacgcgacta

SEQ ID NO: 2499 - DNA, 2026 bp, Artificial Sequence
  chemically treated genomic DNA (Homo sapiens) CpG-island No: 2499
ttcgggtcggggggaaggtgggcgtttattttaggattttattttgttttgtagtttaagttcgaggtttaggcgtttttattagcgtcgtttgcgtttcgggtcgaggtagaggttagatttaagattttcgggagtcgggaggttgtagagaacgacgaagaggagttcggcgaggttatcggagaggtcgttcgggaggatcgtgtgattttcgtagatcggggatttaaggagaggtttcggagagaggggaagtcgcggaaggagaagtcgcggaaggaggagagatttaagaaagagaggtcgcggaaagaggagaggttacgggtcgttagggagtttcgggaagttttattttagcgttgggagttacgcgaagggggttatcggtcgtgggtacgggattttagggacgtcgagtttaggaagaagtaggtttgggtgttttcgaggcgtttcgacgaggagtagcggtttgggagtcgttagaagtttcgcgtaggtaaggggcgggattgagtcggtttcgcgtcggagtttaggggttttttttggacgtttcgcgattttggcgaaataaagcgagtgttgcggtcgtagagttatttgtttttttacgtttggattcggtattaagttcggggtttgaaagacggtggtggggcgttttaggtaggggagagatagcgagcgttatagggcggattcgggtcgtgcgcgaggagagacggtaagggaggttttacgggttttttaatacgtacggatattttagtcggttgtttgttggtttttattggggcgatgtttggggttcgaataaatatgggaaggggcgcgagttggggcgcgttcggattttcggggtaggagttcgcgcggcgtaggggttatcggtagttatattcggtggttattatgttgggtacgtggtgcgcgttgatgcgttttttcgataggttgatgagtagtttgttcgcgtaggcggtgggtacgtagtagggtgggcgcgttagggcggttttacggatttgtatttttagtagtagtattacgtggttgtcgtagcgcgggttgcggtcggattgaggttagtcgtatacgttttggtaattgttggtttggtaggtttcggggatgagtacggagcgttcggcgcggaggtttacgttgagttcgcgtagcgcgtacggttcgtcggcggcggtggttttcgcgttgcgttgtgttcgattcggttcgcgcggatttcgttcgcgttattttacgcgtaggttttgtagcgtttttaggagtagtagcgttcgtaggggatcgtcgaggtcgtcggggttatttgggtagagcgcgagtaggcgcgttagtagcggggttgtggtcggaggtagattcgggaggtttcgtagttcggtagtcgtcgtttgtagtttagtagttacgcggcgcgttagggtcgtggtttacggcgtcgacgtggggtcgtgtaggggcgtaggattttcggtggtggtcgtagtgggttttagtagtagtagtagcggtttttcgtcgtcgagtaggcgttttagcgtcgcggggttcgataggttgattaggttttgcgggaagtcggttagcgcgttcggatttagggttaggcgcggcgcggaggttcgggtcggggggattcgtagcgttcgtattaggcgcgtgagcgtttttaggaaggggtttgcgttgggtggcgatttttcgagtttcgcggatggtttggaattcgtaattggaggagttgagagcggttacgaggttacgtcgttttcgttcgtttttgtttcgtgtttcggtgtttgcgcgtatttgggcggcgggaagggtacggtgtttagttggtcgtgcgtaggtagcggcgcgggttcggatcgcggtagtaggagtagggtcggggttattcgtgtgaagtagcggtggtcgtcgtcgaatagtagtgtttgtagtcgggcggtatttagtcgggagtttgcggtgggtgggtacgcggttg

SEQ ID NO: 2500 - DNA, 2026 bp, Artificial Sequence
  chemically treated genomic DNA (Homo sapiens) CpG-island No: 2500
caaccgcgtacccacccaccgcaaactcccgactaaataccgcccgactacaaacactactattcgacgacgaccaccgctacttcacacgaataaccccgaccctactcctactaccgcgatccgaacccgcgccgctacctacgcacgaccaactaaacaccgtacccttcccgccgcccaaatacgcgcaaacaccgaaacacgaaacaaaaacgaacgaaaacgacgtaacctcgtaaccgctctcaactcctccaattacgaattccaaaccatccgcgaaactcgaaaaatcgccacccaacgcaaaccccttcctaaaaacgctcacgcgcctaatacgaacgctacgaatccccccgacccgaacctccgcgccgcgcctaaccctaaatccgaacgcgctaaccgacttcccgcaaaacctaatcaacctatcgaaccccgcgacgctaaaacgcctactcgacgacgaaaaaccgctactactactactaaaacccactacgaccaccaccgaaaatcctacgcccctacacgaccccacgtcgacgccgtaaaccacgaccctaacgcgccgcgtaactactaaactacaaacgacgactaccgaactacgaaacctcccgaatctacctccgaccacaaccccgctactaacgcgcctactcgcgctctacccaaataaccccgacgacctcgacgatcccctacgaacgctactactcctaaaaacgctacaaaacctacgcgtaaaataacgcgaacgaaatccgcgcgaaccgaatcgaacacaacgcaacgcgaaaaccaccgccgccgacgaaccgtacgcgctacgcgaactcaacgtaaacctccgcgccgaacgctccgtactcatccccgaaacctaccaaaccaacaattaccaaaacgtatacgactaacctcaatccgaccgcaacccgcgctacgacaaccacgtaatactactactaaaaatacaaatccgtaaaaccgccctaacgcgcccaccctactacgtacccaccgcctacgcgaacaaactactcatcaacctatcgaaaaaacgcatcaacgcgcaccacgtacccaacataataaccaccgaatataactaccgataacccctacgccgcgcgaactcctaccccgaaaatccgaacgcgccccaactcgcgccccttcccatatttattcgaaccccaaacatcgccccaataaaaaccaacaaacaaccgactaaaatatccgtacgtattaaaaaacccgtaaaacctcccttaccgtctctcctcgcgcacgacccgaatccgccctataacgctcgctatctctcccctacctaaaacgccccaccaccgtctttcaaaccccgaacttaataccgaatccaaacgtaaaaaaacaaataactctacgaccgcaacactcgctttatttcgccaaaatcgcgaaacgtccaaaaaaaacccctaaactccgacgcgaaaccgactcaatcccgccccttacctacgcgaaacttctaacgactcccaaaccgctactcctcgtcgaaacgcctcgaaaacacccaaacctacttcttcctaaactcgacgtccctaaaatcccgtacccacgaccgataacccccttcgcgtaactcccaacgctaaaataaaacttcccgaaactccctaacgacccgtaacctctcctctttccgcgacctctctttcttaaatctctcctccttccgcgacttctccttccgcgacttcccctctctccgaaacctctccttaaatccccgatctacgaaaatcacacgatcctcccgaacgacctctccgataacctcgccgaactcctcttcgtcgttctctacaacctcccgactcccgaaaatcttaaatctaacctctacctcgacccgaaacgcaaacgacgctaataaaaacgcctaaacctcgaacttaaactacaaaacaaaataaaatcctaaaataaacgcccaccttccccccgacccgaa

SEQ ID NO: 2501 - DNA, 582 bp, Artificial Sequence
  chemically treated genomic DNA (Homo sapiens) CpG-island No: 2501
ggcgcgtatcgatagcggtgttcgcgggtgatttatttgtttatcgtttggttggttagttggcgtatgcgattgaattgtttttttatcgtggtttcgttgtcgcgttagttcgggagttggggaaggacggagtagttcggagttcgtcgtagggttatatggttttcgcgcggagtttttcgggcgacggcggcggtattgcggagttttcgggcgtcgtttggttcgcgcgtagttttttttcgagggcgtcgtcgtttatttttttcgtcgcgtcgttttttgtcgtattttttttacgcgcgtcgcgtaatgttcggggtagagtaatgtttggggtcgttttcggtatcggttcgtttcgttcgggttgtttgtttttagttttagttcggcgcggggattcgggagttttcgtaggttggttggtcggttggttcggcggttttcgtgcgtttgtgcggagaacgtcgtgtatgtcgggatttgtagtttcgcgtttcgtgtttattttttttttgtttaaagtttgtaaggatagtggagtgcggaggtgggagaaggtagcgttattagtag

SEQ ID NO: 2502 - DNA, 582 bp, Artificial Sequence
  chemically treated genomic DNA (Homo sapiens) CpG-island No: 2502
ctactaataacgctaccttctcccacctccgcactccactatccttacaaactttaaacaaaaaaaaaataaacacgaaacgcgaaactacaaatcccgacatacacgacgttctccgcacaaacgcacgaaaaccgccgaaccaaccgaccaaccaacctacgaaaactcccgaatccccgcgccgaactaaaactaaaaacaaacaacccgaacgaaacgaaccgataccgaaaacgaccccaaacattactctaccccgaacattacgcgacgcgcgtaaaaaaaatacgacaaaaaacgacgcgacgaaaaaaataaacgacgacgccctcgaaaaaaaactacgcgcgaaccaaacgacgcccgaaaactccgcaataccgccgccgtcgcccgaaaaactccgcgcgaaaaccatataaccctacgacgaactccgaactactccgtccttccccaactcccgaactaacgcgacaacgaaaccacgataaaaaaacaattcaatcgcatacgccaactaaccaaccaaacgataaacaaataaatcacccgcgaacaccgctatcgatacgcgcc

SEQ ID NO: 2503 - DNA, 582 bp, Artificial Sequence
  chemically treated genomic DNA (Homo sapiens) CpG-island No: 2503
ttgttggtgacgttgtttttttttattttcgtattttattgtttttgtaaattttggatagaggaaaggtgggtacggggcgcgaaattataagtttcggtatgtacggcgtttttcgtataggcgtacggggatcgtcgggttagtcggttagttagtttgcggagattttcgggttttcgcgtcggattgggattgggagtaggtagttcgggcggagcgggtcggtgtcgaggacggttttaggtattgttttgtttcgggtattgcgcggcgcgcgtgagggggatgcggtaggaggcggcgcggcgggaggagtaggcggcggcgttttcgggagggagttgcgcgcgggttagacggcgttcggaggtttcgtagtgtcgtcgtcgtcgttcgggaggtttcgcgcgggagttatgtaattttgcggcgggtttcgggttgtttcgtttttttttagttttcgggttagcgcggtagcggggttacgatgaagaagtagtttaatcgtatgcgttagttggttaattagacggtgggtaggtaggttattcgcgggtatcgttgtcggtgcgcgtt

SEQ ID NO: 2504 - DNA, 582 bp, Artificial Sequence
  chemically treated genomic DNA (Homo sapiens) CpG-island No: 2504
aacgcgcaccgacaacgatacccgcgaataacctacctacccaccgtctaattaaccaactaacgcatacgattaaactacttcttcatcgtaaccccgctaccgcgctaacccgaaaactaaaaaaaaacgaaacaacccgaaacccgccgcaaaattacataactcccgcgcgaaacctcccgaacgacgacgacgacactacgaaacctccgaacgccgtctaacccgcgcgcaactccctcccgaaaacgccgccgcctactcctcccgccgcgccgcctcctaccgcatccccctcacgcgcgccgcgcaatacccgaaacaaaacaatacctaaaaccgtcctcgacaccgacccgctccgcccgaactacctactcccaatcccaatccgacgcgaaaacccgaaaatctccgcaaactaactaaccgactaacccgacgatccccgtacgcctatacgaaaaacgccgtacataccgaaacttataatttcgcgccccgtacccacctttcctctatccaaaatttacaaaaacaataaaatacgaaaataaaaaaaaacaacgtcaccaacaa

SEQ ID NO: 2505 - DNA, 622 bp, Artificial Sequence
  chemically treated genomic DNA (Homo sapiens) CpG-island No: 2505
attgcggtcggtaaatcggaatagaattaggggcggggtcgtttgagacgttttagtatttttttattttatggttattgttaattgataagtttcgagcggtaaagtttttttttattggatgagtagtttcgcgtaggcgggaagttcggtgtacggcgcgttgattggttggattcgttatgcggagcggttaggtggtgtacgggaaacgcgggcgtaggtgatcggcggtttttttagttttggtggagacgggcgtatgtgggcgttttgttcgttgttgcggttcgcggtcggacgtattatgtcgtagggacgtattatatcgtaggtattcgttcgtcgcgagcggtcgcgtaaggattcgttgcggtatttgcgtacgcgagagaagcgcggatcgtcggggtgtttcggcggtttaaatatcgtgtatttgtaggtggtggtagcgggtagtcgggattcgggcgtcgcgttttacgtttttttcgagtttaatcggttagttaacgagttacgtttcgtttcgttgggtttttagtgcggcgtagtttttgagtatcggggtattttttagggtttcggtttttttgttttatatatgtggtttattgtt

SEQ ID NO: 2506 - DNA, 622 bp, Artificial Sequence
  chemically treated genomic DNA (Homo sapiens) CpG-island No: 2506
aacaataaaccacatatataaaacaaaaaaaccgaaaccctaaaaaataccccgatactcaaaaactacgccgcactaaaaacccaacgaaacgaaacgtaactcgttaactaaccgattaaactcgaaaaaaacgtaaaacgcgacgcccgaatcccgactacccgctaccaccacctacaaatacacgatatttaaaccgccgaaacaccccgacgatccgcgcttctctcgcgtacgcaaataccgcaacgaatccttacgcgaccgctcgcgacgaacgaatacctacgatataatacgtccctacgacataatacgtccgaccgcgaaccgcaacaacgaacaaaacgcccacatacgcccgtctccaccaaaactaaaaaaaccgccgatcacctacgcccgcgtttcccgtacaccacctaaccgctccgcataacgaatccaaccaatcaacgcgccgtacaccgaacttcccgcctacgcgaaactactcatccaataaaaaaaaactttaccgctcgaaacttatcaattaacaataaccataaaataaaaaaatactaaaacgtctcaaacgaccccgcccctaattctattccgatttaccgaccgcaat

SEQ ID NO: 2507 - DNA, 622 bp, Artificial Sequence
  chemically treated genomic DNA (Homo sapiens) CpG-island No: 2507
aatagtgaattatatgtgtgaagtagggaagtcgaagttttgggaggtgtttcgatgtttagaggttgcgtcgtattgagggtttagcgggacggggcgtggttcgttgattgatcggttgaattcggagaagacgtagagcgcggcgttcgagtttcggttattcgttgttattatttgtaggtatacggtgtttgggtcgtcggagtatttcgacggttcgcgtttttttcgcgtgcgtaggtgtcgtagcgggtttttgcgcggtcgttcgcggcgggcgggtgtttgcgatatggtgcgtttttgcgatatggtgcgttcggtcgcggatcgtagtagcgagtaaagcgtttatatgcgttcgtttttattaaaattgagaaagtcgtcggttatttacgttcgcgtttttcgtgtattatttagtcgtttcgtatggcggatttagttaattagcgcgtcgtgtatcgagtttttcgtttacgcgaggttgtttatttaatagaaaggagttttatcgttcgggatttgttaattgatagtggttatagagtagaggaatattagagcgttttaagcggtttcgtttttagttttgtttcggtttgtcggtcgtaat

SEQ ID NO: 2508 - DNA, 622 bp, Artificial Sequence
  chemically treated genomic DNA (Homo sapiens) CpG-island No: 2508
attacgaccgacaaaccgaaacaaaactaaaaacgaaaccgcttaaaacgctctaatattcctctactctataaccactatcaattaacaaatcccgaacgataaaactcctttctattaaataaacaacctcgcgtaaacgaaaaactcgatacacgacgcgctaattaactaaatccgccatacgaaacgactaaataatacacgaaaaacgcgaacgtaaataaccgacgactttctcaattttaataaaaacgaacgcatataaacgctttactcgctactacgatccgcgaccgaacgcaccatatcgcaaaaacgcaccatatcgcaaacacccgcccgccgcgaacgaccgcgcaaaaacccgctacgacacctacgcacgcgaaaaaaacgcgaaccgtcgaaatactccgacgacccaaacaccgtatacctacaaataataacaacgaataaccgaaactcgaacgccgcgctctacgtcttctccgaattcaaccgatcaatcaacgaaccacgccccgtcccgctaaaccctcaatacgacgcaacctctaaacatcgaaacacctcccaaaacttcgacttccctacttcacacatataattcactatt

SEQ ID NO: 2509 - DNA, 620 bp, Artificial Sequence
  chemically treated genomic DNA (Homo sapiens) CpG-island No: 2509
  misc_feature (23)..(23): n is either a, c, g or t
  misc_feature (46)..(46): n is either a, c, g or t
  misc_feature (82)..(82): n is either a, c, g or t
  misc_feature (138)..(138): n is either a, c, g or t
  misc_feature (171)..(171): n is either a, c, g or t
  misc_feature (175)..(175): n is either a, c, g or t
  misc_feature (183)..(183): n is either a, c, g or t
  misc_feature (478)..(478): n is either a, c, g or t
gttaatttcgaggtggttggagntcgcgttttttttttagagtgtnatcgtagtcgttgtatttaggaatcgttttagtttncgttttcggtcggtcgggcggggaagattggtgtggtttggttatggatgggtttntaggttagtgtagggtcgttgaggcgcgggcgntcgnaagcgttngcgtaagttttagttatatagcgggtcggttttggttttgtttttgaggtttaggaagatacgaaagtagttgcgaagtgttgtatttcgtatggtagcgttgaggacgtagacgttgtttagcgagaattcggaggaatcgagggtggagtcgacggtcgacgatttgggggacgcgttattcggtggggcggtagtggcggcgtttcggacgtagttcggcgagaattatacgttatttggggttcgtagagttgttggaggtttttcgtcgcgcgttttttgtagatttcgntcgcgcgtttggtgtcgttatatcgcgttcgcgcgtttggtggaggtgttcgtcgcgtcggttcgggtggtggagatttcggttttgttgtgtatcgcgtaatatttagcggtcgtttagtcgttcggggtttttgcgacgg

SEQ ID NO: 2510 - DNA, 620 bp, Artificial Sequence
  chemically treated genomic DNA (Homo sapiens) CpG-island No: 2510
  misc_feature (143)..(143): n is either a, c, g or t
  misc_feature (438)..(438): n is either a, c, g or t
  misc_feature (446)..(446): n is either a, c, g or t
  misc_feature (450)..(450): n is either a, c, g or t
  misc_feature (483)..(483): n is either a, c, g or t
  misc_feature (539)..(539): n is either a, c, g or t
  misc_feature (575)..(575): n is either a, c, g or t
  misc_feature (598)..(598): n is either a, c, g or t
ccgtcgcaaaaaccccgaacgactaaacgaccgctaaatattacgcgatacacaacaaaaccgaaatctccaccacccgaaccgacgcgacgaacacctccaccaaacgcgcgaacgcgatataacgacaccaaacgcgcgancgaaatctacaaaaaacgcgcgacgaaaaacctccaacaactctacgaaccccaaataacgtataattctcgccgaactacgtccgaaacgccgccactaccgccccaccgaataacgcgtcccccaaatcgtcgaccgtcgactccaccctcgattcctccgaattctcgctaaacaacgtctacgtcctcaacgctaccatacgaaatacaacacttcgcaactactttcgtatcttcctaaacctcaaaaacaaaaccaaaaccgacccgctatataactaaaacttacgcnaacgcttncgancgcccgcgcctcaacgaccctacactaacctanaaacccatccataaccaaaccacaccaatcttccccgcccgaccgaccgaaaacgnaaactaaaacgattcctaaatacaacgactacgatnacactctaaaaaaaaaacgcganctccaaccacctcgaaattaac

SEQ ID NO: 2511 - DNA, 620 bp, Artificial Sequence
  chemically treated genomic DNA (Homo sapiens) CpG-island No: 2511
  misc_feature (143)..(143): n is either a, c, g or t
  misc_feature (438)..(438): n is either a, c, g or t
  misc_feature (446)..(446): n is either a, c, g or t
  misc_feature (450)..(450): n is either a, c, g or t
  misc_feature (483)..(483): n is either a, c, g or t
  misc_feature (539)..(539): n is either a, c, g or t
  misc_feature (575)..(575): n is either a, c, g or t
  misc_feature (598)..(598): n is either a, c, g or t
tcgtcgtaggggtttcggacgattggacggtcgttaagtgttgcgcggtgtatagtagggtcgaggtttttattattcggatcggcgcggcgggtatttttattaggcgcgcgggcgcgatatggcggtattaggcgcgcgancggggtttgtagggagcgcgcggcgggaggtttttagtagttttgcgggttttaggtggcgtatggttttcgtcgggttgcgttcgggacgtcgttattgtcgttttatcgggtagcgcgttttttaggtcgtcggtcgtcgattttattttcgattttttcgagttttcgttaggtagcgtttgcgtttttagcgttgttatgcgggatataatatttcgtagttgttttcgtatttttttggattttaagggtagggttaggatcgattcgttgtgtggttggggtttgcgtnggcgtttncggncgttcgcgttttaacggttttgtattggtttgngagtttatttatggttagattatattagtttttttcgttcggtcggtcgggggcgnaagttaaagcggtttttgaatgtagcggttgcggtngtattttgggaagggggcgcggnttttagttatttcggggttggt

SEQ ID NO: 2512 - DNA, 620 bp, Artificial Sequence
  chemically treated genomic DNA (Homo sapiens) CpG-island No: 2512
  misc_feature (23)..(23): n is either a, c, g or t
  misc_feature (46)..(46): n is either a, c, g or t
  misc_feature (82)..(82): n is either a, c, g or t
  misc_feature (138)..(138): n is either a, c, g or t
  misc_feature (171)..(171): n is either a, c, g or t
  misc_feature (175)..(175): n is either a, c, g or t
  misc_feature (183)..(183): n is either a, c, g or t
  misc_feature (478)..(478): n is either a, c, g or t
accaaccccgaaataactaaaanccgcgcccccttcccaaaatacnaccgcaaccgctacattcaaaaaccgctttaacttncgcccccgaccgaccgaacgaaaaaaactaatataatctaaccataaataaactcncaaaccaatacaaaaccgttaaaacgcgaacgnccgnaaacgccnacgcaaaccccaaccacacaacgaatcgatcctaaccctacccttaaaatccaaaaaaatacgaaaacaactacgaaatattatatcccgcataacaacgctaaaaacgcaaacgctacctaacgaaaactcgaaaaaatcgaaaataaaatcgacgaccgacgacctaaaaaacgcgctacccgataaaacgacaataacgacgtcccgaacgcaacccgacgaaaaccatacgccacctaaaacccgcaaaactactaaaaacctcccgccgcgcgctccctacaaaccccgntcgcgcgcctaataccgccatatcgcgcccgcgcgcctaataaaaatacccgccgcgccgatccgaataataaaaacctcgaccctactatacaccgcgcaacacttaacgaccgtccaatcgtccgaaacccctacgacga

SEQ ID NO: 2513 - DNA, 701 bp, Artificial Sequence
  chemically treated genomic DNA (Homo sapiens) CpG-island No: 2513
gtaaggcgtgggagtttggaagttagcgttgcgtttttcgtgggaagcgatcgttttttttgttaattcgcgtttgggtatttagtttttttcgttttagggcgtcgttttttcggatggtaaatattataaagtggcggcgaataaggttttttttgttgttttcggtttagtttaagattagcgatattacgcgtttttcggagtatcgcgtgtaggagttatggcgcgggagttatattacgaagagttcgttcgggcgggtaagtaggcggggttgtaggtttggaggattgagaagttggagttggtgttcgtgttttagagcgtttacggcgatttttacgtcggggatgtttatttggtgttgtatacggttaagacgagtcgaggttttatttattatttgtatttttggttcggtaagggacggcgggcggcgggatttcgacgtattaaggtcggcgaggggagggcgtaggggtttgagatttgtaggcgtgggagtaaaggggatcgtaaattgagttagttattcgcgtttttacggggttgtttttggggtcggttattttttttttatcgaagttaattcgtcggttgtaaacgcggggtttaggcgttgttcgtaattgatttatttcgtaggttttgatttttgttaggtgtagtttttggattttggagttggtgattggttt

SEQ ID NO: 2514 - DNA, 701 bp, Artificial Sequence
  chemically treated genomic DNA (Homo sapiens) CpG-island No: 2514
aaaccaatcaccaactccaaaatccaaaaactacacctaacaaaaatcaaaacctacgaaataaatcaattacgaacaacgcctaaaccccgcgtttacaaccgacgaattaacttcgataaaaaaaaaataaccgaccccaaaaacaaccccgtaaaaacgcgaataactaactcaatttacgatcccctttactcccacgcctacaaatctcaaacccctacgccctcccctcgccgaccttaatacgtcgaaatcccgccgcccgccgtcccttaccgaaccaaaaatacaaataataaataaaacctcgactcgtcttaaccgtatacaacaccaaataaacatccccgacgtaaaaatcgccgtaaacgctctaaaacacgaacaccaactccaacttctcaatcctccaaacctacaaccccgcctacttacccgcccgaacgaactcttcgtaatataactcccgcgccataactcctacacgcgatactccgaaaaacgcgtaatatcgctaatcttaaactaaaccgaaaacaacaaaaaaaaccttattcgccgccactttataatatttaccatccgaaaaaacgacgccctaaaacgaaaaaaactaaatacccaaacgcgaattaacaaaaaaaacgatcgcttcccacgaaaaacgcaacgctaacttccaaactcccacgccttac

SEQ ID NO: 2515 - DNA, 701 bp, Artificial Sequence
  chemically treated genomic DNA (Homo sapiens) CpG-island No: 2515
aagttagttattagttttaaagtttaggaattatatttggtaaaggttaaagtttgcgaggtaagttaattgcggataacgtttgagtttcgcgtttgtagtcggcgagttgatttcggtagggagaaagtggtcggttttaaaggtagtttcgtgggggcgcgagtggttagtttagtttgcggttttttttatttttacgtttgtaaattttagatttttacgtttttttttcgtcggttttggtgcgtcggggtttcgtcgttcgtcgttttttatcgagttagaagtgtaggtggtaggtgaagtttcggttcgttttggtcgtgtgtagtattaggtaggtattttcgacgtagaagtcgtcgtgagcgttttggggtacgggtattagttttagttttttaattttttagatttgtagtttcgtttgtttgttcgttcgggcgaatttttcgtggtatagttttcgcgttatggtttttgtacgcgatgtttcgggggacgcgtgatatcgttgattttggattaaatcgagagtagtaggaggaattttattcgtcgttattttatagtgtttgttattcggggaggcggcgttttgaaacgggaggggttaagtgtttaggcgcgagttgatagaggagacgatcgttttttacggggagcgtagcgttggtttttaagtttttacgttttgt

SEQ ID NO: 2516 - DNA, 701 bp, Artificial Sequence
  chemically treated genomic DNA (Homo sapiens) CpG-island No: 2516
acaaaacgtaaaaacttaaaaaccaacgctacgctccccgtaaaaaacgatcgtctcctctatcaactcgcgcctaaacacttaacccctcccgtttcaaaacgccgcctccccgaataacaaacactataaaataacgacgaataaaattcctcctactactctcgatttaatccaaaatcaacgatatcacgcgtcccccgaaacatcgcgtacaaaaaccataacgcgaaaactataccacgaaaaattcgcccgaacgaacaaacaaacgaaactacaaatctaaaaaattaaaaaactaaaactaatacccgtaccccaaaacgctcacgacgacttctacgtcgaaaatacctacctaatactacacacgaccaaaacgaaccgaaacttcacctaccacctacacttctaactcgataaaaaacgacgaacgacgaaaccccgacgcaccaaaaccgacgaaaaaaaaacgtaaaaatctaaaatttacaaacgtaaaaataaaaaaaaccgcaaactaaactaaccactcgcgcccccacgaaactacctttaaaaccgaccactttctccctaccgaaatcaactcgccgactacaaacgcgaaactcaaacgttatccgcaattaacttacctcgcaaactttaacctttaccaaatataattcctaaactttaaaactaataactaactt

SEQ ID NO: 2517 - DNA, 583 bp, Artificial Sequence
  chemically treated genomic DNA (Homo sapiens) CpG-island No: 2517
ttcgatagtttaggaagcgcgggtaatggagttattcggtttagaagcgaaatttcgtttcgggttcgttttcggcgttttggatttgggtttcggcgttgcgttttttatttggatttcgtcgtcggtttcggtttttttacggtttcgtcggttttgtttttggagatttgagggcgtttttttttcggggaattgcgattcggaattttggtttcgtttttgtcgcgttcgttgagtgcggggacggtgtttagcgttcggtatttagtttcgaggttaggatcgaggaaggcgatcgggcggatttttaattattttcgttgtttgtacgcgtagtagtagcgtttagtttatttcgttattggtgtttttcgcgtttgtagcgcgtcgtcggaagtgtttggttttattttcggttagaggttacgttttcggaagcggcggtgtaggtacgaaaagcgcgcgcggggattttaggagtcgtggtgattagggaggggagtcgggttagcggcggtaggagattaggggagttgagttatgtgtttgggggagagcggggtcgggagttcgaaggaga

SEQ ID NO: 2518 - DNA, 583 bp, Artificial Sequence
  chemically treated genomic DNA (Homo sapiens) CpG-island No: 2518
tctccttcgaactcccgaccccgctctcccccaaacacataactcaactcccctaatctcctaccgccgctaacccgactcccctccctaatcaccacgactcctaaaatccccgcgcgcgcttttcgtacctacaccgccgcttccgaaaacgtaacctctaaccgaaaataaaaccaaacacttccgacgacgcgctacaaacgcgaaaaacaccaataacgaaataaactaaacgctactactacgcgtacaaacaacgaaaataattaaaaatccgcccgatcgccttcctcgatcctaacctcgaaactaaataccgaacgctaaacaccgtccccgcactcaacgaacgcgacaaaaacgaaaccaaaattccgaatcgcaattccccgaaaaaaaaacgccctcaaatctccaaaaacaaaaccgacgaaaccgtaaaaaaaccgaaaccgacgacgaaatccaaataaaaaacgcaacgccgaaacccaaatccaaaacgccgaaaacgaacccgaaacgaaatttcgcttctaaaccgaataactccattacccgcgcttcctaaactatcgaa

SEQ ID NO: 2519 - DNA, 583 bp, Artificial Sequence
  chemically treated genomic DNA (Homo sapiens) CpG-island No: 2519
tttttttcgagttttcggtttcgtttttttttaagtatatggtttagtttttttagttttttgtcgtcgttggttcggtttttttttttggttattacgatttttggaattttcgcgcgcgtttttcgtatttgtatcgtcgttttcgggggcgtggtttttgatcggaagtgaggttaggtattttcggcggcgcgttgtaggcgcggggaatattaatggcggggtgagttgggcgttgttgttgcgcgtgtagatagcgggagtggttgggggttcgttcggtcgtttttttcggttttggtttcggggttgggtgtcgagcgttgggtatcgttttcgtatttagcgagcgcgataggggcgaggttaggatttcgggtcgtagtttttcgggaggagggcgtttttaggtttttaggggtagggtcggcggggtcgtggggaggtcggggtcggcggcggagtttaggtggggggcgtagcgtcggggtttagatttaaggcgtcgggggcgagttcggggcgggatttcgtttttgggtcgggtagttttattgttcgcgttttttgggttgtcgag

SEQ ID NO: 2520 - DNA, 583 bp, Artificial Sequence
  chemically treated genomic DNA (Homo sapiens) CpG-island No: 2520
ctcgacaacccaaaaaacgcgaacaataaaactacccgacccaaaaacgaaatcccgccccgaactcgcccccgacgccttaaatctaaaccccgacgctacgccccccacctaaactccgccgccgaccccgacctccccacgaccccgccgaccctacccctaaaaacctaaaaacgccctcctcccgaaaaactacgacccgaaatcctaacctcgcccctatcgcgctcgctaaatacgaaaacgatacccaacgctcgacacccaaccccgaaaccaaaaccgaaaaaaacgaccgaacgaacccccaaccactcccgctatctacacgcgcaacaacaacgcccaactcaccccgccattaatattccccgcgcctacaacgcgccgccgaaaatacctaacctcacttccgatcaaaaaccacgcccccgaaaacgacgatacaaatacgaaaaacgcgcgcgaaaattccaaaaatcgtaataaccaaaaaaaaaaaccgaaccaacgacgacaaaaaactaaaaaaactaaaccatatacttaaaaaaaaacgaaaccgaaaactcgaaaaaaa

SEQ ID NO: 2521 - DNA, 917 bp, Artificial Sequence
  chemically treated genomic DNA (Homo sapiens) CpG-island No: 2521
gacgtcggatttatttatattacggagtcgaagtcggatttatattacggagtcgacgtcggatttatttatattacggagtcgacgtcggatttatttatattacggagtcgaagtcggatttatttatattacggagtcgaagtcggatttatttatattacggagtcgacgtcggatttatttatattacggagtcgacgtcggatttatattacggagtcgacgtcggatttatttatattacggagtcgacgtcggatttatttatattacggagtcgaagtcggatttatttatattacggagtcgacgtcggatttatttatattacggagtcgacgtcggatttatttatattacggagtcgacgtcggatttatttatattacggagtcgacgtcggatttatttatattacggagtcgacgtcggatttatattacggagtcgacgtcggatttatttatattacggagtcgaagtcggatttatttatattacggagtcgacgtcggatttatttatattacggagtcgaagtcggatttatttatattacggagtcgacgtcggatttatttatattacggagtcgaagtcggatttatttatattacggagtcgacgtcggatttatttatattacggagtcgacgtcggatttatttatattacggagtcgacgtcggatttatttatattacggagtcgaagtcggatttatttatattacggagtcgaagtcggatttatttatattacggagtcgacgttggatttatttatattacggagtcgacgttggatttatttatattatatttatttatgttacggagttaacgttggatttatttatttatgttatagagtcgacgttgcgggtacgtttttttgtttaaaaaaattatggt

SEQ ID NO: 2522 - DNA, 917 bp, Artificial Sequence
  chemically treated genomic DNA (Homo sapiens) CpG-island No: 2522
accataatttttttaaacaaaaaaacgtacccgcaacgtcgactctataacataaataaataaatccaacgttaactccgtaacataaataaatataatataaataaatccaacgtcgactccgtaatataaataaatccaacgtcgactccgtaatataaataaatccgacttcgactccgtaatataaataaatccgacttcgactccgtaatataaataaatccgacgtcgactccgtaatataaataaatccgacgtcgactccgtaatataaataaatccgacgtcgactccgtaatataaataaatccgacttcgactccgtaatataaataaatccgacgtcgactccgtaatataaataaatccgacttcgactccgtaatataaataaatccgacgtcgactccgtaatataaataaatccgacttcgactccgtaatataaataaatccgacgtcgactccgtaatataaatccgacgtcgactccgtaatataaataaatccgacgtcgactccgtaatataaataaatccgacgtcgactccgtaatataaataaatccgacgtcgactccgtaatataaataaatccgacgtcgactccgtaatataaataaatccgacttcgactccgtaatataaataaatccgacgtcgactccgtaatataaataaatccgacgtcgactccgtaatataaatccgacgtcgactccgtaatataaataaatccgacgtcgactccgtaatataaataaatccgacttcgactccgtaatataaataaatccgacttcgactccgtaatataaataaatccgacgtcgactccgtaatataaataaatccgacgtcgactccgtaatataaatccgacttcgactccgtaatataaataaatccgacgtc

SEQ ID NO: 2523 - DNA, 917 bp, Artificial Sequence
  chemically treated genomic DNA (Homo sapiens) CpG-island No: 2523
attatgatttttttgaataaaaggacgtgttcgtagcgtcgattttgtagtatgagtgagtgggtttagcgttgatttcgtagtatgagtgggtgtagtgtgagtgagtttagcgtcgatttcgtagtgtgagtgagtttagcgtcgatttcgtagtgtgagtgagttcggtttcgatttcgtagtgtgagtgagttcggtttcgatttcgtagtgtgagtgagttcggcgtcgatttcgtagtgtgagtgagttcggcgtcgatttcgtagtgtgagtgagttcggcgtcgatttcgtagtgtgagtgagttcggtttcgatttcgtagtgtgagtgagttcggcgtcgatttcgtagtgtgagtgagttcggtttcgatttcgtagtgtgagtgagttcggcgtcgatttcgtagtgtgagtgagttcggtttcgatttcgtagtgtgagtgagttcggcgtcgatttcgtagtgtgagttcggcgtcgatttcgtagtgtgagtgagttcggcgtcgatttcgtagtgtgagtgagttcggcgtcgatttcgtagtgtgagtgagttcggcgtcgatttcgtagtgtgagtgagttcggcgtcgatttcgtagtgtgagtgagttcggtttcgatttcgtagtgtgagtgagttcggcgtcgatttcgtagtgtgagtgagttcggcgtcgatttcgtagtgtgagttcggcgtcgatttcgtagtgtgagtgagttcggcgtcgatttcgtagtgtgagtgagttcggtttcgatttcgtagtgtgagtgagttcggtttcgatttcgtagtgtgagtgagttcggcgtcgatttcgtagtgtgagtgagttcggcgtcgatttcgtagtgtgagttcggtttcgatttcgtagtgtgagtgagttcggcgtt

SEQ ID NO: 2524 - DNA, 917 bp, Artificial Sequence
  chemically treated genomic DNA (Homo sapiens) CpG-island No: 2524
aacgccgaactcactcacactacgaaatcgaaaccgaactcacactacgaaatcgacgccgaactcactcacactacgaaatcgacgccgaactcactcacactacgaaatcgaaaccgaactcactcacactacgaaatcgaaaccgaactcactcacactacgaaatcgacgccgaactcactcacactacgaaatcgacgccgaactcacactacgaaatcgacgccgaactcactcacactacgaaatcgacgccgaactcactcacactacgaaatcgaaaccgaactcactcacactacgaaatcgacgccgaactcactcacactacgaaatcgacgccgaactcactcacactacgaaatcgacgccgaactcactcacactacgaaatcgacgccgaactcactcacactacgaaatcgacgccgaactcacactacgaaatcgacgccgaactcactcacactacgaaatcgaaaccgaactcactcacactacgaaatcgacgccgaactcactcacactacgaaatcgaaaccgaactcactcacactacgaaatcgacgccgaactcactcacactacgaaatcgaaaccgaactcactcacactacgaaatcgacgccgaactcactcacactacgaaatcgacgccgaactcactcacactacgaaatcgacgccgaactcactcacactacgaaatcgaaaccgaactcactcacactacgaaatcgaaaccgaactcactcacactacgaaatcgacgctaaactcactcacactacgaaatcgacgctaaactcactcacactacacccactcatactacgaaatcaacgctaaacccactcactcatactacaaaatcgacgctacgaacacgtccttttattcaaaaaaatcataat

SEQ ID NO: 2525 - DNA, 687 bp, Artificial Sequence
  chemically treated genomic DNA (Homo sapiens) CpG-island No: 2525
cgtggacggggaggggtatgtgggcgtggttaggcgggttgtaggcgtgcgaggtcgggcgaggagcgcggcgggtcgtaggggcggattgtgggcgtggcgcgcgggggagggggcgtgattaggcggggtgtgggcggggcgagggcgcggcgcggtagggttgcgcggtcgggtggcgcgggaggaagttacgtgggagcgcgggtttatatgattggtcgcgcgatggattcgttgttcgcggttgtagtcggggcggtagttgaggcggaggttgacgaggaggcggatttttcggcgttaggtagggcgtggggcggcggtagtttttatttgtttagggcgcgcggttcgattattttcggcggacgggtttagtcgtcgcgtttggttttcgattcgttttttgttttcgcgtttcgcgttcggttttacgttttagtttttcggaggtttttttgtttttttgcgcgtttgttttttgggggttttcgtgttttttcgcgttttcgtttttcggggttttttgtttttttgcgtcgggagagttttgtttaggttatagttggtcgcgtttcgaggcgttttttcggggtttttagaggcgttttcggggatagtttttttttcgtttcgtttttggtgttttgtttttttgttttgtttggttacgttgagcgatgg

SEQ ID NO: 2526 - DNA, 687 bp, Artificial Sequence
  chemically treated genomic DNA (Homo sapiens) CpG-island No: 2526
ccatcgctcaacgtaaccaaacaaaacaaaaaaacaaaacaccaaaaacgaaacgaaaaaaaaactatccccgaaaacgcctctaaaaaccccgaaaaaacgcctcgaaacgcgaccaactataacctaaacaaaactctcccgacgcaaaaaaacaaaaaaccccgaaaaacgaaaacgcgaaaaaacacgaaaacccccaaaaaacaaacgcgcaaaaaaacaaaaaaacctccgaaaaactaaaacgtaaaaccgaacgcgaaacgcgaaaacaaaaaacgaatcgaaaaccaaacgcgacgactaaacccgtccgccgaaaataatcgaaccgcgcgccctaaacaaataaaaactaccgccgccccacgccctacctaacgccgaaaaatccgcctcctcgtcaacctccgcctcaactaccgccccgactacaaccgcgaacaacgaatccatcgcgcgaccaatcatataaacccgcgctcccacgtaacttcctcccgcgccacccgaccgcgcaaccctaccgcgccgcgccctcgccccgcccacaccccgcctaatcacgccccctcccccgcgcgccacgcccacaatccgcccctacgacccgccgcgctcctcgcccgacctcgcacgcctacaacccgcctaaccacgcccacatacccctccccgtccacg

SEQ ID NO: 2527 - DNA, 687 bp, Artificial Sequence
  chemically treated genomic DNA (Homo sapiens) CpG-island No: 2527
ttatcgtttagcgtgattaggtagggtagaagagtagggtattaggaacggggcgaggaggaaattgttttcgaggacgtttttgagagtttcgggaaagcgtttcggaacgcggttagttgtaatttggatagggttttttcggcgtaggagggtaggggatttcgagggacggaggcgcgagagagtacggggatttttaaaggataggcgcgtaggagggtagggggattttcgagggattggggcgtggggtcgaacgcggggcgcgggggtaggaaacgagtcggggattaagcgcggcggttgagttcgttcgtcgggggtggtcgggtcgcgcgttttgggtaggtgggggttatcgtcgttttacgttttatttgacgtcgggggattcgttttttcgttagttttcgttttagttgtcgtttcgattgtagtcgcgggtagcgggtttatcgcgcggttagttatgtgagttcgcgtttttacgtgattttttttcgcgttattcggtcgcgtagttttgtcgcgtcgcgttttcgtttcgtttatatttcgtttggttacgttttttttttcgcgcgttacgtttatagttcgtttttgcggttcgtcgcgtttttcgttcggtttcgtacgtttataattcgtttagttacgtttatatgttttttttcgtttacg

SEQ ID NO: 2528 - DNA, 687 bp, Artificial Sequence
  chemically treated genomic DNA (Homo sapiens) CpG-island No: 2528
cgtaaacgaaaaaaaacatataaacgtaactaaacgaattataaacgtacgaaaccgaacgaaaaacgcgacgaaccgcaaaaacgaactataaacgtaacgcgcgaaaaaaaaaacgtaaccaaacgaaatataaacgaaacgaaaacgcgacgcgacaaaactacgcgaccgaataacgcgaaaaaaaatcacgtaaaaacgcgaactcacataactaaccgcgcgataaacccgctacccgcgactacaatcgaaacgacaactaaaacgaaaactaacgaaaaaacgaatcccccgacgtcaaataaaacgtaaaacgacgataacccccacctacccaaaacgcgcgacccgaccacccccgacgaacgaactcaaccgccgcgcttaatccccgactcgtttcctacccccgcgccccgcgttcgaccccacgccccaatccctcgaaaatccccctaccctcctacgcgcctatcctttaaaaatccccgtactctctcgcgcctccgtccctcgaaatcccctaccctcctacgccgaaaaaaccctatccaaattacaactaaccgcgttccgaaacgctttcccgaaactctcaaaaacgtcctcgaaaacaatttcctcctcgccccgttcctaataccctactcttctaccctacctaatcacgctaaacgataa

SEQ ID NO: 2529 - DNA, 927 bp, Artificial Sequence
  chemically treated genomic DNA (Homo sapiens) CpG-island No: 2529
cgtttcgggggcggcgcgggagttttcgtaggatcgggcgggcgtttcggttggcgcgggcggggggcgcgttttttttatttgcggtttcggtttttaggttatttttttacgcggcggcggtcgggattgagttgatattatttaggtcggtcgggtttgaatgaggaggagcgggcgcggagaggagggagcggggagcgcgtgagggagggagggaggcgtcgcggagtttttttcggttttttgtgcggatattttcggatttcgcgttcgtattcggttttttaaaagatacggggagtcgcgggcgaggggtgtagttatttttcgaggcgtttagtgttttcgcgtttttaagatttttttttaataaaaaggagcgttttttatttttattttcgttcggaggatttagggtttgggtttatttcgggcgcggagttaagtgtaggcgtcgggggtttttagagtcgtcggggcgtagcgagttcggcgttgggtaattgttgggttagaaattgtttaggtagtagttgttgtgtttttttttgtttcgtcgttcggagacgtttcgttttttgtttttaatcgcgcgtcgtttcgttttttgttttgaacgtcgttcgtttcgttttagcgtttacgtgattagtatagcgcgttttcgtttcgttcgtcgtcgtagatttcgtttaagggattcgagcgagcggcgagcgcgcgtaatattagtttttgttcggcgattttcgcgtacgcgtcgtgttatttttttcgtattttttttttcgttattcggtttaacgtggcgggcgcgcgtcgagtatgtagtcgtgataggtattcggcgggggggggggggagggggttggttcgcgagggtgtgcgtaggtatagattcgggttttgttttcgtcgtttttt

SEQ ID NO: 2530 - DNA, 927 bp, Artificial Sequence
  chemically treated genomic DNA (Homo sapiens) CpG-island No: 2530
aaaaaacgacgaaaacaaaacccgaatctatacctacgcacaccctcgcgaaccaaccccctcccccccccccccgccgaatacctatcacgactacatactcgacgcgcgcccgccacgttaaaccgaataacgaaaaaaaaaatacgaaaaaaataacacgacgcgtacgcgaaaatcgccgaacaaaaactaatattacgcgcgctcgccgctcgctcgaatcccttaaacgaaatctacgacgacgaacgaaacgaaaacgcgctatactaatcacgtaaacgctaaaacgaaacgaacgacgttcaaaacaaaaaacgaaacgacgcgcgattaaaaacaaaaaacgaaacgtctccgaacgacgaaacaaaaaaaaacacaacaactactacctaaacaatttctaacccaacaattacccaacgccgaactcgctacgccccgacgactctaaaaacccccgacgcctacacttaactccgcgcccgaaataaacccaaaccctaaatcctccgaacgaaaataaaaataaaaaacgctcctttttattaaaaaaaaatcttaaaaacgcgaaaacactaaacgcctcgaaaaataactacacccctcgcccgcgactccccgtatcttttaaaaaaccgaatacgaacgcgaaatccgaaaatatccgcacaaaaaaccgaaaaaaactccgcgacgcctccctccctccctcacgcgctccccgctccctcctctccgcgcccgctcctcctcattcaaacccgaccgacctaaataatatcaactcaatcccgaccgccgccgcgtaaaaaaataacctaaaaaccgaaaccgcaaataaaaaaaacgcgccccccgcccgcgccaaccgaaacgcccgcccgatcctacgaaaactcccgcgccgcccccgaaacg

SEQ ID NO: 2531 - DNA, 927 bp, Artificial Sequence
  chemically treated genomic DNA (Homo sapiens) CpG-island No: 2531
agggggcggcggggataggattcgggtttgtgtttgcgtatattttcgcgggttaattttttttttttttttttcgtcgggtatttgttacggttatatgttcggcgcgcgttcgttacgttaagtcggatggcgggaggaggggtgcggggagggtggtacggcgcgtgcgcgggagtcgtcgagtaagaattggtattgcgcgcgttcgtcgttcgttcgaattttttaagcggagtttgcggcggcgggcgaaacgggggcgcgttatgttagttacgtgggcgttggggcggggcgggcggcgtttaaggtagggggcggggcggcgcgcggttgaaggtagggggcggggcgttttcgagcggcggggtaagggagggtataatagttgttatttgaatagtttttgatttaatagttatttagcgtcggattcgttgcgtttcggcggttttagggattttcggcgtttatatttagtttcgcgttcgaggtgagtttaggttttaaatttttcgggcgggggtaggggtgggggacgtttttttttgttgggggggggttttggaggcgcgaaggtattaggcgtttcgggggatggttgtatttttcgttcgcggtttttcgtgttttttggggggtcgggtgcgggcgcggaattcgggagtgttcgtataaaaggtcgagaaaaatttcgcgacgttttttttttttttttacgcgtttttcgttttttttttttcgcgttcgtttttttttatttaaattcggtcggtttgagtggtgttagtttagtttcggtcgtcgtcgcgtgaggaaatggtttaggagtcggagtcgtaggtaaagggggcgcgtttttcgttcgcgttagtcggggcgttcgttcggttttgcggaggttttcgcgtcgttttcgaggcg

SEQ ID NO: 2532 - DNA, 927 bp, Artificial Sequence
  chemically treated genomic DNA (Homo sapiens) CpG-island No: 2532
cgcctcgaaaacgacgcgaaaacctccgcaaaaccgaacgaacgccccgactaacgcgaacgaaaaacgcgccccctttacctacgactccgactcctaaaccatttcctcacgcgacgacgaccgaaactaaactaacaccactcaaaccgaccgaatttaaataaaaaaaaacgaacgcgaaaaaaaaaaaacgaaaaacgcgtaaaaaaaaaaaaaaaacgtcgcgaaatttttctcgaccttttatacgaacactcccgaattccgcgcccgcacccgaccccccaaaaaacacgaaaaaccgcgaacgaaaaatacaaccatcccccgaaacgcctaataccttcgcgcctccaaaacccccccccaacaaaaaaaaacgtcccccacccctacccccgcccgaaaaatttaaaacctaaactcacctcgaacgcgaaactaaatataaacgccgaaaatccctaaaaccgccgaaacgcaacgaatccgacgctaaataactattaaatcaaaaactattcaaataacaactattataccctcccttaccccgccgctcgaaaacgccccgccccctaccttcaaccgcgcgccgccccgccccctaccttaaacgccgcccgccccgccccaacgcccacgtaactaacataacgcgcccccgtttcgcccgccgccgcaaactccgcttaaaaaattcgaacgaacgacgaacgcgcgcaataccaattcttactcgacgactcccgcgcacgcgccgtaccaccctccccgcacccctcctcccgccatccgacttaacgtaacgaacgcgcgccgaacatataaccgtaacaaatacccgacgaaaaaaaaaaaaaaaaaattaacccgcgaaaatatacgcaaacacaaacccgaatcctatccccgccgccccct

SEQ ID NO: 2533 - DNA, 906 bp, Artificial Sequence
  chemically treated genomic DNA (Homo sapiens) CpG-island No: 2533
ggggcgacgggcgcgggtagaggttgaggttttgtgtaggtaggtgcgtgtttgtttgttcgcggagggaggagagggggatacggggtagaagaggggttttcgcgtagagtgcggtattgttttattttttttcgttggttcgcgagtacgcgcgtattcgtattcgttttatagatttttttttttatacgtataggtatttttttgtttcgttttttttcgatgggttcgtttgtttcggaggcgtagggggtcgtgtcgtcgtcgcgtatcggttgttttcgggagcgtcgttagggtcggtttcgtgtgggggaggggtggtttcgcgtcgtcgtcgtcgcgttttttttttttcgtttttttttttttcgggcgtttcgaggttcgggcggttttgtttaatgagtagcggcgttgttggtaggtggggagtgtttttgttttgggttgaagttgaggttgaggagagagtcgagttagcgacgagtagtcgttgcggtcgtcggcgtcgcgggaggtggtggaggtttagtcggagtcgagaggttttttgttttcgttttacggtttcggcgttattttttcggcgtttagttttcgtttcggaattttcgggtttgttttgggttttcggtttgtgtatttcgttcgtcgtagcgttcggttcgggtcgtattcgtcggttttatgaggagggacgtgaacggagtgattaagagtaggtttgaggtgtgagtttggggggttcgggcggcgtgaggagggcgggtcgcgcgttttaattttaaaacgttcgtttcgtacggagttttttttttggtaggcgtcgttatttatttattggcggggttgttagatttcgttttttttttttgcgatttagaagtttagcgtagttcg

SEQ ID NO: 2534 - DNA, 906 bp, Artificial Sequence
  chemically treated genomic DNA (Homo sapiens) CpG-island No: 2534
cgaactacgctaaacttctaaatcgcaaaaaaaaaaaacgaaatctaacaaccccgccaataaataaataacgacgcctaccaaaaaaaaaactccgtacgaaacgaacgttttaaaattaaaacgcgcgacccgccctcctcacgccgcccgaaccccccaaactcacacctcaaacctactcttaatcactccgttcacgtccctcctcataaaaccgacgaatacgacccgaaccgaacgctacgacgaacgaaatacacaaaccgaaaacccaaaacaaacccgaaaattccgaaacgaaaactaaacgccgaaaaaataacgccgaaaccgtaaaacgaaaacaaaaaacctctcgactccgactaaacctccaccacctcccgcgacgccgacgaccgcaacgactactcgtcgctaactcgactctctcctcaacctcaacttcaacccaaaacaaaaacactccccacctaccaacaacgccgctactcattaaacaaaaccgcccgaacctcgaaacgcccgaaaaaaaaaaaaacgaaaaaaaaaaaacgcgacgacgacgacgcgaaaccacccctcccccacacgaaaccgaccctaacgacgctcccgaaaacaaccgatacgcgacgacgacacgaccccctacgcctccgaaacaaacgaacccatcgaaaaaaaacgaaacaaaaaaatacctatacgtataaaaaaaaaaatctataaaacgaatacgaatacgcgcgtactcgcgaaccaacgaaaaaaaataaaacaataccgcactctacgcgaaaacccctcttctaccccgtatccccctctcctccctccgcgaacaaacaaacacgcacctacctacacaaaacctcaacctctacccgcgcccgtcgcccc

SEQ ID NO: 2535 - DNA, 906 bp, Artificial Sequence
  chemically treated genomic DNA (Homo sapiens) CpG-island No: 2535
cgggttgcgttgggtttttgggtcgtaagaaaggggagcggagtttggtagtttcgttagtgggtgggtgacggcgtttgttagggaggaggtttcgtgcggagcggacgttttgggattagagcgcgcgattcgttttttttacgtcgttcgagttttttaagtttatattttaaatttgtttttggttatttcgtttacgtttttttttatggggtcggcgggtgcggttcgggtcgggcgttgcggcgagcggagtgtatagatcgggggtttaggataggttcgggagtttcgggacggggattgggcgtcggaggggtgacgtcgggatcgtgggacgggaataagagatttttcggtttcggttaggtttttattatttttcgcggcgtcggcggtcgtaacgattgttcgtcgttagttcggttttttttttagttttaattttaatttaaaataaaaatattttttatttgttagtaacgtcgttgtttattggatagagtcgttcgggtttcggagcgttcgggagggggaggggcgggaggggaggagcgcggcggcggcggcgcgagattattttttttttatacggggtcggttttgacggcgttttcgggagtagtcggtgcgcggcggcggtacgattttttgcgttttcgaggtagacgagtttatcgggagaaggcgaggtagggaagtgtttgtgcgtgtggaaaagggggtttgtggggcggatgcgagtgcgcgcgtgttcgcggattagcgagggagagtagagtagtatcgtattttgcgcgggggttttttttttgtttcgtgtttttttttttttttttcgcgggtaaataggtacgtatttgtttgtatagaattttagtttttgttcgcgttcgtcgtttt

SEQ ID NO: 2536 - DNA, 906 bp, Artificial Sequence
  chemically treated genomic DNA (Homo sapiens) CpG-island No: 2536
aaaacgacgaacgcgaacaaaaactaaaattctatacaaacaaatacgtacctatttacccgcgaaaaaaaaaaaaaaaaacacgaaacaaaaaaaaaacccccgcgcaaaatacgatactactctactctccctcgctaatccgcgaacacgcgcgcactcgcatccgccccacaaacccccttttccacacgcacaaacacttccctacctcgccttctcccgataaactcgtctacctcgaaaacgcaaaaaatcgtaccgccgccgcgcaccgactactcccgaaaacgccgtcaaaaccgaccccgtataaaaaaaaaataatctcgcgccgccgccgccgcgctcctcccctcccgcccctccccctcccgaacgctccgaaacccgaacgactctatccaataaacaacgacgttactaacaaataaaaaatatttttattttaaattaaaattaaaactaaaaaaaaaaccgaactaacgacgaacaatcgttacgaccgccgacgccgcgaaaaataataaaaacctaaccgaaaccgaaaaatctcttattcccgtcccacgatcccgacgtcacccctccgacgcccaatccccgtcccgaaactcccgaacctatcctaaacccccgatctatacactccgctcgccgcaacgcccgacccgaaccgcacccgccgaccccataaaaaaaaacgtaaacgaaataaccaaaaacaaatttaaaatataaacttaaaaaactcgaacgacgtaaaaaaaacgaatcgcgcgctctaatcccaaaacgtccgctccgcacgaaacctcctccctaacaaacgccgtcacccacccactaacgaaactaccaaactccgctcccctttcttacgacccaaaaacccaacgcaacccg

SEQ ID NO: 2537 - DNA, 1347 bp, Artificial Sequence
  chemically treated genomic DNA (Homo sapiens) CpG-island No: 2537
tagcggggtatggcggtgttagagggtggggatatggaggcggtataaggttaaggcgtcgggggatggttagagggaagtaacggtcgcgtttgtggtggagatggggacgggatagagaagttttggggggtgatcggggtaggtacggcggtgttggggggagggcgtttaatgaagtttacgggggggaaaggggcgtgttttatcgagcgtgttgggggagttatagtcgtgtttgggaggatggggtttgggggaaggacggggcgcgttttagtgggatgagggggagggtatagtcgtgttgggaaggtaaagggtcggggggcgggatggagtatgttatggtggggtcgaagaggcggggggcgggaaggggtttttttagaaatcgggagggcgttatagttgtgttcgggaggacggggcgttggggagggatagggagcgttttagtggattcggggaatacggtcgtgttggaaggtatcgagttggggggttgggggcgggacggggtgttttttaggaagtggggcgggtaaggttacgtttcgggggatggagttttggggcgggacggggcgcgttttagtggggtagagcggggggcgcggttcggggcgggttttagggagtttttgaaggtcgaattcgggtagcggtgtagttgggcgtggaaggcggaggatttagtagggcgtgatcggtttagttttcgtttttttcgggtttcggttagttttttttcgttttttttttttttttttttttgttttttttttttgttttttcgttttttttttagttcggttttttttattcgtttttcgtttttttagtcgttttttatttttgggttttgttgtttggcgtttttttcgggtatagaacgcgtttttagttatattttggagattataaggcgtcggatataattacgttttttataggggtttaggttcgttcggggcgtttttcgtcgtgttcgcgattttttttttaggtttttattttaggttttagtatgggtcgcgtttcggggttttaggtatttggcggcgggcgcggcgcgtttttttcgcgcggcggatcgtatggtcgagcgttggtttagagcgtaggattttgttttgcgtatttcgcgttcgggcgtcgttagtgttaaggttttcgtttttttagttgcgggatttgggtcgggcgttcgttttttttttattcgcgttattttttggttttcgggattttcgggatttgcgcgtggaaataggtttttttaggtcgttatacgggaaggtttgggttaaggagttgattaaatttagttacgattgatcgggt

SEQ ID NO: 2538 - DNA, 1347 bp, Artificial Sequence
  chemically treated genomic DNA (Homo sapiens) CpG-island No: 2538
acccgatcaatcgtaactaaatttaatcaactccttaacccaaaccttcccgtataacgacctaaaaaaacctatttccacgcgcaaatcccgaaaatcccgaaaaccaaaaaataacgcgaataaaaaaaaaacgaacgcccgacccaaatcccgcaactaaaaaaacgaaaaccttaacactaacgacgcccgaacgcgaaatacgcaaaacaaaatcctacgctctaaaccaacgctcgaccatacgatccgccgcgcgaaaaaaacgcgccgcgcccgccgccaaatacctaaaaccccgaaacgcgacccatactaaaacctaaaataaaaacctaaaaaaaaaatcgcgaacacgacgaaaaacgccccgaacgaacctaaacccctataaaaaacgtaattatatccgacgccttataatctccaaaatataactaaaaacgcgttctatacccgaaaaaaacgccaaacaacaaaacccaaaaataaaaaacgactaaaaaaacgaaaaacgaataaaaaaaaccgaactaaaaaaaaaacgaaaaaacaaaaaaaaaaaacaaaaaaaaaaaaaaaaaaaaaacgaaaaaaaactaaccgaaacccgaaaaaaacgaaaactaaaccgatcacgccctactaaatcctccgccttccacgcccaactacaccgctacccgaattcgaccttcaaaaactccctaaaacccgccccgaaccgcgccccccgctctaccccactaaaacgcgccccgtcccgccccaaaactccatcccccgaaacgtaaccttacccgccccacttcctaaaaaacaccccgtcccgcccccaaccccccaactcgataccttccaacacgaccgtattccccgaatccactaaaacgctccctatccctccccaacgccccgtcctcccgaacacaactataacgccctcccgatttctaaaaaaaccccttcccgccccccgcctcttcgaccccaccataacatactccatcccgccccccgaccctttaccttcccaacacgactataccctccccctcatcccactaaaacgcgccccgtccttcccccaaaccccatcctcccaaacacgactataactcccccaacacgctcgataaaacacgcccctttcccccccgtaaacttcattaaacgccctccccccaacaccgccgtacctaccccgatcaccccccaaaacttctctatcccgtccccatctccaccacaaacgcgaccgttacttccctctaaccatcccccgacgccttaaccttataccgcctccatatccccaccctctaacaccgccataccccgcta

SEQ ID NO: 2539 - DNA, 1347 bp, Artificial Sequence
  chemically treated genomic DNA (Homo sapiens) CpG-island No: 2539
gttcggttaatcgtaattgggtttaattagttttttagtttaggttttttcgtgtgacgatttgggaaaatttgtttttacgcgtaggtttcggaggtttcgagagttaggagatgacgcggatgaaggaggggcgggcgttcggtttagatttcgtagttgagagggcggaagttttggtattagcggcgttcgggcgcggagtgcgtagggtaaggttttgcgttttgggttagcgttcggttatgcgattcgtcgcgcggaggggacgcgtcgcgttcgtcgttaggtgtttgggatttcgggacgcggtttatattaaggtttagggtgggggtttggggagggggtcgcgagtacggcgaggggcgtttcgggcgagtttgggtttttgtaaagggcgtggttgtgttcggcgttttgtagtttttaaaatgtagttggaggcgcgttttgtgttcgggaaagacgttagatagtagagtttagggatggggggcgattgaggggacgaagggcgggtggaggagatcgaattgaagggaaggcggaagggtagggaaagagaataaaggaggaagggaagggagggcggaggaaggttggtcgggattcggagggagcggaaattgggtcggttacgttttgttgggtttttcgttttttacgtttagttatatcgttgttcggattcggtttttaaaggttttttaagattcgtttcgaatcgcgtttttcgttttgttttattaagacgcgtttcgtttcgttttaaggttttatttttcgaagcgtagttttgttcgttttattttttaagaggtatttcgtttcgtttttaattttttagttcgatgttttttagtacggtcgtgtttttcgggtttattaagacgttttttgtttttttttaacgtttcgttttttcgagtatagttgtgacgttttttcgatttttaagaaggttttttttcgtttttcgttttttcggttttattatgatatgttttatttcgtttttcggttttttgtttttttagtacggttgtgtttttttttttattttattaagacgcgtttcgttttttttttagattttatttttttaagtacggttgtgatttttttaatacgttcggtaagatacgtttttttttttttcgtgggttttattgggcgttttttttttagtatcgtcgtgtttatttcggttattttttaagatttttttgtttcgtttttatttttattataagcgcggtcgttatttttttttggttatttttcggcgttttggttttgtgtcgtttttatgtttttattttttagtatcgttatgtttcgttg

SEQ ID NO: 2540 - DNA, 1347 bp, Artificial Sequence
  chemically treated genomic DNA (Homo sapiens) CpG-island No: 2540
caacgaaacataacgatactaaaaaataaaaacataaaaacgacacaaaaccaaaacgccgaaaaataaccaaaaaaaaataacgaccgcgcttataataaaaataaaaacgaaacaaaaaaatcttaaaaaataaccgaaataaacacgacgatactaaaaaaaaaacgcccaataaaacccacgaaaaaaaaaaaaacgtatcttaccgaacgtattaaaaaaatcacaaccgtacttaaaaaaataaaatctaaaaaaaaaacgaaacgcgtcttaataaaataaaaaaaaaaacacaaccgtactaaaaaaacaaaaaaccgaaaaacgaaataaaacatatcataataaaaccgaaaaaacgaaaaacgaaaaaaaaccttcttaaaaatcgaaaaaacgtcacaactatactcgaaaaaacgaaacgttaaaaaaaaacaaaaaacgtcttaataaacccgaaaaacacgaccgtactaaaaaacatcgaactaaaaaattaaaaacgaaacgaaatacctcttaaaaaataaaacgaacaaaactacgcttcgaaaaataaaaccttaaaacgaaacgaaacgcgtcttaataaaacaaaacgaaaaacgcgattcgaaacgaatcttaaaaaacctttaaaaaccgaatccgaacaacgatataactaaacgtaaaaaacgaaaaacccaacaaaacgtaaccgacccaatttccgctccctccgaatcccgaccaaccttcctccgccctcccttcccttcctcctttattctctttccctacccttccgccttcccttcaattcgatctcctccacccgcccttcgtcccctcaatcgccccccatccctaaactctactatctaacgtctttcccgaacacaaaacgcgcctccaactacattttaaaaactacaaaacgccgaacacaaccacgccctttacaaaaacccaaactcgcccgaaacgcccctcgccgtactcgcgaccccctccccaaacccccaccctaaaccttaatataaaccgcgtcccgaaatcccaaacacctaacgacgaacgcgacgcgtcccctccgcgcgacgaatcgcataaccgaacgctaacccaaaacgcaaaaccttaccctacgcactccgcgcccgaacgccgctaataccaaaacttccgccctctcaactacgaaatctaaaccgaacgcccgcccctccttcatccgcgtcatctcctaactctcgaaacctccgaaacctacgcgtaaaaacaaattttcccaaatcgtcacacgaaaaaacctaaactaaaaaactaattaaacccaattacgattaaccgaac

SEQ ID NO: 2541 - DNA, 768 bp, Artificial Sequence
  chemically treated genomic DNA (Homo sapiens) CpG-island No: 2541
tgttgtcgtcggagttttttcggtcgcggaaggagttttcgcggaggaagaggggttgtagtcgggcggttgtcgggggcggcgggaaggaatcggacgcggaggagatcgagcgagggtggtcgagcgtcgggcgtattgtttttcgaggggttttggggtcgtttagttgtttttttttcgttaatttcgggcgggcgaggcgggttaggcggtcgaggggagtcggggttcgtcgtttttttagtagtggggattcgtatttgggtcgggcggcggcgagattcggattggagttattggattgggcgagtcgggtcgggcggtagggagagggggtaggcggtgaatcgagcggatcgcggtgaagataggcgaggcgggggcggggcggggcggggcggggagcgagtttcgtcgggagggagggaggttggcggcggggaaattaggattggattcgagggggagaggaagtagcgagattagaggaggagaaagcgcggcgcgttggattaacgggaagagaaggggcgggggtgtagtgcgttatagtcgggtcgggagttttgtggtttggaggaagcgggaggaggcgcgggtagtcgttagggcgaggcgattcggtgcggggggatttttatggagcgcggatttttaaggaagtcgttgggaattttatcggttgtatcgtagggcgttagtatttagatggtttcggtgtttttaagcgatgggtttaagttatagggcgggttttgtatttgg

SEQ ID NO: 2542 - DNA, 768 bp, Artificial Sequence
  chemically treated genomic DNA (Homo sapiens) CpG-island No: 2542
ccaaatacaaaacccgccctataacttaaacccatcgcttaaaaacaccgaaaccatctaaatactaacgccctacgatacaaccgataaaattcccaacgacttccttaaaaatccgcgctccataaaaatccccccgcaccgaatcgcctcgccctaacgactacccgcgcctcctcccgcttcctccaaaccacaaaactcccgacccgactataacgcactacacccccgccccttctcttcccgttaatccaacgcgccgcgctttctcctcctctaatctcgctacttcctctccccctcgaatccaatcctaatttccccgccgccaacctccctccctcccgacgaaactcgctccccgccccgccccgccccgcccccgcctcgcctatcttcaccgcgatccgctcgattcaccgcctaccccctctccctaccgcccgacccgactcgcccaatccaataactccaatccgaatctcgccgccgcccgacccaaatacgaatccccactactaaaaaaacgacgaaccccgactcccctcgaccgcctaacccgcctcgcccgcccgaaattaacgaaaaaaaaacaactaaacgaccccaaaacccctcgaaaaacaatacgcccgacgctcgaccaccctcgctcgatctcctccgcgtccgattccttcccgccgcccccgacaaccgcccgactacaacccctcttcctccgcgaaaactccttccgcgaccgaaaaaactccgacgacaaca

SEQ ID NO: 2543 - DNA, 768 bp, Artificial Sequence
  chemically treated genomic DNA (Homo sapiens) CpG-island No: 2543
ttaggtgtaaagttcgttttgtagtttgagtttatcgtttgggggtatcgaagttatttaggtattaacgttttgcggtatagtcggtgggatttttagcgatttttttaggagttcgcgttttatgggagttttttcgtatcgggtcgtttcgttttggcggttgttcgcgttttttttcgttttttttaggttatagggttttcgattcgattgtgacgtattgtattttcgtttttttttttttcgttgatttagcgcgtcgcgttttttttttttttggtttcgttgttttttttttttttcgaatttagttttggttttttcgtcgttagtttttttttttttcggcgggattcgtttttcgtttcgtttcgtttcgttttcgtttcgtttgtttttatcgcggttcgttcggtttatcgtttgttttttttttttgtcgttcggttcggttcgtttagtttagtggttttagttcggatttcgtcgtcgttcggtttaggtgcgagtttttattgttggggaggcggcgggtttcggtttttttcggtcgtttagttcgtttcgttcgttcggggttggcggggagggaatagttgggcggttttagagtttttcggaggataatgcgttcggcgttcggttattttcgttcggtttttttcgcgttcggttttttttcgtcgttttcggtagtcgttcggttgtagttttttttttttcgcgggggtttttttcgcggtcggagaggtttcggcgatagta

SEQ ID NO: 2544 - DNA, 768 bp, Artificial Sequence
  chemically treated genomic DNA (Homo sapiens) CpG-island No: 2544
tactatcgccgaaacctctccgaccgcgaaaaaaacccccgcgaaaaaaaaaaaactacaaccgaacgactaccgaaaacgacgaaaaaaaaccgaacgcgaaaaaaaccgaacgaaaataaccgaacgccgaacgcattatcctccgaaaaactctaaaaccgcccaactattccctccccgccaaccccgaacgaacgaaacgaactaaacgaccgaaaaaaaccgaaacccgccgcctccccaacaataaaaactcgcacctaaaccgaacgacgacgaaatccgaactaaaaccactaaactaaacgaaccgaaccgaacgacaaaaaaaaaaaacaaacgataaaccgaacgaaccgcgataaaaacaaacgaaacgaaaacgaaacgaaacgaaacgaaaaacgaatcccgccgaaaaaaaaaaaaactaacgacgaaaaaaccaaaactaaattcgaaaaaaaaaaaaaacaacgaaaccaaaaaaaaaaaaaacgcgacgcgctaaatcaacgaaaaaaaaaaaaacgaaaatacaatacgtcacaatcgaatcgaaaaccctataacctaaaaaaaacgaaaaaaaacgcgaacaaccgccaaaacgaaacgacccgatacgaaaaaactcccataaaacgcgaactcctaaaaaaatcgctaaaaatcccaccgactataccgcaaaacgttaatacctaaataacttcgatacccccaaacgataaactcaaactacaaaacgaactttacacctaa

SEQ ID NO: 2545 - DNA, 1189 bp, Artificial Sequence
  chemically treated genomic DNA (Homo sapiens) CpG-island No: 2545
acgtttttttgtgagtttatcggttttcgattatacgttatcgtatacgttttatatttgtggtatatttttgtgagtttataggttttcgattatacgttatcgtatacgttttatatttgtgacgtttttttgtgagtttatcggtttttaattatatattatcgtatacgttttatatttgtgacgtttttttgtgagtttatcggtttttaattatacgttatcgtatacgttttatatttgtgacgtttttttgtgagtttatcggttttcgattatacgttatcgtatacgttttatatttgtgacgtttttttgtgagtttatcggttttcgattatacgttatcgtatacgttttatatttgtgacgtttttttgtgagtttatcggttttcgattatacgttatcgtatacgttttatatttgtgacgtttttttgtgagtttatcggttttcgattatacgttatcgtatacgttttatatttgtgacgtttttttgtgagtttatcggttttcgattatacgttatcgtatacgttttatatttgtgacgtatttttgtgagtttataggttttcgattatacgttatcgtatacgttttatatttgtgacgcgtttttgtgagtttatcggttttcgattatatgttatcgtatacgttttatatttgcgacgtttttttgtgagtttatcggtttttatatgttatcgtatacgttttatatttgtggtatatttttgtgagtttatcggttttcgattatacgttatcgtatacgttttatatttgtggtatatttttgtgagtttatcggttttcgattatacgttatcgtatacgttttatatttgtggcgtttttttgtgagtttatcggtttttaattatacgttatcgtatacgttttatatttgtggtatatttttgtgagtttataggttttcgattatatgttatcgtatacgttttatatttgtggcgtttttttgtgagtttatcggttttcgattatacgttattatatacgttttatatttgtgacgtttttttgtgagtttatcggttttcgattatacgttatcgtatacgtttttttattgtttatggtgttatttttgtttttagtataagtttttgattgatttataagttttacgtttttattttggttttcgtttt

SEQ ID NO: 2546 - DNA, 1189 bp, Artificial Sequence
  chemically treated genomic DNA (Homo sapiens) CpG-island No: 2546
aaaacgaaaaccaaaataaaaacgtaaaacttataaatcaatcaaaaacttatactaaaaacaaaaataacaccataaacaataaaaaaacgtatacgataacgtataatcgaaaaccgataaactcacaaaaaaacgtcacaaatataaaacgtatataataacgtataatcgaaaaccgataaactcacaaaaaaacgccacaaatataaaacgtatacgataacatataatcgaaaacctataaactcacaaaaatataccacaaatataaaacgtatacgataacgtataattaaaaaccgataaactcacaaaaaaacgccacaaatataaaacgtatacgataacgtataatcgaaaaccgataaactcacaaaaatataccacaaatataaaacgtatacgataacgtataatcgaaaaccgataaactcacaaaaatataccacaaatataaaacgtatacgataacatataaaaaccgataaactcacaaaaaaacgtcgcaaatataaaacgtatacgataacatataatcgaaaaccgataaactcacaaaaacgcgtcacaaatataaaacgtatacgataacgtataatcgaaaacctataaactcacaaaaatacgtcacaaatataaaacgtatacgataacgtataatcgaaaaccgataaactcacaaaaaaacgtcacaaatataaaacgtatacgataacgtataatcgaaaaccgataaactcacaaaaaaacgtcacaaatataaaacgtatacgataacgtataatcgaaaaccgataaactcacaaaaaaacgtcacaaatataaaacgtatacgataacgtataatcgaaaaccgataaactcacaaaaaaacgtcacaaatataaaacgtatacgataacgtataatcgaaaaccgataaactcacaaaaaaacgtcacaaatataaaacgtatacgataacgtataattaaaaaccgataaactcacaaaaaaacgtcacaaatataaaacgtatacgataatatataattaaaaaccgataaactcacaaaaaaacgtcacaaatataaaacgtatacgataacgtataatcgaaaacctataaactcacaaaaatataccacaaatataaaacgtatacgataacgtataatcgaaaaccgataaactcacaaaaaaacgt

SEQ ID NO: 2547 - DNA, 1189 bp, Artificial Sequence
  chemically treated genomic DNA (Homo sapiens) CpG-island No: 2547
gggacgaggattaggatgagggcgtaggatttatgaattaattaagggtttgtgttggaggtaagaataatattatgagtagtaaaggagcgtgtgcgatggcgtgtgatcgaaggtcggtaagtttataggagggcgttataggtgtggggcgtgtgtgatggcgtgtgatcgaaggtcggtaagtttataggagggcgttataggtgtggagcgtgtgcgatggtatgtgatcgaaggtttgtgagtttataggagtgtgttataggtgtggggcgtgtgcgatggcgtgtgattgaaggtcggtaagtttataggagggcgttataggtgtggggcgtgtgcgatggcgtgtgatcgaaggtcggtaagtttataggagtgtgttataggtgtggggcgtgtgcgatggcgtgtgatcgaaggtcggtaagtttataggagtgtgttataggtgtggagcgtgtgcgatggtatgtgaaggtcggtaagtttataggagggcgtcgtaggtgtggggcgtgtgcgatggtatgtgatcgaaggtcggtaagtttataggagcgcgttataggtgtggggcgtgtgcgatggcgtgtgatcgaaggtttgtaagtttataggagtgcgttataggtgtggggcgtgtgcgatggcgtgtgatcgaaggtcggtaagtttataggagggcgttataggtgtggggcgtgtgcgatggcgtgtgatcgaaggtcggtaagtttataggagggcgttataggtgtggggcgtgtgcgatggcgtgtgatcgaaggtcggtaagtttataggagggcgttataggtgtggggcgtgtgcgatggcgtgtgatcgaaggtcggtaagtttataggagggcgttataggtgtggggcgtgtgcgatggcgtgtgatcgaaggtcggtaagtttataggagggcgttataggtgtggggcgtgtgcgatgacgtgtgattgaaggtcggtaagtttataggagggcgttataggtgtggggcgtgtgcgatgatgtgtgattgaaggtcggtaagtttataggagggcgttataggtgtggggcgtgtgcgatggcgtgtgatcgaaggtttgtaagtttataggagtgtgttataggtgtggagcgtgtgcgatggcgtgtgatcgaaggtcggtaagtttataggagggcgt

SEQ ID NO: 2548 - DNA, 1189 bp, Artificial Sequence
  chemically treated genomic DNA (Homo sapiens) CpG-island No: 2548
acgccctcctataaacttaccgaccttcgatcacacgccatcgcacacgctccacacctataacacactcctataaacttacaaaccttcgatcacacgccatcgcacacgccccacacctataacgccctcctataaacttaccgaccttcaatcacacatcatcgcacacgccccacacctataacgccctcctataaacttaccgaccttcaatcacacgtcatcgcacacgccccacacctataacgccctcctataaacttaccgaccttcgatcacacgccatcgcacacgccccacacctataacgccctcctataaacttaccgaccttcgatcacacgccatcgcacacgccccacacctataacgccctcctataaacttaccgaccttcgatcacacgccatcgcacacgccccacacctataacgccctcctataaacttaccgaccttcgatcacacgccatcgcacacgccccacacctataacgccctcctataaacttaccgaccttcgatcacacgccatcgcacacgccccacacctataacgcactcctataaacttacaaaccttcgatcacacgccatcgcacacgccccacacctataacgcgctcctataaacttaccgaccttcgatcacataccatcgcacacgccccacacctacgacgccctcctataaacttaccgaccttcacataccatcgcacacgctccacacctataacacactcctataaacttaccgaccttcgatcacacgccatcgcacacgccccacacctataacacactcctataaacttaccgaccttcgatcacacgccatcgcacacgccccacacctataacgccctcctataaacttaccgaccttcaatcacacgccatcgcacacgccccacacctataacacactcctataaactcacaaaccttcgatcacataccatcgcacacgctccacacctataacgccctcctataaacttaccgaccttcgatcacacgccatcacacacgccccacacctataacgccctcctataaacttaccgaccttcgatcacacgccatcgcacacgctcctttactactcataatattattcttacctccaacacaaacccttaattaattcataaatcctacgccctcatcctaatcctcgtccc

SEQ ID NO: 2549 - DNA, 1071 bp, Artificial Sequence
  chemically treated genomic DNA (Homo sapiens) CpG-island No: 2549
tattattatcgcgtcgggtatatagtaggcgtcggttttagtttttttgttttcgttcgcggagtttttagcgtttagtcgaggttatagcgagttgaattgaatttaaggttcgtattaaatttataggtatttgggggcggagtattcgtaggcgcggttttcggcgcgcggtttagttttttttatatgtagatgaaaattacgatttaaacgtttttatggtggaaattagaagacgcgtagggaaaatagggacgcggaaattgtcgggaagcgtaggggttgataagtagtttggtttaggtcgttttacgagcgttttttcgcgggagtagcgttttcgaggtcgttagcgagttagaggaaggtagggcgtattcgttttttagtaagaacgcgatgtattcgggcgcgacgacggtttaggtagtttttaggaggttgggatattagttcggtcgttttttttttttcgcggtttttcgtttcgttttcggttttgagtggcgagtggttcggttagaattcggacgtttttatttgagcggggtttatagtatagtatttgcgggcggggcggttttggagtttcgtagtcgcgcgcgtcgttcgttagtaaagtttacgcgtcgcgtcgagcgtagttatatagttttacgtagttattcggtcgtcgtcgtgcgtacgtgtacggggtgcggtttttttttttcgcgagttcgttcgttgtatagttaattagcggtcggcgcgcgcggtattacgggagttgtagttttgtaagcgcgcggagttcgtcgggcgtttatggaattcgattcgtaggttaaaggggtttcgttgtaaggaagaagtgcggggtttcgtcgttttttagatcgagatcgcggtgagttggtcgcggcgtataatgggtacggtttgggcggcggcgttcgtattatcgttttgtgtttgcggatttcggtaatattgcgcggtaggttttaggtcggttttttttagtttcgcggattgtttgggtcgggggttttaattttgattttagggtcgggtcgttggggtaga

SEQ ID NO: 2550 - DNA, 1071 bp, Artificial Sequence
  chemically treated genomic DNA (Homo sapiens) CpG-island No: 2550
tctaccccaacgacccgaccctaaaatcaaaattaaaacccccgacccaaacaatccgcgaaactaaaaaaaaccgacctaaaacctaccgcgcaatattaccgaaatccgcaaacacaaaacgataatacgaacgccgccgcccaaaccgtacccattatacgccgcgaccaactcaccgcgatctcgatctaaaaaacgacgaaaccccgcacttcttccttacaacgaaacccctttaacctacgaatcgaattccataaacgcccgacgaactccgcgcgcttacaaaactacaactcccgtaataccgcgcgcgccgaccgctaattaactatacaacgaacgaactcgcgaaaaaaaaaaaccgcaccccgtacacgtacgcacgacgacgaccgaataactacgtaaaactatataactacgctcgacgcgacgcgtaaactttactaacgaacgacgcgcgcgactacgaaactccaaaaccgccccgcccgcaaatactatactataaaccccgctcaaataaaaacgtccgaattctaaccgaaccactcgccactcaaaaccgaaaacgaaacgaaaaaccgcgaaaaaaaaaaaacgaccgaactaatatcccaacctcctaaaaactacctaaaccgtcgtcgcgcccgaatacatcgcgttcttactaaaaaacgaatacgccctaccttcctctaactcgctaacgacctcgaaaacgctactcccgcgaaaaaacgctcgtaaaacgacctaaaccaaactacttatcaacccctacgcttcccgacaatttccgcgtccctattttccctacgcgtcttctaatttccaccataaaaacgtttaaatcgtaattttcatctacatataaaaaaaactaaaccgcgcgccgaaaaccgcgcctacgaatactccgcccccaaatacctataaatttaatacgaaccttaaattcaattcaactcgctataacctcgactaaacgctaaaaactccgcgaacgaaaacaaaaaaactaaaaccgacgcctactatatacccgacgcgataataata

SEQ ID NO: 2551 - DNA, 1071 bp, Artificial Sequence
  chemically treated genomic DNA (Homo sapiens) CpG-island No: 2551
tttgttttagcggttcggttttgaagttaaggttgagattttcggtttagatagttcgcgaagttgagggaggtcggtttggggtttgtcgcgtaatgttatcgggattcgtaggtatagggcgatagtacggacgtcgtcgtttaggtcgtgtttattgtgcgtcgcggttagtttatcgcgatttcggtttaggaggcggcgggatttcgtattttttttttgtaacggagtttttttggtttgcgggtcgagttttataggcgttcgacgggtttcgcgcgtttataggattataattttcgtgatgtcgcgcgcgtcgatcgttgattggttgtgtagcggacggattcgcggggggggggggtcgtatttcgtgtacgtgcgtacggcgacggtcggatggttgcgtggggttgtgtggttgcgttcggcgcggcgcgtgggttttgttggcgggcggcgcgcgcggttgcggggttttagggtcgtttcgttcgtaggtgttatgttgtgggtttcgtttaggtgaggacgttcgggttttggtcgagttattcgttatttagggtcggaggcggggcggggagtcgcggggaaggaggggcggtcgggttggtattttagttttttgggaattgtttggatcgtcgtcgcgttcgagtgtatcgcgtttttgttggagggcggatgcgttttgtttttttttgattcgttggcggtttcggaaacgttattttcgcgggagagcgttcgtgggacggtttgggttaggttgtttgttagtttttgcgtttttcggtagttttcgcgtttttgttttttttgcgcgttttttgatttttattatgaggacgtttgggtcgtgatttttatttgtatgtggaggaaattgggtcgcgcgtcgggagtcgcgtttgcgggtgtttcgtttttaagtgtttgtgggtttggtgcgggttttgggtttagtttagttcgttgtgatttcgattgagcgttggaggtttcgcgggcgggagtaggagggttggagtcggcgtttgttgtgtgttcggcgcggtagtgatg

SEQ ID NO: 2552 - DNA, 1071 bp, Artificial Sequence
  chemically treated genomic DNA (Homo sapiens) CpG-island No: 2552
catcactaccgcgccgaacacacaacaaacgccgactccaaccctcctactcccgcccgcgaaacctccaacgctcaatcgaaatcacaacgaactaaactaaacccaaaacccgcaccaaacccacaaacacttaaaaacgaaacacccgcaaacgcgactcccgacgcgcgacccaatttcctccacatacaaataaaaatcacgacccaaacgtcctcataataaaaatcaaaaaacgcgcaaaaaaaacaaaaacgcgaaaactaccgaaaaacgcaaaaactaacaaacaacctaacccaaaccgtcccacgaacgctctcccgcgaaaataacgtttccgaaaccgccaacgaatcaaaaaaaaacaaaacgcatccgccctccaacaaaaacgcgatacactcgaacgcgacgacgatccaaacaattcccaaaaaactaaaataccaacccgaccgcccctccttccccgcgactccccgccccgcctccgaccctaaataacgaataactcgaccaaaacccgaacgtcctcacctaaacgaaacccacaacataacacctacgaacgaaacgaccctaaaaccccgcaaccgcgcgcgccgcccgccaacaaaacccacgcgccgcgccgaacgcaaccacacaaccccacgcaaccatccgaccgtcgccgtacgcacgtacacgaaatacgaccccccccccccgcgaatccgtccgctacacaaccaatcaacgatcgacgcgcgcgacatcacgaaaattataatcctataaacgcgcgaaacccgtcgaacgcctataaaactcgacccgcaaaccaaaaaaactccgttacaaaaaaaaaatacgaaatcccgccgcctcctaaaccgaaatcgcgataaactaaccgcgacgcacaataaacacgacctaaacgacgacgtccgtactatcgccctatacctacgaatcccgataacattacgcgacaaaccccaaaccgacctccctcaacttcgcgaactatctaaaccgaaaatctcaaccttaacttcaaaaccgaaccgctaaaacaaa

SEQ ID NO: 2553 - DNA, 794 bp, Artificial Sequence
  chemically treated genomic DNA (Homo sapiens) CpG-island No: 2553
ggtatcgggcggttcgcgggtggggcgggggttgcgtaggggtagggagggggttgtcgtcgtacgttcgtgcgtttgtttttcgtcgtagagggcgttttttaggtttattatttcggttcgtgcgggaagtataacgttatggtgttggagttgttggggtttagtttggaggatttgttcgatttgtgcgatcggatttttacgtttaagacggtgttgatgatcgttatttagttggtgcgcggcgggcggggcggggcggggttcggagggaagagggtggttttggaggggagcgcgtgggacggggaggggttcggtcgatatcgtcgtgtttttttgtagattacgcgtatggagtatgtgtatattaagagtttaatttatcgggacgtgaagttcgagaattttttggtgggtcgttcggggattaagcggtagtatgttatttatattatcgatttcgggttggttaaggagtatatcgatttcgagattaagaagtatatttcgtatcgcgagtataagagtttgacgggtacggcgcgttatatgagtattaatacgtatttgggtaagggtgagttgcgcgcgcgcggcggggggcgggcgttcggatttcgttgaggttgcgtttttgttttcgtagagtagagtcgtcgcgacgatttggaggcgttgggttatatgtttatgtattttttgcgcggtagttttttttggtaggggtttaaggtgggcgaggaggtcgggtaggcgggcggggacgtagggcgggagtaaggttgatt

SEQ ID NO: 2554 - DNA, 794 bp, Artificial Sequence
  chemically treated genomic DNA (Homo sapiens) CpG-island No: 2554
aatcaaccttactcccgccctacgtccccgcccgcctacccgacctcctcgcccaccttaaacccctaccaaaaaaaactaccgcgcaaaaaatacataaacatataacccaacgcctccaaatcgtcgcgacgactctactctacgaaaacaaaaacgcaacctcaacgaaatccgaacgcccgccccccgccgcgcgcgcgcaactcacccttacccaaatacgtattaatactcatataacgcgccgtacccgtcaaactcttatactcgcgatacgaaatatacttcttaatctcgaaatcgatatactccttaaccaacccgaaatcgataatataaataacatactaccgcttaatccccgaacgacccaccaaaaaattctcgaacttcacgtcccgataaattaaactcttaatatacacatactccatacgcgtaatctacaaaaaaacacgacgatatcgaccgaacccctccccgtcccacgcgctcccctccaaaaccaccctcttccctccgaaccccgccccgccccgcccgccgcgcaccaactaaataacgatcatcaacaccgtcttaaacgtaaaaatccgatcgcacaaatcgaacaaatcctccaaactaaaccccaacaactccaacaccataacgttatacttcccgcacgaaccgaaataataaacctaaaaaacgccctctacgacgaaaaacaaacgcacgaacgtacgacgacaaccccctccctacccctacgcaacccccgccccacccgcgaaccgcccgatacc

SEQ ID NO: 2555 - DNA, 794 bp, Artificial Sequence
  chemically treated genomic DNA (Homo sapiens) CpG-island No: 2555
ggttagttttgttttcgttttgcgttttcgttcgtttgttcggttttttcgtttattttgagtttttgttaggggaggttgtcgcgtaggaagtatatgaatatgtggtttagcgtttttaggtcgtcgcggcggttttgttttgcggggataggggcgtagttttagcggggttcgggcgttcgtttttcgtcgcgcgcgcgtagtttatttttgtttaggtgcgtgttgatgtttatgtagcgcgtcgtgttcgttaggtttttgtgttcgcggtacgggatgtgttttttggtttcggggtcgatgtattttttggttagttcgaagtcgatgatgtggatggtatgttgtcgtttggttttcgggcggtttattaggaagttttcgggttttacgtttcggtagattaggtttttggtgtgtatatattttatgcgcgtgatttgtaggggggtacggcggtgtcggtcgggttttttttcgttttacgcgtttttttttagggttattttttttttttcgagtttcgtttcgtttcgttcgtcgcgtattagttggatggcgattattagtatcgttttgagcgtgaaggttcggtcgtataggtcgaataggttttttaggttgggttttagtagttttagtattatggcgttgtatttttcgtacggatcgaagtagtagatttgagggacgttttttgcggcggaggatagacgtacgggcgtgcggcggtagttttttttttgtttttgcgtagttttcgttttattcgcgggtcgttcggtatt

SEQ ID NO: 2556 - DNA, 794 bp, Artificial Sequence
  chemically treated genomic DNA (Homo sapiens) CpG-island No: 2556
aataccgaacgacccgcgaataaaacgaaaactacgcaaaaacaaaaaaaaaactaccgccgcacgcccgtacgtctatcctccgccgcaaaaaacgtccctcaaatctactacttcgatccgtacgaaaaatacaacgccataatactaaaactactaaaacccaacctaaaaaacctattcgacctatacgaccgaaccttcacgctcaaaacgatactaataatcgccatccaactaatacgcgacgaacgaaacgaaacgaaactcgaaaaaaaaaaaataaccctaaaaaaaaacgcgtaaaacgaaaaaaaacccgaccgacaccgccgtacccccctacaaatcacgcgcataaaatatatacacaccaaaaacctaatctaccgaaacgtaaaacccgaaaacttcctaataaaccgcccgaaaaccaaacgacaacataccatccacatcatcgacttcgaactaaccaaaaaatacatcgaccccgaaaccaaaaaacacatcccgtaccgcgaacacaaaaacctaacgaacacgacgcgctacataaacatcaacacgcacctaaacaaaaataaactacgcgcgcgcgacgaaaaacgaacgcccgaaccccgctaaaactacgcccctatccccgcaaaacaaaaccgccgcgacgacctaaaaacgctaaaccacatattcatatacttcctacgcgacaacctcccctaacaaaaactcaaaataaacgaaaaaaccgaacaaacgaacgaaaacgcaaaacgaaaacaaaactaacc

SEQ ID NO: 2557 - DNA, 542 bp, Artificial Sequence
  chemically treated genomic DNA (Homo sapiens) CpG-island No: 2557
gcgttgcgcgggtttcgagtcgttttcgatatcggtggtagttttagtcgcgtttatttgtattttttcggaacgtttattagagggcgttgttggatagcgcgtagagttaagtttatggggcggaagagttgcgaggttagtatcgtcgattggagtattcggggcgggtgggtaggacgagcggaggtcgtgggttggagcgtgggagatttttaggagtttttacgttttttaagaggtttggcgtagttcggcgaggtttcgggggtgcgcggatattagtttttttagttttaggtttggaattcggcgggatgggggattgggcgacggtattgtgagggttcggcggaggcgttagggggcgttagttggtttttcgtagtcgatttaggtcgcggcggttttacgaggttcggcgtttcgcgtttcgcgattcgcggttttggttaagttgttagggaaggtgcggcggagattattcgtttttttttttttttttttttttttttttcggtcggcggggagtggcgtttatt

SEQ ID NO: 2558 - DNA, 542 bp, Artificial Sequence
  chemically treated genomic DNA (Homo sapiens) CpG-island No: 2558
aataaacgccactccccgccgaccgaaaaaaaaaaaaaaaaaaaaaaaaaaaaacgaataatctccgccgcaccttccctaacaacttaaccaaaaccgcgaatcgcgaaacgcgaaacgccgaacctcgtaaaaccgccgcgacctaaatcgactacgaaaaaccaactaacgccccctaacgcctccgccgaaccctcacaataccgtcgcccaatcccccatcccgccgaattccaaacctaaaactaaaaaaactaatatccgcgcacccccgaaacctcgccgaactacgccaaacctcttaaaaaacgtaaaaactcctaaaaatctcccacgctccaacccacgacctccgctcgtcctacccacccgccccgaatactccaatcgacgatactaacctcgcaactcttccgccccataaacttaactctacgcgctatccaacaacgccctctaataaacgttccgaaaaaatacaaataaacgcgactaaaactaccaccgatatcgaaaacgactcgaaacccgcgcaacgc

SEQ ID NO: 2559 - DNA, 542 bp, Artificial Sequence
  chemically treated genomic DNA (Homo sapiens) CpG-island No: 2559
ggtgggcgttatttttcgtcggtcgaagagggagggagggagggagaagaggaacgggtggttttcgtcgtattttttttgatagtttggttaggatcgcgggtcgcggggcgcggggcgtcggatttcgtggaatcgtcgcggtttggatcggttgcgaggagttagttagcgttttttggcgttttcgtcgagtttttataatgtcgtcgtttagttttttatttcgtcggattttagatttgaggttgaggaggttggtgttcgcgtattttcgagatttcgtcggattacgttaagttttttagaggacgtaggagtttttgaaggttttttacgttttaatttacggttttcgttcgttttgtttattcgtttcgagtgttttagtcggcggtgttgatttcgtagttttttcgttttataagtttggttttgcgcgttgtttaatagcgttttttggtgggcgtttcggggagatgtaggtgagcgcggttgaggttgttatcgatgtcgagaacggttcgggattcgcgtagcgt

SEQ ID NO: 2560 - DNA, 542 bp, Artificial Sequence
  chemically treated genomic DNA (Homo sapiens) CpG-island No: 2560
acgctacgcgaatcccgaaccgttctcgacatcgataacaacctcaaccgcgctcacctacatctccccgaaacgcccaccaaaaaacgctattaaacaacgcgcaaaaccaaacttataaaacgaaaaaactacgaaatcaacaccgccgactaaaacactcgaaacgaataaacaaaacgaacgaaaaccgtaaattaaaacgtaaaaaaccttcaaaaactcctacgtcctctaaaaaacttaacgtaatccgacgaaatctcgaaaatacgcgaacaccaacctcctcaacctcaaatctaaaatccgacgaaataaaaaactaaacgacgacattataaaaactcgacgaaaacgccaaaaaacgctaactaactcctcgcaaccgatccaaaccgcgacgattccacgaaatccgacgccccgcgccccgcgacccgcgatcctaaccaaactatcaaaaaaaatacgacgaaaaccacccgttcctcttctccctccctccctccctcttcgaccgacgaaaaataacgcccacc

SEQ ID NO: 2561 - DNA, 573 bp, Artificial Sequence
  chemically treated genomic DNA (Homo sapiens) CpG-island No: 2561
gcggggaagtcgtgaacgtcgaggttattgtaaggttgggtggtgcggagcgcgggaagggggttgggatttgaatgggagtttgtgattggtcgatttttggattgacgttattttttcgcggggcgattagtttgcgagaggagggtcggcggtttagtgcgttgggggcggtcggggcgttcgaggttttttaagcgtttcgcgcgggtgttttacgtgagtttcgggacgtcgtcgaggtaggtcggtagcgtcggtgttaggacgtacggaacggggagtaggggagaaatgcgtcgggagggcgagggaggaagggaattgggcgggggttgcgggtttaggtggcgggagttagcgtgtgcgtgtgtttgtttattttttttggtttttcgcgtgcgttttaggattcgggtacggcgttcgtttaggttttcgcgttcggtaggtagtagtacgtggagtttacggcgcggtagcggtattggttaagggaggttcgtttttttttttggttatttagttgtatgagtgttatagagtcgttataaagttagataatcgaaagta

SEQ ID NO: 2562 - DNA, 573 bp, Artificial Sequence
  chemically treated genomic DNA (Homo sapiens) CpG-island No: 2562
tactttcgattatctaactttataacgactctataacactcatacaactaaataaccaaaaaaaaaaacgaacctcccttaaccaataccgctaccgcgccgtaaactccacgtactactacctaccgaacgcgaaaacctaaacgaacgccgtacccgaatcctaaaacgcacgcgaaaaaccaaaaaaaataaacaaacacacgcacacgctaactcccgccacctaaacccgcaacccccgcccaattcccttcctccctcgccctcccgacgcatttctcccctactccccgttccgtacgtcctaacaccgacgctaccgacctacctcgacgacgtcccgaaactcacgtaaaacacccgcgcgaaacgcttaaaaaacctcgaacgccccgaccgcccccaacgcactaaaccgccgaccctcctctcgcaaactaatcgccccgcgaaaaaataacgtcaatccaaaaatcgaccaatcacaaactcccattcaaatcccaacccccttcccgcgctccgcaccacccaaccttacaataacctcgacgttcacgacttccccgc

SEQ ID NO: 2563 - DNA, 573 bp, Artificial Sequence
  chemically treated genomic DNA (Homo sapiens) CpG-island No: 2563
tattttcggttatttagttttatgacggttttgtggtatttatatagttagataattaaagagagaaacgggttttttttagttagtgtcgttgtcgcgtcgtgggttttacgtgttgttgtttgtcgagcgcgggagtttgagcggacgtcgtgttcggattttggggcgtacgcggagagttagaggggatggatagatatacgtatacgttgattttcgttatttaggttcgtagttttcgtttagttttttttttttttcgttttttcggcgtattttttttttgtttttcgtttcgtgcgttttggtatcggcgttgtcggtttgtttcgacggcgtttcggggtttacgtagggtattcgcgcggagcgtttagagagtttcgagcgtttcggtcgtttttagcgtattggatcgtcggtttttttttcgtaggttaatcgtttcgcggggaagtgacgttagtttagggatcggttaattataggtttttatttaaattttagtttttttttcgcgtttcgtattatttagttttataatggtttcggcgtttacggttttttcgt

SEQ ID NO: 2564 - DNA, 573 bp, Artificial Sequence
  chemically treated genomic DNA (Homo sapiens) CpG-island No: 2564
acgaaaaaaccgtaaacgccgaaaccattataaaactaaataatacgaaacgcgaaaaaaaaactaaaatttaaataaaaacctataattaaccgatccctaaactaacgtcacttccccgcgaaacgattaacctacgaaaaaaaaaccgacgatccaatacgctaaaaacgaccgaaacgctcgaaactctctaaacgctccgcgcgaataccctacgtaaaccccgaaacgccgtcgaaacaaaccgacaacgccgataccaaaacgcacgaaacgaaaaacaaaaaaaaaatacgccgaaaaaacgaaaaaaaaaaaaaactaaacgaaaactacgaacctaaataacgaaaatcaacgtatacgtatatctatccatcccctctaactctccgcgtacgccccaaaatccgaacacgacgtccgctcaaactcccgcgctcgacaaacaacaacacgtaaaacccacgacgcgacaacgacactaactaaaaaaaacccgtttctctctttaattatctaactatataaataccacaaaaccgtcataaaactaaataaccgaaaata

SEQ ID NO: 2565 - DNA, 745 bp, Artificial Sequence
  chemically treated genomic DNA (Homo sapiens) CpG-island No: 2565
gaggtattcggggtttttttttttttggtttacgaatttttaatttcgaacgttgtgggattgtatgggtttttgttcgggttaatgaaatgcgttgtcgagaggaggttgcggcgcggtttgaggtcggatttttataggtcggagagttttttgtcggtcgcggtcggatttttcgggaaatgggattagagcgcggagggagtttggttaggaggttttttaggatttagtcgcgacgttgaaaagtatgaagggtcggaattaggtatttatttagcgagcgttattaattcgaagttatagcgttaattttttgattcggtcgtttttatacgtagcgtcgggattagaggcgcggtcgtcgttcgtttcgtttttatattttaaacgcgttcgtttcgcgttttcgaggttgcgggtttagggttaattcgtcgcgtcgcgttcgtttggttcgagcgcgcggcgggtcgggttcggttagttggggcgagtcggtttgttcgttggttcgggcgttcggtttcgggttgggtaaggagcgtttggttatgagtcgcgggatagtttaggcgggacggatgcgttttttagggtttaggcgaggtcgcgcggtgtagaatcgtcgggatttttttaattcgggtatgcgtatttatagtagcggtttttggaggtcgcggcgttattttagtggtttttttttttttttggtatttgtcgtgtatggtgtggttgggtg

SEQ ID NO: 2566 - DNA, 745 bp, Artificial Sequence
  chemically treated genomic DNA (Homo sapiens) CpG-island No: 2566
cacccaaccacaccatacacgacaaataccaaaaaaaaaaaaaaaccactaaaataacgccgcgacctccaaaaaccgctactataaatacgcatacccgaattaaaaaaatcccgacgattctacaccgcgcgacctcgcctaaaccctaaaaaacgcatccgtcccgcctaaactatcccgcgactcataaccaaacgctccttacccaacccgaaaccgaacgcccgaaccaacgaacaaaccgactcgccccaactaaccgaacccgacccgccgcgcgctcgaaccaaacgaacgcgacgcgacgaattaaccctaaacccgcaacctcgaaaacgcgaaacgaacgcgtttaaaatataaaaacgaaacgaacgacgaccgcgcctctaatcccgacgctacgtataaaaacgaccgaatcaaaaaattaacgctataacttcgaattaataacgctcgctaaataaatacctaattccgacccttcatacttttcaacgtcgcgactaaatcctaaaaaacctcctaaccaaactccctccgcgctctaatcccatttcccgaaaaatccgaccgcgaccgacaaaaaactctccgacctataaaaatccgacctcaaaccgcgccgcaacctcctctcgacaacgcatttcattaacccgaacaaaaacccatacaatcccacaacgttcgaaattaaaaattcgtaaaccaaaaaaaaaaaaaccccgaatacctc

SEQ ID NO: 2567 - DNA, 745 bp, Artificial Sequence
  chemically treated genomic DNA (Homo sapiens) CpG-island No: 2567
tatttagttatattatatacgatagatgttaagggggaaggaaggttattaaaatggcgtcgcggtttttaaaggtcgttgttgtgggtgcgtatattcgggttggagaaatttcggcggttttgtatcgcgcggtttcgtttgggttttggagggcgtattcgtttcgtttgggttgtttcgcggtttatggttaagcgttttttgtttagttcggaatcgggcgttcgagttagcgaataggtcggttcgttttagttggtcgagttcgattcgtcgcgcgttcgggttaggcgagcgcggcgcggcggattagttttgagttcgtagtttcgagggcgcggggcgggcgcgtttggggtatgagggcggggcgggcggcggtcgcgtttttaatttcggcgttgcgtgtgggagcggtcggattagggaattagcgttgtaatttcggattagtaacgttcgttaaatgagtgtttaatttcgattttttatgttttttagcgtcgcggttgagttttaggaggttttttggttaggtttttttcgcgttttggttttatttttcgggaggttcggtcgcggtcggtagagaatttttcggtttgtggagattcggttttaggtcgcgtcgtagttttttttcggtagcgtattttattggttcgggtagaggtttatgtagttttatagcgttcggagttgggagttcgtggattagagaaaaggaagtttcggatgtttt

SEQ ID NO: 2568 - DNA, 745 bp, Artificial Sequence
  chemically treated genomic DNA (Homo sapiens) CpG-island No: 2568
aaaacatccgaaacttccttttctctaatccacgaactcccaactccgaacgctataaaactacataaacctctacccgaaccaataaaatacgctaccgaaaaaaaactacgacgcgacctaaaaccgaatctccacaaaccgaaaaattctctaccgaccgcgaccgaacctcccgaaaaataaaaccaaaacgcgaaaaaaacctaaccaaaaaacctcctaaaactcaaccgcgacgctaaaaaacataaaaaatcgaaattaaacactcatttaacgaacgttactaatccgaaattacaacgctaattccctaatccgaccgctcccacacgcaacgccgaaattaaaaacgcgaccgccgcccgccccgccctcataccccaaacgcgcccgccccgcgccctcgaaactacgaactcaaaactaatccgccgcgccgcgctcgcctaacccgaacgcgcgacgaatcgaactcgaccaactaaaacgaaccgacctattcgctaactcgaacgcccgattccgaactaaacaaaaaacgcttaaccataaaccgcgaaacaacccaaacgaaacgaatacgccctccaaaacccaaacgaaaccgcgcgatacaaaaccgccgaaatttctccaacccgaatatacgcacccacaacaacgacctttaaaaaccgcgacgccattttaataaccttccttcccccttaacatctatcgtatataatataactaaata

SEQ ID NO: 2569 - DNA, 844 bp, Artificial Sequence
  chemically treated genomic DNA (Homo sapiens) CpG-island No: 2569
cggttttggcggttttagtatcggaggcggttttttggatattcggcgttcgcgggagtttgaggcgttcggttgttagagttttagttgggagtggcgcggttgtttttcgttcgcgtaggattaggtcggttttcgcgggtttggagttggatttagagttagggaaattggaaaaataggtataaattcggaagtcgcggtacggtaagagtttaagtaaagaattttttttaagatttatatttcgtttatattagggaatcgtttgggtttacggtttttcgaattcgaagcgttcgtagtttagagttggtattaggttattaggtcgggaaggtcgtcgtaggttttagagtgcgggcgcggggggcgcgcgtttataggacgttcggggttgggtaggtaggagagaagggcgttagtaggttcgcggttgttttttttcggttcgtatagcgggttcgggaggttattttgagagcgcgaagaggggcggtaagatggttgcgtgggtattcggaaggtcgtcgcgttaagggttcgttgagtttttttttttattcgtttagtcgcgcggtttatagaagcggaacgcgcgtcgagagcgttttgttcgttcgttttagatagatgttcggttatttattatcgcgaggtttagaggaaagagtggttgtcgtttttttgtttatagttcgtcggatttttcgtcgcggttgttcggttttcggagtcgtagtcgtcgagttcggttgtgcgtgtcgtggttgttggggagaaagaggttttcggtaagagtttttttgattgggttgtttatttcgggtaggggcggaaacgg

SEQ ID NO: 2570 - DNA, 844 bp, Artificial Sequence
  chemically treated genomic DNA (Homo sapiens) CpG-island No: 2570
ccgtttccgcccctacccgaaataaacaacccaatcaaaaaaactcttaccgaaaacctctttctccccaacaaccacgacacgcacaaccgaactcgacgactacgactccgaaaaccgaacaaccgcgacgaaaaatccgacgaactataaacaaaaaaacgacaaccactctttcctctaaacctcgcgataataaataaccgaacatctatctaaaacgaacgaacaaaacgctctcgacgcgcgttccgcttctataaaccgcgcgactaaacgaataaaaaaaaaaactcaacgaacccttaacgcgacgaccttccgaatacccacgcaaccatcttaccgcccctcttcgcgctctcaaaataacctcccgaacccgctatacgaaccgaaaaaaaacaaccgcgaacctactaacgcccttctctcctacctacccaaccccgaacgtcctataaacgcgcgccccccgcgcccgcactctaaaacctacgacgaccttcccgacctaataacctaataccaactctaaactacgaacgcttcgaattcgaaaaaccgtaaacccaaacgattccctaatataaacgaaatataaatcttaaaaaaaattctttacttaaactcttaccgtaccgcgacttccgaatttatacctatttttccaatttccctaactctaaatccaactccaaacccgcgaaaaccgacctaatcctacgcgaacgaaaaacaaccgcgccactcccaactaaaactctaacaaccgaacgcctcaaactcccgcgaacgccgaatatccaaaaaaccgcctccgatactaaaaccgccaaaaccg

SEQ ID NO: 2571 - DNA, 844 bp, Artificial Sequence
  chemically treated genomic DNA (Homo sapiens) CpG-island No: 2571
tcgttttcgtttttgttcggggtgggtagtttagttaggggggtttttatcggaagtttttttttttttagtagttacgatacgtatagtcgggttcggcggttgcggtttcggggatcgggtagtcgcgacggagggttcggcgggttgtgggtaggaagacggtagttatttttttttttaggtttcgcggtaatgaataatcgggtatttgtttggggcgagcggatagggcgttttcgacgcgcgtttcgtttttgtgggtcgcgcggttggacgaatgggaggaggggtttagcgggtttttggcgcggcgatttttcgggtgtttacgtagttattttgtcgttttttttcgcgtttttaaaatggtttttcgggttcgttgtgcggatcgaggggaaatagtcgcgggtttgttggcgttttttttttttgtttatttaatttcgggcgttttgtgggcgcgcgtttttcgcgttcgtattttggggtttgcgacgattttttcggtttgatggtttgatgttagttttgggttgcgggcgtttcgggttcggaaggtcgtaggtttaggcggttttttggtgtagacgaggtgtgaattttggaaaggattttttgtttaggtttttgtcgtatcgcggttttcgagtttgtgtttgtttttttagtttttttagttttggatttagttttaggttcgcgggggtcggtttgattttgcgcgggcgggaagtagtcgcgttatttttagttaaggttttagtaatcgagcgttttaggttttcgcgaacgtcgggtgtttaagaagtcgttttcggtgttagaatcgttagagtcg

SEQ ID NO: 2572 - DNA, 844 bp, Artificial Sequence
  chemically treated genomic DNA (Homo sapiens) CpG-island No: 2572
cgactctaacgattctaacaccgaaaacgacttcttaaacacccgacgttcgcgaaaacctaaaacgctcgattactaaaaccttaactaaaaataacgcgactacttcccgcccgcgcaaaatcaaaccgacccccgcgaacctaaaactaaatccaaaactaaaaaaactaaaaaaacaaacacaaactcgaaaaccgcgatacgacaaaaacctaaacaaaaaatcctttccaaaattcacacctcgtctacaccaaaaaaccgcctaaacctacgaccttccgaacccgaaacgcccgcaacccaaaactaacatcaaaccatcaaaccgaaaaaatcgtcgcaaaccccaaaatacgaacgcgaaaaacgcgcgcccacaaaacgcccgaaattaaataaacaaaaaaaaaaaacgccaacaaacccgcgactatttcccctcgatccgcacaacgaacccgaaaaaccattttaaaaacgcgaaaaaaaacgacaaaataactacgtaaacacccgaaaaatcgccgcgccaaaaacccgctaaacccctcctcccattcgtccaaccgcgcgacccacaaaaacgaaacgcgcgtcgaaaacgccctatccgctcgccccaaacaaatacccgattattcattaccgcgaaacctaaaaaaaaaaataactaccgtcttcctacccacaacccgccgaaccctccgtcgcgactacccgatccccgaaaccgcaaccgccgaacccgactatacgtatcgtaactactaaaaaaaaaaaaacttccgataaaaacccccctaactaaactacccaccccgaacaaaaacgaaaacga

SEQ ID NO: 2573 - DNA, 635 bp, Artificial Sequence
  chemically treated genomic DNA (Homo sapiens) CpG-island No: 2573
atcggcgcgggtttagcgtcgagaggtgttagcgttcggattcgaattcgtagggtgggtcgtcgtttttcgggatttatatttatattcggattacggtttattcggtcgagagcgttttgtaggaggagtcggcggttattttcgtgcgtttcgtcgttcgtttgcgttcggtagaggcgtcgcggtgcgttttgggattagtcgtcgttttgtttcgggtttcgttttttgattggagagggaggggtcgcgtcgtcgtttagcgattcggttttttcgtcgtcgatttcgtcggaaatttcggtttttacggtgtttttcggtttgttgttttttcgattttaggtttacggtacggcgttttttttcgcgcggtttacgtagtttcggggtagcgtgtggtttttattcggtcggttcgtttcgttggtagtcgtaatttttcgtttgtatttagttaggtttcgcggttattcgagaggtaagcgggagatttttagcgcgattaataggagggtcgttaatggagcggttcgttcgcggggggagaagggggatttttgggtgggttttttttgcggaacgcgcgaattaaaggttaattttttttttttaaggagtaggtggattgg

SEQ ID NO: 2574 - DNA, 635 bp, Artificial Sequence
  chemically treated genomic DNA (Homo sapiens) CpG-island No: 2574
ccaatccacctactccttaaaaaaaaaaaattaacctttaattcgcgcgttccgcaaaaaaaacccacccaaaaatcccccttctccccccgcgaacgaaccgctccattaacgaccctcctattaatcgcgctaaaaatctcccgcttacctctcgaataaccgcgaaacctaactaaatacaaacgaaaaattacgactaccaacgaaacgaaccgaccgaataaaaaccacacgctaccccgaaactacgtaaaccgcgcgaaaaaaaacgccgtaccgtaaacctaaaatcgaaaaaacaacaaaccgaaaaacaccgtaaaaaccgaaatttccgacgaaatcgacgacgaaaaaaccgaatcgctaaacgacgacgcgacccctccctctccaatcaaaaaacgaaacccgaaacaaaacgacgactaatcccaaaacgcaccgcgacgcctctaccgaacgcaaacgaacgacgaaacgcacgaaaataaccgccgactcctcctacaaaacgctctcgaccgaataaaccgtaatccgaatataaatataaatcccgaaaaacgacgacccaccctacgaattcgaatccgaacgctaacacctctcgacgctaaacccgcgccgat

SEQ ID NO: 2575 - DNA, 635 bp, Artificial Sequence
  chemically treated genomic DNA (Homo sapiens) CpG-island No: 2575
ttaatttatttgttttttgagaaggggaggttggtttttggttcgcgcgtttcgtagggagagtttatttagaagtttttttttttttttcgcgggcggatcgttttattggcggtttttttattggtcgcgttgggagtttttcgtttgtttttcgggtagtcgcgggatttagttgggtgtagacgggaagttgcggttgttagcgaagcggatcggtcgggtggaggttatacgttatttcgaggttgcgtaggtcgcgcgaagggggacgtcgtgtcgtgggtttggggtcgggggagtagtagatcgggaagtatcgtgaggatcgaggttttcggcggggtcggcggcggggaggtcgggtcgttgagcgacggcgcggtttttttttttttagttagggagcgaggttcggagtagggcggcggttagttttagggcgtatcgcggcgtttttgtcgggcgtaggcgggcggcggggcgtacgggggtggtcgtcgattttttttgtaggacgttttcggtcgggtgggtcgtggttcgggtgtgggtgtgggtttcgggggacggcggtttattttgcgggttcgaattcgggcgttggtatttttcgacgttaggttcgcgtcggt

SEQ ID NO: 2576 - DNA, 635 bp, Artificial Sequence
  chemically treated genomic DNA (Homo sapiens) CpG-island No: 2576
accgacgcgaacctaacgtcgaaaaataccaacgcccgaattcgaacccgcaaaataaaccgccgtcccccgaaacccacacccacacccgaaccacgacccacccgaccgaaaacgtcctacaaaaaaaatcgacgaccacccccgtacgccccgccgcccgcctacgcccgacaaaaacgccgcgatacgccctaaaactaaccgccgccctactccgaacctcgctccctaactaaaaaaaaaaaaaccgcgccgtcgctcaacgacccgacctccccgccgccgaccccgccgaaaacctcgatcctcacgatacttcccgatctactactcccccgaccccaaacccacgacacgacgtcccccttcgcgcgacctacgcaacctcgaaataacgtataacctccacccgaccgatccgcttcgctaacaaccgcaacttcccgtctacacccaactaaatcccgcgactacccgaaaaacaaacgaaaaactcccaacgcgaccaataaaaaaaccgccaataaaacgatccgcccgcgaaaaaaaaaaaaaaacttctaaataaactctccctacgaaacgcgcgaaccaaaaaccaacctccccttctcaaaaaacaaataaattaa

SEQ ID NO: 2577 - DNA, 616 bp, Artificial Sequence
  chemically treated genomic DNA (Homo sapiens) CpG-island No: 2577
tcgggcgtcggtttaatgaatttttttgtagaaattttagcggttagttacggttttttcgtttatggttggtcggggattagtcggttttagttacgttcgcgtttagatataaagtatttttaaaaggagttcgtgtattttgcgttttgtcggttcgataattcgtagatttttcgaaagttatagcgcgtatatatatttgtaggttttttttggtcgtttttgttagatttttagcgtggcggggtacgcgttttagggaggatagtttcgcggttttatgcgattgtttcgcgagttcgggcgggttatcggttagcggcgttgggttacggagcgcgtcggggttttagttcgttcgcggcgtatcgcgcgtttttttttttttcgtcggggttttttcgaggagtttatatttatttgatattagtatcgattaaagtacgtggcgtagcgttagatagcggattttagcggtttagagcgcgttttaggtgttgtcgttcggttaggacggcgcgttcgagtttagtatattttttttttcgtagaggatgttgtaagtgggaggggtagagaggttgaggagggggagggaaacgggcggaggggt

SEQ ID NO: 2578 - DNA, 616 bp, Artificial Sequence
  chemically treated genomic DNA (Homo sapiens) CpG-island No: 2578
acccctccgcccgtttccctccccctcctcaacctctctacccctcccacttacaacatcctctacgaaaaaaaaaatatactaaactcgaacgcgccgtcctaaccgaacgacaacacctaaaacgcgctctaaaccgctaaaatccgctatctaacgctacgccacgtactttaatcgatactaatatcaaataaatataaactcctcgaaaaaaccccgacgaaaaaaaaaaaaacgcgcgatacgccgcgaacgaactaaaaccccgacgcgctccgtaacccaacgccgctaaccgataacccgcccgaactcgcgaaacaatcgcataaaaccgcgaaactatcctccctaaaacgcgtaccccgccacgctaaaaatctaacaaaaacgaccaaaaaaaacctacaaatatatatacgcgctataactttcgaaaaatctacgaattatcgaaccgacaaaacgcaaaatacacgaactccttttaaaaatactttatatctaaacgcgaacgtaactaaaaccgactaatccccgaccaaccataaacgaaaaaaccgtaactaaccgctaaaatttctacaaaaaaattcattaaaccgacgcccga

SEQ ID NO: 2579 - DNA, 616 bp, Artificial Sequence
  chemically treated genomic DNA (Homo sapiens) CpG-island No: 2579
gttttttcgttcgtttttttttttttttttagtttttttattttttttatttgtagtattttttacgaggaaaggaatgtgttgggttcggacgcgtcgttttggtcgaacggtagtatttggggcgcgttttggatcgttggggttcgttgtttggcgttgcgttacgtgttttgatcggtgttgatgttaagtgggtgtgggtttttcggaaaggtttcggcgaggaggaggagggcgcgcgatgcgtcgcgggcgagttgaggtttcggcgcgtttcgtagtttagcgtcgttgatcgatggttcgttcgggttcgcgaagtagtcgtatggagtcgcggagttgttttttttgggacgcgtgtttcgttacgttgggggtttggtaggggcgattaaggggggtttgtaggtgtgtgtgcgcgttgtaattttcggggggtttgcgggttgtcgagtcgatagggcgtagggtgtacgggttttttttgggggtgttttgtgtttgggcgcgggcgtgattggagtcggttagttttcggttagttatgagcgagggagtcgtagttggtcgttggagtttttgtaagagaatttattgagtcggcgttcgg

SEQ ID NO: 2580 - DNA, 616 bp, Artificial Sequence
  chemically treated genomic DNA (Homo sapiens) CpG-island No: 2580
ccgaacgccgactcaataaattctcttacaaaaactccaacgaccaactacgactccctcgctcataactaaccgaaaactaaccgactccaatcacgcccgcgcccaaacacaaaacacccccaaaaaaaacccgtacaccctacgccctatcgactcgacaacccgcaaaccccccgaaaattacaacgcgcacacacacctacaaaccccccttaatcgcccctaccaaacccccaacgtaacgaaacacgcgtcccaaaaaaaacaactccgcgactccatacgactacttcgcgaacccgaacgaaccatcgatcaacgacgctaaactacgaaacgcgccgaaacctcaactcgcccgcgacgcatcgcgcgccctcctcctcctcgccgaaacctttccgaaaaacccacacccacttaacatcaacaccgatcaaaacacgtaacgcaacgccaaacaacgaaccccaacgatccaaaacgcgccccaaatactaccgttcgaccaaaacgacgcgtccgaacccaacacattcctttcctcgtaaaaaatactacaaataaaaaaaataaaaaaactaaaaaaaaaaaaaaaaacgaacgaaaaaac

SEQ ID NO: 2581 - DNA, 780 bp, Artificial Sequence
  chemically treated genomic DNA (Homo sapiens) CpG-island No: 2581
cgttttttgttaaaaattataaaaattaaaatagtggtaaaggtcgaagatgtcgcgagtgttgggttggggatcgggattcggtattttttgggcgttttcgtttagggggttattattcggatttttcggtagagatggggaaattgaggtttggagcggtttagtcgcggagtcgggtatgttggggtttggttttgggttcgttacgtttcgtttacgtcgggacgcgtcgtttcgtttttcggttttagtttttttttttgttatcgggaataataagggatttgggttcggttcggttcggttttcggaaacgcgtataaatacggaacgtagcggcgcggggttgggtcgaggcgggagcgcggatggggtcgcgggtcggcgtttttattagtttttgattagttttcggtagcgtgggtttaggaatcgggttattatcgcggcggagtcgtatttttaggatgattttgtttagttgattcggttatattgcgtaggcgcggtcgcggcgcgtacgcgcgcggggagggcggggggggggggaggaaaaaaaaatattattcgttattgtgcgcgtagattcggaagttatttatagtaattttcggcgagggttggacgatcgcggagaagtggttcggagtgggcggcgttagggcggtgttttttggttacgtggtttggcggtcgattgtgtttttgggtttcgcggggttatttgttagtgattttgtgcgtttagtatgtgttagaacgttatttataatgaag

SEQ ID NO: 2582 - DNA, 780 bp, Artificial Sequence
  chemically treated genomic DNA (Homo sapiens) CpG-island No: 2582
cttcattataaataacgttctaacacatactaaacgcacaaaatcactaacaaataaccccgcgaaacccaaaaacacaatcgaccgccaaaccacgtaaccaaaaaacaccgccctaacgccgcccactccgaaccacttctccgcgatcgtccaaccctcgccgaaaattactataaataacttccgaatctacgcgcacaataacgaataatatttttttttcctccccccccccccgccctccccgcgcgcgtacgcgccgcgaccgcgcctacgcaatataaccgaatcaactaaacaaaatcatcctaaaaatacgactccgccgcgataataacccgattcctaaacccacgctaccgaaaactaatcaaaaactaataaaaacgccgacccgcgaccccatccgcgctcccgcctcgacccaaccccgcgccgctacgttccgtatttatacgcgtttccgaaaaccgaaccgaaccgaacccaaatcccttattattcccgataacaaaaaaaaaaactaaaaccgaaaaacgaaacgacgcgtcccgacgtaaacgaaacgtaacgaacccaaaaccaaaccccaacatacccgactccgcgactaaaccgctccaaacctcaatttccccatctctaccgaaaaatccgaataataaccccctaaacgaaaacgcccaaaaaataccgaatcccgatccccaacccaacactcgcgacatcttcgacctttaccactattttaatttttataatttttaacaaaaaacg

SEQ ID NO: 2583 - DNA, 780 bp, Artificial Sequence
  chemically treated genomic DNA (Homo sapiens) CpG-island No: 2583
ttttattgtaaataacgttttggtatatattaggcgtataaaattattggtaggtagtttcgcggagtttagaagtataatcggtcgttagattacgtggttagaaagtatcgttttaacgtcgtttatttcggattattttttcgcggtcgtttaattttcgtcggaagttattgtaagtggttttcgggtttgcgcgtatagtggcggatgatgtttttttttttttttttttttttcgtttttttcgcgcgcgtgcgcgtcgcggtcgcgtttgcgtagtgtagtcgggttagttggatagggttattttgagggtgcgatttcgtcgcgatggtgattcggtttttgggtttacgttatcgggagttggttaagaattggtgaggacgtcgattcgcggttttattcgcgttttcgtttcggtttagtttcgcgtcgttgcgtttcgtatttgtgcgcgttttcgggggtcgggtcgggtcgggtttaggttttttgttgttttcggtgatagagggggaaattgaggtcgagaggcggagcggcgcgtttcggcgtgaacgggacgtgacggatttaaggttaaattttagtatgttcggtttcgcggttaggtcgttttaagttttagtttttttatttttatcgggggattcgaatggtgattttttggacggaagcgtttagaaggtgtcgagtttcgatttttagtttagtattcgcggtattttcggtttttgttattattttggtttttatgatttttaataaggagcg

SEQ ID NO: 2584 - DNA, 780 bp, Artificial Sequence
  chemically treated genomic DNA (Homo sapiens) CpG-island No: 2584
cgctccttattaaaaatcataaaaaccaaaataataacaaaaaccgaaaataccgcgaatactaaactaaaaatcgaaactcgacaccttctaaacgcttccgtccaaaaaatcaccattcgaatcccccgataaaaataaaaaaactaaaacttaaaacgacctaaccgcgaaaccgaacatactaaaatttaaccttaaatccgtcacgtcccgttcacgccgaaacgcgccgctccgcctctcgacctcaatttccccctctatcaccgaaaacaacaaaaaacctaaacccgacccgacccgacccccgaaaacgcgcacaaatacgaaacgcaacgacgcgaaactaaaccgaaacgaaaacgcgaataaaaccgcgaatcgacgtcctcaccaattcttaaccaactcccgataacgtaaacccaaaaaccgaatcaccatcgcgacgaaatcgcaccctcaaaataaccctatccaactaacccgactacactacgcaaacgcgaccgcgacgcgcacgcgcgcgaaaaaaacgaaaaaaaaaaaaaaaaaaaaaaacatcatccgccactatacgcgcaaacccgaaaaccacttacaataacttccgacgaaaattaaacgaccgcgaaaaaataatccgaaataaacgacgttaaaacgatactttctaaccacgtaatctaacgaccgattatacttctaaactccgcgaaactacctaccaataattttatacgcctaatatataccaaaacgttatttacaataaaa

SEQ ID NO: 2585 - DNA, 515 bp, Artificial Sequence
  chemically treated genomic DNA (Homo sapiens) CpG-island No: 2585
tgttttcgaggtttttttaataaacgcgtattttagtttcgattcggtatagaacgattcggggaattatcgtcgaggtcgagtcgagacgagcgatattattataagtaatttattttttatttcgggttttataaaggggacgaatttttttggttagttcggagtcgcgtatgcgtaagaaggagcggagttaggcgtgttgtttttatttcgttcggaattataatttttagaagcgttttggtatcgttagatttcggtttttcgtaggtgggagtattcgtggtgcggttgggagaatcggacgatcgaagagtttcgttcgtttcgcgagagtatgaggtagtattttttgtgtttaatttttagagtaagggagggagggagtagcggagacgcggatcggagttagggttcgttttcgcgttttgtttgtataagtttttgcggtatagtgtttagggttgttgagtttaatttaaattatttcggtgtaagatacgttaaaatat

SEQ ID NO: 2586 - DNA, 515 bp, Artificial Sequence
  chemically treated genomic DNA (Homo sapiens) CpG-island No: 2586
atattttaacgtatcttacaccgaaataatttaaattaaactcaacaaccctaaacactataccgcaaaaacttatacaaacaaaacgcgaaaacgaaccctaactccgatccgcgtctccgctactccctccctcccttactctaaaaattaaacacaaaaaatactacctcatactctcgcgaaacgaacgaaactcttcgatcgtccgattctcccaaccgcaccacgaatactcccacctacgaaaaaccgaaatctaacgataccaaaacgcttctaaaaattataattccgaacgaaataaaaacaacacgcctaactccgctccttcttacgcatacgcgactccgaactaaccaaaaaaattcgtcccctttataaaacccgaaataaaaaataaattacttataataatatcgctcgtctcgactcgacctcgacgataattccccgaatcgttctataccgaatcgaaactaaaatacgcgtttattaaaaaaacctcgaaaaca

SEQ ID NO: 2587 - DNA, 515 bp, Artificial Sequence
  chemically treated genomic DNA (Homo sapiens) CpG-island No: 2587
gtattttaacgtattttatatcggagtaatttgggttgaatttagtagttttaagtattgtgtcgtaggaatttgtgtagataaagcgcggggacggattttgatttcggttcgcgttttcgttgtttttttttttttttgttttgaggattagatataggagatgttgttttatattttcgcgagacggacggagtttttcgatcgttcgatttttttagtcgtattacgggtgtttttatttgcggagaatcggagtttggcgatgttaaggcgtttttgggaattgtagtttcgggcgggatgagggtagtacgtttggtttcgtttttttttacgtatgcgcgatttcgagttggttaaagaagttcgttttttttgtgaggttcgggatgggaggtgagttgtttgtggtgatgtcgttcgtttcggttcggtttcggcggtggtttttcgggtcgttttgtgtcgagtcggggttagagtgcgcgtttgttaaaggggtttcgagggta

SEQ ID NO: 2588 - DNA, 515 bp, Artificial Sequence
  chemically treated genomic DNA (Homo sapiens) CpG-island No: 2588
taccctcgaaacccctttaacaaacgcgcactctaaccccgactcgacacaaaacgacccgaaaaaccaccgccgaaaccgaaccgaaacgaacgacatcaccacaaacaactcacctcccatcccgaacctcacaaaaaaaacgaacttctttaaccaactcgaaatcgcgcatacgtaaaaaaaaacgaaaccaaacgtactaccctcatcccgcccgaaactacaattcccaaaaacgccttaacatcgccaaactccgattctccgcaaataaaaacacccgtaatacgactaaaaaaatcgaacgatcgaaaaactccgtccgtctcgcgaaaatataaaacaacatctcctatatctaatcctcaaaacaaaaaaaaaaaaaaacaacgaaaacgcgaaccgaaatcaaaatccgtccccgcgctttatctacacaaattcctacgacacaatacttaaaactactaaattcaacccaaattactccgatataaaatacgttaaaatac

SEQ ID NO: 2589 - DNA, 743 bp, Artificial Sequence
  chemically treated genomic DNA (Homo sapiens) CpG-island No: 2589
cgttttttcgtcgttttatttagttttgtttcgtttcggatatttcgcggtttcgtttttgtgcgcgttggttggttttcgtaggtatgatgaaatttttcgtacgcgttataggagttaggtcggtataagcgttagcggtttcgtcgttcgttaagttgtttatatttttggttttagttcgttatattattttgatttgtttacgtttaggtgagtcgggttttgcgtttcgtgttttgcgtttcgcgttagtatttttttcgcgtgttttggggttgtttcggaaggaaggggtggaggatgcggtttttagtttggtattcggtagacgcggttcgcgggcgtttgttgatgttgcggtttttgcggtagggagggcggggcggacgtttagcgattgttacgtatttgatagttagcggaaggatttttttgttttggttttttgaagtatcgagagggaatcgcggtcggtaggtcggatcgtttcggagaggaggtagcggtagtttgagtttttgtaaatgttatatgtgtatttttttttattatgtggcgtcgaagtttgtggatattttcgcggttcgggtttttgcggcggacgggtcggatcgtgttcgtggttagggcgtagttaggtgtcgcgtggttttgatttaggaagagattgcggttttattatcgtttcggtgtttgtttttatttttaattgtttttttttttatttggatcgtttattt

SEQ ID NO: 2590 - DNA, 743 bp, Artificial Sequence
  chemically treated genomic DNA (Homo sapiens) CpG-island No: 2590
aaataaacgatccaaataaaaaaaaaaacaattaaaaataaaaacaaacaccgaaacgataataaaaccgcaatctcttcctaaatcaaaaccacgcgacacctaactacgccctaaccacgaacacgatccgacccgtccgccgcaaaaacccgaaccgcgaaaatatccacaaacttcgacgccacataataaaaaaaaatacacatataacatttacaaaaactcaaactaccgctacctcctctccgaaacgatccgacctaccgaccgcgattccctctcgatacttcaaaaaaccaaaacaaaaaaatccttccgctaactatcaaatacgtaacaatcgctaaacgtccgccccgccctccctaccgcaaaaaccgcaacatcaacaaacgcccgcgaaccgcgtctaccgaataccaaactaaaaaccgcatcctccaccccttccttccgaaacaaccccaaaacacgcgaaaaaaatactaacgcgaaacgcaaaacacgaaacgcaaaacccgactcacctaaacgtaaacaaatcaaaataatataacgaactaaaaccaaaaatataaacaacttaacgaacgacgaaaccgctaacgcttataccgacctaactcctataacgcgtacgaaaaatttcatcatacctacgaaaaccaaccaacgcgcacaaaaacgaaaccgcgaaatatccgaaacgaaacaaaactaaataaaacgacgaaaaaacg

SEQ ID NO: 2591 - DNA, 743 bp, Artificial Sequence
  chemically treated genomic DNA (Homo sapiens) CpG-island No: 2591
gggtgagcggtttaggtgaggaggggggtagttgaaggtgaaagtagatatcgagacggtgataaggtcgtagtttttttttagattaggattacgcgatatttgattgcgttttggttacgagtacgattcgattcgttcgtcgtagggattcggatcgcgaaaatgtttataggtttcgacgttatatagtaaaaaaaagtatatatataatatttataggggtttaaattgtcgttgtttttttttcggagcggttcggtttgtcggtcgcggttttttttcgatgttttagggaattaggatagaaaggttttttcgttagttgttaggtgcgtaataatcgttaggcgttcgtttcgttttttttatcgtaggagtcgtagtattagtaggcgttcgcgaatcgcgtttgtcgggtgttaggttgaagatcgtattttttatttttttttttcggagtagttttagggtacgcgaggaggatgttggcgcggggcgtagggtacggggcgtaggattcggtttatttgggcgtaagtaggttagggtgatgtggcgggttgaggttagggatgtggatagtttgacgggcggcgaggtcgttggcgtttatatcgatttggtttttgtaacgcgtgcgggaagttttattatgtttgcgaggattaattagcgcgtataggggcggggtcgcggggtgttcggggcggagtaggattaagtggggcggcggaagggcg

SEQ ID NO: 2592 - DNA, 743 bp, Artificial Sequence
  chemically treated genomic DNA (Homo sapiens) CpG-island No: 2592
cgcccttccgccgccccacttaatcctactccgccccgaacaccccgcgaccccgcccctatacgcgctaattaatcctcgcaaacataataaaacttcccgcacgcgttacaaaaaccaaatcgatataaacgccaacgacctcgccgcccgtcaaactatccacatccctaacctcaacccgccacatcaccctaacctacttacgcccaaataaaccgaatcctacgccccgtaccctacgccccgcgccaacatcctcctcgcgtaccctaaaactactccgaaaaaaaaaaataaaaaatacgatcttcaacctaacacccgacaaacgcgattcgcgaacgcctactaatactacgactcctacgataaaaaaaacgaaacgaacgcctaacgattattacgcacctaacaactaacgaaaaaacctttctatcctaattccctaaaacatcgaaaaaaaaccgcgaccgacaaaccgaaccgctccgaaaaaaaaacaacgacaatttaaacccctataaatattatatatatacttttttttactatataacgtcgaaacctataaacattttcgcgatccgaatccctacgacgaacgaatcgaatcgtactcgtaaccaaaacgcaatcaaatatcgcgtaatcctaatctaaaaaaaaactacgaccttatcaccgtctcgatatctactttcaccttcaactacccccctcctcacctaaaccgctcaccc

SEQ ID NO: 2593 - DNA, 910 bp, Artificial Sequence
  chemically treated genomic DNA (Homo sapiens) CpG-island No: 2593
gttagggttcgttttttttgagaattcggttttttcgtcgtttaagtttatttttttcgggtatttatttggtcgtttttgtcgttcgttttcgtttttttcggatatttatttgatcgtttttgtcgttcgttttcgtttttttcggtatttaattggtcgtttcggtcgttttagtcgtcgtatcgtttcgtagtcgtcgcggagggatacggtcgcgggaacgttttatacgtatgttcgatcgtattcgcggatcggatttattttttttaaagggttcggggtttcgcgtagaagcggcgtgtaggggttttttagattcggtttcgcgggttttaaggggttcgggcggcgaaggcgtacggagttaagtttcgggtagtagttttgggatgttttgagtcgggtcgggcggaggttttcgttgtttagtaatcggggtcgcggtttgtgggcggagtttgtatcgtggttgcgatacggggcggggttttagcgggagtcggtcgaggagcgggtatcggttattggtataggtacgggttattggcgtatgcgtagggcgcggttttggggcggggtttatttagtggcggagttttttgaggggcgggtcgtgggcggggtttggaggcggagtcggcgtcgttagtagtcggttgaggacggaggcggggttgggtttgggatggggcggggtttgcgttggtggggcgggcgggggaggagatacggttaagcgttcgagtgggggtcgttggttggtgcgcggttgaagggtgtggcgcgagtagcgtcgttggttggtcggcggcgggtcgggacgggtatggttttgttgttgtgtttggtgtgtttgacggcggcgttggtttacggttgtttgtattgttatagtaattttttt

SEQ ID NO: 2594 - DNA, 910 bp, Artificial Sequence
  chemically treated genomic DNA (Homo sapiens) CpG-island No: 2594
aaaaaaattactataacaatacaaacaaccgtaaaccaacgccgccgtcaaacacaccaaacacaacaacaaaaccatacccgtcccgacccgccgccgaccaaccaacgacgctactcgcgccacacccttcaaccgcgcaccaaccaacgacccccactcgaacgcttaaccgtatctcctcccccgcccgccccaccaacgcaaaccccgccccatcccaaacccaaccccgcctccgtcctcaaccgactactaacgacgccgactccgcctccaaaccccgcccacgacccgcccctcaaaaaactccgccactaaataaaccccgccccaaaaccgcgccctacgcatacgccaataacccgtacctataccaataaccgatacccgctcctcgaccgactcccgctaaaaccccgccccgtatcgcaaccacgatacaaactccgcccacaaaccgcgaccccgattactaaacaacgaaaacctccgcccgacccgactcaaaacatcccaaaactactacccgaaacttaactccgtacgccttcgccgcccgaaccccttaaaacccgcgaaaccgaatctaaaaaacccctacacgccgcttctacgcgaaaccccgaaccctttaaaaaaaataaatccgatccgcgaatacgatcgaacatacgtataaaacgttcccgcgaccgtatccctccgcgacgactacgaaacgatacgacgactaaaacgaccgaaacgaccaattaaataccgaaaaaaacgaaaacgaacgacaaaaacgatcaaataaatatccgaaaaaaacgaaaacgaacgacaaaaacgaccaaataaatacccgaaaaaaataaacttaaacgacgaaaaaaccgaattctcaaaaaaaacgaaccctaac

SEQ ID NO: 2595 - DNA, 910 bp, Artificial Sequence
  chemically treated genomic DNA (Homo sapiens) CpG-island No: 2595
ggagaagttgttgtggtagtgtagatagtcgtgggttagcgtcgtcgttaggtatattaggtatagtagtagggttatgttcgtttcggttcgtcgtcggttaattaacgacgttgttcgcgttatattttttagtcgcgtattaattaacggtttttattcgggcgtttggtcgtgttttttttttcgttcgttttattagcgtaggtttcgttttattttaggtttagtttcgttttcgtttttagtcgattattgacggcgtcggtttcgtttttaggtttcgtttacgattcgttttttagaagatttcgttattgggtgggtttcgttttaaggtcgcgttttacgtatgcgttaatggttcgtgtttgtgttaatggtcggtgttcgtttttcggtcggttttcgttgaggtttcgtttcgtgtcgtagttacggtgtaggtttcgtttataggtcgcggtttcggttgttaggtaacggagattttcgttcggttcggtttagggtattttagggttgttgttcggaatttggtttcgtgcgttttcgtcgttcgggttttttaaagttcgcgggatcgagtttgggagatttttgtacgtcgtttttgcgcggagtttcgggttttttaaggaaagtaggttcggttcgcgggtgcggtcgggtatgcgtgtggggcgttttcgcggtcgtgttttttcgcggcggttgcgaggcggtgcggcggttgaggcggtcgaggcggttagttgggtatcgggaggggcgaaggcgggcggtagaggcgattaggtgggtgttcgggaggggcgaaggcgggcggtagaggcggttaggtgggtgttcgggaggggtgaatttaggcggcgaggagatcgagtttttaggaagggcgaattttggt

SEQ ID NO: 2596 - DNA, 910 bp, Artificial Sequence
  chemically treated genomic DNA (Homo sapiens) CpG-island No: 2596
accaaaattcgcccttcctaaaaactcgatctcctcgccgcctaaattcacccctcccgaacacccacctaaccgcctctaccgcccgccttcgcccctcccgaacacccacctaatcgcctctaccgcccgccttcgcccctcccgatacccaactaaccgcctcgaccgcctcaaccgccgcaccgcctcgcaaccgccgcgaaaaaacacgaccgcgaaaacgccccacacgcatacccgaccgcacccgcgaaccgaacctactttccttaaaaaacccgaaactccgcgcaaaaacgacgtacaaaaatctcccaaactcgatcccgcgaactttaaaaaacccgaacgacgaaaacgcacgaaaccaaattccgaacaacaaccctaaaataccctaaaccgaaccgaacgaaaatctccgttacctaacaaccgaaaccgcgacctataaacgaaacctacaccgtaactacgacacgaaacgaaacctcaacgaaaaccgaccgaaaaacgaacaccgaccattaacacaaacacgaaccattaacgcatacgtaaaacgcgaccttaaaacgaaacccacccaataacgaaatcttctaaaaaacgaatcgtaaacgaaacctaaaaacgaaaccgacgccgtcaataatcgactaaaaacgaaaacgaaactaaacctaaaataaaacgaaacctacgctaataaaacgaacgaaaaaaaaaacacgaccaaacgcccgaataaaaaccgttaattaatacgcgactaaaaaatataacgcgaacaacgtcgttaattaaccgacgacgaaccgaaacgaacataaccctactactatacctaatatacctaacgacgacgctaacccacgactatctacactaccacaacaacttctcc

SEQ ID NO: 2597 - DNA, 545 bp, Artificial Sequence
  chemically treated genomic DNA (Homo sapiens) CpG-island No: 2597
tacgtgcgtatttcgatgattttttcgtttcgggtgatttgggggtgtacggcgtaatacgattacggaggtcgaaagcgtagcggaatttttcggttttaggtttcggttttcgtatgcgtttcgagtcgttttgggcggcggtttcgggaattcggagcgttaaggagaacggattttagaggttgtttgaaggtcgaggttaagatggcggtgttgttaggtgagcgcggtatcggcggcgggtgtggggtcgcgcgggtttggggtcgtgggagtttcgggtgtcgtggtggcgtcgggggtcggtgtcggcgtcgtggtcgcggtttttttcgggttttttcgagtcggtcgtttttcgggtttttcgttcggtttgcgatgaacggtcgtcgttattgcgtttagagtatagtcggggaaatcgaggttcggtaggttatgacgtaagtttttagttttaggaaggcgttcggggtggaggttggaggggttttatttacgttttcgagattagggtacggttcgcgaggttgtttttg

SEQ ID NO: 2598 - DNA, 545 bp, Artificial Sequence
  chemically treated genomic DNA (Homo sapiens) CpG-island No: 2598
caaaaacaacctcgcgaaccgtaccctaatctcgaaaacgtaaataaaacccctccaacctccaccccgaacgccttcctaaaactaaaaacttacgtcataacctaccgaacctcgatttccccgactatactctaaacgcaataacgacgaccgttcatcgcaaaccgaacgaaaaacccgaaaaacgaccgactcgaaaaaacccgaaaaaaaccgcgaccacgacgccgacaccgacccccgacgccaccacgacacccgaaactcccacgaccccaaacccgcgcgaccccacacccgccgccgataccgcgctcacctaacaacaccgccatcttaacctcgaccttcaaacaacctctaaaatccgttctccttaacgctccgaattcccgaaaccgccgcccaaaacgactcgaaacgcatacgaaaaccgaaacctaaaaccgaaaaattccgctacgctttcgacctccgtaatcgtattacgccgtacacccccaaatcacccgaaacgaaaaaatcatcgaaatacgcacgta

SEQ ID NO: 2599 - DNA, 545 bp, Artificial Sequence
  chemically treated genomic DNA (Homo sapiens) CpG-island No: 2599
taagagtagtttcgcgggtcgtgttttggtttcggggacgtgaatggggtttttttagtttttatttcgagcgtttttttgaggttggaggtttgcgttatgatttatcgggtttcggttttttcgattgtattttggacgtaataacggcgatcgtttatcgtaagtcgggcggggagttcgaggagcggtcggttcggagaagttcggagaggatcgcggttacgacgtcggtatcgattttcgacgttattacgatattcgaggtttttacggttttagattcgcgcggttttatattcgtcgtcggtgtcgcgtttatttgatagtatcgttattttggtttcggtttttagataatttttgaggttcgttttttttagcgtttcgggttttcggggtcgtcgtttaaagcggttcggagcgtatgcggaaatcggaatttggagtcgggaggtttcgttgcgttttcggttttcgtggtcgtgttgcgtcgtgtatttttagattattcgaggcggaaaggttatcggagtgcgtacgtg

SEQ ID NO: 2600 - DNA, 545 bp, Artificial Sequence
  chemically treated genomic DNA (Homo sapiens) CpG-island No: 2600
cacgtacgcactccgataacctttccgcctcgaataatctaaaaatacacgacgcaacacgaccacgaaaaccgaaaacgcaacgaaacctcccgactccaaattccgatttccgcatacgctccgaaccgctttaaacgacgaccccgaaaacccgaaacgctaaaaaaaacgaacctcaaaaattatctaaaaaccgaaaccaaaataacgatactatcaaataaacgcgacaccgacgacgaatataaaaccgcgcgaatctaaaaccgtaaaaacctcgaatatcgtaataacgtcgaaaatcgataccgacgtcgtaaccgcgatcctctccgaacttctccgaaccgaccgctcctcgaactccccgcccgacttacgataaacgatcgccgttattacgtccaaaatacaatcgaaaaaaccgaaacccgataaatcataacgcaaacctccaacctcaaaaaaacgctcgaaataaaaactaaaaaaaccccattcacgtccccgaaaccaaaacacgacccgcgaaactactctta

SEQ ID NO: 2601 - DNA, 560 bp, Artificial Sequence
  chemically treated genomic DNA (Homo sapiens) CpG-island No: 2601
ggcggcggcggttagcgcgtgtatatagggggttttttagcgttttattatcggtttgtttaggatgcgtaggtgcgtgttcgttgcgtcgtaggtcgcgggcgtcgttttttacgcggggttgtagttttcgtcgggcgcgaagatgggggtcgcgttgggggcgtttatgttgtaggttggacggcgattcgatttcgatcgcgcgtcgttcgggttcgttttttgtaggggtttgtgggtcgggggcgggtttaataggttcggggggcggattcgcgagaggacgcgcgcgcgcggtttcgggagcggtttttagcggcggttacgcgagaggtggcgggagtggggtcggggtttcggtcgttttttttttaaggagtttcggtgttttttttgcggagcgggtatcgtagtttcgcgttcggggacgcgaatttgtaggttggggattggaattttcgttttgtcgtttacgcgttatagattttttatttgttagtatcgtagaaaggtttttttttcgttggggtgtgagaatttgaggattttttaggcgt

SEQ ID NO: 2602 - DNA, 560 bp, Artificial Sequence
  chemically treated genomic DNA (Homo sapiens) CpG-island No: 2602
acgcctaaaaaatcctcaaattctcacaccccaacgaaaaaaaaacctttctacgatactaacaaataaaaaatctataacgcgtaaacgacaaaacgaaaattccaatccccaacctacaaattcgcgtccccgaacgcgaaactacgatacccgctccgcaaaaaaaacaccgaaactccttaaaaaaaaaacgaccgaaaccccgaccccactcccgccacctctcgcgtaaccgccgctaaaaaccgctcccgaaaccgcgcgcgcgcgtcctctcgcgaatccgccccccgaacctattaaacccgcccccgacccacaaacccctacaaaaaacgaacccgaacgacgcgcgatcgaaatcgaatcgccgtccaacctacaacataaacgcccccaacgcgacccccatcttcgcgcccgacgaaaactacaaccccgcgtaaaaaacgacgcccgcgacctacgacgcaacgaacacgcacctacgcatcctaaacaaaccgataataaaacgctaaaaaaccccctatatacacgcgctaaccgccgccgcc

SEQ ID NO: 2603 - DNA, 560 bp, Artificial Sequence
  chemically treated genomic DNA (Homo sapiens) CpG-island No: 2603
gcgtttggaagatttttagatttttatattttagcgaggagggggtttttttgcggtgttgatagatgaggaatttatggcgcgtaagcggtaaggcggggattttagtttttagtttgtaggttcgcgttttcgggcgcggggttgcggtgttcgtttcgtagagggggtatcgaggttttttggggagggggcggtcggggtttcgattttattttcgttatttttcgcgtggtcgtcgttagaggtcgttttcggagtcgcgcgcgcgcgttttttcgcgggttcgtttttcgggtttgttggattcgttttcggtttataagtttttgtagggagcgggttcgggcggcgcgcgatcgaggtcgggtcgtcgtttagtttgtagtatgagcgtttttagcgcgatttttattttcgcgttcggcgagaattgtagtttcgcgtggggggcggcgttcgcggtttacgacgtagcggatacgtatttgcgtattttgggtaagtcggtgatggagcgttgggagattttttatatgtacgcgttggtcgtcgtcgtt

SEQ ID NO: 2604 - DNA, 560 bp, Artificial Sequence
  chemically treated genomic DNA (Homo sapiens) CpG-island No: 2604
aacgacgacgaccaacgcgtacatataaaaaatctcccaacgctccatcaccgacttacccaaaatacgcaaatacgtatccgctacgtcgtaaaccgcgaacgccgccccccacgcgaaactacaattctcgccgaacgcgaaaataaaaatcgcgctaaaaacgctcatactacaaactaaacgacgacccgacctcgatcgcgcgccgcccgaacccgctccctacaaaaacttataaaccgaaaacgaatccaacaaacccgaaaaacgaacccgcgaaaaaacgcgcgcgcgcgactccgaaaacgacctctaacgacgaccacgcgaaaaataacgaaaataaaatcgaaaccccgaccgccccctccccaaaaaacctcgataccccctctacgaaacgaacaccgcaaccccgcgcccgaaaacgcgaacctacaaactaaaaactaaaatccccgccttaccgcttacgcgccataaattcctcatctatcaacaccgcaaaaaaaccccctcctcgctaaaatataaaaatctaaaaatcttccaaacgc

SEQ ID NO: 2605 - DNA, 893 bp, Artificial Sequence
  chemically treated genomic DNA (Homo sapiens) CpG-island No: 2605
gtgcgggcgggtatatttttatttttcgtagcgttttacgcggttttatcgttttcgagtgaagagttaaagaggaagcggtagtcgcgtttgcgtttatagtgtttagttcggagcgtcggtttcgtaagcgcgtacgcgtacgtaagttcgtacgcgcgcgtacgtacgtacgtggttcggttcgcgcgtattttttttttgtaggggcggggttagcgtagggattttattttttagcgtgtttcgcggtaacgttaggagttttcgaggagaaaggaaaacgcgcgacggtttcgattgcggcggcgcgaaattcgttttagggacgtacgtatagacggagtatttttggattcgttttcggagatttcgtgcgggagcgcgttcgggcgtgcgtaggggcggcggcgcggcggcgcggggacgcgcggtgatcgttggcgtcgaggggaggaggtagtcgtcgtcgtcgtcgtcgtcgtcgtcgtcgtcgtcgtcgtcgttgcgtagattcgggtcgcggttgtggggagggcgacggagcgggtgatttttcggaggcgggagcgagcgaggaggttcgggagcgtcgagcgtcgtcgtcgtcgtcgttatgaataattcgggcgtcgacgagatcgggtgaggacgagcggcgcgggtttgcgttttcgtttcgagttcggttcgtcgtttttcgtcgttcggttttagacgtcgtttttcggggtcgtttcgttaaggttacgtcggtcgggggcggattcgggattcggattcgtcgcggtttcgcgtcgggggttttggacgggtgttcggggtttgggggggttttggcgttttcgtcgtcgtttttcggtttttcgttttgggggattttgaaggagagt

SEQ ID NO: 2606 - DNA, 893 bp, Artificial Sequence
  chemically treated genomic DNA (Homo sapiens) CpG-island No: 2606
actctccttcaaaatcccccaaaacgaaaaaccgaaaaacgacgacgaaaacgccaaaacccccccaaaccccgaacacccgtccaaaacccccgacgcgaaaccgcgacgaatccgaatcccgaatccgcccccgaccgacgtaaccttaacgaaacgaccccgaaaaacgacgtctaaaaccgaacgacgaaaaacgacgaaccgaactcgaaacgaaaacgcaaacccgcgccgctcgtcctcacccgatctcgtcgacgcccgaattattcataacgacgacgacgacgacgctcgacgctcccgaacctcctcgctcgctcccgcctccgaaaaatcacccgctccgtcgccctccccacaaccgcgacccgaatctacgcaacgacgacgacgacgacgacgacgacgacgacgacgacgacgactacctcctcccctcgacgccaacgatcaccgcgcgtccccgcgccgccgcgccgccgcccctacgcacgcccgaacgcgctcccgcacgaaatctccgaaaacgaatccaaaaatactccgtctatacgtacgtccctaaaacgaatttcgcgccgccgcaatcgaaaccgtcgcgcgttttcctttctcctcgaaaactcctaacgttaccgcgaaacacgctaaaaaataaaatccctacgctaaccccgcccctacaaaaaaaaaatacgcgcgaaccgaaccacgtacgtacgtacgcgcgcgtacgaacttacgtacgcgtacgcgcttacgaaaccgacgctccgaactaaacactataaacgcaaacgcgactaccgcttcctctttaactcttcactcgaaaacgataaaaccgcgtaaaacgctacgaaaaataaaaatatacccgcccgcac

SEQ ID NO: 2607 - DNA, 893 bp, Artificial Sequence
  chemically treated genomic DNA (Homo sapiens) CpG-island No: 2607
gtttttttttaggattttttaggacgggaagtcgggaagcggcggcgggggcgttaggatttttttagatttcgggtattcgtttagggttttcggcgcgaagtcgcggcgagttcgggtttcgagttcgttttcggtcggcgtgattttgacggggcggtttcggggggcggcgtttgaggtcgggcggcggggagcggcgggtcgggttcggggcggagacgtaggttcgcgtcgttcgtttttattcgatttcgtcggcgttcgagttgtttatggcggcggcggcggcgacgttcggcgttttcgggttttttcgttcgttttcgttttcggaaggttattcgtttcgtcgttttttttatagtcgcggttcggatttgcgtaacggcggcggcggcggcggcggcggcggcggcggcggcggcggttgtttttttttttcggcgttaacggttatcgcgcgttttcgcgtcgtcgcgtcgtcgtttttgcgtacgttcgggcgcgttttcgtacggggttttcgggggcgggtttaggggtatttcgtttgtgcgtgcgtttttgaggcggatttcgcgtcgtcgtagtcggggtcgtcgcgcgttttttttttttttcggaggtttttggcgttgtcgcggggtacgttgggaaatggagtttttgcgttggtttcgtttttgtaaggggaggatgcgcgcgggtcgagttacgtgcgtgcgtgcgcgcgcgtgcgggtttgcgtgcgcgtgcgcgtttgcgagatcggcgtttcgggttaggtattgtgggcgtaggcgcggttgtcgttttttttttaattttttattcggaagcggtggagtcgcgtggggcgttgcggggagtgggagtgtattcgttcgtat

SEQ ID NO: 2608 - DNA, 893 bp, Artificial Sequence
  chemically treated genomic DNA (Homo sapiens) CpG-island No: 2608
atacgaacgaatacactcccactccccgcaacgccccacgcgactccaccgcttccgaataaaaaattaaaaaaaaaacgacaaccgcgcctacgcccacaatacctaacccgaaacgccgatctcgcaaacgcgcacgcgcacgcaaacccgcacgcgcgcgcacgcacgcacgtaactcgacccgcgcgcatcctccccttacaaaaacgaaaccaacgcaaaaactccatttcccaacgtaccccgcgacaacgccaaaaacctccgaaaaaaaaaaaaaacgcgcgacgaccccgactacgacgacgcgaaatccgcctcaaaaacgcacgcacaaacgaaatacccctaaacccgcccccgaaaaccccgtacgaaaacgcgcccgaacgtacgcaaaaacgacgacgcgacgacgcgaaaacgcgcgataaccgttaacgccgaaaaaaaaaaacaaccgccgccgccgccgccgccgccgccgccgccgccgccgccgttacgcaaatccgaaccgcgactataaaaaaaacgacgaaacgaataaccttccgaaaacgaaaacgaacgaaaaaacccgaaaacgccgaacgtcgccgccgccgccgccataaacaactcgaacgccgacgaaatcgaataaaaacgaacgacgcgaacctacgtctccgccccgaacccgacccgccgctccccgccgcccgacctcaaacgccgccccccgaaaccgccccgtcaaaatcacgccgaccgaaaacgaactcgaaacccgaactcgccgcgacttcgcgccgaaaaccctaaacgaatacccgaaatctaaaaaaatcctaacgcccccgccgccgcttcccgacttcccgtcctaaaaaatcctaaaaaaaaac

SEQ ID NO: 2609 - DNA, 637 bp, Artificial Sequence
  chemically treated genomic DNA (Homo sapiens) CpG-island No: 2609
ttcgcgggagtcggcggggatttttgggaagtcggttaaggttcgtttcgttcgtagtttcgttttcgtttattcgtaggcggggttcggggtttttcggttttagttttttttcgcggttcggggatgcggggaggcgtcggttgtttcgcgcggcgcggtcgttaggggtcgttgcggagtcgtttttgtggtttcgatgtcggggcgggcgcgggcgggaggagggcgcgggggttcgggagggaggcgggaggcgcggtcgtcgttttagttgcgagttcgttcgtcgttcgtcgtcgtcgtcgtcggttcggtttcgcgttcgttatggttcgtttgacggagagcgaggcgcgtcggtagtagtagtagtttttgtagtcgcggttttcgttcgtgggtagtagcgggttcgagtttttcggggggtagttcgacggtatgaaggatttggacgttattaaatttttcgtgggttagatttcgcggtatttggacgagaaggattttaagtcgtttttcgagtagttcggtcgtatttacgagtttacggtgtttaaagatttttatacggggatgtataaaggtgggcgttcggttttttttttttttttttttttttttcgttttttat

SEQ ID NO: 2610 - DNA, 637 bp, Artificial Sequence
  chemically treated genomic DNA (Homo sapiens) CpG-island No: 2610
ataaaaaacgaaaaaaaaaaaaaaaaaaaaaaaaaaccgaacgcccacctttatacatccccgtataaaaatctttaaacaccgtaaactcgtaaatacgaccgaactactcgaaaaacgacttaaaatccttctcgtccaaataccgcgaaatctaacccacgaaaaatttaataacgtccaaatccttcataccgtcgaactaccccccgaaaaactcgaacccgctactacccacgaacgaaaaccgcgactacaaaaactactactactaccgacgcgcctcgctctccgtcaaacgaaccataacgaacgcgaaaccgaaccgacgacgacgacgacgaacgacgaacgaactcgcaactaaaacgacgaccgcgcctcccgcctccctcccgaacccccgcgccctcctcccgcccgcgcccgccccgacatcgaaaccacaaaaacgactccgcaacgacccctaacgaccgcgccgcgcgaaacaaccgacgcctccccgcatccccgaaccgcgaaaaaaaactaaaaccgaaaaaccccgaaccccgcctacgaataaacgaaaacgaaactacgaacgaaacgaaccttaaccgacttcccaaaaatccccgccgactcccgcgaa

SEQ ID NO: 2611 - DNA, 637 bp, Artificial Sequence
  chemically treated genomic DNA (Homo sapiens) CpG-island No: 2611
gtgggaggcggagggagggggagaggggggagggggtcgggcgtttatttttgtgtattttcgtgtaggggtttttgagtatcgtgagttcgtagatgcggtcgaattgttcgaagagcggtttgaggtttttttcgtttaggtgtcgcgggatttggtttacgaagagtttgatggcgtttaggttttttatgtcgtcgggttgtttttcggggggttcgggttcgttgttgtttacgggcgagggtcgcggttgtaggagttgttgttgttgtcggcgcgtttcgtttttcgttaggcgggttatggcgggcgcgggatcgagtcggcggcggcggcggcgggcggcgggcggattcgtagttggagcggcggtcgcgtttttcgtttttttttcgggttttcgcgtttttttttcgttcgcgttcgtttcggtatcgggattataaaggcggtttcgtagcggtttttggcggtcgcgtcgcgcggggtagtcggcgttttttcgtattttcgggtcgcggggggaaattgaggtcggaaggtttcgggtttcgtttacgggtgggcgagggcggagttgcgggcgggacgggttttagtcggttttttaggggttttcgtcggttttcgcgga

SEQ ID NO: 2612 - DNA, 637 bp, Artificial Sequence
  chemically treated genomic DNA (Homo sapiens) CpG-island No: 2612
tccgcgaaaaccgacgaaaacccctaaaaaaccgactaaaacccgtcccgcccgcaactccgccctcgcccacccgtaaacgaaacccgaaaccttccgacctcaatttccccccgcgacccgaaaatacgaaaaaacgccgactaccccgcgcgacgcgaccgccaaaaaccgctacgaaaccgcctttataatcccgataccgaaacgaacgcgaacgaaaaaaaaacgcgaaaacccgaaaaaaaaacgaaaaacgcgaccgccgctccaactacgaatccgcccgccgcccgccgccgccgccgccgactcgatcccgcgcccgccataacccgcctaacgaaaaacgaaacgcgccgacaacaacaacaactcctacaaccgcgaccctcgcccgtaaacaacaacgaacccgaaccccccgaaaaacaacccgacgacataaaaaacctaaacgccatcaaactcttcgtaaaccaaatcccgcgacacctaaacgaaaaaaacctcaaaccgctcttcgaacaattcgaccgcatctacgaactcacgatactcaaaaacccctacacgaaaatacacaaaaataaacgcccgaccccctcccccctctccccctccctccgcctcccac

SEQ ID NO: 2613 - DNA, 876 bp, Artificial Sequence
  chemically treated genomic DNA (Homo sapiens) CpG-island No: 2613
taggcgtcgcgcgcgtagtttatatttaaattggaaggaatttgttttgttcggggcgggcgcgaagtcgtcgtagtcgcgagcgtcgcgcgggattagtttcggcgcgcgcgtgttttttttcgtcgttaaatttttaaatttttagggcgcgggcgggattgggcggtgggcgcgtcgggaaggcgttcgggggtggggacggggattcgcgcgttcgcgtttggtcgaggtgtttcgagataggatgtaggtatttttaatattttgtacgttcgcgtttttattagcgttgtagtaaagtttcggggtttgggcgggttacgcgcgtagaggcgtattcgggttgggagatcggggcgttgtgttaaggatttcggcggcgttggcgggggcggttcggtttcggatcgcgacgcggttatttttcgtgatttttagtttaggcggtaggttggcgggcgcgcgatcggcgcggtttaggtttacgtgggacggcgcgcgcgcgttaggtaggttttttttttggttgcgtttagcgttcgtagtatatggtcggcggcggcgcgttttcgaggtcggcggagatcggttgtagtcggtataggataagagttaggtagcgacgcggggtcggggcgcgggcggtagtacgtacggttcgggtcgtaggcggtcggggtggggggcggggggagggtgtggttcgggtgttcgagtcgcgggagtgggtggagggttcgggcgttcgggttttattagttcgagttaatttgcgttagagtcgggttcgttttttaaggggttaattttttttttatgttatcgagcggtttataaggagggggaggttaagttttcgttttattgggagtt

SEQ ID NO: 2614 - DNA, 876 bp, Artificial Sequence
  chemically treated genomic DNA (Homo sapiens) CpG-island No: 2614
aactcccaataaaacgaaaacttaacctccccctccttataaaccgctcgataacataaaaaaaaaattaaccccttaaaaaacgaacccgactctaacgcaaattaactcgaactaataaaacccgaacgcccgaaccctccacccactcccgcgactcgaacacccgaaccacaccctccccccgccccccaccccgaccgcctacgacccgaaccgtacgtactaccgcccgcgccccgaccccgcgtcgctacctaactcttatcctataccgactacaaccgatctccgccgacctcgaaaacgcgccgccgccgaccatatactacgaacgctaaacgcaaccaaaaaaaaaacctacctaacgcgcgcgcgccgtcccacgtaaacctaaaccgcgccgatcgcgcgcccgccaacctaccgcctaaactaaaaatcacgaaaaataaccgcgtcgcgatccgaaaccgaaccgcccccgccaacgccgccgaaatccttaacacaacgccccgatctcccaacccgaatacgcctctacgcgcgtaacccgcccaaaccccgaaactttactacaacgctaataaaaacgcgaacgtacaaaatattaaaaatacctacatcctatctcgaaacacctcgaccaaacgcgaacgcgcgaatccccgtccccacccccgaacgccttcccgacgcgcccaccgcccaatcccgcccgcgccctaaaaatttaaaaatttaacgacgaaaaaaaacacgcgcgcgccgaaactaatcccgcgcgacgctcgcgactacgacgacttcgcgcccgccccgaacaaaacaaattccttccaatttaaatataaactacgcgcgcgacgccta

SEQ ID NO: 2615 - DNA, 876 bp, Artificial Sequence
  chemically treated genomic DNA (Homo sapiens) CpG-island No: 2615
ggtttttaataaggcggaggtttggtttttttttttttataagtcgttcggtaatatgagaaaaggattaattttttagggggcgggttcgattttagcgtaagttggttcgggttggtgaggttcgagcgttcgggttttttatttattttcgcgattcgggtattcgagttatatttttttttcgttttttatttcggtcgtttgcgattcgggtcgtgcgtgttgtcgttcgcgtttcggtttcgcgtcgttgtttagtttttattttatatcggttgtagtcggttttcgtcggtttcgggggcgcgtcgtcgtcgattatgtgttgcgagcgttgagcgtagttaaggagggggtttgtttggcgcgcgcgcgtcgttttacgtggatttgagtcgcgtcggtcgcgcgttcgttagtttgtcgtttgggttgggggttacgaaaggtaatcgcgtcgcggttcggggtcgggtcgttttcgttagcgtcgtcggggtttttggtataacgtttcgattttttaattcgggtgcgtttttgcgcgcgtgattcgtttagatttcggagttttgttgtaacgttagtaggagcgcgagcgtgtagggtgttgggggtgtttgtattttgtttcggagtatttcggttaggcgcgagcgcgcgggttttcgtttttattttcgggcgttttttcggcgcgtttatcgtttagtttcgttcgcgttttgaggatttagggatttagcggcgagggggaatacgcgcgcgtcggggttgatttcgcgcggcgttcgcggttgcggcggtttcgcgttcgtttcgggtagaataggttttttttagtttgggtgtgagttgcgcgcgcggcgtttg

SEQ ID NO: 2616 - DNA, 876 bp, Artificial Sequence
  chemically treated genomic DNA (Homo sapiens) CpG-island No: 2616
caaacgccgcgcgcgcaactcacacccaaactaaaaaaaacctattctacccgaaacgaacgcgaaaccgccgcaaccgcgaacgccgcgcgaaatcaaccccgacgcgcgcgtattccccctcgccgctaaatccctaaatcctcaaaacgcgaacgaaactaaacgataaacgcgccgaaaaaacgcccgaaaataaaaacgaaaacccgcgcgctcgcgcctaaccgaaatactccgaaacaaaatacaaacacccccaacaccctacacgctcgcgctcctactaacgttacaacaaaactccgaaatctaaacgaatcacgcgcgcaaaaacgcacccgaattaaaaaatcgaaacgttataccaaaaaccccgacgacgctaacgaaaacgacccgaccccgaaccgcgacgcgattacctttcgtaacccccaacccaaacgacaaactaacgaacgcgcgaccgacgcgactcaaatccacgtaaaacgacgcgcgcgcgccaaacaaaccccctccttaactacgctcaacgctcgcaacacataatcgacgacgacgcgcccccgaaaccgacgaaaaccgactacaaccgatataaaataaaaactaaacaacgacgcgaaaccgaaacgcgaacgacaacacgcacgacccgaatcgcaaacgaccgaaataaaaaacgaaaaaaaaatataactcgaatacccgaatcgcgaaaataaataaaaaacccgaacgctcgaacctcaccaacccgaaccaacttacgctaaaatcgaacccgccccctaaaaaattaatccttttctcatattaccgaacgacttataaaaaaaaaaaaaccaaacctccgccttattaaaaacc

SEQ ID NO: 2617 - DNA, 892 bp, Artificial Sequence
  chemically treated genomic DNA (Homo sapiens) CpG-island No: 2617
tcgcggttttcgttacgttcgttttttttatatttttatttcgttttatcgatcgcgatcggttttcgtttttacgattcggttattttgtttaggggtttcggtttagttttgatagtattcgcgaatcgttttgattcgataggtttcgatattatttattcgcggtagtttttacgcgtatgcgtatcgcgttttttcgtattgcgttacgttacgtttattggcgttacgttttttacgttacgcgtcgcgtcgttgcgtcgcgtacgttttgtgggtttcgtttaatttacgatttatttatgttacgtttttgagcgtgcggtcgtttgggtaggcgtagagttggagtttagcggtcgcgattcgttttttttagaatagagggtagcgaggggattataagttttagttgtttattttcgtagtcgtcgatttttcgtttgcgttcgcggcggtttcgcggttcggttttcgagagttatagatgcgttcgcgtcgttggggtttttcgtgtgggaacgttttcggtaggtcgcgggtttgagaggtatcgtcggcgtgacgaatgtaattagcgtggttttaaatgagtcggcggtcgtcgtaggttgacgtagagtcgtagcgtttttcggggtcgttatttttagtatttttttttttttatttgttgggggtcgcgggggttggaatttagaagcgtaagtgtggggcgcgttttcgtggcgtttttggcgtttcgaggtcgaaattcggatgttgaggggaggtcgtgagttcggaaaggtatcgcggggtcggtattagggttgagttagttttgtattttttggtgggattttcggtttttttgggtttcgttatttttttttttttttttgttttt

SEQ ID NO: 2618 - DNA, 892 bp, Artificial Sequence
  chemically treated genomic DNA (Homo sapiens) CpG-island No: 2618
aaaaacaaaaaaaaaaaaaaaaataacgaaacccaaaaaaaccgaaaatcccaccaaaaaatacaaaactaactcaaccctaataccgaccccgcgatacctttccgaactcacgacctcccctcaacatccgaatttcgacctcgaaacgccaaaaacgccacgaaaacgcgccccacacttacgcttctaaattccaacccccgcgacccccaacaaataaaaaaaaaaaaatactaaaaataacgaccccgaaaaacgctacgactctacgtcaacctacgacgaccgccgactcatttaaaaccacgctaattacattcgtcacgccgacgatacctctcaaacccgcgacctaccgaaaacgttcccacacgaaaaaccccaacgacgcgaacgcatctataactctcgaaaaccgaaccgcgaaaccgccgcgaacgcaaacgaaaaatcgacgactacgaaaataaacaactaaaacttataatcccctcgctaccctctattctaaaaaaaacgaatcgcgaccgctaaactccaactctacgcctacccaaacgaccgcacgctcaaaaacgtaacataaataaatcgtaaattaaacgaaacccacaaaacgtacgcgacgcaacgacgcgacgcgtaacgtaaaaaacgtaacgccaataaacgtaacgtaacgcaatacgaaaaaacgcgatacgcatacgcgtaaaaactaccgcgaataaataatatcgaaacctatcgaatcaaaacgattcgcgaatactatcaaaactaaaccgaaacccctaaacaaaataaccgaatcgtaaaaacgaaaaccgatcgcgatcgataaaacgaaataaaaatataaaaaaaacgaacgtaacgaaaaccgcga

SEQ ID NO: 2619 - DNA, 892 bp, Artificial Sequence
  chemically treated genomic DNA (Homo sapiens) CpG-island No: 2619
aaaagtaagaaaaagaaagagaatggcgaggtttagagagatcgaaagttttattagagggtatagagttagtttagttttaatgtcggtttcgcggtgttttttcgagtttacggtttttttttagtattcgggtttcggtttcggagcgttagggacgttacgaggacgcgttttatatttgcgtttttgggttttagttttcgcggtttttaataaataaagaagggaaagtgttgagggtgacggtttcggggagcgttgcggttttacgttaatttgcggcggtcgtcgatttatttggggttacgttggttgtattcgttacgtcggcgatgttttttaaattcgcggtttgtcgaggacgtttttatacgggagattttagcgacgcgggcgtatttgtggttttcgagaatcgggtcgcggagtcgtcgcgagcgtaagcgaggaatcggcgattgcgggggtggatagttggggtttgtagttttttcgttattttttattttggaagaggcgggtcgcggtcgttgaattttagttttgcgtttgtttaggcggtcgtacgtttaggggcgtggtatgggtgggtcgtgagttgggcggggtttatagggcgtgcgcgacgtagcggcgcggcgcgtggcgtaaggggcgtggcgttagtgggcgtggcgtggcgtagtgcgaagggacgcggtgcgtatgcgcgtgagggttgtcgcgggtgggtggtatcgaggtttgtcgggttagggcggttcgcgggtgttgttagagttgggtcggggtttttaggtagggtagtcgggtcgtagaggcgggggtcggtcgcggtcggtggagcgggatgaggatgtaggaggggcggacgtggcggaagtcgcgg

SEQ ID NO: 2620 - DNA, 892 bp, Artificial Sequence
  chemically treated genomic DNA (Homo sapiens) CpG-island No: 2620
ccgcgacttccgccacgtccgcccctcctacatcctcatcccgctccaccgaccgcgaccgacccccgcctctacgacccgactaccctacctaaaaaccccgacccaactctaacaacacccgcgaaccgccctaacccgacaaacctcgataccacccacccgcgacaaccctcacgcgcatacgcaccgcgtcccttcgcactacgccacgccacgcccactaacgccacgccccttacgccacgcgccgcgccgctacgtcgcgcacgccctataaaccccgcccaactcacgacccacccataccacgcccctaaacgtacgaccgcctaaacaaacgcaaaactaaaattcaacgaccgcgacccgcctcttccaaaataaaaaataacgaaaaaactacaaaccccaactatccacccccgcaatcgccgattcctcgcttacgctcgcgacgactccgcgacccgattctcgaaaaccacaaatacgcccgcgtcgctaaaatctcccgtataaaaacgtcctcgacaaaccgcgaatttaaaaaacatcgccgacgtaacgaatacaaccaacgtaaccccaaataaatcgacgaccgccgcaaattaacgtaaaaccgcaacgctccccgaaaccgtcaccctcaacactttcccttctttatttattaaaaaccgcgaaaactaaaacccaaaaacgcaaatataaaacgcgtcctcgtaacgtccctaacgctccgaaaccgaaacccgaatactaaaaaaaaaccgtaaactcgaaaaaacaccgcgaaaccgacattaaaactaaactaactctataccctctaataaaactttcgatctctctaaacctcgccattctctttctttttcttactttt

SEQ ID NO: 2621 - DNA, 663 bp, Artificial Sequence
  chemically treated genomic DNA (Homo sapiens) CpG-island No: 2621
gttcgcggtgtcgcgagttgagtttttcgatgggttcggatttgggcggcggcggcggcggggtcggggtaggggtcggggtaggggtcggggcgtagcgtttcgtagcggaagtcgtaggttgtttgggttgtttgtttcgtttgtttttaatgtcggagtcgaggacgggggagaagggaaagcggaggaggagggacgggcgcgggtggggaggtttgcgaggtcgcgcgggagggtttcggtcggtagaagcgggtggagggaaaaggtttatttcgaattgttggggttttatttaggatcggttttagtcgtttttttgttttatttttttttcgtagcgcggttacgtgagatgcgttatagaagagtttgagatcgagtgaggcggcgcggtagtcgttagggggagcgcgggggcgtcgagtcgggagcgcggagttcggagcgtttgggttcggcgtagcgcggtgcgtttggattcggggcgcggatggcgcggttgagaggggcgcgtagttcgcgaaatgttcggcgttaaaggttttcggagattagttttcgcggatttttggttggagtttaaagtcggttagatttttttttcgcgttttttttttcgcggttcggagaggaaggtaggggagtttttaaatatta

SEQ ID NO: 2622 - DNA, 663 bp, Artificial Sequence
  chemically treated genomic DNA (Homo sapiens) CpG-island No: 2622
taatatttaaaaactcccctaccttcctctccgaaccgcgaaaaaaaaaacgcgaaaaaaaaatctaaccgactttaaactccaaccaaaaatccgcgaaaactaatctccgaaaacctttaacgccgaacatttcgcgaactacgcgcccctctcaaccgcgccatccgcgccccgaatccaaacgcaccgcgctacgccgaacccaaacgctccgaactccgcgctcccgactcgacgcccccgcgctccccctaacgactaccgcgccgcctcactcgatctcaaactcttctataacgcatctcacgtaaccgcgctacgaaaaaaaaataaaacaaaaaaacgactaaaaccgatcctaaataaaaccccaacaattcgaaataaaccttttccctccacccgcttctaccgaccgaaaccctcccgcgcgacctcgcaaacctccccacccgcgcccgtccctcctcctccgctttcccttctcccccgtcctcgactccgacattaaaaacaaacgaaacaaacaacccaaacaacctacgacttccgctacgaaacgctacgccccgacccctaccccgacccctaccccgaccccgccgccgccgccgcccaaatccgaacccatcgaaaaactcaactcgcgacaccgcgaac

SEQ ID NO: 2623 - DNA, 663 bp, Artificial Sequence
  chemically treated genomic DNA (Homo sapiens) CpG-island No: 2623
tgatatttgggggtttttttgttttttttttcgagtcgcggaaggggagacgcggggaggaggtttggtcggttttgggttttagttaggggttcgcggagattggttttcgaaggtttttgacgtcgggtatttcgcgagttacgcgttttttttagtcgcgttattcgcgtttcgagtttaggcgtatcgcgttgcgtcgagtttaggcgtttcgggtttcgcgttttcgattcgacgttttcgcgttttttttagcggttgtcgcgtcgttttattcggttttaggtttttttgtggcgtattttacgtgatcgcgttgcgggagagggatgaaataagagggcggttgaagtcgattttgagtggggttttagtaattcggaatgagttttttttttttattcgtttttgtcgatcggggttttttcgcgcggtttcgtaggtttttttattcgcgttcgttttttttttttcgtttttttttttttttcgttttcggtttcgatattaggggtaggcggggtaggtagtttaagtagtttgcggttttcgttgcggagcgttgcgtttcggtttttgtttcggtttttgtttcggtttcgtcgtcgtcgtcgtttaagttcggatttatcggggggtttagttcgcggtatcgcgagt

SEQ ID NO: 2624 - DNA, 663 bp, Artificial Sequence
  chemically treated genomic DNA (Homo sapiens) CpG-island No: 2624
actcgcgataccgcgaactaaaccccccgataaatccgaacttaaacgacgacgacgacgaaaccgaaacaaaaaccgaaacaaaaaccgaaacgcaacgctccgcaacgaaaaccgcaaactacttaaactacctaccccgcctacccctaatatcgaaaccgaaaacgaaaaaaaaaaaaaaacgaaaaaaaaaaaacgaacgcgaataaaaaaacctacgaaaccgcgcgaaaaaaccccgatcgacaaaaacgaataaaaaaaaaaaactcattccgaattactaaaaccccactcaaaatcgacttcaaccgccctcttatttcatccctctcccgcaacgcgatcacgtaaaatacgccacaaaaaaacctaaaaccgaataaaacgacgcgacaaccgctaaaaaaaacgcgaaaacgtcgaatcgaaaacgcgaaacccgaaacgcctaaactcgacgcaacgcgatacgcctaaactcgaaacgcgaataacgcgactaaaaaaaacgcgtaactcgcgaaatacccgacgtcaaaaaccttcgaaaaccaatctccgcgaacccctaactaaaacccaaaaccgaccaaacctcctccccgcgtctccccttccgcgactcgaaaaaaaaaacaaaaaaacccccaaatatca

SEQ ID NO: 2625 - DNA, 834 bp, Artificial Sequence
  chemically treated genomic DNA (Homo sapiens) CpG-island No: 2625
gttgagcggagtaggttttttcgcgtttcggtttcgtgcgggcgcggtttttagcgcgttatttttgtttttcgtttttttttcgcggcgggtcgtgtatattttggatggtttcgtagacggtttttgagtcgttgcgcgttaggggtcgcgggtatatttaggaattcgttatattgtagttttgaagttgtcgtttttttcgaggtggtcggcgggaggcgagacggcggcgcgcgttaggtagtttagggattgcgtaggtcgtaagtataggtaggcgggtaggtcgggcgttaggttgttgcgttgggtcgcggcgtcgcgttgcgaagggtcgtatagggagttggcgcggtttcggggtttcgcgggggtgttgtcggggttcgttgtcgtcgtcgcgtttataagtcggtagtcgtaggtgagcggttcgggggtcgaggggattgttggggggatttggcggcgcggtagtggtaggttgtttcgttcgggcgttttcgttcgcggggaggttatttgtttagcgtaggtagttcgcgtacgtattgcgcgggtaggtagaaggggtggtcgttaggttcgcgtcgtacgtgttattagtgtttcgtgttgcgtcgtagtagttagtagcgtttattgggttagatggttacgcggcgttagtttttgcgggtatattcgaaggggtgttttattattaggtagatatttttttttatatacgtcggtatcgtggtcgcggcgtttttttgtaggtaataaggaggagggtcgtggaggttaagattatcgagtttggaatagtttcgtattcggggatagatt

SEQ ID NO: 2626 - DNA, 834 bp, Artificial Sequence
  chemically treated genomic DNA (Homo sapiens) CpG-island No: 2626
aatctatccccgaatacgaaactattccaaactcgataatcttaacctccacgaccctcctccttattacctacaaaaaaacgccgcgaccacgataccgacgtatataaaaaaaaatatctacctaataataaaacaccccttcgaatatacccgcaaaaactaacgccgcgtaaccatctaacccaataaacgctactaactactacgacgcaacacgaaacactaataacacgtacgacgcgaacctaacgaccaccccttctacctacccgcgcaatacgtacgcgaactacctacgctaaacaaataacctccccgcgaacgaaaacgcccgaacgaaacaacctaccactaccgcgccgccaaatccccccaacaatcccctcgacccccgaaccgctcacctacgactaccgacttataaacgcgacgacgacaacgaaccccgacaacacccccgcgaaaccccgaaaccgcgccaactccctatacgacccttcgcaacgcgacgccgcgacccaacgcaacaacctaacgcccgacctacccgcctacctatacttacgacctacgcaatccctaaactacctaacgcgcgccgccgtctcgcctcccgccgaccacctcgaaaaaaacgacaacttcaaaactacaatataacgaattcctaaatatacccgcgacccctaacgcgcaacgactcaaaaaccgtctacgaaaccatccaaaatatacacgacccgccgcgaaaaaaaaacgaaaaacaaaaataacgcgctaaaaaccgcgcccgcacgaaaccgaaacgcgaaaaaacctactccgctcaac

SEQ ID NO: 2627 - DNA, 834 bp, Artificial Sequence
  chemically treated genomic DNA (Homo sapiens) CpG-island No: 2627
agtttgttttcgagtgcggggttattttaggttcggtggttttgatttttacggtttttttttttgttgtttgtagaaaaacgtcgcggttacgatgtcggcgtatgtggagggggatgtttatttggtggtggagtattttttcgagtatattcgtaaggattggcgtcgcgtggttatttggtttaatgagcgttattggttgttgcggcgtagtacggagtattggtggtacgtgcggcgcgagtttggcggttattttttttatttgttcgcgtagtacgtgcgcgagttgtttgcgttgggtaaatgattttttcgcgaacgggaacgttcggacgagataatttgttattgtcgcgtcgttaggtttttttaatagttttttcggttttcgagtcgtttatttacgattatcggtttgtgagcgcggcggcggtagcgggtttcgatagtattttcgcggagtttcgaggtcgcgttagttttttgtgcggtttttcgtaacgcggcgtcgcgatttagcgtagtagtttggcgttcggtttgttcgtttgtttgtatttgcggtttgcgtagtttttggattatttggcgcgcgtcgtcgtttcgtttttcgtcggttatttcggaaggagcggtagttttaaggttgtagtgtggcgggtttttggatgtgttcgcggtttttggcgcgtagcgatttagagatcgtttacgaggttatttaggatgtgtacggttcgtcgcgggaggagagcggggaataggggtggcgcgttggggatcgcgttcgtacggagtcggggcgcgaggagatttgtttcgtttagt

SEQ ID NO: 2628 - DNA, 834 bp, Artificial Sequence
  chemically treated genomic DNA (Homo sapiens) CpG-island No: 2628
actaaacgaaacaaatctcctcgcgccccgactccgtacgaacgcgatccccaacgcgccacccctattccccgctctcctcccgcgacgaaccgtacacatcctaaataacctcgtaaacgatctctaaatcgctacgcgccaaaaaccgcgaacacatccaaaaacccgccacactacaaccttaaaactaccgctccttccgaaataaccgacgaaaaacgaaacgacgacgcgcgccaaataatccaaaaactacgcaaaccgcaaatacaaacaaacgaacaaaccgaacgccaaactactacgctaaatcgcgacgccgcgttacgaaaaaccgcacaaaaaactaacgcgacctcgaaactccgcgaaaatactatcgaaacccgctaccgccgccgcgctcacaaaccgataatcgtaaataaacgactcgaaaaccgaaaaaactattaaaaaaacctaacgacgcgacaataacaaattatctcgtccgaacgttcccgttcgcgaaaaaatcatttacccaacgcaaacaactcgcgcacgtactacgcgaacaaataaaaaaaataaccgccaaactcgcgccgcacgtaccaccaatactccgtactacgccgcaacaaccaataacgctcattaaaccaaataaccacgcgacgccaatccttacgaatatactcgaaaaaatactccaccaccaaataaacatccccctccacatacgccgacatcgtaaccgcgacgtttttctacaaacaacaaaaaaaaaaaccgtaaaaatcaaaaccaccgaacctaaaataaccccgcactcgaaaacaaact

SEQ ID NO: 2629 - DNA, 576 bp, Artificial Sequence
  chemically treated genomic DNA (Homo sapiens) CpG-island No: 2629
ttcgttttcgtattcgggttttttcgcgatttcggaggaattttttagagtcgtttgatttcgtttttaggtttcgttttttttttttatttttttttcgtcgtagtgttttgtttttattggttttttcgtatattgttcgttttgttattggttaattcggagcgttcggttcgttttttaggtttggtaatttttcggtttttttcgcgcgggcggggcgagtggagggcgtggtttgtcgaggggcgaggcgagtggagggcggggtcgcgttgttcgtttcgtttcggtttcggtttcggtttcggcgttgtttttatcgtcgcggtaacggtttcggtttacggaggcggttggacggattttcgacggttggacgtacggattttgtttcgagagtaggtgagcgagtagtgtcggggcgttttttattttagcgtatttcgggggttatttggtcgttttttgtttttttcgttttttaatgtttttgtattttatcgtttgttcgtttatatttttgttttagttttcgtttgtttttttgttattttcgttgtataggttaggggg

SEQ ID NO: 2630 - DNA, 576 bp, Artificial Sequence
  chemically treated genomic DNA (Homo sapiens) CpG-island No: 2630
ccccctaacctatacaacgaaaataacaaaaaaacaaacgaaaactaaaacaaaaatataaacgaacaaacgataaaatacaaaaacattaaaaaacgaaaaaaacaaaaaacgaccaaataacccccgaaatacgctaaaataaaaaacgccccgacactactcgctcacctactctcgaaacaaaatccgtacgtccaaccgtcgaaaatccgtccaaccgcctccgtaaaccgaaaccgttaccgcgacgataaaaacaacgccgaaaccgaaaccgaaaccgaaacgaaacgaacaacgcgaccccgccctccactcgcctcgcccctcgacaaaccacgccctccactcgccccgcccgcgcgaaaaaaaccgaaaaattaccaaacctaaaaaacgaaccgaacgctccgaattaaccaataacaaaacgaacaatatacgaaaaaaccaataaaaacaaaacactacgacgaaaaaaaaataaaaaaaaaaaacgaaacctaaaaacgaaatcaaacgactctaaaaaattcctccgaaatcgcgaaaaaacccgaatacgaaaacgaa

SEQ ID NO: 2631 - DNA, 576 bp, Artificial Sequence
  chemically treated genomic DNA (Homo sapiens) CpG-island No: 2631
ttttttaatttatatagcgagagtgatagagagatagacggaaattgaggtaggaatgtagacggataggcggtggggtgtagaagtattaaggggcgggagagatagagggcggttaggtggttttcgagatgcgttgaaatggggggcgtttcggtattgttcgtttatttattttcgaagtagagttcgtacgtttaatcgtcgggggttcgtttagtcgttttcgtgggtcggggtcgttgtcgcggcggtgggagtagcgtcggagtcggggtcggggtcggggcggggcgggtagcgcggtttcgttttttattcgtttcgtttttcggtaggttacgttttttattcgtttcgttcgcgcggaagggatcggagagttgttaggtttggggggcgggtcgagcgtttcggattagttaatgatagggcgggtaatgtacgaaaaggttaatgggagtagggtattgcgacgggggggaagtggggggaaggggcggagtttgggggcggggttaggcggttttgggggattttttcggaatcgcgaaggggttcggatgcgggggcgag

SEQ ID NO: 2632 - DNA, 576 bp, Artificial Sequence
  chemically treated genomic DNA (Homo sapiens) CpG-island No: 2632
ctcgcccccgcatccgaaccccttcgcgattccgaaaaaatcccccaaaaccgcctaaccccgcccccaaactccgccccttccccccacttcccccccgtcgcaataccctactcccattaaccttttcgtacattacccgccctatcattaactaatccgaaacgctcgacccgccccccaaacctaacaactctccgatcccttccgcgcgaacgaaacgaataaaaaacgtaacctaccgaaaaacgaaacgaataaaaaacgaaaccgcgctacccgccccgccccgaccccgaccccgactccgacgctactcccaccgccgcgacaacgaccccgacccacgaaaacgactaaacgaacccccgacgattaaacgtacgaactctacttcgaaaataaataaacgaacaataccgaaacgccccccatttcaacgcatctcgaaaaccacctaaccgccctctatctctcccgccccttaatacttctacaccccaccgcctatccgtctacattcctacctcaatttccgtctatctctctatcactctcgctatataaattaaaaaa

SEQ ID NO: 2633 - DNA, 503 bp, Artificial Sequence
  chemically treated genomic DNA (Homo sapiens) CpG-island No: 2633
ttttcggtggagtttcggtttcgttttttttatacgatcgggtttatatttgaatattttttaggattgcgttacggatatttttacgttaatttttacgtcggattgttttacggatatttttacgttaatttttacgtcggattgcgttacggatatttttacgttaatttttacgtcggattgcgttacggatatttttacgttaatttttacgtcggattgttttacggatatttttacgttaatttttacgtcggatagcgttatggatatttttacgttaatttttacgtcggattgcgttacggatatttttacgttaatttttacgtcggattgcgttacggatatttttacgttaatttttacgttaggtttttgtattttatattcggtttttttttacgatattgtggttcgcgttggttttttacgtatatttttagtcgcgtttttgttttgtttaagttttttgtatttgtttttttttgttgagaaag

SEQ ID NO: 2634 - DNA, 503 bp, Artificial Sequence
  chemically treated genomic DNA (Homo sapiens) CpG-island No: 2634
ctttctcaacaaaaaaaaacaaatacaaaaaacttaaacaaaacaaaaacgcgactaaaaatatacgtaaaaaaccaacgcgaaccacaatatcgtaaaaaaaaaccgaatataaaatacaaaaacctaacgtaaaaattaacgtaaaaatatccgtaacgcaatccgacgtaaaaattaacgtaaaaatatccgtaacgcaatccgacgtaaaaattaacgtaaaaatatccataacgctatccgacgtaaaaattaacgtaaaaatatccgtaaaacaatccgacgtaaaaattaacgtaaaaatatccgtaacgcaatccgacgtaaaaattaacgtaaaaatatccgtaacgcaatccgacgtaaaaattaacgtaaaaatatccgtaaaacaatccgacgtaaaaattaacgtaaaaatatccgtaacgcaatcctaaaaaatattcaaatataaacccgatcgtataaaaaaaacgaaaccgaaactccaccgaaaa

SEQ ID NO: 2635 - DNA, 503 bp, Artificial Sequence
  chemically treated genomic DNA (Homo sapiens) CpG-island No: 2635
tttttttagtagggaaaggtaggtgtagaaggtttgagtagggtagggacgcggttgggagtatgcgtggaaggttagcgcgggttatagtgtcgtgaggaggagtcgggtgtggggtgtaggaatttggcgtgggagttggcgtggggatgttcgtgacgtagttcggcgtgggagttggcgtggggatgttcgtgacgtagttcggcgtgggagttggcgtggggatgtttataacgttgttcggcgtgggagttggcgtggggatgttcgtgaggtagttcggcgtgggagttggcgtggggatgttcgtgacgtagttcggcgtgggagttggcgtggggatgttcgtgacgtagttcggcgtgggagttggcgtggggatgttcgtgaggtagttcggcgtgggagttggcgtggggatgttcgtgacgtagttttggggggtgtttaggtgtgaattcggtcgtgtggaggaaacggggtcggggttttatcggagg

SEQ ID NO: 2636 - DNA, 503 bp, Artificial Sequence
  chemically treated genomic DNA (Homo sapiens) CpG-island No: 2636
cctccgataaaaccccgaccccgtttcctccacacgaccgaattcacacctaaacaccccccaaaactacgtcacgaacatccccacgccaactcccacgccgaactacctcacgaacatccccacgccaactcccacgccgaactacgtcacgaacatccccacgccaactcccacgccgaactacgtcacgaacatccccacgccaactcccacgccgaactacctcacgaacatccccacgccaactcccacgccgaacaacgttataaacatccccacgccaactcccacgccgaactacgtcacgaacatccccacgccaactcccacgccgaactacgtcacgaacatccccacgccaactcccacgccaaattcctacaccccacacccgactcctcctcacgacactataacccgcgctaaccttccacgcatactcccaaccgcgtccctaccctactcaaaccttctacacctacctttccctactaaaaaaa

SEQ ID NO: 2637 - DNA, 697 bp, Artificial Sequence
  chemically treated genomic DNA (Homo sapiens) CpG-island No: 2637
tttttggaatttcgtttatagaggttttttcggcgtggtcggtttagtagggacgcgtcgtcgtagcggaggagagaacgcgggcggggggttgtaggtcggcgcggggggcgcgacgtcgtcggcggggcgcgagggggtgtgttcgcgtcgcggttatcgcggttatcgcggttggcgttcgggtgcgtcgcgcgtttcggttttttcgggggttttttacgtcgtttttcgttcgtcggcggtcggggttcgttttttttgacgttatgcgggcggagggttcgttcgggcggcgttgtcgcgggcgtcgggagggggttcgatttcgggttttagttcgtcgtcgtgcgtttcgcgtcgtgcgttcggttttttgcgcgtcgtcgtagttatatttggaagcgtttagcgcgtttgttttcggcgcgtcgggcgggcgggcgggcggcgcgggtaggggcgggcgcgggcgcggcggggttgggtcggggggagtgagcgcggcgttttcgcgcgttcggtgtttttttttcgttgtttttgtagaaatagtttttgttagagcggcgttcggcgcggcgcggcgggttcggagcggcggcggcggttttttttgttttcgcgtttaggagttgtcggttttttttgatagtagagagtcgggtaggggttttaggaggattcgttgggagtg

SEQ ID NO: 2638 - DNA, 697 bp, Artificial Sequence
  chemically treated genomic DNA (Homo sapiens) CpG-island No: 2638
cactcccaacgaatcctcctaaaacccctacccgactctctactatcaaaaaaaaccgacaactcctaaacgcgaaaacaaaaaaaaccgccgccgccgctccgaacccgccgcgccgcgccgaacgccgctctaacaaaaactatttctacaaaaacaacgaaaaaaaaacaccgaacgcgcgaaaacgccgcgctcactccccccgacccaaccccgccgcgcccgcgcccgcccctacccgcgccgcccgcccgcccgcccgacgcgccgaaaacaaacgcgctaaacgcttccaaatataactacgacgacgcgcaaaaaaccgaacgcacgacgcgaaacgcacgacgacgaactaaaacccgaaatcgaaccccctcccgacgcccgcgacaacgccgcccgaacgaaccctccgcccgcataacgtcaaaaaaaacgaaccccgaccgccgacgaacgaaaaacgacgtaaaaaacccccgaaaaaaccgaaacgcgcgacgcacccgaacgccaaccgcgataaccgcgataaccgcgacgcgaacacaccccctcgcgccccgccgacgacgtcgcgccccccgcgccgacctacaaccccccgcccgcgttctctcctccgctacgacgacgcgtccctactaaaccgaccacgccgaaaaaacctctataaacgaaattccaaaaa

SEQ ID NO: 2639 - DNA, 697 bp, Artificial Sequence
  chemically treated genomic DNA (Homo sapiens) CpG-island No: 2639
tatttttagcgagtttttttgaggtttttgttcggttttttgttgttaaagggagtcggtaatttttgggcgcggaggtaggaagagtcgtcgtcgtcgtttcgggttcgtcgcgtcgcgtcgagcgtcgttttggtaggagttgtttttgtagaggtagcgagagggagatatcgggcgcgcgagagcgtcgcgtttatttttttcggtttagtttcgtcgcgttcgcgttcgtttttgttcgcgtcgttcgttcgttcgttcggcgcgtcggaggtagacgcgttgaacgtttttagatgtggttgcggcggcgcgtagggagtcgggcgtacggcgcggggcgtacggcggcggattggagttcgaagtcgggttttttttcggcgttcgcggtagcgtcgttcgagcgagtttttcgttcgtatgacgttaaagggagcgggtttcggtcgtcggcgggcgaggggcggcgtgaggagttttcggggaggtcggggcgcgcggcgtattcgggcgttagtcgcggtggtcgcggtggtcgcggcgcggatatattttttcgcgtttcgtcggcggcgtcgcgtttttcgcgtcggtttgtagtttttcgttcgcgttttttttttcgttgcggcggcgcgtttttgttgggtcggttacgtcgggaaggtttttgtgagcggaattttaagga

SEQ ID NO: 2640 - DNA, 697 bp, Artificial Sequence
  chemically treated genomic DNA (Homo sapiens) CpG-island No: 2640
tccttaaaattccgctcacaaaaaccttcccgacgtaaccgacccaacaaaaacgcgccgccgcaacgaaaaaaaaaacgcgaacgaaaaactacaaaccgacgcgaaaaacgcgacgccgccgacgaaacgcgaaaaaatatatccgcgccgcgaccaccgcgaccaccgcgactaacgcccgaatacgccgcgcgccccgacctccccgaaaactcctcacgccgcccctcgcccgccgacgaccgaaacccgctccctttaacgtcatacgaacgaaaaactcgctcgaacgacgctaccgcgaacgccgaaaaaaaacccgacttcgaactccaatccgccgccgtacgccccgcgccgtacgcccgactccctacgcgccgccgcaaccacatctaaaaacgttcaacgcgtctacctccgacgcgccgaacgaacgaacgaacgacgcgaacaaaaacgaacgcgaacgcgacgaaactaaaccgaaaaaaataaacgcgacgctctcgcgcgcccgatatctccctctcgctacctctacaaaaacaactcctaccaaaacgacgctcgacgcgacgcgacgaacccgaaacgacgacgacgactcttcctacctccgcgcccaaaaattaccgactccctttaacaacaaaaaaccgaacaaaaacctcaaaaaaactcgctaaaaata

SEQ ID NO: 2641 - DNA, 525 bp, Artificial Sequence
  chemically treated genomic DNA (Homo sapiens) CpG-island No: 2641
taaatataagaagtaggattcgttgtagttttgcgatacggagtatttcgtgttcgtgtattagtcggttattcgggaggttaacgggatcgtggagtgcgggttttgttagaagtaagatcgtagggcggcgtcgttcgtttcgttatatttttttcgttttcggtaaggcggaagtgcgggtagggtttcggaattttcgggaaacggttttatagtcgggaggaggggatgcgtttaagtgtagagtttacgttttcggggttttttttcgtcgtttttagtggaggagatacgtaggaggcggacggtttgaggcgggtaggacggttggggatcgggatagtcgggatggggagaggtggtttcgaggtttgattttgtgtgtcgagtttatttcgtcgaggtcgtagtcgtgattttacggcgtttttgggcgagtgggtttttcggcgggttttttttagttttgtttaggcggtgtttagggcggtgttagtgttcgcgtttgagttgcgtggggag

SEQ ID NO: 2642 - DNA, 525 bp, Artificial Sequence
  chemically treated genomic DNA (Homo sapiens) CpG-island No: 2642
ctccccacgcaactcaaacgcgaacactaacaccgccctaaacaccgcctaaacaaaactaaaaaaaacccgccgaaaaacccactcgcccaaaaacgccgtaaaatcacgactacgacctcgacgaaataaactcgacacacaaaatcaaacctcgaaaccacctctccccatcccgactatcccgatccccaaccgtcctacccgcctcaaaccgtccgcctcctacgtatctcctccactaaaaacgacgaaaaaaaaccccgaaaacgtaaactctacacttaaacgcatcccctcctcccgactataaaaccgtttcccgaaaattccgaaaccctacccgcacttccgccttaccgaaaacgaaaaaaatataacgaaacgaacgacgccgccctacgatcttacttctaacaaaacccgcactccacgatcccgttaacctcccgaataaccgactaatacacgaacacgaaatactccgtatcgcaaaactacaacgaatcctacttcttatattta

SEQ ID NO: 2643 - DNA, 525 bp, Artificial Sequence
  chemically treated genomic DNA (Homo sapiens) CpG-island No: 2643
ttttttacgtagtttaggcgcgggtattggtatcgttttgggtatcgtttgagtagggttgggggagattcgtcgaagggtttattcgtttagagacgtcgtggggttacggttgcggtttcggcggggtgggttcgatatatagggttaggtttcgggattatttttttttatttcggttgtttcggtttttagtcgttttgttcgttttagatcgttcgttttttgcgtgttttttttattgaggacggcgggggaagatttcgggagcgtgggttttgtatttagacgtatttttttttttcggttgtggagtcgtttttcgggggtttcggggttttgttcgtattttcgttttgtcgagggcgggaggagtgtggcgggacgggcggcgtcgttttgcggttttatttttggtagggttcgtattttacgatttcgttggtttttcggatggtcggttggtatacgaatacggggtatttcgtgtcgtagggttgtagcgggttttgttttttgtgtttg

SEQ ID NO: 2644 - DNA, 525 bp, Artificial Sequence
  chemically treated genomic DNA (Homo sapiens) CpG-island No: 2644
caaacacaaaaaacaaaacccgctacaaccctacgacacgaaataccccgtattcgtataccaaccgaccatccgaaaaaccaacgaaatcgtaaaatacgaaccctaccaaaaataaaaccgcaaaacgacgccgcccgtcccgccacactcctcccgccctcgacaaaacgaaaatacgaacaaaaccccgaaacccccgaaaaacgactccacaaccgaaaaaaaaaaatacgtctaaatacaaaacccacgctcccgaaatcttcccccgccgtcctcaataaaaaaaacacgcaaaaaacgaacgatctaaaacgaacaaaacgactaaaaaccgaaacaaccgaaataaaaaaaaataatcccgaaacctaaccctatatatcgaacccaccccgccgaaaccgcaaccgtaaccccacgacgtctctaaacgaataaacccttcgacgaatctcccccaaccctactcaaacgatacccaaaacgataccaatacccgcgcctaaactacgtaaaaaa

SEQ ID NO: 2645 - DNA, 1688 bp, Artificial Sequence
  chemically treated genomic DNA (Homo sapiens) CpG-island No: 2645
aattatgcgattaggttacgttacgtagtatttatacgtttaattatgcgattaggtcgcgttacgtagcgttaatacgtttaattatgcgattaggttaggttacgtagtatttatacgtttaattatgcgattaggttgcgttatatagtatttatacgtttaattatgcgattaggttaggttacgtagtattaatacgttaaattatgcgattaggttaggttacgtagtatttatacgtttaattatgcgattaggttgcgttatatagtatttatacgtttaattatgcgattaggttaggttacgtagtattaatacgtttaattatgcgattaggttaggttacgtagtatttatacgtttaattatgcgattaggtcgcgttacgtagtatttatacgtttaattatgcgattaggtcgcgttatatagtatttatatatttaattatgcgattaggtcgcgttacgtagtattaatacgtttaattatgcgattaggtcgcgttacgtagtattaatacgtttaattatgcgattaggttaggttatgtagtatttatacgtttaattatgcgattaggttaggttacgtagtatttatacgtttaattatgcgattaggttaggttacgtagtatttatacgtttaattatgcgattaggttaggttatgtagtatttatacgttttagtatgcgattaggttaggttacgtagtatttatacgtttaattatgcgattaggttaggttacgtagtatttatacgtttaattatgcgattaggttgcgttatatagtatttatacgtttaattatgcgattaggttaggttacgtagtattaatacgtttaattatgcgattaggttaggttacgtagtatttatacgtttaattatgcgattaggttgcgttatatagtatttatacgtttaattatgcgattaggttaggttacgtagtattaatacgtttaattatgcgattaggttaggttacgtagtatttatacgtttaattatgcgattaggtcgcgttacgtagtatttatacgtttaattatgtaattaggtcgcgttatatagtatttatacgtttaattatgcgattaggtcgcgttacgtagtattaatacgtttaattatgcgattaggtcgcgttacgtagtattaatatgtttaattatgcgattaggttaggttacgtagtatttatacgtttaattatgcgattaggttaggttacgtagtatttatacgtttaattatgcgattaggttaggttacgtagtattaatacgtttaattatgcgattaggttaggttacgtagtatttatacgtttaattatgcgattaggtcgtattacgtagtattaatacgtttaattatgtaattaggtcgcgttacgtagtattaatacgttttattatgcgattaggttaggttacgtagtatttatacgtttaattatgcgattaggtcgcgttacgtagtatttatacgtttaattatgtaattaggtcgcgttatatagtattaatacgttttaattatatacgtacgcgtgcgcgcgcgcgcgcgcgcgcgtatatatatatatatatatattatatttttttttatcgagtttttttgagattttagttcgggacgggattgcgttgggagttttgtagg

SEQ ID NO: 2646 - DNA, 1688 bp, Artificial Sequence
  chemically treated genomic DNA (Homo sapiens) CpG-island No: 2646
cctacaaaactcccaacgcaatcccgtcccgaactaaaatctcaaaaaaactcgataaaaaaaaatataatatatatatatatatatatacgcgcgcgcgcgcgcgcgcgcacgcgtacgtatataattaaaacgtattaatactatataacgcgacctaattacataattaaacgtataaatactacgtaacgcgacctaatcgcataattaaacgtataaatactacgtaacctaacctaatcgcataataaaacgtattaatactacgtaacgcgacctaattacataattaaacgtattaatactacgtaatacgacctaatcgcataattaaacgtataaatactacgtaacctaacctaatcgcataattaaacgtattaatactacgtaacctaacctaatcgcataattaaacgtataaatactacgtaacctaacctaatcgcataattaaacgtataaatactacgtaacctaacctaatcgcataattaaacatattaatactacgtaacgcgacctaatcgcataattaaacgtattaatactacgtaacgcgacctaatcgcataattaaacgtataaatactatataacgcgacctaattacataattaaacgtataaatactacgtaacgcgacctaatcgcataattaaacgtataaatactacgtaacctaacctaatcgcataattaaacgtattaatactacgtaacctaacctaatcgcataattaaacgtataaatactatataacgcaacctaatcgcataattaaacgtataaatactacgtaacctaacctaatcgcataattaaacgtattaatactacgtaacctaacctaatcgcataattaaacgtataaatactatataacgcaacctaatcgcataattaaacgtataaatactacgtaacctaacctaatcgcataattaaacgtataaatactacgtaacctaacctaatcgcatactaaaacgtataaatactacataacctaacctaatcgcataattaaacgtataaatactacgtaacctaacctaatcgcataattaaacgtataaatactacgtaacctaacctaatcgcataattaaacgtataaatactacataacctaacctaatcgcataattaaacgtattaatactacgtaacgcgacctaatcgcataattaaacgtattaatactacgtaacgcgacctaatcgcataattaaatatataaatactatataacgcgacctaatcgcataattaaacgtataaatactacgtaacgcgacctaatcgcataattaaacgtataaatactacgtaacctaacctaatcgcataattaaacgtattaatactacgtaacctaacctaatcgcataattaaacgtataaatactatataacgcaacctaatcgcataattaaacgtataaatactacgtaacctaacctaatcgcataatttaacgtattaatactacgtaacctaacctaatcgcataattaaacgtataaatactatataacgcaacctaatcgcataattaaacgtataaatactacgtaacctaacctaatcgcataattaaacgtattaacgctacgtaacgcgacctaatcgcataattaaacgtataaatactacgtaacgtaacctaatcgcataatt

SEQ ID NO: 2647 - DNA, 1688 bp, Artificial Sequence
  chemically treated genomic DNA (Homo sapiens) CpG-island No: 2647
tttgtagagtttttagcgtagtttcgtttcgagttggggttttaggggagttcggtgggggggggtgtggtgtgtgtgtgtgtgtgtgtgcgcgcgcgcgcgcgcgcgcgtacgcgtgcgtgtgtggttggggcgtgttagtgttgtgtggcgcggtttggttgtatggttaagcgtgtgagtgttgcgtggcgcggtttggtcgtatggttaagcgtgtgagtgttgcgtgatttggtttggtcgtatggtaaagcgtgttagtgttgcgtggcgcggtttggttgtatggttaagcgtgttagtgttgcgtggtgcggtttggtcgtatggttaagcgtgtgagtgttgcgtggtttggtttggtcgtatggttaagcgtgttagtgttgcgtggtttggtttggtcgtatggttaagcgtgtgagtgttacgtggtttggtttggtcgtatggttaagcgtgtgagtgttgcgtggtttggtttggtcgtatggttaagtatgttagtgttacgtggcgcggtttggtcgtatggttaagcgtgttagtgttgcgtggcgcggtttggtcgtatggttaagcgtgtgagtgttgtgtggcgcggtttggttgtatggttaagcgtgtgagtgttgcgtggcgcggtttggtcgtatggttaagcgtgtgagtgttgcgtggtttggtttggtcgtatggttaagcgtgttagtgttgcgtggtttggtttggtcgtatggttaagcgtgtgagtgttgtgtggcgtagtttggtcgtatggttaagcgtgtgagtgttgcgtggtttggtttggtcgtatggttaagcgtgttagtgttgcgtggtttggtttggtcgtatggttaagcgtgtgagtgttgtgtggcgtagtttggtcgtatggttaagcgtgtgagtgttgcgtggtttggtttggtcgtatggttaagcgtgtgagtgttgcgtggtttggtttggtcgtatgttgaagcgtgtgagtgttgtatggtttggtttggtcgtatggttaagcgtgtgagtgttgcgtggtttggtttggtcgtatggttaagcgtgtgagtgttgcgtggtttggtttggtcgtatggttaagcgtgtgagtgttgtatggtttggtttggtcgtatggttaagcgtgttagtgttacgtggcgcggtttggtcgtatggttaagcgtgttagtgttgcgtggcgcggtttggtcgtatggttaagtgtgtgagtgttgtgtggcgcggtttggtcgtatggttaagcgtgtgagtgttgcgtggcgcggtttggtcgtatggttaagcgtgtgagtgttgcgtggtttggtttggtcgtatggttaagcgtgttagtgttgcgtggtttggtttggtcgtatggttaagcgtgtgagtgttgtgtggcgtagtttggtcgtatggttaaacgtgtgagtgttgcgtggtttggtttggtcgtatggtttagcgtgttagtgttgcgtggtttggtttggtcgtatggttaagcgtgtgagtgttgtgtggcgtagtttggtcgtatggttaagcgtgtgagtgttgcgtggtttggtttggtcgtatggttaagcgtgttagcgttgcgtggcgcggtttggtcgtatgattaagcgtgtgagtgttgcgtggcgtggtttggtcgtatggtt

SEQ ID NO: 2648 - DNA, 1688 bp, Artificial Sequence
  chemically treated genomic DNA (Homo sapiens) CpG-island No: 2648
aaccatacgaccaaaccacgccacgcaacactcacacgcttaatcatacgaccaaaccgcgccacgcaacgctaacacgcttaaccatacgaccaaaccaaaccacgcaacactcacacgcttaaccatacgaccaaactacgccacacaacactcacacgcttaaccatacgaccaaaccaaaccacgcaacactaacacgctaaaccatacgaccaaaccaaaccacgcaacactcacacgtttaaccatacgaccaaactacgccacacaacactcacacgcttaaccatacgaccaaaccaaaccacgcaacactaacacgcttaaccatacgaccaaaccaaaccacgcaacactcacacgcttaaccatacgaccaaaccgcgccacgcaacactcacacgcttaaccatacgaccaaaccgcgccacacaacactcacacacttaaccatacgaccaaaccgcgccacgcaacactaacacgcttaaccatacgaccaaaccgcgccacgtaacactaacacgcttaaccatacgaccaaaccaaaccatacaacactcacacgcttaaccatacgaccaaaccaaaccacgcaacactcacacgcttaaccatacgaccaaaccaaaccacgcaacactcacacgcttaaccatacgaccaaaccaaaccatacaacactcacacgcttcaacatacgaccaaaccaaaccacgcaacactcacacgcttaaccatacgaccaaaccaaaccacgcaacactcacacgcttaaccatacgaccaaactacgccacacaacactcacacgcttaaccatacgaccaaaccaaaccacgcaacactaacacgcttaaccatacgaccaaaccaaaccacgcaacactcacacgcttaaccatacgaccaaactacgccacacaacactcacacgcttaaccatacgaccaaaccaaaccacgcaacactaacacgcttaaccatacgaccaaaccaaaccacgcaacactcacacgcttaaccatacgaccaaaccgcgccacgcaacactcacacgcttaaccatacaaccaaaccgcgccacacaacactcacacgcttaaccatacgaccaaaccgcgccacgcaacactaacacgcttaaccatacgaccaaaccgcgccacgtaacactaacatacttaaccatacgaccaaaccaaaccacgcaacactcacacgcttaaccatacgaccaaaccaaaccacgtaacactcacacgcttaaccatacgaccaaaccaaaccacgcaacactaacacgcttaaccatacgaccaaaccaaaccacgcaacactcacacgcttaaccatacgaccaaaccgcaccacgcaacactaacacgcttaaccatacaaccaaaccgcgccacgcaacactaacacgctttaccatacgaccaaaccaaatcacgcaacactcacacgcttaaccatacgaccaaaccgcgccacgcaacactcacacgcttaaccatacaaccaaaccgcgccacacaacactaacacgccccaaccacacacgcacgcgtacgcgcgcgcgcgcgcgcgcgcacacacacacacacacacaccacacccccccccaccgaactcccctaaaaccccaactcgaaacgaaactacgctaaaaactctacaaa

SEQ ID NO: 2649 - DNA, 623 bp, Artificial Sequence
  chemically treated genomic DNA (Homo sapiens) CpG-island No: 2649
ggggcggagcgtgaaaaatagttcgtgcgtttcggtcgattttgtagtgcgacgggcggagtttttagacgtttcgttttacgtcgtatgcgtttcgggaacgcgtggggcggagttttcggaggtttcgttttgttgtcgattttgtggagcggagggtgaagttttcggatgttagttttttatcgttggttcggtcgcgttgtggcgaagggggcggagtttgtattcgtttcgttttttttcgtttcgttcgtttcgcgtcgcgcggggaggaggaggaggagtcgcggcggggttcgtattgtagcgttagcgttcgagcgggcggtcgagttttcggagcggtttggtttcgagtttcgagcgggcgtcgtttagtagtaggtcgcggtcgtagttttatttagtttcgcgttcgttatgtcgttcgcgggtttcgtttgagttgcggttttcgcgcgcgggcgggtttggggacggcggggttatgcgcgcgttgttttaacgatgtcgttcgtcgcgttcgttcgtttggcgttggttttgggtttgggtttgtggttcggggcgttggcggggggtttcgggcgcggttgcgggttttgcgagtttttttgttt

SEQ ID NO: 2650 - DNA, 623 bp, Artificial Sequence
  chemically treated genomic DNA (Homo sapiens) CpG-island No: 2650
aaacaaaaaaactcgcaaaacccgcaaccgcgcccgaaaccccccgccaacgccccgaaccacaaacccaaacccaaaaccaacgccaaacgaacgaacgcgacgaacgacatcgttaaaacaacgcgcgcataaccccgccgtccccaaacccgcccgcgcgcgaaaaccgcaactcaaacgaaacccgcgaacgacataacgaacgcgaaactaaataaaactacgaccgcgacctactactaaacgacgcccgctcgaaactcgaaaccaaaccgctccgaaaactcgaccgcccgctcgaacgctaacgctacaatacgaaccccgccgcgactcctcctcctcctccccgcgcgacgcgaaacgaacgaaacgaaaaaaaacgaaacgaatacaaactccgcccccttcgccacaacgcgaccgaaccaacgataaaaaactaacatccgaaaacttcaccctccgctccacaaaatcgacaacaaaacgaaacctccgaaaactccgccccacgcgttcccgaaacgcatacgacgtaaaacgaaacgtctaaaaactccgcccgtcgcactacaaaatcgaccgaaacgcacgaactatttttcacgctccgcccc

SEQ ID NO: 2651 - DNA, 623 bp, Artificial Sequence
  chemically treated genomic DNA (Homo sapiens) CpG-island No: 2651
aggtaggggggttcgtagggttcgtagtcgcgttcggggtttttcgttagcgtttcgagttataggtttaggtttagggttagcgttaggcgggcgggcgcggcgggcggtatcgttagggtagcgcgcgtatggtttcgtcgtttttaggttcgttcgcgcgcggaggtcgtagtttaggcggggttcgcggacggtatggcgggcgcggggttggatggggttgcggtcgcgatttgttgttgagcgacgttcgttcggggttcggggttaggtcgtttcgggagttcggtcgttcgttcggacgttggcgttgtagtgcgggtttcgtcgcggtttttttttttttttttcgcgcggcgcggggcggacggggcgagggggggcggggcgggtgtaggtttcgtttttttcgttatagcgcgatcgggttagcgatgagggattggtattcggaggttttatttttcgttttatagggtcggtagtagggcggggttttcggaagtttcgttttacgcgttttcggggcgtatgcgacgtggggcggagcgtttggaagtttcgttcgtcgtattgtagagtcggtcgaggcgtacgagttattttttacgtttcgtttt

SEQ ID NO: 2652 - DNA, 623 bp, Artificial Sequence
  chemically treated genomic DNA (Homo sapiens) CpG-island No: 2652
aaaacgaaacgtaaaaaataactcgtacgcctcgaccgactctacaatacgacgaacgaaacttccaaacgctccgccccacgtcgcatacgccccgaaaacgcgtaaaacgaaacttccgaaaaccccgccctactaccgaccctataaaacgaaaaataaaacctccgaataccaatccctcatcgctaacccgatcgcgctataacgaaaaaaacgaaacctacacccgccccgccccccctcgccccgtccgccccgcgccgcgcgaaaaaaaaaaaaaaaaaccgcgacgaaacccgcactacaacgccaacgtccgaacgaacgaccgaactcccgaaacgacctaaccccgaaccccgaacgaacgtcgctcaacaacaaatcgcgaccgcaaccccatccaaccccgcgcccgccataccgtccgcgaaccccgcctaaactacgacctccgcgcgcgaacgaacctaaaaacgacgaaaccatacgcgcgctaccctaacgataccgcccgccgcgcccgcccgcctaacgctaaccctaaacctaaacctataactcgaaacgctaacgaaaaaccccgaacgcgactacgaaccctacgaacccccctacct

SEQ ID NO: 2653 - DNA, 1231 bp, Artificial Sequence
  chemically treated genomic DNA (Homo sapiens) CpG-island No: 2653
cgcgggaggaggcgaggggttttcgttcgtttcgtcgtcgcgattttttttattttttcggtttgcggggttttttttttgggttcgcgcgttcggtttttttttcgggttttttcgagggcgggacgtttcgggttttttcgtttttttaggttatttttcggtcgtgttttagcgttgttttcgggtcgggggcggggtcgcggggggggggtggcgtgaggatggggtcgaggaggacgcgcgcggttcggcgttttattttttttttttatttttttttttcggtgttcgtttttcgcggtcgcgtcgtttttttttttttttttttcggtttagcgtcggttttcgtcgttttttttttcgacgcgtacgtttcgtttggtagttggcgtttcgggtttggggtcgtagcggtgagaggggttttgttgggagggagggagcgagcgagcgaggggaggggtggaggtcgtttttcgcgtttttttttttcgttttttttcgcggtcggcgggtttttttttcgtcgtttttttttttttttttttcgttcgttcgttttttttttaagatattttcgtacggttcggtcgtcgcggttattttttttgttcgagttgtagatgtggcggagcggtcgggcgtcgggcggtcgtgttaggggagttcgcgtttcgtgaggtttcgcgtttcggttttcgttcgtttcggtttttttttcgttcggtttttcgcgtttttcgatcgtcggagttcgtagttcggatttcgatcgttttcgtcgttgaggtaggaagtttttcgggcgtcgcgtcgtggggatcgggtcggggcgggggggggggggttcgtttgtcgcgtcggggttgcggggttcgagggttttttttttcgttcgcgttcgcgtttcgggttattgtgagttttcgtcgaggttttcgcgttcgttcgttcgttggttcgcgcgttttttttttcgtcggtttttcggtcgggtttttcgagttttcggtttttttttttttttttttttttttttcgtttggaggtcgggtcgagtagcgttcgggttcggggcgggcgtaaattttagttgggaagttgggcggtcgcggtggggggcgtgcggcgaggtgagaggggggtattcggagtttgggtatgaagttgttcggggtagtcgttttttttttcggtcgcgtcggggttgttgttaggaagggttttg

SEQ ID NO: 2654 - DNA, 1231 bp, Artificial Sequence
  chemically treated genomic DNA (Homo sapiens) CpG-island No: 2654
caaaacccttcctaacaacaaccccgacgcgaccgaaaaaaaaaacgactaccccgaacaacttcatacccaaactccgaatacccccctctcacctcgccgcacgccccccaccgcgaccgcccaacttcccaactaaaatttacgcccgccccgaacccgaacgctactcgacccgacctccaaacgaaaaaaaaaaaaaaaaaaaaaaaaaaaccgaaaactcgaaaaacccgaccgaaaaaccgacgaaaaaaaaaacgcgcgaaccaacgaacgaacgaacgcgaaaacctcgacgaaaactcacaataacccgaaacgcgaacgcgaacgaaaaaaaaaaccctcgaaccccgcaaccccgacgcgacaaacgaacccccccccccccgccccgacccgatccccacgacgcgacgcccgaaaaacttcctacctcaacgacgaaaacgatcgaaatccgaactacgaactccgacgatcgaaaaacgcgaaaaaccgaacgaaaaaaaaaccgaaacgaacgaaaaccgaaacgcgaaacctcacgaaacgcgaactcccctaacacgaccgcccgacgcccgaccgctccgccacatctacaactcgaacaaaaaaaataaccgcgacgaccgaaccgtacgaaaatatcttaaaaaaaaaacgaacgaacgaaaaaaaaaaaaaaaaaaacgacgaaaaaaaaacccgccgaccgcgaaaaaaaacgaaaaaaaaaaacgcgaaaaacgacctccacccctcccctcgctcgctcgctccctccctcccaacaaaacccctctcaccgctacgaccccaaacccgaaacgccaactaccaaacgaaacgtacgcgtcgaaaaaaaaaacgacgaaaaccgacgctaaaccgaaaaaaaaaaaaaaaaaaacgacgcgaccgcgaaaaacgaacaccgaaaaaaaaaaataaaaaaaaaaaataaaacgccgaaccgcgcgcgtcctcctcgaccccatcctcacgccaccccccccccgcgaccccgcccccgacccgaaaacaacgctaaaacacgaccgaaaaataacctaaaaaaacgaaaaaacccgaaacgtcccgccctcgaaaaaacccgaaaaaaaaaccgaacgcgcgaacccaaaaaaaaaaccccgcaaaccgaaaaaataaaaaaaatcgcgacgacgaaacgaacgaaaacccctcgcctcctcccgcg

SEQ ID NO: 2655 - DNA, 1231 bp, Artificial Sequence
  chemically treated genomic DNA (Homo sapiens) CpG-island No: 2655
taaagttttttttagtagtagtttcggcgcggtcgagaggaggggcggttgtttcggataattttatgtttaggtttcgggtattttttttttatttcgtcgtacgttttttatcgcggtcgtttaattttttagttgaagtttgcgttcgtttcgggttcgggcgttgttcggttcggtttttagacggagggaaggaaggagggagaagaaagatcgagagttcgagggattcggtcggggagtcggcgagggagggagcgcgcgagttagcgagcgagcgaacgcgggggtttcggcgagggtttataatggttcggggcgcggacgcgagcgggggaggagattttcgggtttcgtagtttcggcgcgataggcgggttttttttttttcgtttcggttcggtttttacggcgcgacgttcggggggttttttattttagcggcgggggcggtcgggattcgggttgcgggtttcggcggtcggggggcgcggggagtcgagcgggggaggggtcgggacgggcgggggtcggggcgcgaggttttacggggcgcgggtttttttggtacggtcgttcggcgttcggtcgtttcgttatatttgtagttcgggtagggaaggtggtcgcggcggtcgggtcgtgcggggatgttttagagggagggcgggcgggcgggaggagggaggagggaggcggcgggaggagggttcgtcggtcgcggaggagggcgaggaggaggggcgcggggggcggtttttattttttttttcgttcgttcgtttttttttttttagtaaaattttttttatcgttgcggttttaggttcggggcgttagttgttaggcggggcgtgcgcgtcgggggagggggcggcgggagtcggcgttgggtcgagggagggggaagggagggcggcgcggtcgcggggagcgggtatcgggagggaggggtgagggagggaagtggggcgtcgagtcgcgcgcgtttttttcggttttatttttacgttatttttttttcgcggtttcgttttcggttcgagggtagcgttaggatacggtcgggaggtggtttgggggggcgggggagttcgagacgtttcgttttcggggaagttcgaggagggggtcgggcgcgcgggtttagaggaaaagtttcgtagatcgggaagatggaggaggtcgcggcggcggagcgggcggggatttttcgttttttttcgcg

SEQ ID NO: 2656 - DNA, 1231 bp, Artificial Sequence
  chemically treated genomic DNA (Homo sapiens) CpG-island No: 2656
cgcgaaaaaaaacgaaaaatccccgcccgctccgccgccgcgacctcctccatcttcccgatctacgaaacttttcctctaaacccgcgcgcccgaccccctcctcgaacttccccgaaaacgaaacgtctcgaactcccccgcccccccaaaccacctcccgaccgtatcctaacgctaccctcgaaccgaaaacgaaaccgcgaaaaaaaaataacgtaaaaataaaaccgaaaaaaacgcgcgcgactcgacgccccacttccctccctcacccctccctcccgatacccgctccccgcgaccgcgccgccctcccttccccctccctcgacccaacgccgactcccgccgccccctcccccgacgcgcacgccccgcctaacaactaacgccccgaacctaaaaccgcaacgataaaaaaaattttactaaaaaaaaaaaaacgaacgaacgaaaaaaaaaataaaaaccgccccccgcgcccctcctcctcgccctcctccgcgaccgacgaaccctcctcccgccgcctccctcctccctcctcccgcccgcccgccctccctctaaaacatccccgcacgacccgaccgccgcgaccaccttccctacccgaactacaaatataacgaaacgaccgaacgccgaacgaccgtaccaaaaaaacccgcgccccgtaaaacctcgcgccccgacccccgcccgtcccgacccctcccccgctcgactccccgcgccccccgaccgccgaaacccgcaacccgaatcccgaccgcccccgccgctaaaataaaaaaccccccgaacgtcgcgccgtaaaaaccgaaccgaaacgaaaaaaaaaaaacccgcctatcgcgccgaaactacgaaacccgaaaatctcctcccccgctcgcgtccgcgccccgaaccattataaaccctcgccgaaacccccgcgttcgctcgctcgctaactcgcgcgctccctccctcgccgactccccgaccgaatccctcgaactctcgatctttcttctccctccttccttccctccgtctaaaaaccgaaccgaacaacgcccgaacccgaaacgaacgcaaacttcaactaaaaaattaaacgaccgcgataaaaaacgtacgacgaaataaaaaaaaaatacccgaaacctaaacataaaattatccgaaacaaccgcccctcctctcgaccgcgccgaaactactactaaaaaaaacttta

SEQ ID NO: 2657 - DNA, 700 bp, Artificial Sequence
  chemically treated genomic DNA (Homo sapiens) CpG-island No: 2657
ggaatgcgtgggtttcggttcgtcggaagtttttttttttaggggtttagtttatttttaaattgtttcgcgtgaattgtttcgcgggcgcgtacgttttttcgcgtagtttttgtagtcggttggcgggagatttcggtcgtttttttttcgtcggtagaagttcggtcggggaagtttcggttgcgtacgtttatttttaggatttcggagtttttagcggttgtcgtagtttcgcgaattatttgtaagtttcgcggcgtcgtagtttttttttttttttttcgggtattcgttttttagttcgcgttttttttttagattttcgatttttggttttgttttcgttttttgtgtttcggcggttgcggggttcgtcgtaaagagttaagagtcggttttcgagacggtttcggcggtttcgggtttttagatttcgttcgtcgtttttgattggttgagcgtttgttagtagtaaagggtattagatggtaaagttgggatttttataaaggcgtggtggcgatttttcgtaatcgtcggtagtttatgatattagataggaacgtttgggatgtcgcgttgtttttggttaattttcgaggaggaggagggtttcgtcggttaagagttaattagtttcgtacggcgaggggggaggcgttagttttttggggatattggttgttattgtattttt

SEQ ID NO: 2658 - DNA, 700 bp, Artificial Sequence
  chemically treated genomic DNA (Homo sapiens) CpG-island No: 2658
aaaaatacaataacaaccaatatccccaaaaaactaacgcctcccccctcgccgtacgaaactaattaactcttaaccgacgaaaccctcctcctcctcgaaaattaaccaaaaacaacgcgacatcccaaacgttcctatctaatatcataaactaccgacgattacgaaaaatcgccaccacgcctttataaaaatcccaactttaccatctaataccctttactactaacaaacgctcaaccaatcaaaaacgacgaacgaaatctaaaaacccgaaaccgccgaaaccgtctcgaaaaccgactcttaactctttacgacgaaccccgcaaccgccgaaacacaaaaaacgaaaacaaaaccaaaaatcgaaaatctaaaaaaaaaacgcgaactaaaaaacgaatacccgaaaaaaaaaaaaaaaaactacgacgccgcgaaacttacaaataattcgcgaaactacgacaaccgctaaaaactccgaaatcctaaaaataaacgtacgcaaccgaaacttccccgaccgaacttctaccgacgaaaaaaaaacgaccgaaatctcccgccaaccgactacaaaaactacgcgaaaaaacgtacgcgcccgcgaaacaattcacgcgaaacaatttaaaaataaactaaacccctaaaaaaaaaaacttccgacgaaccgaaacccacgcattcc

SEQ ID NO: 2659 - DNA, 700 bp, Artificial Sequence
  chemically treated genomic DNA (Homo sapiens) CpG-island No: 2659
aggagtatagtggtagttagtgtttttagaaaattggcgttttttttttcgtcgtgcggggttaattaatttttagtcggcgggatttttttttttttcggaggttggttaggagtagcgcggtattttaggcgtttttgtttgatgttataggttgtcggcgattgcggagaatcgttattacgtttttatgaaggttttaattttgttatttgatattttttattattgataggcgtttagttaattaggagcggcgagcggggtttggggattcggagtcgtcgaagtcgtttcgggaatcggtttttaattttttgcggcgggtttcgtagtcgtcgaggtatagagggcgggagtagggttaggggtcgggaatttgggagaggggcgcgagttaaagagcggatgttcggaggaaagaaggaagggttgcgacgtcgcggggtttgtaggtggttcgcggggttgcggtagtcgttgggagtttcgaggttttggggatgggcgtgcgtagtcggggttttttcggtcgggtttttgtcggcgaaagggaagcggtcgggatttttcgttagtcggttgtaaaggttgcgcgaaagggcgtgcgcgttcgcgggatagtttacgcggggtaatttggaaataagttggatttttgagaagaaaagttttcgacggatcgaagtttacgtatttt

SEQ ID NO: 2660 - DNA, 700 bp, Artificial Sequence
  chemically treated genomic DNA (Homo sapiens) CpG-island No: 2660
aaaatacgtaaacttcgatccgtcgaaaacttttcttctcaaaaatccaacttatttccaaattaccccgcgtaaactatcccgcgaacgcgcacgccctttcgcgcaacctttacaaccgactaacgaaaaatcccgaccgcttccctttcgccgacaaaaacccgaccgaaaaaaccccgactacgcacgcccatccccaaaacctcgaaactcccaacgactaccgcaaccccgcgaaccacctacaaaccccgcgacgtcgcaacccttccttctttcctccgaacatccgctctttaactcgcgcccctctcccaaattcccgacccctaaccctactcccgccctctatacctcgacgactacgaaacccgccgcaaaaaattaaaaaccgattcccgaaacgacttcgacgactccgaatccccaaaccccgctcgccgctcctaattaactaaacgcctatcaataataaaaaatatcaaataacaaaattaaaaccttcataaaaacgtaataacgattctccgcaatcgccgacaacctataacatcaaacaaaaacgcctaaaataccgcgctactcctaaccaacctccgaaaaaaaaaaaaatcccgccgactaaaaattaattaaccccgcacgacgaaaaaaaaaacgccaattttctaaaaacactaactaccactatactcct

SEQ ID NO: 2661 - DNA, 660 bp, Artificial Sequence
  chemically treated genomic DNA (Homo sapiens) CpG-island No: 2661
ggcgtcggttagggcggacgggttagggtgtttatcggtattaggcgaggtcgcgttcgtagtatttgtcgaagaagtggggtttagagtttagcgcgcggacgtcggggtgtagtcgtagaaattttagtagggcgcgcgtgtcgtttttttttacgttaacgatgagcgtttgcgggaagcgtcggcggtcgggatcgttggttaaaggtaggtcgggtgttttcgggcggtggacggagttggacggttcggagggcgcgggggtcggcgcgggggcgcgggcggtcggcgggtagcggtcggggagggcgtagaggtagtaggcgtcgagtattagggttacgagtagtatcggcgcgcgggacgttcgtagagcggttttttgttcggtttttgcgttttggtcgttttcggtttcgtcgtttaggtcgtcgttatttgttatggggtcgcgtcgtttttaggttcgggagcgggggtagtaggcgggcgcgtatttcggttcgcgcgtcgtttagttcgtgggtgttcggtttgtgttttgcgttcggcggtttcgtagtttgggagcgggcgcggggcgggatcgggggcggggtttggacgtttttttttttttttttttttcgtttatttcgttttcgaggttattgtttg

SEQ ID NO: 2662 - DNA, 660 bp, Artificial Sequence
  chemically treated genomic DNA (Homo sapiens) CpG-island No: 2662
caaacaataacctcgaaaacgaaataaacgaaaaaaaaaaaaaaaaaaaaacgtccaaaccccgcccccgatcccgccccgcgcccgctcccaaactacgaaaccgccgaacgcaaaacacaaaccgaacacccacgaactaaacgacgcgcgaaccgaaatacgcgcccgcctactacccccgctcccgaacctaaaaacgacgcgaccccataacaaataacgacgacctaaacgacgaaaccgaaaacgaccaaaacgcaaaaaccgaacaaaaaaccgctctacgaacgtcccgcgcgccgatactactcgtaaccctaatactcgacgcctactacctctacgccctccccgaccgctacccgccgaccgcccgcgcccccgcgccgacccccgcgccctccgaaccgtccaactccgtccaccgcccgaaaacacccgacctacctttaaccaacgatcccgaccgccgacgcttcccgcaaacgctcatcgttaacgtaaaaaaaaacgacacgcgcgccctactaaaatttctacgactacaccccgacgtccgcgcgctaaactctaaaccccacttcttcgacaaatactacgaacgcgacctcgcctaataccgataaacaccctaacccgtccgccctaaccgacgcc

SEQ ID NO: 2663 - DNA, 660 bp, Artificial Sequence
  chemically treated genomic DNA (Homo sapiens) CpG-island No: 2663
taggtagtggtttcggaggcggagtgggcgggggagggggaggggggagggcgtttagatttcgttttcggtttcgtttcgcgttcgtttttaggttgcgggatcgtcgggcgtagagtataagtcgggtatttacggattgagcggcgcgcgggtcgagatgcgcgttcgtttgttgttttcgttttcgggtttgggagcggcgcgattttatggtaggtagcggcggtttgggcggcggggtcgggggcggttagggcgtaggggtcgggtaaggggtcgttttgcgggcgtttcgcgcgtcgatgttgttcgtggttttggtgttcggcgtttattgtttttgcgtttttttcggtcgttgttcgtcggtcgttcgcgttttcgcgtcggttttcgcgtttttcgagtcgtttagtttcgtttatcgttcgggagtattcggtttgtttttggttagcggtttcggtcgtcggcgtttttcgtaagcgtttatcgttggcgtgaagaagggcggtacgcgcgttttgttggagtttttgcggttgtatttcgacgttcgcgcgttgggttttgagttttattttttcgataggtgttacgagcgcggtttcgtttggtatcggtgagtattttggttcgttcgttttgatcggcgtt

SEQ ID NO: 2664 - DNA, 660 bp, Artificial Sequence
  chemically treated genomic DNA (Homo sapiens) CpG-island No: 2664
aacgccgatcaaaacgaacgaaccaaaatactcaccgataccaaacgaaaccgcgctcgtaacacctatcgaaaaaataaaactcaaaacccaacgcgcgaacgtcgaaatacaaccgcaaaaactccaacaaaacgcgcgtaccgcccttcttcacgccaacgataaacgcttacgaaaaacgccgacgaccgaaaccgctaaccaaaaacaaaccgaatactcccgaacgataaacgaaactaaacgactcgaaaaacgcgaaaaccgacgcgaaaacgcgaacgaccgacgaacaacgaccgaaaaaaacgcaaaaacaataaacgccgaacaccaaaaccacgaacaacatcgacgcgcgaaacgcccgcaaaacgaccccttacccgacccctacgccctaaccgcccccgaccccgccgcccaaaccgccgctacctaccataaaatcgcgccgctcccaaacccgaaaacgaaaacaacaaacgaacgcgcatctcgacccgcgcgccgctcaatccgtaaatacccgacttatactctacgcccgacgatcccgcaacctaaaaacgaacgcgaaacgaaaccgaaaacgaaatctaaacgccctcccccctccccctcccccgcccactccgcctccgaaaccactaccta

SEQ ID NO: 2665 - DNA, 881 bp, Artificial Sequence
  chemically treated genomic DNA (Homo sapiens) CpG-island No: 2665
tacgtatttggtagtttttcgcgagatttagataagggttttcgtttaggagcgcggattcgggagtttagattcgattcgatgttcgcggattttcgtcgtttacgtagaggttcgttgtagcgattaataggatttacgtgttttgtcggaaaagaagaacgagatttattgggaagtagtttttatagtacgttaagcgtcgcgagattttcgtagtttcgttttaagcgggagcgggtcgagtttttataagataatttgtgattggtttcgcggtgtttcgtttttatcgggttttgagtgtttttgttcgttcggttttagtcgcggttcgggaatttacgttattcgaaaagcgattataaacgtcggcgttttcgtttttagtcgcggttcgggaatttattcgaagagtggttataaacgttcgcgtttttattgcgtttttttttttatttaggtaggttttgtcgcgttgattattggcgtttcgttggtggttttcgagatcggcgttggttgaaaatcgttttcggttttggtcgtggtcgcgggtgagattcggcgtttagagttttcgggggttttagtttatcgcgcgttgttttatgtgcggcggtgaaatttaggtttcgataggcgttgtcgtttttttttcgggtgcggtcgttcgcgaggtttggtttttgatttttgatttcgattgtagatttttaattttgtttttttttcgtaggatattggtttttttacgtttgatatcgacgtcgttaggatcgcggggttgggggaatttggttgttttacgttttttaaataaagttgttttgtttaatttattgtatgcgggtgtttttggggtttcgattcgtttatta

SEQ ID NO: 2666 - DNA, 881 bp, Artificial Sequence
  chemically treated genomic DNA (Homo sapiens) CpG-island No: 2666
taataaacgaatcgaaaccccaaaaacacccgcatacaataaattaaacaaaacaactttatttaaaaaacgtaaaacaaccaaattcccccaaccccgcgatcctaacgacgtcgatatcaaacgtaaaaaaaccaatatcctacgaaaaaaaaacaaaattaaaaatctacaatcgaaatcaaaaatcaaaaaccaaacctcgcgaacgaccgcacccgaaaaaaaaacgacaacgcctatcgaaacctaaatttcaccgccgcacataaaacaacgcgcgataaactaaaacccccgaaaactctaaacgccgaatctcacccgcgaccacgaccaaaaccgaaaacgattttcaaccaacgccgatctcgaaaaccaccaacgaaacgccaataatcaacgcgacaaaacctacctaaataaaaaaaaaaacgcaataaaaacgcgaacgtttataaccactcttcgaataaattcccgaaccgcgactaaaaacgaaaacgccgacgtttataatcgcttttcgaataacgtaaattcccgaaccgcgactaaaaccgaacgaacaaaaacactcaaaacccgataaaaacgaaacaccgcgaaaccaatcacaaattatcttataaaaactcgacccgctcccgcttaaaacgaaactacgaaaatctcgcgacgcttaacgtactataaaaactacttcccaataaatctcgttcttcttttccgacaaaacacgtaaatcctattaatcgctacaacgaacctctacgtaaacgacgaaaatccgcgaacatcgaatcgaatctaaactcccgaatccgcgctcctaaacgaaaacccttatctaaatctcgcgaaaaactaccaaatacgta

SEQ ID NO: 2667 - DNA, 881 bp, Artificial Sequence
  chemically treated genomic DNA (Homo sapiens) CpG-island No: 2667
tgataggcgagtcggggttttaagaatattcgtatgtagtgagttagataaaatagttttatttgaaagacgtgggatagttaagtttttttaatttcgcggttttggcgacgtcggtgttaggcgtgggaggattagtgttttgcggagaaagaataaggttaggggtttgtagtcggggttaggagttaggggttagatttcgcgagcgatcgtattcgggggggaggcggtagcgtttgtcggggtttgggttttatcgtcgtatatggggtagcgcgcggtgagttgaggttttcgggggttttgggcgtcgaattttattcgcggttacggttaaagtcgggggcgatttttaattaacgtcggtttcgaagattattagcgagacgttagtggttaacgcggtaggatttatttaagtgaagaggagagcgtaatggaggcgcggacgtttatagttatttttcgggtggattttcgagtcgcggttggggacggaggcgtcggcgtttatagtcgtttttcgggtgacgtagattttcgggtcgcggttggggtcggacgggtaagagtatttagagttcggtgagggcggggtatcgcggagttaattataggttgttttataggagttcggttcgttttcgtttggggcggggttgcggagatttcgcggcgtttggcgtgttataaaagttgttttttagtaggtttcgtttttttttttcgataaaatacgtgagttttgttggtcgttgtagcgggtttttgcgtgggcggcgggaattcgcggatatcgggtcgggtttaggttttcgagttcgcgtttttgggcgggagtttttgtttgggtttcgcggggggttgttagatgcgta

SEQ ID NO: 2668 - DNA, 881 bp, Artificial Sequence
  chemically treated genomic DNA (Homo sapiens) CpG-island No: 2668
tacgcatctaacaaccccccgcgaaacccaaacaaaaactcccgcccaaaaacgcgaactcgaaaacctaaacccgacccgatatccgcgaattcccgccgcccacgcaaaaacccgctacaacgaccaacaaaactcacgtattttatcgaaaaaaaaaaacgaaacctactaaaaaacaacttttataacacgccaaacgccgcgaaatctccgcaaccccgccccaaacgaaaacgaaccgaactcctataaaacaacctataattaactccgcgataccccgccctcaccgaactctaaatactcttacccgtccgaccccaaccgcgacccgaaaatctacgtcacccgaaaaacgactataaacgccgacgcctccgtccccaaccgcgactcgaaaatccacccgaaaaataactataaacgtccgcgcctccattacgctctcctcttcacttaaataaatcctaccgcgttaaccactaacgtctcgctaataatcttcgaaaccgacgttaattaaaaatcgcccccgactttaaccgtaaccgcgaataaaattcgacgcccaaaacccccgaaaacctcaactcaccgcgcgctaccccatatacgacgataaaacccaaaccccgacaaacgctaccgcctcccccccgaatacgatcgctcgcgaaatctaacccctaactcctaaccccgactacaaacccctaaccttattctttctccgcaaaacactaatcctcccacgcctaacaccgacgtcgccaaaaccgcgaaattaaaaaaacttaactatcccacgtctttcaaataaaactattttatctaactcactacatacgaatattcttaaaaccccgactcgcctatca

SEQ ID NO: 2669 - DNA, 767 bp, Artificial Sequence
  chemically treated genomic DNA (Homo sapiens) CpG-island No: 2669
cgtacggatcgtattcgatagttggtatttttatattttagaacgtcgaaaagtaggagtaaacgttggttataaatgtttttttatattggtattaaagagttaggttattagcgatgttatattcgtcggtttatttttatcgattcgcgaagtatttttatagtttacggttttttttttaggtcggaaacgttttcgttcgttttcgtttttcgatgtagtcgttattgttcgaagtaaagatggcgttaagtgcgcggcgtcggcggggacgttatagtggtcgcgcgcggtgacgttatcgtagcgcgtcgggagtgtggcgttttgtgaagagttcggtgttaattttttttacgcggcggtggttgtcgggattttagtaggttttagttggagcggcggcggcggtaatatggtagagatcgcggtcggagtgggtcgttttaagattaagtgagttcggagttttggggtcgtgcggggagggagttgggtttgtagtcggtatagcggaggcgcgcgtggggtgggtacgtattggggttcgtggaggcgagaggttgtgtgtgcgtcggttcgcggggtcgcggaggttgcggtgatattaggcgggagagtcggtttcggttgttttcggggaggacggcgatcggagttcggtcgtcgggagtagtagcgtgggtttatcgagaagtcggttatggggtggagtggggattagaagtttcgatgaggggaggagagggttgagtttaggtcgg

SEQ ID NO: 2670 - DNA, 767 bp, Artificial Sequence
  chemically treated genomic DNA (Homo sapiens) CpG-island No: 2670
ccgacctaaactcaaccctctcctcccctcatcgaaacttctaatccccactccaccccataaccgacttctcgataaacccacgctactactcccgacgaccgaactccgatcgccgtcctccccgaaaacaaccgaaaccgactctcccgcctaatatcaccgcaacctccgcgaccccgcgaaccgacgcacacacaacctctcgcctccacgaaccccaatacgtacccaccccacgcgcgcctccgctataccgactacaaacccaactccctccccgcacgaccccaaaactccgaactcacttaatcttaaaacgacccactccgaccgcgatctctaccatattaccgccgccgccgctccaactaaaacctactaaaatcccgacaaccaccgccgcgtaaaaaaaattaacaccgaactcttcacaaaacgccacactcccgacgcgctacgataacgtcaccgcgcgcgaccactataacgtccccgccgacgccgcgcacttaacgccatctttacttcgaacaataacgactacatcgaaaaacgaaaacgaacgaaaacgtttccgacctaaaaaaaaaaccgtaaactataaaaatacttcgcgaatcgataaaaataaaccgacgaatataacatcgctaataacctaactctttaataccaatataaaaaaacatttataaccaacgtttactcctacttttcgacgttctaaaatataaaaataccaactatcgaatacgatccgtacg

SEQ ID NO: 2671 - DNA, 767 bp, Artificial Sequence
  chemically treated genomic DNA (Homo sapiens) CpG-island No: 2671
tcgatttaggtttagtttttttttttttttatcgggatttttggtttttattttattttatagtcggtttttcgatgagtttacgttgttgttttcggcggtcgggtttcgatcgtcgtttttttcgagagtagtcggggtcggttttttcgtttagtattatcgtagttttcgcgatttcgcgggtcggcgtatatatagtttttcgtttttacggattttaatgcgtgtttattttacgcgcgttttcgttatgtcggttgtaaatttagtttttttttcgtacggttttagagtttcgggtttatttggttttgaagcggtttatttcggtcgcggtttttgttatgttgtcgtcgtcgtcgttttagttgaaatttgttagggtttcggtagttatcgtcgcgtgagggaggttagtatcgaattttttatagaacgttatattttcggcgcgttgcgatggcgttatcgcgcgcgattattgtgacgttttcgtcggcgtcgcgtatttggcgttatttttgtttcgggtagtggcggttgtatcgggaagcggaagcgggcggagacgttttcggtttggagggagggtcgtgagttgtgagggtgtttcgcgggtcggtgggggtagatcggcggatgtggtatcgttggtggtttggttttttgatattagtataaaaaggtatttgtagttagcgtttatttttgtttttcggcgttttgggatgtgggggtattagttgtcgggtgcggttcgtgcg

SEQ ID NO: 2672 - DNA, 767 bp, Artificial Sequence
  chemically treated genomic DNA (Homo sapiens) CpG-island No: 2672
cgcacgaaccgcacccgacaactaatacccccacatcccaaaacgccgaaaaacaaaaataaacgctaactacaaatacctttttatactaatatcaaaaaaccaaaccaccaacgataccacatccgccgatctacccccaccgacccgcgaaacaccctcacaactcacgaccctccctccaaaccgaaaacgtctccgcccgcttccgcttcccgatacaaccgccactacccgaaacaaaaataacgccaaatacgcgacgccgacgaaaacgtcacaataatcgcgcgcgataacgccatcgcaacgcgccgaaaatataacgttctataaaaaattcgatactaacctccctcacgcgacgataactaccgaaaccctaacaaatttcaactaaaacgacgacgacgacaacataacaaaaaccgcgaccgaaataaaccgcttcaaaaccaaataaacccgaaactctaaaaccgtacgaaaaaaaaactaaatttacaaccgacataacgaaaacgcgcgtaaaataaacacgcattaaaatccgtaaaaacgaaaaactatatatacgccgacccgcgaaatcgcgaaaactacgataatactaaacgaaaaaaccgaccccgactactctcgaaaaaaacgacgatcgaaacccgaccgccgaaaacaacaacgtaaactcatcgaaaaaccgactataaaataaaataaaaaccaaaaatcccgataaaaaaaaaaaaaaactaaacctaaatcga

SEQ ID NO: 2673 - DNA, 832 bp, Artificial Sequence
  chemically treated genomic DNA (Homo sapiens) CpG-island No: 2673
ttcgtttgttcgaggtttttgggttgaggggtcgtcgatttttgagacggagtttcgggattattcggatttttggtttaaggatcgtagagttttgttcgttcggtatttagagcggtagtcgttttagcgtttttggtttcgcgtttcgtttaggtcgttttttaggcgattcggtttagttcggggcgtaggtgggagaggtgagaggaggtttcggagttttcgtttggttttgggcggtcgcgatttgggatttttaggcgcgtataattagttacgagtatttttgagttcggcggagggagcggtagaggggagttgcgagtggatcggaataggtttgtgaatttggtcgcgagcgagtggtagtgaaagttggtattcgcgtaagtttacgtgcgaggagtgcgtgcgtgcgttcgcgtacgtgttggcggggcgtggcgagttcgtgtaatttgtgtgggtcgtgggggtggttagtagggaggatacgtatgagtttcgcgcgtatatttaagtttcgtagataggtgcggttgggtgatgcggggatagggagggtaatagtgaagttatagatgttgggagttggggagaaatcgaagaggaaatttatagatcggcgaagcgtgtcggagtcggcgtttaggaggttggttgtaggggtggatttgtgattgttttttttcgggattttcgatattcgcggaaatcgttcgaaatttatcggaagttcgaaggaggtttcggttttttttgagtgtaggggtgggggtcggttttattttttttcgtttatagtcgttattattttcggtgttcggag

SEQ ID NO: 2674 - DNA, 832 bp, Artificial Sequence
  chemically treated genomic DNA (Homo sapiens) CpG-island No: 2674
ctccgaacaccgaaaataataacgactataaacgaaaaaaaataaaaccgacccccacccctacactcaaaaaaaaccgaaacctccttcgaacttccgataaatttcgaacgatttccgcgaatatcgaaaatcccgaaaaaaaacaatcacaaatccacccctacaaccaacctcctaaacgccgactccgacacgcttcgccgatctataaatttcctcttcgatttctccccaactcccaacatctataacttcactattaccctccctatccccgcatcacccaaccgcacctatctacgaaacttaaatatacgcgcgaaactcatacgtatcctccctactaaccacccccacgacccacacaaattacacgaactcgccacgccccgccaacacgtacgcgaacgcacgcacgcactcctcgcacgtaaacttacgcgaataccaactttcactaccactcgctcgcgaccaaattcacaaacctattccgatccactcgcaactcccctctaccgctccctccgccgaactcaaaaatactcgtaactaattatacgcgcctaaaaatcccaaatcgcgaccgcccaaaaccaaacgaaaactccgaaacctcctctcacctctcccacctacgccccgaactaaaccgaatcgcctaaaaaacgacctaaacgaaacgcgaaaccaaaaacgctaaaacgactaccgctctaaataccgaacgaacaaaactctacgatccttaaaccaaaaatccgaataatcccgaaactccgtctcaaaaatcgacgacccctcaacccaaaaacctcgaacaaacgaa

SEQ ID NO: 2675 - DNA, 832 bp, Artificial Sequence
  chemically treated genomic DNA (Homo sapiens) CpG-island No: 2675
tttcgagtatcgggggtggtggcgattgtgggcgaggggaggtgggatcgatttttatttttatatttaaaaaaggtcggggtttttttcgagttttcggtgaatttcgggcgattttcgcgggtgtcgggggtttcgggaggaggtagttatagatttatttttgtagttagttttttaggcgtcggtttcggtacgtttcgtcggtttgtagatttttttttcgatttttttttagtttttagtatttgtgattttattgttattttttttattttcgtattatttaatcgtatttgtttgcgggatttaggtgtgcgcgcggggtttatgcgtgttttttttgttggttatttttacggtttatataagttgtacgggttcgttacgtttcgttaatacgtgcgcggacgtacgtacgtatttttcgtacgtgggtttacgcgaatattagtttttattgttattcgttcgcggttagatttataggtttgtttcggtttattcgtagtttttttttgtcgtttttttcgtcgggtttaggagtattcgtagttgattgtgcgcgtttgagggttttagatcgcggtcgtttaggattaggcgaggatttcggagtttttttttattttttttatttgcgtttcgggttgggtcgggtcgtttggggggcggtttgagcgaggcgcggggttaggagcgttggagcgattgtcgttttaagtgtcgggcgggtaggattttacgatttttgggttagaggttcggatggtttcgggatttcgttttaagggtcggcgattttttaatttagaagtttcgagtaggcgga

SEQ ID NO: 2676 - DNA, 832 bp, Artificial Sequence
  chemically treated genomic DNA (Homo sapiens) CpG-island No: 2676
tccgcctactcgaaacttctaaattaaaaaatcgccgacccttaaaacgaaatcccgaaaccatccgaacctctaacccaaaaatcgtaaaatcctacccgcccgacacttaaaacgacaatcgctccaacgctcctaaccccgcgcctcgctcaaaccgccccccaaacgacccgacccaacccgaaacgcaaataaaaaaaataaaaaaaaactccgaaatcctcgcctaatcctaaacgaccgcgatctaaaaccctcaaacgcgcacaatcaactacgaatactcctaaacccgacgaaaaaaacgacaaaaaaaaactacgaataaaccgaaacaaacctataaatctaaccgcgaacgaataacaataaaaactaatattcgcgtaaacccacgtacgaaaaatacgtacgtacgtccgcgcacgtattaacgaaacgtaacgaacccgtacaacttatataaaccgtaaaaataaccaacaaaaaaaacacgcataaaccccgcgcgcacacctaaatcccgcaaacaaatacgattaaataatacgaaaataaaaaaaataacaataaaatcacaaatactaaaaactaaaaaaaaatcgaaaaaaaaatctacaaaccgacgaaacgtaccgaaaccgacgcctaaaaaactaactacaaaaataaatctataactacctcctcccgaaacccccgacacccgcgaaaatcgcccgaaattcaccgaaaactcgaaaaaaaccccgaccttttttaaatataaaaataaaaatcgatcccacctcccctcgcccacaatcgccaccacccccgatactcgaaa

SEQ ID NO: 2677 - DNA, 548 bp, Artificial Sequence
  chemically treated genomic DNA (Homo sapiens) CpG-island No: 2677
aaggcgaatagttgtcgtacgtcggcgcggttgtggttgtcgaaggagtaaataattttatcgttggggtttttatttagattcgttgtaaggatttgtattacgcgcgtgtcggagggtgtattttttaggacgcgcgttcggtataaggattggttgaagataggcgtattgttattcgcgtttagtattttgatgtgaataggtaggttggcggagagagttggggttttttcgtttaacgtcgttagtattaattggagattaggttttcgttttcggtttagggcgcgttttaatattagtttcgcgtatttggtgttgttttttcgcgtttgtacgcgaagcgtaaagtatttatttcggtttagtttataggtttgtaaagagttgttttttatatcgggatcgtgcgcgttttcgagcggaaagcgcgttttcggagttacggtttcgttaatttttaattttattttttgggtagggaaagtaggattgttgtcgttgatgttttggattattatttttacgttgaatagttttagcgg

SEQ ID NO: 2678 - DNA, 548 bp, Artificial Sequence
  chemically treated genomic DNA (Homo sapiens) CpG-island No: 2678
ccgctaaaactattcaacgtaaaaataataatccaaaacatcaacgacaacaatcctactttccctacccaaaaaataaaattaaaaattaacgaaaccgtaactccgaaaacgcgctttccgctcgaaaacgcgcacgatcccgatataaaaaacaactctttacaaacctataaactaaaccgaaataaatactttacgcttcgcgtacaaacgcgaaaaaacaacaccaaatacgcgaaactaatattaaaacgcgccctaaaccgaaaacgaaaacctaatctccaattaatactaacgacgttaaacgaaaaaaccccaactctctccgccaacctacctattcacatcaaaatactaaacgcgaataacaatacgcctatcttcaaccaatccttataccgaacgcgcgtcctaaaaaatacaccctccgacacgcgcgtaatacaaatccttacaacgaatctaaataaaaaccccaacgataaaattatttactccttcgacaaccacaaccgcgccgacgtacgacaactattcgcctt

SEQ ID NO: 2679 - DNA, 548 bp, Artificial Sequence
  chemically treated genomic DNA (Homo sapiens) CpG-island No: 2679
tcgttggagttgtttagcgtggaagtggtgatttaggatattaacgataataattttgttttttttatttaggaaatgaaattggagattagcgaggtcgtggtttcggggacgcgtttttcgttcgagagcgcgtacgatttcgatgtgggaagtaattttttataaatttatgagttgagtcgaaatgaatattttgcgtttcgcgtgtagacgcgggaggatagtattaagtacgcggagttggtgttggagcgcgttttggatcgagaacgggagtttagtttttagttagtgttgacggcgttggacggagggattttagtttttttcgttagtttgtttatttatattaaggtgttggacgcgaatgataatgcgtttgtttttaattagtttttgtatcgggcgcgcgttttggaggatgtatttttcggtacgcgcgtggtataagtttttgtaacggatttggatgaaggttttaacggtgaaattatttattttttcggtagttataatcgcgtcggcgtgcggtaattattcgtttt

SEQ ID NO: 2680 - DNA, 548 bp, Artificial Sequence
  chemically treated genomic DNA (Homo sapiens) CpG-island No: 2680
aaaacgaataattaccgcacgccgacgcgattataactaccgaaaaaataaataatttcaccgttaaaaccttcatccaaatccgttacaaaaacttataccacgcgcgtaccgaaaaatacatcctccaaaacgcgcgcccgatacaaaaactaattaaaaacaaacgcattatcattcgcgtccaacaccttaatataaataaacaaactaacgaaaaaaactaaaatccctccgtccaacgccgtcaacactaactaaaaactaaactcccgttctcgatccaaaacgcgctccaacaccaactccgcgtacttaatactatcctcccgcgtctacacgcgaaacgcaaaatattcatttcgactcaactcataaatttataaaaaattacttcccacatcgaaatcgtacgcgctctcgaacgaaaaacgcgtccccgaaaccacgacctcgctaatctccaatttcatttcctaaataaaaaaaacaaaattattatcgttaatatcctaaatcaccacttccacgctaaacaactccaacga

SEQ ID NO: 2681 - DNA, 528 bp, Artificial Sequence
  chemically treated genomic DNA (Homo sapiens) CpG-island No: 2681
gtcgtcgtcgtcgttcgtcgagggtagtttatttgggtttcggtttttttttttgtttcgggtttcgcggtcgggttttaggttttcgtcgggcggtttttatgtttcggtttacgttggtcggcgatttcgcgtttacgtcgttttcgtttggtagtttcgcgttcgtcgtcgtttagtcgttttttagttagtcgtcgcgtttcgttttattagtatgtcgggttgcgcgcgttttatgaatatataacgacgacgtttcgttttcgttcgtttgttttattttcgttcggattcgtagtttttattaatgggggaagggagaggggcggagggaagtcgcggaagcgcgttatttgtttatcggatttaattattcggatttacgtgggggggggtggtgagtgggcgttgtagtttttcgcggtcgcggcggagaatatcgttttttggcggttggagtagcgtaggtttttggtttttacgtagcgtttacgtggttgtatagtttgatagtttggatttttt

SEQ ID NO: 2682 - DNA, 528 bp, Artificial Sequence
  chemically treated genomic DNA (Homo sapiens) CpG-island No: 2682
aaaaaatccaaactatcaaactatacaaccacgtaaacgctacgtaaaaaccaaaaacctacgctactccaaccgccaaaaaacgatattctccgccgcgaccgcgaaaaactacaacgcccactcaccacccccccccacgtaaatccgaataattaaatccgataaacaaataacgcgcttccgcgacttccctccgcccctctcccttcccccattaataaaaactacgaatccgaacgaaaataaaacaaacgaacgaaaacgaaacgtcgtcgttatatattcataaaacgcgcgcaacccgacatactaataaaacgaaacgcgacgactaactaaaaaacgactaaacgacgacgaacgcgaaactaccaaacgaaaacgacgtaaacgcgaaatcgccgaccaacgtaaaccgaaacataaaaaccgcccgacgaaaacctaaaacccgaccgcgaaacccgaaacaaaaaaaaaaaccgaaacccaaataaactaccctcgacgaacgacgacgacgac

SEQ ID NO: 2683 - DNA, 528 bp, Artificial Sequence
  chemically treated genomic DNA (Homo sapiens) CpG-island No: 2683
agagggtttaggttgttaggttgtatagttacgtgggcgttgcgtgggagttagaggtttgcgttgttttaatcgttagagggcggtgtttttcgtcgcggtcgcggagagttgtagcgtttatttattatttttttttacgtgggttcgaatggttaggttcgatgggtaggtagcgcgttttcgcggttttttttcgtttttttttttttttttattggtaggggttgcgggttcgggcggaagtggggtaggcgggcgggagcgaggcgtcgtcgttgtatatttatgaggcgcgcgtagttcggtatgttaatgaggcggggcgcggcggttggttaaagagcgattgggcggcggcgggcgcggagttgttaggcgggagcggcgtaggcgcggggtcgtcggttagcgtgaatcgggatatggaagtcgttcggcgggagtttggggttcggtcgcgggattcgggataagaagaagggtcggagtttagatgagttgttttcggcgggcggcgacggcggt

SEQ ID NO: 2684 - DNA, 528 bp, Artificial Sequence
  chemically treated genomic DNA (Homo sapiens) CpG-island No: 2684
accgccgtcgccgcccgccgaaaacaactcatctaaactccgacccttcttcttatcccgaatcccgcgaccgaaccccaaactcccgccgaacgacttccatatcccgattcacgctaaccgacgaccccgcgcctacgccgctcccgcctaacaactccgcgcccgccgccgcccaatcgctctttaaccaaccgccgcgccccgcctcattaacataccgaactacgcgcgcctcataaatatacaacgacgacgcctcgctcccgcccgcctaccccacttccgcccgaacccgcaacccctaccaataaaaaaaaaaaaaaaaacgaaaaaaaaccgcgaaaacgcgctacctacccatcgaacctaaccattcgaacccacgtaaaaaaaaataataaataaacgctacaactctccgcgaccgcgacgaaaaacaccgccctctaacgattaaaacaacgcaaacctctaactcccacgcaacgcccacgtaactatacaacctaacaacctaaaccctct

SEQ ID NO: 2685 - DNA, 685 bp, Artificial Sequence
  chemically treated genomic DNA (Homo sapiens) CpG-island No: 2685
cggtttttacgttttttagtttcgagttagagaatcggttttttagggaagtcgtcgtttttttttatcgggttgttattgtttttcggttatttcgggcggcgatttttacggttcggttcgcgcgtttcgatagttttcgttcgcgggattagtagtcgcggtagggtacgggatattttttttttggcggggcggcgtgggggcggcgttgttaatcgttgcgtagcgtacgtgttgtacgtttgcgtattcggtttcgttcggtcggcgtggtgtggggttgcgggggtgcgggggcgcgaggcgtagcggcggtgtggacgcgcgagggtcgagggatgcgcgcgtcgcggggtggagtgcgcggtgtttcggatttcggggcggcgagagtgcgtcggggggtagtgcgaacgtttaggagtggggagtgcgtagagatttgggggtggtagaggacgagcgcgttagcggggattacggggggattcgagggtttataaaagggttcgtttttttttatgcgatggttgagtatcgggaaattttttagcggttttcgtttgtttttattttttttttattagaaatttgttatagttggtgggcgcgggttcgttgttttgtacgtttatcgttagattagtttagggttcgcgttcggaggttagggagttggagg

SEQ ID NO: 2686 - DNA, 685 bp, Artificial Sequence
  chemically treated genomic DNA (Homo sapiens) CpG-island No: 2686
cctccaactccctaacctccgaacgcgaaccctaaactaatctaacgataaacgtacaaaacaacgaacccgcgcccaccaactataacaaatttctaataaaaaaaaaataaaaacaaacgaaaaccgctaaaaaatttcccgatactcaaccatcgcataaaaaaaaacgaacccttttataaaccctcgaatccccccgtaatccccgctaacgcgctcgtcctctaccacccccaaatctctacgcactccccactcctaaacgttcgcactaccccccgacgcactctcgccgccccgaaatccgaaacaccgcgcactccaccccgcgacgcgcgcatccctcgaccctcgcgcgtccacaccgccgctacgcctcgcgcccccgcacccccgcaaccccacaccacgccgaccgaacgaaaccgaatacgcaaacgtacaacacgtacgctacgcaacgattaacaacgccgcccccacgccgccccgccaaaaaaaaaatatcccgtaccctaccgcgactactaatcccgcgaacgaaaactatcgaaacgcgcgaaccgaaccgtaaaaatcgccgcccgaaataaccgaaaaacaataacaacccgataaaaaaaaacgacgacttccctaaaaaaccgattctctaactcgaaactaaaaaacgtaaaaaccg

SEQ ID NO: 2687 - DNA, 685 bp, Artificial Sequence
  chemically treated genomic DNA (Homo sapiens) CpG-island No: 2687
tttttagttttttggttttcgggcgcgggttttgggttgatttggcggtggacgtgtagggtagcgggttcgcgtttattagttgtggtaagtttttagtaagagagggatagagataggcggagatcgttggggagtttttcggtgtttagttatcgtataggggggaacggatttttttgtgggttttcgggttttttcgtggttttcgttggcgcgttcgttttttgttatttttagatttttgcgtattttttatttttgggcgttcgtattgtttttcggcgtattttcgtcgtttcggggttcgaagtatcgcgtattttatttcgcgacgcgcgtatttttcgattttcgcgcgtttatatcgtcgttgcgtttcgcgttttcgtattttcgtaattttatattacgtcggtcgggcggggtcggatgcgtagacgtgtagtacgtgcgttgcgtagcgattggtagcgtcgtttttacgtcgtttcgttagggaaagggtgtttcgtgttttgtcgcggttgttggtttcgcgggcgggggttgtcggggcgcgcgggtcgggtcgtgggggtcgtcgttcgaagtgatcggggaataatgatagttcgatggggaagggcggcggtttttttagagggtcggttttttggttcggagttggggggcgtgggggtcg

SEQ ID NO: 2688 - DNA, 685 bp, Artificial Sequence
  chemically treated genomic DNA (Homo sapiens) CpG-island No: 2688
cgacccccacgccccccaactccgaaccaaaaaaccgaccctctaaaaaaaccgccgcccttccccatcgaactatcattattccccgatcacttcgaacgacgacccccacgacccgacccgcgcgccccgacaacccccgcccgcgaaaccaacaaccgcgacaaaacacgaaacaccctttccctaacgaaacgacgtaaaaacgacgctaccaatcgctacgcaacgcacgtactacacgtctacgcatccgaccccgcccgaccgacgtaatataaaattacgaaaatacgaaaacgcgaaacgcaacgacgatataaacgcgcgaaaatcgaaaaatacgcgcgtcgcgaaataaaatacgcgatacttcgaaccccgaaacgacgaaaatacgccgaaaaacaatacgaacgcccaaaaataaaaaatacgcaaaaatctaaaaataacaaaaaacgaacgcgccaacgaaaaccacgaaaaaacccgaaaacccacaaaaaaatccgttcccccctatacgataactaaacaccgaaaaactccccaacgatctccgcctatctctatccctctcttactaaaaacttaccacaactaataaacgcgaacccgctaccctacacgtccaccgccaaatcaacccaaaacccgcgcccgaaaaccaaaaaactaaaaa

SEQ ID NO: 2689 - DNA, 754 bp, Artificial Sequence
  chemically treated genomic DNA (Homo sapiens) CpG-island No: 2689
ggaacgaggggagggaagggaaaggaggggaggggaggcggggagaggattttaggggagggagtttagttcgttttcggcgttcgtcgcgtttcgttcgttcgcgtttatagtagtcgtcgttcgttcggggtgtttttcgtcgttttcgggtcgtattcggggttttttagcgcgattatggttcgtacgttgtcgtcgtcgtcgtcgttcggtagggtttttatcgggtcgggtaggaagtgacgggcgttcggaggcgggtaggggcggggtttggggttgcgcggcggggcgggggcgtttatttttcggttgtcgggaacgaacgcggaaatttaggcgcgcggggaggggatttagtttttggggggacgaacggggaaatcgaggcgcgcggggcggggatttagttaatagggaacgaacggggaaatcgaggtaggcggggtcgggatttagttattagggaacgaacggggaaatcgaggtaggcggggtcgggatttagtttttggggggacgaacggggagattgaggcgggaggcggggtcggttacgatttttatatttagaaatttagtttcgggaaggagggatatttaggcgaggggtcgaaaatttaattataattttgcgtttcgattcgggttgcggattgagttaggaatttagtttagggaggcgaggagatacggatagggaaattaaggtttgagtatcgacgagggaggggacgttttttttggaggt

SEQ ID NO: 2690 - DNA, 754 bp, Artificial Sequence
  chemically treated genomic DNA (Homo sapiens) CpG-island No: 2690
acctccaaaaaaaacgtcccctccctcgtcgatactcaaaccttaatttccctatccgtatctcctcgcctccctaaactaaattcctaactcaatccgcaacccgaatcgaaacgcaaaattataattaaattttcgacccctcgcctaaatatccctccttcccgaaactaaatttctaaatataaaaatcgtaaccgaccccgcctcccgcctcaatctccccgttcgtccccccaaaaactaaatcccgaccccgcctacctcgatttccccgttcgttccctaataactaaatcccgaccccgcctacctcgatttccccgttcgttccctattaactaaatccccgccccgcgcgcctcgatttccccgttcgtccccccaaaaactaaatcccctccccgcgcgcctaaatttccgcgttcgttcccgacaaccgaaaaataaacgcccccgccccgccgcgcaaccccaaaccccgcccctacccgcctccgaacgcccgtcacttcctacccgacccgataaaaaccctaccgaacgacgacgacgacgacaacgtacgaaccataatcgcgctaaaaaaccccgaatacgacccgaaaacgacgaaaaacaccccgaacgaacgacgactactataaacgcgaacgaacgaaacgcgacgaacgccgaaaacgaactaaactccctcccctaaaatcctctccccgcctcccctcccctcctttcccttccctcccctcgttcc

SEQ ID NO: 2691 - DNA, 754 bp, Artificial Sequence
  chemically treated genomic DNA (Homo sapiens) CpG-island No: 2691
gtttttaagaagaacgttttttttttcgtcgatgtttaggttttagtttttttgttcgtgttttttcgtttttttgggttggatttttggtttagttcgtagttcggatcgggacgtagggttgtggttgagttttcgatttttcgtttaggtgtttttttttttcggagttagatttttgggtgtagggatcgtggtcggtttcgtttttcgttttagttttttcgttcgtttttttaggggttggatttcggtttcgtttgtttcggttttttcgttcgttttttgatggttggatttcggtttcgtttgtttcggttttttcgttcgttttttgttggttggattttcgtttcgcgcgtttcggttttttcgttcgtttttttaggggttggatttttttttcgcgcgtttgggttttcgcgttcgttttcggtagtcgggaggtgggcgttttcgtttcgtcgcgtagttttaggtttcgtttttgttcgttttcgggcgttcgttattttttgttcggttcggtgaaggttttgtcgggcggcggcggcggcgatagcgtgcgagttatggtcgcgttggagaatttcgagtgcggttcggaggcggcggagggtatttcgggcgggcggcggttgttgtgagcgcgggcgggcggggcgcggcgggcgtcgggggcgggttgggtttttttttttgagatttttttttcgttttttttttttttttttttttttttttttttcgtttt

SEQ ID NO: 2692 - DNA, 754 bp, Artificial Sequence
  chemically treated genomic DNA (Homo sapiens) CpG-island No: 2692
aaaacgaaaaaaaaaaaaaaaaaaaaaaaaaaaaaaaacgaaaaaaaaatctcaaaaaaaaaaacccaacccgcccccgacgcccgccgcgccccgcccgcccgcgctcacaacaaccgccgcccgcccgaaataccctccgccgcctccgaaccgcactcgaaattctccaacgcgaccataactcgcacgctatcgccgccgccgccgcccgacaaaaccttcaccgaaccgaacaaaaaataacgaacgcccgaaaacgaacaaaaacgaaacctaaaactacgcgacgaaacgaaaacgcccacctcccgactaccgaaaacgaacgcgaaaacccaaacgcgcgaaaaaaaaatccaacccctaaaaaaacgaacgaaaaaaccgaaacgcgcgaaacgaaaatccaaccaacaaaaaacgaacgaaaaaaccgaaacaaacgaaaccgaaatccaaccatcaaaaaacgaacgaaaaaaccgaaacaaacgaaaccgaaatccaacccctaaaaaaacgaacgaaaaaactaaaacgaaaaacgaaaccgaccacgatccctacacccaaaaatctaactccgaaaaaaaaaaacacctaaacgaaaaatcgaaaactcaaccacaaccctacgtcccgatccgaactacgaactaaaccaaaaatccaacccaaaaaaacgaaaaaacacgaacaaaaaaactaaaacctaaacatcgacgaaaaaaaaaacgttcttcttaaaaac

SEQ ID NO: 2693 - DNA, 686 bp, Artificial Sequence
  chemically treated genomic DNA (Homo sapiens) CpG-island No: 2693
ggtcgcgtcgcgtattttgtttatcgtttttaggtcgggggcggggtttttcgcggcgttgttttttttttcgtttattatttattattttttaaaggggtcgcgatttgaaaattttcgtttattttgttcggttttttagcgttttcgggttggttgcgcgtcgttagatcgcgggaggggggcgagggggcgtgcggggaaaagtggggagttttggcgaggttttttcgcgttcgggtcgcggcgttgaattatcggttaggtatttgtattcgagagcgattcgttttttggtgatttgtttgggggtgggggaggggcggggcgggggtcggtcgcgcgcggggcgttttttattaatcgggcggaggggtgtagacgcggacgcggttggcggttcggtgagtcggcgcgcggtatagtttcgtgggtcgggggtcgggagttagcggcgcgtatcggcggttggaagttaggcgggttcgggtaggtcgattttaggcgcggggcgcgcgttttattacgagtcgttttgcgcggtaaggttggggagcgcgttggtcgtttttagcgcgggtttcggtgtcggggtgggcgtagtgcgttttggaagttaaagaagggggtttttaaagttgggcggagatgttggtgggggtttcggattgggaaggcggttttgg

SEQ ID NO: 2694 - DNA, 686 bp, Artificial Sequence
  chemically treated genomic DNA (Homo sapiens) CpG-island No: 2694
ccaaaaccgccttcccaatccgaaacccccaccaacatctccgcccaactttaaaaacccccttctttaacttccaaaacgcactacgcccaccccgacaccgaaacccgcgctaaaaacgaccaacgcgctccccaaccttaccgcgcaaaacgactcgtaataaaacgcgcgccccgcgcctaaaatcgacctacccgaacccgcctaacttccaaccgccgatacgcgccgctaactcccgacccccgacccacgaaactataccgcgcgccgactcaccgaaccgccaaccgcgtccgcgtctacacccctccgcccgattaataaaaaacgccccgcgcgcgaccgacccccgccccgcccctcccccacccccaaacaaatcaccaaaaaacgaatcgctctcgaatacaaatacctaaccgataattcaacgccgcgacccgaacgcgaaaaaacctcgccaaaactccccacttttccccgcacgccccctcgcccccctcccgcgatctaacgacgcgcaaccaacccgaaaacgctaaaaaaccgaacaaaataaacgaaaattttcaaatcgcgacccctttaaaaaataataaataataaacgaaaaaaaaaacaacgccgcgaaaaaccccgcccccgacctaaaaacgataaacaaaatacgcgacgcgacc

SEQ ID NO: 2695 - DNA, 686 bp, Artificial Sequence
  chemically treated genomic DNA (Homo sapiens) CpG-island No: 2695
ttagggtcgtttttttagttcgggatttttattaatattttcgtttaattttggggatttttttttttggtttttaggacgtattgcgtttatttcggtatcggaattcgcgttgggaacggttagcgcgttttttagttttatcgcgtagggcggttcgtagtggggcgcgcgtttcgcgtttggggtcggtttgttcgggttcgtttggtttttagtcgtcggtgcgcgtcgttggttttcggttttcgatttacggggttgtgtcgcgcgtcgatttatcgagtcgttagtcgcgttcgcgtttatattttttcgttcgattggtaagaggcgtttcgcgcgcggtcggttttcgtttcgttttttttttatttttagataaattattaggggacgagtcgttttcggatgtaaatatttggtcggtgatttagcgtcgcggttcgggcgcgggagggtttcgttagggttttttattttttttcgtacgttttttcgtttttttttcgcggtttgacgacgcgtaattagttcgggggcgttggggagtcgggtagagtggacggaaatttttaggtcgcggtttttttaaaggataataaataataaacgggaaggggaatagcgtcgcgggaggtttcgttttcggtttagggacggtgggtaaagtgcgcgacgcggtt

SEQ ID NO: 2696 - DNA, 686 bp, Artificial Sequence
  chemically treated genomic DNA (Homo sapiens) CpG-island No: 2696
aaccgcgtcgcgcactttacccaccgtccctaaaccgaaaacgaaacctcccgcgacgctattccccttcccgtttattatttattatcctttaaaaaaaccgcgacctaaaaatttccgtccactctacccgactccccaacgcccccgaactaattacgcgtcgtcaaaccgcgaaaaaaaaacgaaaaaacgtacgaaaaaaaataaaaaaccctaacgaaaccctcccgcgcccgaaccgcgacgctaaatcaccgaccaaatatttacatccgaaaacgactcgtcccctaataatttatctaaaaataaaaaaaaaacgaaacgaaaaccgaccgcgcgcgaaacgcctcttaccaatcgaacgaaaaaatataaacgcgaacgcgactaacgactcgataaatcgacgcgcgacacaaccccgtaaatcgaaaaccgaaaaccaacgacgcgcaccgacgactaaaaaccaaacgaacccgaacaaaccgaccccaaacgcgaaacgcgcgccccactacgaaccgccctacgcgataaaactaaaaaacgcgctaaccgttcccaacgcgaattccgataccgaaataaacgcaatacgtcctaaaaaccaaaaaaaaaaatccccaaaattaaacgaaaatattaataaaaatcccgaactaaaaaaacgaccctaa

SEQ ID NO: 2697 - DNA, 651 bp, Artificial Sequence
  chemically treated genomic DNA (Homo sapiens) CpG-island No: 2697
ttcggaggttgggtgattcgcgtagaagtgaagtatttttttatttgtagatttgggtcgatgtcgttttaaaaaacgcgaggggttttatgtatttttttggcggtagttttttcgattttagtcgggtcgggtcgtgtcgtttttttttaggagagataaataggtgttttacgtggtagtcgcgtttcgggcgttttttttgtgatttcgtagcgttttttggttcgagtcgcgttcgggtttgtgagtagagtcgttcgggtatcgagcgttggtcgtcgtttttttttcggtgagttttagtttcgagttggttttggcgttcgggtattcgttagtgtcggttgtcgatgatcgatttacgttttcggtattggggttttttttgtttagttatttttatttagagtattcgggttgcgcggtttcgtcgagggtgcgggttttgttcgtattgtttgcgcgtatttgagcgcggtttttttggtacggcggcgtcgggggaagagcgtatttggcgcgcgtttttttcgtggttattcgcggttcgtttcgggcgagttggcggggttttgggaggggtgcggttagtaggtaagtgggtaggggtttcgggtataggggtggaggagggtatgtattaaattt

SEQ ID NO: 2698 - DNA, 651 bp, Artificial Sequence
  chemically treated genomic DNA (Homo sapiens) CpG-island No: 2698
aaatttaatacataccctcctccacccctatacccgaaacccctacccacttacctactaaccgcacccctcccaaaaccccgccaactcgcccgaaacgaaccgcgaataaccacgaaaaaaacgcgcgccaaatacgctcttcccccgacgccgccgtaccaaaaaaaccgcgctcaaatacgcgcaaacaatacgaacaaaacccgcaccctcgacgaaaccgcgcaacccgaatactctaaataaaaataactaaacaaaaaaaaccccaataccgaaaacgtaaatcgatcatcgacaaccgacactaacgaatacccgaacgccaaaaccaactcgaaactaaaactcaccgaaaaaaaaacgacgaccaacgctcgatacccgaacgactctactcacaaacccgaacgcgactcgaaccaaaaaacgctacgaaatcacaaaaaaaacgcccgaaacgcgactaccacgtaaaacacctatttatctctcctaaaaaaaaacgacacgacccgacccgactaaaatcgaaaaaactaccgccaaaaaaatacataaaacccctcgcgttttttaaaacgacatcgacccaaatctacaaataaaaaaatacttcacttctacgcgaatcacccaacctccgaa

SEQ ID NO: 2699 - DNA, 651 bp, Artificial Sequence
  chemically treated genomic DNA (Homo sapiens) CpG-island No: 2699
gggtttaatatatgtttttttttatttttgtattcggagtttttatttatttatttgttgatcgtattttttttaaaatttcgttagttcgttcgggacggatcgcgagtggttacgagggaggcgcgcgttaggtgcgtttttttttcgacgtcgtcgtgttaggaaggtcgcgtttaggtgcgcgtagataatgcgaataaagttcgtattttcggcggggtcgcgtagttcgggtgttttgggtaggggtggttgggtagagggggttttagtatcgggagcgtgaatcggttatcggtagtcggtattggcgggtattcgggcgttagagttaattcggggttgggatttatcggaaggagagcggcgattagcgttcggtgttcgggcggttttatttatagattcgggcgcggttcgggttagggggcgttacgggattataggaggggcgttcggggcgcggttgttacgtgggatatttgtttgttttttttgggagagggcggtacgattcgattcggttgaggtcggaggaattatcgttagggaggtgtatagagtttttcgcgttttttaaagcggtatcggtttaggtttgtaaataaaaaagtattttatttttacgcgggttatttagttttcgag

SEQ ID NO: 2700 - DNA, 651 bp, Artificial Sequence
  chemically treated genomic DNA (Homo sapiens) CpG-island No: 2700
ctcgaaaactaaataacccgcgtaaaaataaaatacttttttatttacaaacctaaaccgataccgctttaaaaaacgcgaaaaactctatacacctccctaacgataattcctccgacctcaaccgaatcgaatcgtaccgccctctcccaaaaaaaacaaacaaatatcccacgtaacaaccgcgccccgaacgcccctcctataatcccgtaacgccccctaacccgaaccgcgcccgaatctataaataaaaccgcccgaacaccgaacgctaatcgccgctctccttccgataaatcccaaccccgaattaactctaacgcccgaatacccgccaataccgactaccgataaccgattcacgctcccgatactaaaaccccctctacccaaccacccctacccaaaacacccgaactacgcgaccccgccgaaaatacgaactttattcgcattatctacgcgcacctaaacgcgaccttcctaacacgacgacgtcgaaaaaaaaacgcacctaacgcgcgcctccctcgtaaccactcgcgatccgtcccgaacgaactaacgaaattttaaaaaaaatacgatcaacaaataaataaataaaaactccgaatacaaaaataaaaaaaaacatatattaaaccc

SEQ ID NO: 2701 - DNA, 761 bp, Artificial Sequence
  chemically treated genomic DNA (Homo sapiens) CpG-island No: 2701
gcggtttatcgttttttcgtttcgtcgttaggtgcgtaaattggattttgtttaggtgtttagtaggttagaaaggtttcggacgtcgttaggtgtcgatatcgacgtttttcgggttcggcgcgcgagtttgggttttttagtagtttcgggttattcgtttgtattgttttttagtgttgagaaggaacgcggtttttagcgttttaggtcggattggcgtttatttcgcgtttcgtcggtttagggattcgcgagtagtattatagatttagcgttttcgagttcggacgttttagtgaggggagcgcgaggtcggttcgcgttcggacgttttttattggcgcgtcgggcgttatgttatttatttgtttggcgcggtagttttcgaaggtttttagggtattgtcggtgagttttacgtggaatatcgatattttgttgtcgtcgttaattcgttcgtacgatagttcgtagtttttatttttttttagcgtcgttattttgcgattatttttttttcgcgtttttttttcggttttagcgtcgttacgtcggttacgtttcgtttcgtcgttcgttgacgcgttgtattatttatgagacgcggttggttacgtttttcgagttcgattaaattaatagtcgtcgttatatcggtaggtagcgtattatattatttaggagacgcgtttggttacgttttatgagggttttataaggtttatagttaacgttttaagttgttgtatatttataag

SEQ ID NO: 2702 - DNA, 761 bp, Artificial Sequence
  chemically treated genomic DNA (Homo sapiens) CpG-island No: 2702
cttataaatatacaacaacttaaaacgttaactataaaccttataaaaccctcataaaacgtaaccaaacgcgtctcctaaataatataatacgctacctaccgatataacgacgactattaatttaatcgaactcgaaaaacgtaaccaaccgcgtctcataaataatacaacgcgtcaacgaacgacgaaacgaaacgtaaccgacgtaacgacgctaaaaccgaaaaaaaaacgcgaaaaaaaaataatcgcaaaataacgacgctaaaaaaaaataaaaactacgaactatcgtacgaacgaattaacgacgacaacaaaatatcgatattccacgtaaaactcaccgacaataccctaaaaaccttcgaaaactaccgcgccaaacaaataaataacataacgcccgacgcgccaataaaaaacgtccgaacgcgaaccgacctcgcgctcccctcactaaaacgtccgaactcgaaaacgctaaatctataatactactcgcgaatccctaaaccgacgaaacgcgaaataaacgccaatccgacctaaaacgctaaaaaccgcgttccttctcaacactaaaaaacaatacaaacgaataacccgaaactactaaaaaacccaaactcgcgcgccgaacccgaaaaacgtcgatatcgacacctaacgacgtccgaaacctttctaacctactaaacacctaaacaaaatccaatttacgcacctaacgacgaaacgaaaaaacgataaaccgc

SEQ ID NO: 2703 - DNA, 761 bp, Artificial Sequence
  chemically treated genomic DNA (Homo sapiens) CpG-island No: 2703
tttatgaatatgtaataatttggggcgttgattgtgggttttgtggggtttttatggggcgtggttaggcgcgttttttgaataatgtagtgcgttgtttgtcggtgtggcggcgattgttggtttggtcggattcggggggcgtggttagtcgcgttttatgaataatgtagcgcgttagcgggcggcggggcggggcgtggtcggcgtggcggcgttggagtcgggaagggggcgcgggggagagatggtcgtaagatggcggcgttgaaggaggataggagttacgggttgtcgtgcgggcgggttagcgacggtagtaaggtgtcggtgttttacgtgaagtttatcgatagtgttttgagggttttcgagagttatcgcgttagataggtgagtggtatggcgttcggcgcgttagtggggaacgttcggacgcgggtcggtttcgcgttttttttattgaggcgttcgggttcggagacgttaggtttgtggtgttgttcgcgggtttttgggtcggcggggcgcggagtgggcgttagttcggtttggagcgttgagaatcgcgtttttttttagtattaggaggtaatataggcgggtggttcggggttgttgaggggtttagattcgcgcgtcgggttcggggggcgtcggtgtcggtatttggcggcgttcggggtttttttggtttgttgggtatttgggtagggtttagtttgcgtatttggcggcggggcgaggaggcggtgggtcgt

SEQ ID NO: 2704 - DNA, 761 bp, Artificial Sequence
  chemically treated genomic DNA (Homo sapiens) CpG-island No: 2704
acgacccaccgcctcctcgccccgccgccaaatacgcaaactaaaccctacccaaatacccaacaaaccaaaaaaaccccgaacgccgccaaataccgacaccgacgccccccgaacccgacgcgcgaatctaaacccctcaacaaccccgaaccacccgcctatattacctcctaatactaaaaaaaaacgcgattctcaacgctccaaaccgaactaacgcccactccgcgccccgccgacccaaaaacccgcgaacaacaccacaaacctaacgtctccgaacccgaacgcctcaataaaaaaaacgcgaaaccgacccgcgtccgaacgttccccactaacgcgccgaacgccataccactcacctatctaacgcgataactctcgaaaaccctcaaaacactatcgataaacttcacgtaaaacaccgacaccttactaccgtcgctaacccgcccgcacgacaacccgtaactcctatcctccttcaacgccgccatcttacgaccatctctcccccgcgcccccttcccgactccaacgccgccacgccgaccacgccccgccccgccgcccgctaacgcgctacattattcataaaacgcgactaaccacgccccccgaatccgaccaaaccaacaatcgccgccacaccgacaaacaacgcactacattattcaaaaaacgcgcctaaccacgccccataaaaaccccacaaaacccacaatcaacgccccaaattattacatattcataaa

SEQ ID NO: 2705 - DNA, 818 bp, Artificial Sequence
  chemically treated genomic DNA (Homo sapiens) CpG-island No: 2705
tggattacgttttgtcgttcgggattatcgttcgtcgcgtttttcgttttcgcgtttttttttagcgcgttttcggagggcggtttcgcgtgtagcgagcgtagtatgttttttagtatttttttgaagttgatgtcgtagttttggtgcgcgagggtcgtagggtcggtttgggcgtcgggggtgtttagcggtacgacgtcggggtcggcgtttagggatagcggcgtcgggaaagagaagtgcgggggcggcgggaaggtttcggtcggggggttgtaggtgaggtttagtattttttcggggtcgtaaggtagcgttagcgggcgcggggcgggcggggcggggtagtttagggcgggcgtttgtttgcgttttacgttcgtatttattagtcgtagtttttgtagtattcggcgtacgtagttttcggggattttgatgtttgcgggtagagcgtcggggttagggtcggcgttgggggttcgggttttttcggggcgttcgtcgtttatttatttatttgtttttttttgtttttggtttttagtcgtacgatttgtaggtagttgttgttgttgacgtcggttatgacggcggcgatgcggttttatacgcgtagtagcgcgtcgtatagtatgtagtggtgtcgtagtcgtagtttttgtaggtagtttttatttttttgcgttagtcggtagtgtcggtttttgcggacgagacgggtcgtttcggtttaggcgggttttaggggttcgtaggttttttaggtgttttgagatttttcgtttttttttagggtttcgggagttttcgat

SEQ ID NO: 2706 - DNA, 818 bp, Artificial Sequence
  chemically treated genomic DNA (Homo sapiens) CpG-island No: 2706
atcgaaaactcccgaaaccctaaaaaaaaacgaaaaatctcaaaacacctaaaaaacctacgaacccctaaaacccgcctaaaccgaaacgacccgtctcgtccgcaaaaaccgacactaccgactaacgcaaaaaaataaaaactacctacaaaaactacgactacgacaccactacatactatacgacgcgctactacgcgtataaaaccgcatcgccgccgtcataaccgacgtcaacaacaacaactacctacaaatcgtacgactaaaaaccaaaaacaaaaaaaaacaaataaataaataaacgacgaacgccccgaaaaaacccgaacccccaacgccgaccctaaccccgacgctctacccgcaaacatcaaaatccccgaaaactacgtacgccgaatactacaaaaactacgactaataaatacgaacgtaaaacgcaaacaaacgcccgccctaaactaccccgccccgcccgccccgcgcccgctaacgctaccttacgaccccgaaaaaatactaaacctcacctacaaccccccgaccgaaaccttcccgccgcccccgcacttctctttcccgacgccgctatccctaaacgccgaccccgacgtcgtaccgctaaacacccccgacgcccaaaccgaccctacgaccctcgcgcaccaaaactacgacatcaacttcaaaaaaatactaaaaaacatactacgctcgctacacgcgaaaccgccctccgaaaacgcgctaaaaaaaaacgcgaaaacgaaaaacgcgacgaacgataatcccgaacgacaaaacgtaatcca

SEQ ID NO: 2707 - DNA, 818 bp, Artificial Sequence
  chemically treated genomic DNA (Homo sapiens) CpG-island No: 2707
atcgggggttttcgagattttgagaggaggcgggagattttagggtatttggggagtttgcgggtttttgggattcgtttgagtcgagacgattcgtttcgttcgtaggaatcggtattgtcggttggcgtaggagggtaaggattgtttgtaggggttgcggttgcggtattattatatgttgtgcggcgcgttgttgcgcgtgtggggtcgtatcgtcgtcgttatggtcgacgttagtagtagtagttatttgtagatcgtgcggttgaagattaaggataggaagaagtaagtgggtgagtgggcggcgggcgtttcgggaaggttcgagtttttagcgtcggttttgatttcgacgttttgttcgtaggtattaagattttcgagggttgcgtgcgtcgggtgttgtaggagttgcggttgatggatgcggacgtgaagcgtaggtaggcgttcgttttgggttgtttcgtttcgttcgtttcgcgttcgttggcgttgttttgcggtttcggagaggtgttggattttatttatagtttttcggtcgaggttttttcgtcgttttcgtatttttttttttcggcgtcgttgtttttggacgtcggtttcggcgtcgtgtcgttgggtattttcgacgtttaggtcgattttgcggttttcgcgtattagggttgcgatattaattttaaggaggtgttggaggatatgttgcgttcgttgtacgcggggtcgtttttcgagggcgcgttgggggagggcgcgggggcggggggcgcggcgggcggtggtttcgagcggtagagcgtgattta

SEQ ID NO: 2708 - DNA, 818 bp, Artificial Sequence
  chemically treated genomic DNA (Homo sapiens) CpG-island No: 2708
taaatcacgctctaccgctcgaaaccaccgcccgccgcgccccccgcccccgcgccctcccccaacgcgccctcgaaaaacgaccccgcgtacaacgaacgcaacatatcctccaacacctccttaaaattaatatcgcaaccctaatacgcgaaaaccgcaaaatcgacctaaacgtcgaaaatacccaacgacacgacgccgaaaccgacgtccaaaaacaacgacgccgaaaaaaaaaaatacgaaaacgacgaaaaaacctcgaccgaaaaactataaataaaatccaacacctctccgaaaccgcaaaacaacgccaacgaacgcgaaacgaacgaaacgaaacaacccaaaacgaacgcctacctacgcttcacgtccgcatccatcaaccgcaactcctacaacacccgacgcacgcaaccctcgaaaatcttaatacctacgaacaaaacgtcgaaatcaaaaccgacgctaaaaactcgaaccttcccgaaacgcccgccgcccactcacccacttacttcttcctatccttaatcttcaaccgcacgatctacaaataactactactactaacgtcgaccataacgacgacgatacgaccccacacgcgcaacaacgcgccgcacaacatataataataccgcaaccgcaacccctacaaacaatccttaccctcctacgccaaccgacaataccgattcctacgaacgaaacgaatcgtctcgactcaaacgaatcccaaaaacccgcaaactccccaaataccctaaaatctcccgcctcctctcaaaatctcgaaaacccccgat

SEQ ID NO: 2709 - DNA, 764 bp, Artificial Sequence
  chemically treated genomic DNA (Homo sapiens) CpG-island No: 2709
gtcgcgcgattttcgagttttaggtaagcgggaaattttattttataagaaagttttttttttcgaggtacgggcgtatgcgcgggtcggttattcgttggggtcgcggggtcgtcgttttggttcgcgtggggtagtcgttcgcgtttcgtttatgatgacgtacgttcggggcggtggggaaggtaagatggcggcgtttatggaggtggtcgtgtgtacggattcggcggtttcgatgtggagttgtatcgtgtgggaattttattcgggcgttaatttgtttatttatcgcggcggttaggcgggatttcgcggtttggcgttgtttaatggcgagtatttgttggcggcgtagttgggtaagaattatattagcgtttgggagttttagcggaaggtgcggcggtgcggtttcgttgttggggttatggggcgttcgaggttgaagtcgggggatgggttggtgggggtcgcgtgtatttttagtcggaattggcgtggggaggggaggtggttttcgttcgggcgttttgcgtatgcgcgggtttgggggttttggggagatacgtgcgatttgttaggtcgttttgcgtacgcgcggggtttaggtttgagttgttatgggggtagtgggggaaaatgggagacgtttcggggggttttttggggtaattgcgtatgtacgagtttttggagcgcgaaatttgattaaaaggggtttatgagttttgtggatgttgtggttttggaggaaaagggag

SEQ ID NO: 2710 - DNA, 764 bp, Artificial Sequence
  chemically treated genomic DNA (Homo sapiens) CpG-island No: 2710
ctcccttttcctccaaaaccacaacatccacaaaactcataaaccccttttaatcaaatttcgcgctccaaaaactcgtacatacgcaattaccccaaaaaaccccccgaaacgtctcccattttcccccactacccccataacaactcaaacctaaaccccgcgcgtacgcaaaacgacctaacaaatcgcacgtatctccccaaaacccccaaacccgcgcatacgcaaaacgcccgaacgaaaaccacctcccctccccacgccaattccgactaaaaatacacgcgacccccaccaacccatcccccgacttcaacctcgaacgccccataaccccaacaacgaaaccgcaccgccgcaccttccgctaaaactcccaaacgctaatataattcttacccaactacgccgccaacaaatactcgccattaaacaacgccaaaccgcgaaatcccgcctaaccgccgcgataaataaacaaattaacgcccgaataaaattcccacacgatacaactccacatcgaaaccgccgaatccgtacacacgaccacctccataaacgccgccatcttaccttccccaccgccccgaacgtacgtcatcataaacgaaacgcgaacgactaccccacgcgaaccaaaacgacgaccccgcgaccccaacgaataaccgacccgcgcatacgcccgtacctcgaaaaaaaaaactttcttataaaataaaatttcccgcttacctaaaactcgaaaatcgcgcgac

SEQ ID NO: 2711 - DNA, 764 bp, Artificial Sequence
  chemically treated genomic DNA (Homo sapiens) CpG-island No: 2711
ttttttttttttttagaattataatatttatagagtttataggttttttttaattaaatttcgcgttttaagaattcgtgtatgcgtaattgttttaagggatttttcggagcgttttttatttttttttattgtttttatagtagtttaggtttgagtttcgcgcgtgcgtagagcggtttaataggtcgtacgtatttttttaaagtttttagattcgcgtatgcgtagagcgttcgaacggagattattttttttttttacgttaatttcgattaagggtgtacgcggtttttattaatttatttttcgattttagtttcgggcgttttatgattttagtagcgagatcgtatcgtcgtatttttcgttggagtttttaggcgttgatgtaatttttgtttagttgcgtcgttagtagatattcgttattgagtagcgttaggtcgcggggtttcgtttggtcgtcgcggtaggtgagtaggttggcgttcgagtgaagtttttatacgatgtagttttatatcggggtcgtcgagttcgtatatacggttatttttatgggcgtcgttattttgttttttttatcgtttcggacgtgcgttattatgagcgagacgcggacgattgttttacgcgggttagagcggcggtttcgcggttttagcgggtggtcgattcgcgtatgcgttcgtgtttcggagagaggggtttttttgtgaagtgggatttttcgtttatttgagattcgagggtcgcgcggt

SEQ ID NO: 2712 - DNA, 764 bp, Artificial Sequence
  chemically treated genomic DNA (Homo sapiens) CpG-island No: 2712
accgcgcgaccctcgaatctcaaataaacgaaaaatcccacttcacaaaaaaacccctctctccgaaacacgaacgcatacgcgaatcgaccacccgctaaaaccgcgaaaccgccgctctaacccgcgtaaaacaatcgtccgcgtctcgctcataataacgcacgtccgaaacgataaaaaaaacaaaataacgacgcccataaaaataaccgtatatacgaactcgacgaccccgatataaaactacatcgtataaaaacttcactcgaacgccaacctactcacctaccgcgacgaccaaacgaaaccccgcgacctaacgctactcaataacgaatatctactaacgacgcaactaaacaaaaattacatcaacgcctaaaaactccaacgaaaaatacgacgatacgatctcgctactaaaatcataaaacgcccgaaactaaaatcgaaaaataaattaataaaaaccgcgtacacccttaatcgaaattaacgtaaaaaaaaaaaataatctccgttcgaacgctctacgcatacgcgaatctaaaaactttaaaaaaatacgtacgacctattaaaccgctctacgcacgcgcgaaactcaaacctaaactactataaaaacaataaaaaaaaataaaaaacgctccgaaaaatcccttaaaacaattacgcatacacgaattcttaaaacgcgaaatttaattaaaaaaaacctataaactctataaatattataattctaaaaaaaaaaaaaa

SEQ ID NO: 2713 - DNA, 1501 bp, Artificial Sequence
  chemically treated genomic DNA (Homo sapiens) CpG-island No: 2713
gtcgagataacgggaaggcggttagtcgtattaattagtagcgtttaagtttcgttagcgtagatttgttgttcgcggttaggtcgggtagttgttgattttcgggttatttttttaaagtttaggtagagcgcgggtgggaagcgtgcgaggagagttgagttagggagttgcggggaggagaaggtaagaatgttttagagaaaaagtcggagagggttgtaaattggttggttcggttggcggggttcggcgcggcggaagcgggaggagaggggaaggaaggggaggggaggggaggggagggggttagcgttttaaagtttcgcgtttcggcggcgtcggcgttagggttgtttatttaataggagcgtggtttaggttcggtcgcgtttcgcgcgtcgtaggtttagcgtttagcgtagtcgggcggttaggcgttttttaaggtcgttttcggcgggcggcgcgtcgggttcggcgcggggtttttttttgttcgcggcgtttttgcgtttcggggataggggcgcgcgttcgggtttcggtttttcggcgtcgacgttcgacgttttttttagcggcgattgtgaggcgcggggtggttggggcggtttgggagtcgtttttcggtgtttgtttcgcgtttgtaggattattttggtatagtcgcgttcgttcgttgcgcgcgttcggacggcggttagagaacggcgggttggttgggcggttgggcgtagtttattttttagcgggcgggcgggcggagggtggagggcgggttcgttttttttcgcgggtcgggaggcggggagatcgtggaggtcgggcggttgttgtttggttggtagtatcgtcgggaggcggcgtcggatttgttagttcgtcgtcgttgtcgtcgtttcggttgttacggcgatcgcggaacgtcggggggcgggggcggggatattttgcgagcggtcgcggtttcgttttcgtcgtttttttgcgtcggacgcgcgttttaggtcggttagcgcgtacgcgcggattttcggcgtaggcggggttcgatttttttggcgttcggttatttatattttttcggcgttcgcgcggggttcggtcggtgcgaggacgcgggggcggacggtttttcggaggcggtcgtttttttattgtgggagtgatggggtcgaaggaagagttttttcgggatcggggcgttgatttaagtttcggagtttgttaaggttgcgtttggagttcgcgtaggcgagacgcggcggggtagggagaaggcgttcggagcggttatttaggggcgttgtgcgtgcgttttgggcgtttggtcggttttatcgatgtgaagcgcgcgggtggtaattaagttatcgttttcgtttatttttcgtagtgtggtcgcgtaatttggagcgtagttttttatttatcgataagaagaacgggtgcgattcgatttaagatagtaatagagtattaaaatagtagtttggaa

SEQ ID NO: 2714 - DNA, 1501 bp, Artificial Sequence
  chemically treated genomic DNA (Homo sapiens) CpG-island No: 2714
ttccaaactactattttaatactctattactatcttaaatcgaatcgcacccgttcttcttatcgataaataaaaaactacgctccaaattacgcgaccacactacgaaaaataaacgaaaacgataacttaattaccacccgcgcgcttcacatcgataaaaccgaccaaacgcccaaaacgcacgcacaacgcccctaaataaccgctccgaacgccttctccctaccccgccgcgtctcgcctacgcgaactccaaacgcaaccttaacaaactccgaaacttaaatcaacgccccgatcccgaaaaaactcttccttcgaccccatcactcccacaataaaaaaacgaccgcctccgaaaaaccgtccgcccccgcgtcctcgcaccgaccgaaccccgcgcgaacgccgaaaaaatataaataaccgaacgccaaaaaaatcgaaccccgcctacgccgaaaatccgcgcgtacgcgctaaccgacctaaaacgcgcgtccgacgcaaaaaaacgacgaaaacgaaaccgcgaccgctcgcaaaatatccccgcccccgccccccgacgttccgcgatcgccgtaacaaccgaaacgacgacaacgacgacgaactaacaaatccgacgccgcctcccgacgatactaccaaccaaacaacaaccgcccgacctccacgatctccccgcctcccgacccgcgaaaaaaaacgaacccgccctccaccctccgcccgcccgcccgctaaaaaataaactacgcccaaccgcccaaccaacccgccgttctctaaccgccgtccgaacgcgcgcaacgaacgaacgcgactataccaaaataatcctacaaacgcgaaacaaacaccgaaaaacgactcccaaaccgccccaaccaccccgcgcctcacaatcgccgctaaaaaaaacgtcgaacgtcgacgccgaaaaaccgaaacccgaacgcgcgcccctatccccgaaacgcaaaaacgccgcgaacaaaaaaaaaccccgcgccgaacccgacgcgccgcccgccgaaaacgaccttaaaaaacgcctaaccgcccgactacgctaaacgctaaacctacgacgcgcgaaacgcgaccgaacctaaaccacgctcctattaaataaacaaccctaacgccgacgccgccgaaacgcgaaactttaaaacgctaaccccctcccctcccctcccctccccttccttcccctctcctcccgcttccgccgcgccgaaccccgccaaccgaaccaaccaatttacaaccctctccgactttttctctaaaacattcttaccttctcctccccgcaactccctaactcaactctcctcgcacgcttcccacccgcgctctacctaaactttaaaaaaataacccgaaaatcaacaactacccgacctaaccgcgaacaacaaatctacgctaacgaaacttaaacgctactaattaatacgactaaccgccttcccgttatctcgac

SEQ ID NO: 2715 - DNA, 1501 bp, Artificial Sequence
  chemically treated genomic DNA (Homo sapiens) CpG-island No: 2715
ttttaggttgttattttaatattttgttattattttaaatcgggtcgtattcgttttttttgtcggtgagtgaggggttgcgttttaagttgcgcgattatattgcggggagtaaacggagacggtgatttgattgttattcgcgcgttttatatcggtggggtcgattaggcgtttagggcgtacgtatagcgtttttaagtggtcgtttcgggcgttttttttttgtttcgtcgcgtttcgtttgcgcgggttttaagcgtagttttaataggtttcgaaatttgaattagcgtttcgatttcgagagggtttttttttcggttttattatttttataatggaagggcggtcgttttcggaaggtcgttcgttttcgcgttttcgtatcggtcgagtttcgcgcgggcgtcgaagaggtgtgggtagtcgggcgttagaggggtcgggtttcgtttgcgtcggaagttcgcgcgtgcgcgttggtcggtttggagcgcgcgttcggcgtagaggggcggcgggggcggggtcgcggtcgttcgtagggtgttttcgttttcgtttttcggcgtttcgcggtcgtcgtgataatcggagcggcggtaacggcggcgggttagtaagttcggcgtcgtttttcggcggtattgttagttaggtagtagtcgttcggtttttacgattttttcgtttttcggttcgcggggagggacgagttcgttttttatttttcgttcgttcgttcgttggagagtgagttgcgtttagtcgtttagttagttcgtcgttttttggtcgtcgttcgggcgcgcgtagcgagcgggcgcgattatgttaagatggttttgtaggcgcggaataagtatcgggaggcggtttttaagtcgttttagttatttcgcgttttatagtcgtcgttgaggggggcgtcggacgtcggcgtcggggagtcggggttcgagcgcgcgtttttgttttcggggcgtaagggcgtcgcgggtaggaaggggtttcgcgtcgagttcggcgcgtcgttcgtcgggggcggttttggggggcgtttggtcgttcggttgcgttgggcgttgggtttgcggcgcgcggggcgcggtcggatttggattacgtttttgttaggtgagtagttttagcgtcggcgtcgtcgggacgcggaattttgaggcgttggtttttttttttttttttttttttttttttttttttttttttttcgttttcgtcgcgtcgagtttcgttagtcggattagttagtttgtagtttttttcgattttttttttgggatatttttattttttttttttcgtaattttttggtttagtttttttcgtacgttttttattcgcgttttgtttgggttttaaaagaatggttcggggattaatagttgttcggtttggtcgcgggtagtaggtttgcgttaacgagatttgagcgttgttgattggtacgattggtcgttttttcgttatttcggt

SEQ ID NO: 2716 - DNA, 1501 bp, Artificial Sequence
  chemically treated genomic DNA (Homo sapiens) CpG-island No: 2716
accgaaataacgaaaaaacgaccaatcgtaccaatcaacaacgctcaaatctcgttaacgcaaacctactacccgcgaccaaaccgaacaactattaatccccgaaccattcttttaaaacccaaacaaaacgcgaataaaaaacgtacgaaaaaaactaaaccaaaaaattacgaaaaaaaaaaaataaaaatatcccaaaaaaaaaatcgaaaaaaactacaaactaactaatccgactaacgaaactcgacgcgacgaaaacgaaaaaaaaaaaaaaaaaaaaaaaaaaaaaaaaaaaaaaaaaaaccaacgcctcaaaattccgcgtcccgacgacgccgacgctaaaactactcacctaacaaaaacgtaatccaaatccgaccgcgccccgcgcgccgcaaacccaacgcccaacgcaaccgaacgaccaaacgccccccaaaaccgcccccgacgaacgacgcgccgaactcgacgcgaaaccccttcctacccgcgacgcccttacgccccgaaaacaaaaacgcgcgctcgaaccccgactccccgacgccgacgtccgacgcccccctcaacgacgactataaaacgcgaaataactaaaacgacttaaaaaccgcctcccgatacttattccgcgcctacaaaaccatcttaacataatcgcgcccgctcgctacgcgcgcccgaacgacgaccaaaaaacgacgaactaactaaacgactaaacgcaactcactctccaacgaacgaacgaacgaaaaataaaaaacgaactcgtccctccccgcgaaccgaaaaacgaaaaaatcgtaaaaaccgaacgactactacctaactaacaataccgccgaaaaacgacgccgaacttactaacccgccgccgttaccgccgctccgattatcacgacgaccgcgaaacgccgaaaaacgaaaacgaaaacaccctacgaacgaccgcgaccccgcccccgccgcccctctacgccgaacgcgcgctccaaaccgaccaacgcgcacgcgcgaacttccgacgcaaacgaaacccgacccctctaacgcccgactacccacacctcttcgacgcccgcgcgaaactcgaccgatacgaaaacgcgaaaacgaacgaccttccgaaaacgaccgcccttccattataaaaataataaaaccgaaaaaaaaaccctctcgaaatcgaaacgctaattcaaatttcgaaacctattaaaactacgcttaaaacccgcgcaaacgaaacgcgacgaaacaaaaaaaaaacgcccgaaacgaccacttaaaaacgctatacgtacgccctaaacgcctaatcgaccccaccgatataaaacgcgcgaataacaatcaaatcaccgtctccgtttactccccgcaatataatcgcgcaacttaaaacgcaacccctcactcaccgacaaaaaaaacgaatacgacccgatttaaaataataacaaaatattaaaataacaacctaaaa

SEQ ID NO: 2717 - DNA, 902 bp, Artificial Sequence
  chemically treated genomic DNA (Homo sapiens) CpG-island No: 2717
ttcgtcgatagattttttcgtttaggcgttttttttcgtataggttgtcggcgagtttagtttcggtattttatagattttcgtttcgcgtttacgtttcgttattttagtttttttttttgttagatcgcggtttagttcgtcgacgttattttttttaaggatgttggtttttgtatcgttagggagcgggttagtgataggatcgtgttgaaatagaagtttcgcgaggcgttggagtcggagtcggagtagtcgtcgtcgttttcgttttcgttttcgttttttcgggtcggggttatcgttattattttacgagtcgcggcgttgttcgtcggtttttcgtttttggttcgcgagcgttcgattttagggcgtaggagtaggtgtattcggttttttcgttacgtgattttttagttgttgatattagatagggcgtggttgcggggcgggtttatcgttgtaggggagagaggggatggatagtaggttgcggttgcgcgcgtcggatgtgggttttttttagtcgatttgcgcgatggtcggtttcgagggcggggttatttgcgcgcgacgcgcggaaggagttcgcgcgacgatcgcggggtcggcgggcggggcgaggttttggacggcggcggtagtggggtttttttttttgttttttagatcgagagtcgcgtcggtattatgttagtttattttaaaagttataattcgttcgacgacgacggggaggacgaaggcgttcggtcggttttttggagggacgttcgagattttttcgacgggttcgacgcgttcgcggataggtagtagtatttgcggtaggaggtttttcgtagggttgaggttacggtcgttagtattagtaggtttttggtttttatgtacgagtt

SEQ ID NO: 2718 - DNA, 902 bp, Artificial Sequence
  chemically treated genomic DNA (Homo sapiens) CpG-island No: 2718
aactcgtacataaaaaccaaaaacctactaatactaacgaccgtaacctcaaccctacgaaaaacctcctaccgcaaatactactacctatccgcgaacgcgtcgaacccgtcgaaaaaatctcgaacgtccctccaaaaaaccgaccgaacgccttcgtcctccccgtcgtcgtcgaacgaattataacttttaaaataaactaacataataccgacgcgactctcgatctaaaaaacaaaaaaaaaaaccccactaccgccgccgtccaaaacctcgccccgcccgccgaccccgcgatcgtcgcgcgaactccttccgcgcgtcgcgcgcaaataaccccgccctcgaaaccgaccatcgcgcaaatcgactaaaaaaaacccacatccgacgcgcgcaaccgcaacctactatccatcccctctctcccctacaacgataaacccgccccgcaaccacgccctatctaatatcaacaactaaaaaatcacgtaacgaaaaaaccgaatacacctactcctacgccctaaaatcgaacgctcgcgaaccaaaaacgaaaaaccgacgaacaacgccgcgactcgtaaaataataacgataaccccgacccgaaaaaacgaaaacgaaaacgaaaacgacgacgactactccgactccgactccaacgcctcgcgaaacttctatttcaacacgatcctatcactaacccgctccctaacgatacaaaaaccaacatccttaaaaaaaataacgtcgacgaactaaaccgcgatctaacaaaaaaaaaaactaaaataacgaaacgtaaacgcgaaacgaaaatctataaaataccgaaactaaactcgccgacaacctatacgaaaaaaaacgcctaaacgaaaaaatctatcgacgaa

SEQ ID NO: 2719 - DNA, 902 bp, Artificial Sequence
  chemically treated genomic DNA (Homo sapiens) CpG-island No: 2719
gattcgtatatgagggttagggatttgttggtgttggcggtcgtggttttagttttgcggaggattttttgtcgtaagtattgttgtttgttcgcgggcgcgtcgggttcgtcggggaggtttcgggcgtttttttaaggggtcggtcgggcgttttcgtttttttcgtcgtcgtcgaacggattgtagtttttagggtaagttgatatggtgtcggcgcggttttcggtttgggaaatagaaggaggagttttattgtcgtcgtcgtttagggtttcgtttcgttcgtcgatttcgcggtcgtcgcgcgaatttttttcgcgcgtcgcgcgtaggtggtttcgttttcggagtcgattatcgcgtaggtcggttggggggggtttatattcggcgcgcgtaatcgtagtttattgtttatttttttttttttttgtagcggtgggttcgtttcgtagttacgttttatttagtgttagtaattgagaggttacgtggcgggaaagtcggatgtatttatttttgcgttttgaggtcgggcgttcgcgggttaggagcggggagtcggcgggtagcgtcgcggttcgtgaggtgatggcggtggtttcggttcggagaggcggaggcggaggcggaggcggcggcggttgtttcggtttcggttttagcgtttcgcggggtttttattttaatacggttttgttattggttcgttttttggcggtgtagagattagtatttttggagaaggtaacgtcggcgggttgggtcgcggtttgataggaggaggggttggggtgacgaagcgtggacgcgggacgagggtttgtgggatgtcgaggttgggttcgtcggtagtttgtgcgggagggggcgtttgagcggagggatttatcggcgga

SEQ ID NO: 2720 - DNA, 902 bp, Artificial Sequence
  chemically treated genomic DNA (Homo sapiens) CpG-island No: 2720
tccgccgataaatccctccgctcaaacgccccctcccgcacaaactaccgacgaacccaacctcgacatcccacaaaccctcgtcccgcgtccacgcttcgtcaccccaacccctcctcctatcaaaccgcgacccaacccgccgacgttaccttctccaaaaatactaatctctacaccgccaaaaaacgaaccaataacaaaaccgtattaaaataaaaaccccgcgaaacgctaaaaccgaaaccgaaacaaccgccgccgcctccgcctccgcctccgcctctccgaaccgaaaccaccgccatcacctcacgaaccgcgacgctacccgccgactccccgctcctaacccgcgaacgcccgacctcaaaacgcaaaaataaatacatccgactttcccgccacgtaacctctcaattactaacactaaataaaacgtaactacgaaacgaacccaccgctacaaaaaaaaaaaaaaataaacaataaactacgattacgcgcgccgaatataaaccccccccaaccgacctacgcgataatcgactccgaaaacgaaaccacctacgcgcgacgcgcgaaaaaaattcgcgcgacgaccgcgaaatcgacgaacgaaacgaaaccctaaacgacgacgacaataaaactcctccttctatttcccaaaccgaaaaccgcgccgacaccatatcaacttaccctaaaaactacaatccgttcgacgacgacgaaaaaaacgaaaacgcccgaccgaccccttaaaaaaacgcccgaaacctccccgacgaacccgacgcgcccgcgaacaaacaacaatacttacgacaaaaaatcctccgcaaaactaaaaccacgaccgccaacaccaacaaatccctaaccctcatatacgaatc

SEQ ID NO: 2721 - DNA, 831 bp, Artificial Sequence
  chemically treated genomic DNA (Homo sapiens) CpG-island No: 2721
tttgttcgattttcgtagtagtagcgcgatcggatggtatgggtgttattacgcggtggttatttttattgttgcgaagcgtcggcggcgggatttcggagggggcgttttcggggtgcgaggttcggtatttcggaaatttttcgggagggaggggttgggagaaataaatttttttttttagagttgcgtaagagttagcgcggtagggttagagtgggaaggttagagcgggcgttttcgttagtgattttacgtcgttcgttcgcgtttaattcggttttcgtcgagtgtttaaattaaaagcgaaaggaattcgatttcgcgtttttttcggcggtttcgtagtcgcgttcgtttggagttcgtcgggcgttttcgattttgtcgggtcgttttgtgattttattcgtttcgtaataagttcgggtagttcgcgttttatttattttggttcggtagtttcgtcgttcgtagtttcgtttcgtttttcgcgtttttttttttttcggggttgggtttgtttcggtcgtcgcggagtttttttttttatcgttcgtgagtgtacgcgttcggtcgtcgtttttaggtagttcggagtaattcggcgttcggtttcgttgggcgtagtatttcgtcggcggcggcggcggcgcgatgttgtgttttttgaggggaatggttttcgtttttttttttttggtgatttggtcgttagtcgtttttattattttttacgtggtcgtcgtgtttttcgggtacgttaatttttttttttcgtatattaggtgagtggtagggtgggcgttagggttttaggagtaggtatag

SEQ ID NO: 2722 - DNA, 831 bp, Artificial Sequence
  chemically treated genomic DNA (Homo sapiens) CpG-island No: 2722
ctatacctactcctaaaaccctaacgcccaccctaccactcacctaatatacgaaaaaaaaaaattaacgtacccgaaaaacacgacgaccacgtaaaaaataataaaaacgactaacgaccaaatcaccaaaaaaaaaaaaacgaaaaccattcccctcaaaaaacacaacatcgcgccgccgccgccgccgacgaaatactacgcccaacgaaaccgaacgccgaattactccgaactacctaaaaacgacgaccgaacgcgtacactcacgaacgataaaaaaaaaaactccgcgacgaccgaaacaaacccaaccccgaaaaaaaaaaaaacgcgaaaaacgaaacgaaactacgaacgacgaaactaccgaaccaaaataaataaaacgcgaactacccgaacttattacgaaacgaataaaatcacaaaacgacccgacaaaatcgaaaacgcccgacgaactccaaacgaacgcgactacgaaaccgccgaaaaaaacgcgaaatcgaattcctttcgcttttaatttaaacactcgacgaaaaccgaattaaacgcgaacgaacgacgtaaaatcactaacgaaaacgcccgctctaaccttcccactctaaccctaccgcgctaactcttacgcaactctaaaaaaaaaaatttatttctcccaacccctccctcccgaaaaatttccgaaataccgaacctcgcaccccgaaaacgccccctccgaaatcccgccgccgacgcttcgcaacaataaaaataaccaccgcgtaataacacccataccatccgatcgcgctactactacgaaaatcgaacaaa

SEQ ID NO: 2723 - DNA, 831 bp, Artificial Sequence
  chemically treated genomic DNA (Homo sapiens) CpG-island No: 2723
ttgtgtttgtttttggggttttgacgtttattttgttatttatttgatatacgggaggaaggggttgacgtgttcggagagtacggcgattacgtaggagataatgaaggcggttgacgattaggttattaagaggaaggggacgaaagttattttttttaggaagtatagtatcgcgtcgtcgtcgtcgtcgacggagtgttgcgtttagcggggtcgggcgtcgggttgtttcgggttgtttggaggcggcggtcgggcgcgtatatttacggacggtgggaggggaggtttcgcgacggtcggggtaggtttagtttcggagggaggggaagcgcgaggagcggagcgaggttgcgggcggcgaggttgtcgggttagagtgggtggggcgcgggttgttcgggtttgttgcgaaacgagtgaagttataaagcggttcggtagggtcggaggcgttcggcgagttttaagcggacgcgattacggagtcgtcggaggggacgcggggtcgggtttttttcgtttttggtttggatattcggcggaggtcgggttgggcgcggacgggcggcgtggggttattggcggggacgttcgttttggtttttttattttggttttatcgcgttggtttttgcgtaattttggagaaaaggatttattttttttaatttttttttttcgggggattttcggagtgtcgggtttcgtatttcgagggcgtttttttcgaggtttcgtcgtcggcgtttcgtagtagtgagagtggttatcgcgtggtgatatttatgttattcggtcgcgttgttgttgcgggggtcgggtaga

SEQ ID NO: 2724 - DNA, 831 bp, Artificial Sequence
  chemically treated genomic DNA (Homo sapiens) CpG-island No: 2724
tctacccgacccccgcaacaacaacgcgaccgaataacataaatatcaccacgcgataaccactctcactactacgaaacgccgacgacgaaacctcgaaaaaaacgccctcgaaatacgaaacccgacactccgaaaatcccccgaaaaaaaaaaattaaaaaaaataaatccttttctccaaaattacgcaaaaaccaacgcgataaaaccaaaataaaaaaaccaaaacgaacgtccccgccaataaccccacgccgcccgtccgcgcccaacccgacctccgccgaatatccaaaccaaaaacgaaaaaaacccgaccccgcgtcccctccgacgactccgtaatcgcgtccgcttaaaactcgccgaacgcctccgaccctaccgaaccgctttataacttcactcgtttcgcaacaaacccgaacaacccgcgccccacccactctaacccgacaacctcgccgcccgcaacctcgctccgctcctcgcgcttcccctccctccgaaactaaacctaccccgaccgtcgcgaaacctcccctcccaccgtccgtaaatatacgcgcccgaccgccgcctccaaacaacccgaaacaacccgacgcccgaccccgctaaacgcaacactccgtcgacgacgacgacgacgcgatactatacttcctaaaaaaaataactttcgtccccttcctcttaataacctaatcgtcaaccgccttcattatctcctacgtaatcgccgtactctccgaacacgtcaaccccttcctcccgtatatcaaataaataacaaaataaacgtcaaaaccccaaaaacaaacacaa

SEQ ID NO: 2725 - DNA, 561 bp, Artificial Sequence
  chemically treated genomic DNA (Homo sapiens) CpG-island No: 2725
cggtcggtttcgcggggcgtagaggcgtaggaatgtagagtcgggacggggtttatatattttttcgtatttacggtttatttttagttatggttgtttcggtttcgtattcgttacgtttttcgcgcgtttttagacgtatgggtaagggagttcgttggttttttcgtagtttcggggtgtttagttgagttaggtgcggacgtagatagcgtaaggtttgatttcgagcggtcggaggtcgggatcgtttcgtaagcgcgtttatttcggttcgcggcgtcggtttcgggcgtattttcgggagttgggtggttgcgcgcgttttaggcggtaggcgaacgacgtgcggtatcgggcggagttagggggcgggggcggagttgatatcgaagtttttattggtcgtcggggacgtttcgtttttttttggcgttgtagtttaggagtttttatcgatatggtagcgaggttttcgagttaacgttatttttcgtttttttcgttatttatttattaattattgtttttgagtttttttattttttattcgttatttat

SEQ ID NO: 2726 - DNA, 561 bp, Artificial Sequence
  chemically treated genomic DNA (Homo sapiens) CpG-island No: 2726
ataaataacgaataaaaaataaaaaaactcaaaaacaataattaataaataaataacgaaaaaaacgaaaaataacgttaactcgaaaacctcgctaccatatcgataaaaactcctaaactacaacgccaaaaaaaaacgaaacgtccccgacgaccaataaaaacttcgatatcaactccgcccccgccccctaactccgcccgataccgcacgtcgttcgcctaccgcctaaaacgcgcgcaaccacccaactcccgaaaatacgcccgaaaccgacgccgcgaaccgaaataaacgcgcttacgaaacgatcccgacctccgaccgctcgaaatcaaaccttacgctatctacgtccgcacctaactcaactaaacaccccgaaactacgaaaaaaccaacgaactcccttacccatacgtctaaaaacgcgcgaaaaacgtaacgaatacgaaaccgaaacaaccataactaaaaataaaccgtaaatacgaaaaaatatataaaccccgtcccgactctacattcctacgcctctacgccccgcgaaaccgaccg

SEQ ID NO: 2727 - DNA, 561 bp, Artificial Sequence
  chemically treated genomic DNA (Homo sapiens) CpG-island No: 2727
ataaatgacgggtgagaagtgaaggaatttaggaatagtgattagtgagtgagtgacggaaggaacggaggatggcgttggttcgggaatttcgttgttatgtcggtggaggtttttgggttgtaacgttagagagaggcggggcgttttcgacggttaataggagtttcggtattagtttcgttttcgttttttagtttcgttcggtgtcgtacgtcgttcgtttgtcgtttgaggcgcgcgtagttatttagttttcggaagtgcgttcggagtcggcgtcgcgggtcgaggtgagcgcgtttgcggggcggtttcggttttcggtcgttcggggttaggttttgcgttatttgcgttcgtatttgatttagttgggtatttcggagttacggaggggttagcgggtttttttgtttatgcgtttgggagcgcgcgggggacgtggcgagtgcggggtcggggtagttatggttgggagtggatcgtgggtgcggggggatgtgtgaatttcgtttcggttttgtatttttgcgtttttgcgtttcgcgggatcggtcg

SEQ ID NO: 2728 - DNA, 561 bp, Artificial Sequence
  chemically treated genomic DNA (Homo sapiens) CpG-island No: 2728
cgaccgatcccgcgaaacgcaaaaacgcaaaaatacaaaaccgaaacgaaattcacacatccccccgcacccacgatccactcccaaccataactaccccgaccccgcactcgccacgtcccccgcgcgctcccaaacgcataaacaaaaaaacccgctaacccctccgtaactccgaaatacccaactaaatcaaatacgaacgcaaataacgcaaaacctaaccccgaacgaccgaaaaccgaaaccgccccgcaaacgcgctcacctcgacccgcgacgccgactccgaacgcacttccgaaaactaaataactacgcgcgcctcaaacgacaaacgaacgacgtacgacaccgaacgaaactaaaaaacgaaaacgaaactaataccgaaactcctattaaccgtcgaaaacgccccgcctctctctaacgttacaacccaaaaacctccaccgacataacaacgaaattcccgaaccaacgccatcctccgttccttccgtcactcactcactaatcactattcctaaattccttcacttctcacccgtcatttat

SEQ ID NO: 2729 - DNA, 585 bp, Artificial Sequence
  chemically treated genomic DNA (Homo sapiens) CpG-island No: 2729
gagtcgggcggttttgtagtttagtatttggttcgggttgcgcgtcgggttttggcgggggcgtgttaggaggcgtgttcggggcgtgtcggaggcggggttaaggcgggggtaagtttcgtttttcggtcgtgcgagaggtcgagtttgttgtattgtagtcgtcgcggcgtcgttcggttttttatttttaataatggcggtttcgagttcgagcggcggcggcggtttcgggggcggtagcggtagcggtattttcggtttcgtagggttttcggcgttaggttattcggtcgttagtagtatgtagggtaaggaacgcggtcgcgtcgagattttagttttttagcgcggtaattcgcgtcgtcgcggtttgttttagcggacgttttcggattcggttgaggaagttacggtagtcgtcggttttttttttttttttttttcggtttttcgtttcgttttcggtcgttttcggttcggtttggattcgggtttcggttcgtataggtttcggtcgcggtttttgtttgcgtttggtttttgggttttatcgggtttttagtaggttcgtagggtttattt

SEQ ID NO: 2730 - DNA, 585 bp, Artificial Sequence
  chemically treated genomic DNA (Homo sapiens) CpG-island No: 2730
aaataaaccctacgaacctactaaaaacccgataaaacccaaaaaccaaacgcaaacaaaaaccgcgaccgaaacctatacgaaccgaaacccgaatccaaaccgaaccgaaaacgaccgaaaacgaaacgaaaaaccgaaaaaaaaaaaaaaaaaaaaccgacgactaccgtaacttcctcaaccgaatccgaaaacgtccgctaaaacaaaccgcgacgacgcgaattaccgcgctaaaaaactaaaatctcgacgcgaccgcgttccttaccctacatactactaacgaccgaataacctaacgccgaaaaccctacgaaaccgaaaataccgctaccgctaccgcccccgaaaccgccgccgccgctcgaactcgaaaccgccattattaaaaataaaaaaccgaacgacgccgcgacgactacaatacaacaaactcgacctctcgcacgaccgaaaaacgaaacttacccccgccttaaccccgcctccgacacgccccgaacacgcctcctaacacgcccccgccaaaacccgacgcgcaacccgaaccaaatactaaactacaaaaccgcccgactc

SEQ ID NO: 2731 - DNA, 585 bp, Artificial Sequence
  chemically treated genomic DNA (Homo sapiens) CpG-island No: 2731
aggtgggttttgcgggtttgttgagagttcggtagggtttaggggttaagcgtaggtagaggtcgcggtcggggtttatgcgggtcggagttcggatttaagtcgggtcggaggcggtcgggagcggggcgggaagtcggggagggagagagggagaagtcggcggttgtcgtggtttttttagtcgggttcgggggcgttcgttggggtaggtcgcgacgacgcgggttgtcgcgttagggggttgggatttcggcgcggtcgcgttttttattttgtatgttgttgacggtcgggtggtttggcgtcggggattttacggggtcgggggtgtcgttgtcgttgtcgttttcggagtcgtcgtcgtcgttcgggttcggagtcgttattgttgggagtgaagagtcgagcggcgtcgcggcggttgtaatgtagtaagttcggtttttcgtacggtcgaggggcgaggtttattttcgttttggtttcgttttcgatacgtttcggatacgttttttgatacgttttcgttagagttcgacgcgtagttcgggttagatgttgagttgtagaatcgttcggttt

SEQ ID NO: 2732 - DNA, 585 bp, Artificial Sequence
  chemically treated genomic DNA (Homo sapiens) CpG-island No: 2732
aaaccgaacgattctacaactcaacatctaacccgaactacgcgtcgaactctaacgaaaacgtatcaaaaaacgtatccgaaacgtatcgaaaacgaaaccaaaacgaaaataaacctcgcccctcgaccgtacgaaaaaccgaacttactacattacaaccgccgcgacgccgctcgactcttcactcccaacaataacgactccgaacccgaacgacgacgacgactccgaaaacgacaacgacaacgacacccccgaccccgtaaaatccccgacgccaaaccacccgaccgtcaacaacatacaaaataaaaaacgcgaccgcgccgaaatcccaaccccctaacgcgacaacccgcgtcgtcgcgacctaccccaacgaacgcccccgaacccgactaaaaaaaccacgacaaccgccgacttctccctctctccctccccgacttcccgccccgctcccgaccgcctccgacccgacttaaatccgaactccgacccgcataaaccccgaccgcgacctctacctacgcttaacccctaaaccctaccgaactctcaacaaacccgcaaaacccacct

SEQ ID NO: 2733 - DNA, 1313 bp, Artificial Sequence
  chemically treated genomic DNA (Homo sapiens) CpG-island No: 2733
cggtattaggcgaggtttttgtcgtagttgcggtcgaagaagtggggttcggcgtttacggcgcgtacgtcggggtgtacgcgtaggaattttagtagcgttcgcgtgtcgtttttttttatttcgatgatgatggtttgcggtagttgtttgttgttttcgtttaggagtagcgttagggttttcggcggggtttcggttacggtgttttcggtttcggagtcgttcggattttttgataggttaggggatttttttttttaggtcgttttttcgtcgtcgtcgcggggcgcgggcggtcggcgttttcgttattgcggtagttgtaggaggcgttttttttgtgtcgtcgtcggttatatcgttagttttttcgggttttcggttaggacgtcgttattaggggttttcgttttttcgtcgtcgtcggatagttttacgacggggtcggatagggtttggtagcgttcggttaggtagtagaagacgtaaagggacgtgagtagggagtagagtattagtaagaattttcggaagatgttgcgggatagcggttcggtcgaggtggagagggtattggtcgggttcggaggggttattttagtcggaggcgacgtcgggtaacgcgtcggttatgttaggtttggatttcgataggtgttagagtattttttcggcgggttagcgcgttggacggaggttatatcgtcgtgcgtttttgtggtcgtgcgaattgtttcgggaggtagcggtcggggtttcgcggggaaacggaatttcgggggtttcgcgtaggatttttgtttttagtcgagggagcgggaaggggaacgcgggttcgtgtttaagaaattatcgttttagattcgtttaagttttgagtttggggtagttttggtttttcggtttttcgtaagagtcgtcggaatcggggttttggtagcggtgtcgaaggcgtgcgttttagtttcggtttcgagagatttttcggcgcggattttcgtttagcgattttgtattattggttcggttttcgtgagggtacgcgcggttgtcgggtttttgcgtttcgtgcgttttagatagtggcgagcgatagtgatttttagtttcggttttttttggtttttttgttcgtttgggcgcgtttttttcgttcgagtttaggtttttttagttaaggagcgaggttttttcgagtttttttgttcgagcgggagataggaggttcgtgtagagtcgtttattttttttcgtagcgtcgggttgttttaaattgtttttggattttatttgtgagtcgcgtggttggg

SEQ ID NO: 2734 - DNA, 1313 bp, Artificial Sequence
  chemically treated genomic DNA (Homo sapiens) CpG-island No: 2734
cccaaccacgcgactcacaaataaaatccaaaaacaatttaaaacaacccgacgctacgaaaaaaaataaacgactctacacgaacctcctatctcccgctcgaacaaaaaaactcgaaaaaacctcgctccttaactaaaaaaacctaaactcgaacgaaaaaaacgcgcccaaacgaacaaaaaaaccaaaaaaaaccgaaactaaaaatcactatcgctcgccactatctaaaacgcacgaaacgcaaaaacccgacaaccgcgcgtaccctcacgaaaaccgaaccaataatacaaaatcgctaaacgaaaatccgcgccgaaaaatctctcgaaaccgaaactaaaacgcacgccttcgacaccgctaccaaaaccccgattccgacgactcttacgaaaaaccgaaaaaccaaaactaccccaaactcaaaacttaaacgaatctaaaacgataatttcttaaacacgaacccgcgttccccttcccgctccctcgactaaaaacaaaaatcctacgcgaaacccccgaaattccgtttccccgcgaaaccccgaccgctacctcccgaaacaattcgcacgaccacaaaaacgcacgacgatataacctccgtccaacgcgctaacccgccgaaaaaatactctaacacctatcgaaatccaaacctaacataaccgacgcgttacccgacgtcgcctccgactaaaataacccctccgaacccgaccaataccctctccacctcgaccgaaccgctatcccgcaacatcttccgaaaattcttactaatactctactccctactcacgtccctttacgtcttctactacctaaccgaacgctaccaaaccctatccgaccccgtcgtaaaactatccgacgacgacgaaaaaacgaaaacccctaataacgacgtcctaaccgaaaacccgaaaaaactaacgatataaccgacgacgacacaaaaaaaacgcctcctacaactaccgcaataacgaaaacgccgaccgcccgcgccccgcgacgacgacgaaaaaacgacctaaaaaaaaaaatcccctaacctatcaaaaaatccgaacgactccgaaaccgaaaacaccgtaaccgaaaccccgccgaaaaccctaacgctactcctaaacgaaaacaacaaacaactaccgcaaaccatcatcatcgaaataaaaaaaaacgacacgcgaacgctactaaaattcctacgcgtacaccccgacgtacgcgccgtaaacgccgaaccccacttcttcgaccgcaactacgacaaaaacctcgcctaataccg

SEQ ID NO: 2735 - DNA, 1313 bp, Artificial Sequence
  chemically treated genomic DNA (Homo sapiens) CpG-island No: 2735
tttagttacgcggtttataggtggggtttaagagtagtttggagtaattcggcgttacggagaggggtggacggttttgtacgggttttttgtttttcgttcgggtagagggattcggggggatttcgttttttggttgagagaatttgaattcgggcggagagaacgcgtttaggcgggtaaggggattagagaaagtcggggttggaagttattgtcgttcgttattgtttggagcgtacggagcgtagaggttcggtagtcgcgcgtgtttttacggggatcgagttagtgatgtaggatcgttgagcggagattcgcgtcgagaagtttttcggggtcggggttgagacgtacgttttcgatatcgttgttaagatttcgatttcggcgatttttgcggggaatcgaggggttaaggttgttttaagtttaggatttgggcgagtttaagacgatggttttttaagtacggattcgcgttttttttttcgttttttcgattggaggtagggattttgcgcggggttttcgggatttcgttttttcgcggagtttcggtcgttgtttttcgggatagttcgtacggttataggggcgtacggcgatgtggttttcgtttagcgcgttggttcgtcggggggatgttttggtatttgtcggggtttaggtttagtatggtcggcgcgttgttcgacgtcgttttcggttaggatggttttttcgggttcggttagtgttttttttatttcggtcgagtcgttgtttcgtagtatttttcggaagtttttgttgatgttttgttttttgtttacgtttttttacgttttttattgtttggtcgagcgttgttagattttgttcggtttcgtcgtggggttgttcggcggcggcgaggaggcgggggtttttggtggcggcgttttggtcggaggttcgagggagttggcggtgtggtcggcggcggtatagagaaagcgttttttgtaattgtcgtagtggcggaggcgtcggtcgttcgcgtttcgcgacgacggcgaggaggcggtttgggaagaagagttttttggtttgttagggggttcgggcggtttcggggtcggaagtatcgtggtcgaggtttcgtcggggattttggcgttgtttttggacgaaggtagtaagtagttgtcgtaggttattattatcggagtgaagaagggcggtacgcgggcgttgttggagtttttgcgcgtgtatttcgacgtgcgcgtcgtgggcgtcgagttttattttttcgatcgtagttacgataagggtttcgtttggtatcg

SEQ ID NO: 2736 - DNA, 1313 bp, Artificial Sequence
  chemically treated genomic DNA (Homo sapiens) CpG-island No: 2736
cgataccaaacgaaacccttatcgtaactacgatcgaaaaaataaaactcgacgcccacgacgcgcacgtcgaaatacacgcgcaaaaactccaacaacgcccgcgtaccgcccttcttcactccgataataataacctacgacaactacttactaccttcgtccaaaaacaacgccaaaatccccgacgaaacctcgaccacgatacttccgaccccgaaaccgcccgaaccccctaacaaaccaaaaaactcttcttcccaaaccgcctcctcgccgtcgtcgcgaaacgcgaacgaccgacgcctccgccactacgacaattacaaaaaacgctttctctataccgccgccgaccacaccgccaactccctcgaacctccgaccaaaacgccgccaccaaaaacccccgcctcctcgccgccgccgaacaaccccacgacgaaaccgaacaaaatctaacaacgctcgaccaaacaataaaaaacgtaaaaaaacgtaaacaaaaaacaaaacatcaacaaaaacttccgaaaaatactacgaaacaacgactcgaccgaaataaaaaaaacactaaccgaacccgaaaaaaccatcctaaccgaaaacgacgtcgaacaacgcgccgaccatactaaacctaaaccccgacaaataccaaaacatccccccgacgaaccaacgcgctaaacgaaaaccacatcgccgtacgcccctataaccgtacgaactatcccgaaaaacaacgaccgaaactccgcgaaaaaacgaaatcccgaaaaccccgcgcaaaatccctacctccaatcgaaaaaacgaaaaaaaaaacgcgaatccgtacttaaaaaaccatcgtcttaaactcgcccaaatcctaaacttaaaacaaccttaacccctcgattccccgcaaaaatcgccgaaatcgaaatcttaacaacgatatcgaaaacgtacgtctcaaccccgaccccgaaaaacttctcgacgcgaatctccgctcaacgatcctacatcactaactcgatccccgtaaaaacacgcgcgactaccgaacctctacgctccgtacgctccaaacaataacgaacgacaataacttccaaccccgactttctctaatccccttacccgcctaaacgcgttctctccgcccgaattcaaattctctcaaccaaaaaacgaaatccccccgaatccctctacccgaacgaaaaacaaaaaacccgtacaaaaccgtccacccctctccgtaacgccgaattactccaaactactcttaaaccccacctataaaccgcgtaactaaa

SEQ ID NO: 2737 - DNA, 632 bp, Artificial Sequence
  chemically treated genomic DNA (Homo sapiens) CpG-island No: 2737
ttcgtagttttgtttcgcggtttttttcgaggtcggcgtttcgcgttcgttttttttagagtcggcgcggttggaatgttttttttttttcgcggggtcgttttttgttcgttatgttggaagtcgatttttgttatcgatttcggtttattgaggagcggagggggaagggtgtcgagggttatacggggcggcggagtcgggtgattcgggattattatcggtcgtagtttcgttttttgtattgcgggggcgtcggcgtttttcgtatcgcggtcgttttttttttcgtcgtcggtcggggttgtgtaattcggtggcggcgcgcggtttcgggcgggtttttggggtgaggggcgggggcggttggggtgggggagggaagcggttacgaggggagcggtttgcgtagggtttcgcgcgttagcggtcgcgtttttcgttttcgggtgcggcgggaggcgcgggtagtcggggcggggagtcggtttcgaagcggagttgagagggaaggaggtcgcgggcggcggtcgcggcgtttttagaggtaggaggtttgggggggcggcggggggatttatttcgggtagaggcggtgtttgaggtcgggtggggtatttagcgggaattta

SEQ ID NO: 2738 - DNA, 632 bp, Artificial Sequence
  chemically treated genomic DNA (Homo sapiens) CpG-island No: 2738
taaattcccgctaaataccccacccgacctcaaacaccgcctctacccgaaataaatccccccgccgcccccccaaacctcctacctctaaaaacgccgcgaccgccgcccgcgacctccttccctctcaactccgcttcgaaaccgactccccgccccgactacccgcgcctcccgccgcacccgaaaacgaaaaacgcgaccgctaacgcgcgaaaccctacgcaaaccgctcccctcgtaaccgcttccctcccccaccccaaccgcccccgcccctcaccccaaaaacccgcccgaaaccgcgcgccgccaccgaattacacaaccccgaccgacgacgaaaaaaaaaacgaccgcgatacgaaaaacgccgacgcccccgcaatacaaaaaacgaaactacgaccgataataatcccgaatcacccgactccgccgccccgtataaccctcgacacccttccccctccgctcctcaataaaccgaaatcgataacaaaaatcgacttccaacataacgaacaaaaaacgaccccgcgaaaaaaaaaaaacattccaaccgcgccgactctaaaaaaaacgaacgcgaaacgccgacctcgaaaaaaaccgcgaaacaaaactacgaa

SEQ ID NO: 2739 - DNA, 632 bp, Artificial Sequence
  chemically treated genomic DNA (Homo sapiens) CpG-island No: 2739
tgggttttcgttgggtattttattcggttttaggtatcgtttttattcgaaatgaattttttcgtcgtttttttaggttttttgtttttaggagcgtcgcggtcgtcgttcgcggttttttttttttttagtttcgtttcgaggtcggtttttcgtttcgattgttcgcgtttttcgtcgtattcgggagcgggaaacgcggtcgttggcgcgcggggttttgcgtaggtcgtttttttcgtggtcgttttttttttttattttaatcgttttcgttttttattttagggattcgttcggggtcgcgcgtcgttatcgggttatataatttcggtcggcgacgggggggggggcggtcgcggtgcggggggcgtcggcgttttcgtagtgtagggggcgaggttgcggtcggtggtgatttcgggttattcggtttcgtcgtttcgtgtggttttcgatattttttttttttcgttttttagtgggtcggagtcggtgataggaatcggtttttaatatggcggataggaagcggtttcgcgaggaggagagaatattttagtcgcgtcggttttggggggagcgggcgcggggcgtcggtttcgggaggagtcgcgggataagattgcggg

SEQ ID NO: 2740 - DNA, 632 bp, Artificial Sequence
  chemically treated genomic DNA (Homo sapiens) CpG-island No: 2740
cccgcaatcttatcccgcgactcctcccgaaaccgacgccccgcgcccgctccccccaaaaccgacgcgactaaaatattctctcctcctcgcgaaaccgcttcctatccgccatattaaaaaccgattcctatcaccgactccgacccactaaaaaacgaaaaaaaaaaaatatcgaaaaccacacgaaacgacgaaaccgaataacccgaaatcaccaccgaccgcaacctcgccccctacactacgaaaacgccgacgccccccgcaccgcgaccgcccccccccccgtcgccgaccgaaattatataacccgataacgacgcgcgaccccgaacgaatccctaaaataaaaaacgaaaacgattaaaataaaaaaaaaaaacgaccacgaaaaaaacgacctacgcaaaaccccgcgcgccaacgaccgcgtttcccgctcccgaatacgacgaaaaacgcgaacaatcgaaacgaaaaaccgacctcgaaacgaaactaaaaaaaaaaaaaaccgcgaacgacgaccgcgacgctcctaaaaacaaaaaacctaaaaaaacgacgaaaaaattcatttcgaataaaaacgatacctaaaaccgaataaaatacccaacgaaaaccca

SEQ ID NO: 2741 - DNA, 617 bp, Artificial Sequence
  chemically treated genomic DNA (Homo sapiens) CpG-island No: 2741
cggttcggtttttcggtgtcgtcgcgcgtttcgggcgcgttcgtcgcgcgttttttttggggagaaagagaaatcgtgtagacggtcggcgcgcgtttattcgtcgttttttttgcggagagcggcgaggtcggttcgaggcgggcgtcgagcgcggagcggaggggggttcgagggaggcgggggtggaattagtttaattttcgaggttggtttcgagggggattcggaatataggttggcggggggtcggcgggggtcgagttttcggaggaggggaaggcggaggtggtttcgtttttgggtattaattattgtttaggcgttcgggttttcgttcgcgtcgttttcgaggtttagcgtttttatttcgttcgttagtagaaagaattgagggggcggttagtacgggaagtaagtgcgggggttcgggtttcgaaggtttaaggtgggcgcgaggttgtcgggggggggatgaggaggtgcgtatcgtatgggggaggggataggtaagtgcggacgggggcgggaaggttttaacgatcggtgggggaggaaatggggagggagttatagaggcgggagggaatggagtggttgcgggggcggtttttggg

SEQ ID NO: 2742 - DNA, 617 bp, Artificial Sequence
  chemically treated genomic DNA (Homo sapiens) CpG-island No: 2742
cccaaaaaccgcccccgcaaccactccattccctcccgcctctataactccctccccatttcctcccccaccgatcgttaaaaccttcccgcccccgtccgcacttacctatcccctcccccatacgatacgcacctcctcatcccccccccgacaacctcgcgcccaccttaaaccttcgaaacccgaacccccgcacttacttcccgtactaaccgccccctcaattctttctactaacgaacgaaataaaaacgctaaacctcgaaaacgacgcgaacgaaaacccgaacgcctaaacaataattaatacccaaaaacgaaaccacctccgccttcccctcctccgaaaactcgacccccgccgaccccccgccaacctatattccgaatccccctcgaaaccaacctcgaaaattaaactaattccacccccgcctccctcgaacccccctccgctccgcgctcgacgcccgcctcgaaccgacctcgccgctctccgcaaaaaaaacgacgaataaacgcgcgccgaccgtctacacgatttctctttctccccaaaaaaaacgcgcgacgaacgcgcccgaaacgcgcgacgacaccgaaaaaccgaaccg

SEQ ID NO: 2743 - DNA, 617 bp, Artificial Sequence
  chemically treated genomic DNA (Homo sapiens) CpG-island No: 2743
tttagaggtcgttttcgtagttattttattttttttcgtttttgtggttttttttttatttttttttttatcggtcgttggggttttttcgttttcgttcgtatttatttgtttttttttttatgcggtacgtatttttttatttttttttcggtaatttcgcgtttattttggattttcggagttcggattttcgtatttgtttttcgtattggtcgtttttttagttttttttgttggcgggcgggatgggggcgttgagtttcggggacggcgcgagcgggggttcgggcgtttagataatagttgatgtttaaggacggggttattttcgtttttttttttttcgggagttcggttttcgtcggtttttcgttagtttgtatttcgggtttttttcggagttagtttcgggaattgggttgattttattttcgtttttttcgggttttttttcgtttcgcgttcggcgttcgtttcgggtcggtttcgtcgtttttcgtagaggaggcggcgagtgagcgcgcgtcggtcgtttatacggtttttttttttttttagggagagcgcgcggcggacgcgttcgggacgcgcggcggtatcgggaggtcgggtcg

SEQ ID NO: 2744 - DNA, 617 bp, Artificial Sequence
  chemically treated genomic DNA (Homo sapiens) CpG-island No: 2744
cgacccgacctcccgataccgccgcgcgtcccgaacgcgtccgccgcgcgctctccctaaaaaaaaaaaaaaaccgtataaacgaccgacgcgcgctcactcgccgcctcctctacgaaaaacgacgaaaccgacccgaaacgaacgccgaacgcgaaacgaaaaaaaacccgaaaaaaacgaaaataaaatcaacccaattcccgaaactaactccgaaaaaaacccgaaatacaaactaacgaaaaaccgacgaaaaccgaactcccgaaaaaaaaaaaaacgaaaataaccccgtccttaaacatcaactattatctaaacgcccgaacccccgctcgcgccgtccccgaaactcaacgcccccatcccgcccgccaacaaaaaaaactaaaaaaacgaccaatacgaaaaacaaatacgaaaatccgaactccgaaaatccaaaataaacgcgaaattaccgaaaaaaaaataaaaaaatacgtaccgcataaaaaaaaaaacaaataaatacgaacgaaaacgaaaaaaccccaacgaccgataaaaaaaaaaataaaaaaaaaaccacaaaaacgaaaaaaaataaaataactacgaaaacgacctctaaa

SEQ ID NO: 2745 - DNA, 680 bp, Artificial Sequence
  chemically treated genomic DNA (Homo sapiens) CpG-island No: 2745
ttcgtgggcggtcgtagttgcggcgattttcggtttttcggggaggtttagataggggtggtttttttggttttcgttttcgcggattttatgatatcgtattggttcgcgggacggggcggggtcgggtgagggggaggagatagttttacgttttggtattcgcggtgatttttacgcggaattttttcgcggtaattcgaagtatcgcgtttgcgtgttgtagtagcgtttggtggcggtggtagtttgttcgcgggtgtgtgaagggagttagtgtggcggtttacgggtattcgttacgatgagtagtattttagttaagatcgcggagatagaagtagaggtaatggacgtagttggcgttttatttttagtttgagtattttttttttggtggcgtcgtttttttttgtttttttttgagtcgcgttaggatcgggtttagatttcgcgattttttttagcgaggttcgtgtttcgattgttttttgttacgattaggagttttcgattttttttagttagggtttttttttttttcgtttcgcgtttacgttttcggatttttttttgttcgggttcgcgtttcgtatttttgtattttaggtttttagttcgtttttttttttagtgtttggtttttgttttgatgttgttttttttcgttttgttttgag

SEQ ID NO: 2746 - DNA, 680 bp, Artificial Sequence
  chemically treated genomic DNA (Homo sapiens) CpG-island No: 2746
ctcaaaacaaaacgaaaaaaaacaacatcaaaacaaaaaccaaacactaaaaaaaaaaacgaactaaaaacctaaaatacaaaaatacgaaacgcgaacccgaacaaaaaaaaatccgaaaacgtaaacgcgaaacgaaaaaaaaaaaaaccctaactaaaaaaaatcgaaaactcctaatcgtaacaaaaaacaatcgaaacacgaacctcgctaaaaaaaatcgcgaaatctaaacccgatcctaacgcgactcaaaaaaaaacaaaaaaaaacgacgccaccaaaaaaaaaatactcaaactaaaaataaaacgccaactacgtccattacctctacttctatctccgcgatcttaactaaaatactactcatcgtaacgaatacccgtaaaccgccacactaactcccttcacacacccgcgaacaaactaccaccgccaccaaacgctactacaacacgcaaacgcgatacttcgaattaccgcgaaaaaattccgcgtaaaaatcaccgcgaataccaaaacgtaaaactatctcctccccctcacccgaccccgccccgtcccgcgaaccaatacgatatcataaaatccgcgaaaacgaaaaccaaaaaaaccacccctatctaaacctccccgaaaaaccgaaaatcgccgcaactacgaccgcccacgaa

SEQ ID NO: 2747 - DNA, 680 bp, Artificial Sequence
  chemically treated genomic DNA (Homo sapiens) CpG-island No: 2747
tttagagtaaaacggaaagaaataatattagaataggagttaaatattgggagggggaacggattaagggtttaaggtgtaggggtgcggaacgcgggttcgggtaaaggggagttcgagagcgtagacgcgggacgaggggaaagggggttttgattgaggagagtcggggatttttagtcgtggtagagggtagtcggaatacgggtttcgttgagagaagtcgcggaatttaggttcggttttgacgcggtttaaaggagaataggaaggagcgacgttattaaagaaggaatgtttagattaagagtgaagcgttagttgcgtttattatttttgtttttattttcgcgattttagttaaggtgttgtttatcgtggcgagtattcgtgggtcgttatattggttttttttatatattcgcgggtaaattgttatcgttattaggcgttattgtagtacgtaggcgcggtatttcgaattatcgcgagagagtttcgcgtaggggttatcgcgagtgttaaagcgtggggttgtttttttttttttattcgatttcgtttcgtttcgcgagttagtgcggtgttatagagttcgcgggagcggaggttagagaggttatttttgtttgggttttttcgagaggtcgagggtcgtcgtagttgcggtcgtttacggg

SEQ ID NO: 2748 - DNA, 680 bp, Artificial Sequence
  chemically treated genomic DNA (Homo sapiens) CpG-island No: 2748
cccgtaaacgaccgcaactacgacgaccctcgacctctcgaaaaaacccaaacaaaaataacctctctaacctccgctcccgcgaactctataacaccgcactaactcgcgaaacgaaacgaaatcgaataaaaaaaaaaaaacaaccccacgctttaacactcgcgataacccctacgcgaaactctctcgcgataattcgaaataccgcgcctacgtactacaataacgcctaataacgataacaatttacccgcgaatatataaaaaaaaccaatataacgacccacgaatactcgccacgataaacaacaccttaactaaaatcgcgaaaataaaaacaaaaataataaacgcaactaacgcttcactcttaatctaaacattccttctttaataacgtcgctccttcctattctcctttaaaccgcgtcaaaaccgaacctaaattccgcgacttctctcaacgaaacccgtattccgactaccctctaccacgactaaaaatccccgactctcctcaatcaaaaccccctttcccctcgtcccgcgtctacgctctcgaactcccctttacccgaacccgcgttccgcacccctacaccttaaacccttaatccgttccccctcccaatatttaactcctattctaatattatttctttccgttttactctaaa

SEQ ID NO: 2749 - DNA, 728 bp, Artificial Sequence
  chemically treated genomic DNA (Homo sapiens) CpG-island No: 2749
gacgcgcggcggagagatttagttttattttagtttcgtttcgcgtagttgtttataagcgttcgcggcggatgagtttatacgagtggcggcggcggtaataggttttgagttcgcgatttggagatagttttggttaatcggacggcgcggaggcggagcggggtcggtcggtatcgcgcggtcgtacgtgcgttacgagtgttttagtcgttttttgttagcgttaggagcgggggattttcggggtttcgggtaggtatttggatagcgtaggttttcgtaaggtcgttttttagggacgtcgtttcgttattgacgtagtattagggttcgcgcgggttttcgttcgggtttcggtagtaattgtgattgtcggtttttaagagaggagagaaggaaatgtgtgtcggggttggtatcgggaacgcggtcgtcgttcgttagtttcggcgtcgtttttcggaggatatttattcgatacggggtcgaggttagttcgttttgcgcgtttagttagttgaggtagcggaggttcggcgcgggggaggtttggttttttcggtataggtggtcgttgttttagaaatagtttgtgaggaaaagaagttttcggatatagaatagcgggtagcgaacggaagacgtttagcgtggcggataggggagtcgggattattcgggttgaattttagtttggttaggggattcgggtattgttgggtttt

SEQ ID NO: 2750 - DNA, 728 bp, Artificial Sequence
  chemically treated genomic DNA (Homo sapiens) CpG-island No: 2750
aaaacccaacaatacccgaatcccctaaccaaactaaaattcaacccgaataatcccgactcccctatccgccacgctaaacgtcttccgttcgctacccgctattctatatccgaaaacttcttttcctcacaaactatttctaaaacaacgaccacctataccgaaaaaaccaaacctcccccgcgccgaacctccgctacctcaactaactaaacgcgcaaaacgaactaacctcgaccccgtatcgaataaatatcctccgaaaaacgacgccgaaactaacgaacgacgaccgcgttcccgataccaaccccgacacacatttccttctctcctctcttaaaaaccgacaatcacaattactaccgaaacccgaacgaaaacccgcgcgaaccctaatactacgtcaataacgaaacgacgtccctaaaaaacgaccttacgaaaacctacgctatccaaatacctacccgaaaccccgaaaatcccccgctcctaacgctaacaaaaaacgactaaaacactcgtaacgcacgtacgaccgcgcgataccgaccgaccccgctccgcctccgcgccgtccgattaaccaaaactatctccaaatcgcgaactcaaaacctattaccgccgccgccactcgtataaactcatccgccgcgaacgcttataaacaactacgcgaaacgaaactaaaataaaactaaatctctccgccgcgcgtc

SEQ ID NO: 2751 - DNA, 728 bp, Artificial Sequence
  chemically treated genomic DNA (Homo sapiens) CpG-island No: 2751
gaggtttagtagtgttcgggttttttaattaggttgaggtttagttcgggtggtttcggtttttttgttcgttacgttgggcgtttttcgttcgttgttcgttattttgtgttcgggggttttttttttttataggttgtttttgggataacggttatttgtatcgggaggattagatttttttcgcgtcgggttttcgttgttttaattggttggacgcgtagagcgggttggtttcggtttcgtgtcgggtaagtgtttttcgggggacggcgtcggggttggcgggcggcggtcgcgttttcggtgttagtttcggtatatatttttttttttttttttttaggggtcggtaattatagttattgtcgaaattcggacgaggattcgcgcgggttttggtgttacgttagtggcgaggcggcgtttttgagaaacggttttgcgaggatttgcgttgtttaggtatttgttcgggatttcgggaatttttcgtttttggcgttgataggaagcggttgagatattcgtggcgtacgtgcggtcgcgcgatgtcggtcggtttcgtttcgttttcgcgtcgttcgattggttagggttgtttttaggtcgcgggtttaaagtttattgtcgtcgtcgttattcgtatgagtttattcgtcgcgagcgtttgtaaataattgcgcggggcgaggttggggtgaggttaggttttttcgtcgcgcgtt

SEQ ID NO: 2752 - DNA, 728 bp, Artificial Sequence
  chemically treated genomic DNA (Homo sapiens) CpG-island No: 2752
aacgcgcgacgaaaaaacctaacctcaccccaacctcgccccgcgcaattatttacaaacgctcgcgacgaataaactcatacgaataacgacgacgacaataaactttaaacccgcgacctaaaaacaaccctaaccaatcgaacgacgcgaaaacgaaacgaaaccgaccgacatcgcgcgaccgcacgtacgccacgaatatctcaaccgcttcctatcaacgccaaaaacgaaaaattcccgaaatcccgaacaaatacctaaacaacgcaaatcctcgcaaaaccgtttctcaaaaacgccgcctcgccactaacgtaacaccaaaacccgcgcgaatcctcgtccgaatttcgacaataactataattaccgacccctaaaaaaaaaaaaaaaaaaatatataccgaaactaacaccgaaaacgcgaccgccgcccgccaaccccgacgccgtcccccgaaaaacacttacccgacacgaaaccgaaaccaacccgctctacgcgtccaaccaattaaaacaacgaaaacccgacgcgaaaaaaatctaatcctcccgatacaaataaccgttatcccaaaaacaacctataaaaaaaaaaaacccccgaacacaaaataacgaacaacgaacgaaaaacgcccaacgtaacgaacaaaaaaaccgaaaccacccgaactaaacctcaacctaattaaaaaacccgaacactactaaacctc

SEQ ID NO: 2753 - DNA, 1073 bp, Artificial Sequence
  chemically treated genomic DNA (Homo sapiens) CpG-island No: 2753
ttgtcgtcgcgttttttatattagtcgattttcgttcggtagttcgttcggttttaattgggcgttgaatatcgatttaaagtattcgttgtaggcggttagtacggcgcggtgcgttgggaagttttcgtcgtttattcgtaagagtacgtcgtagaagcgttcgtcgtttttgcgttgttggtttaggttgtgtagtattttcgtgttgtgtttgtttatttggtatgtgtagtagttagacgggtcgtacgaagcgtcgtttattcgttttatggtcgtcgtttttttttattagttcggtcgttgtatttgttcgtttttttttttttttttagtagcgagaagcggggcgtacgagacgtgtttatattttttatacgtgtcggttcgtggttttgtagtttcgtaggtgcgtcgagtgtatacgtttttagttcggattagattgtttagattgcggggtgtattatttttatatagttaattttcgttttcgttggattgcgcgtaattttttttttttcggtcgttcgtatttttttttcggtttattttttcgggggggtgcgcgagcgaagaggtgcgttttttttgtaaacgcgtttgttatttttcgcgtgtcgttcgttaggcggtcggcgcgtagttaagaagggtacgcgtacgcggggaggcgaaggagggtgttatcgcgtagcggcgcgcgtcgcggtttttttcgggtcgttgggggcgtcgttgcgttttttgtaaagcgcgagtcggtgcgggggcgtcggagcggaggaaataaaaggcgaaggcgaaggcgtgcggcggcggggcgcgtacgggggcggtggcgcgggtcgggtttcggagtttggagggcggtggcggcggcggcggcggttggagcgggcgggcggcggcggcggtagagtaggtttttttttaggtcgggagaaggcggcggcggagcggcggttgtgcggtttcgggtttcgtgtgttcggagcggaggaaagatggtagcggttgtatttttttttgtatttttatttttggggggaggagaaggagggggcgat

SEQ ID NO: 2754 - DNA, 1073 bp, Artificial Sequence
  chemically treated genomic DNA (Homo sapiens) CpG-island No: 2754
atcgccccctccttctcctccccccaaaaataaaaatacaaaaaaaaatacaaccgctaccatctttcctccgctccgaacacacgaaacccgaaaccgcacaaccgccgctccgccgccgccttctcccgacctaaaaaaaaacctactctaccgccgccgccgcccgcccgctccaaccgccgccgccgccgccaccgccctccaaactccgaaacccgacccgcgccaccgcccccgtacgcgccccgccgccgcacgccttcgccttcgccttttatttcctccgctccgacgcccccgcaccgactcgcgctttacaaaaaacgcaacgacgcccccaacgacccgaaaaaaaccgcgacgcgcgccgctacgcgataacaccctccttcgcctccccgcgtacgcgtacccttcttaactacgcgccgaccgcctaacgaacgacacgcgaaaaataacaaacgcgtttacaaaaaaaacgcacctcttcgctcgcgcacccccccgaaaaaataaaccgaaaaaaaaatacgaacgaccgaaaaaaaaaaaattacgcgcaatccaacgaaaacgaaaattaactatataaaaataatacaccccgcaatctaaacaatctaatccgaactaaaaacgtatacactcgacgcacctacgaaactacaaaaccacgaaccgacacgtataaaaaatataaacacgtctcgtacgccccgcttctcgctactaaaaaaaaaaaaaaaaacgaacaaatacaacgaccgaactaataaaaaaaaacgacgaccataaaacgaataaacgacgcttcgtacgacccgtctaactactacacataccaaataaacaaacacaacacgaaaatactacacaacctaaaccaacaacgcaaaaacgacgaacgcttctacgacgtactcttacgaataaacgacgaaaacttcccaacgcaccgcgccgtactaaccgcctacaacgaatactttaaatcgatattcaacgcccaattaaaaccgaacgaactaccgaacgaaaatcgactaatataaaaaacgcgacgacaa

SEQ ID NO: 2755 - DNA, 1073 bp, Artificial Sequence
  chemically treated genomic DNA (Homo sapiens) CpG-island No: 2755
atcgtttttttttttttttttttttaggggtgaaagtgtaagaggaagtgtagtcgttgttatttttttttcgtttcgaatatacggagttcggggtcgtatagtcgtcgtttcgtcgtcgttttttttcggtttgaggaagggtttattttgtcgtcgtcgtcgttcgttcgttttagtcgtcgtcgtcgtcgttatcgttttttaggtttcgggattcggttcgcgttatcgttttcgtgcgcgtttcgtcgtcgtacgttttcgttttcgttttttgtttttttcgtttcggcgttttcgtatcggttcgcgttttgtaggggacgtagcggcgtttttagcggttcgggaaaagtcgcggcgcgcgtcgttgcgcggtaatattttttttcgttttttcgcgtgcgcgtgttttttttggttgcgcgtcggtcgtttggcgggcggtacgcgggaggtggtaggcgcgtttgtaggaggggcgtattttttcgttcgcgtattttttcggaagggtagatcgggaaggggatgcgggcggtcggagaggagagagttgcgcgtagtttagcgagggcgggggttggttatgtgggggtggtgtatttcgtagtttagatagtttgattcgggttgggggcgtgtatattcggcgtatttgcgagattatagagttacgggtcggtacgtgtggggagtgtggatacgtttcgtgcgtttcgtttttcgttgttgaggggaagggagggggcgggtaggtgtagcggtcgggttagtgggagggggcggcggttatggagcgggtgaacgacgtttcgtgcggttcgtttggttgttatatatattaggtgagtagatatagtacggagatgttgtataatttgaattagtagcgtaaaaacggcgggcgtttttgcgacgtgtttttgcgggtaggcgacgagagttttttagcgtatcgcgtcgtgttggtcgtttgtagcgagtattttgagtcggtgtttagcgtttagttgggatcgggcggattgtcggacgggggtcggttgatgtagggggcgcgacggtag

SEQ ID NO: 2756 - DNA, 1073 bp, Artificial Sequence
  chemically treated genomic DNA (Homo sapiens) CpG-island No: 2756
ctaccgtcgcgccccctacatcaaccgacccccgtccgacaatccgcccgatcccaactaaacgctaaacaccgactcaaaatactcgctacaaacgaccaacacgacgcgatacgctaaaaaactctcgtcgcctacccgcaaaaacacgtcgcaaaaacgcccgccgtttttacgctactaattcaaattatacaacatctccgtactatatctactcacctaatatatataacaaccaaacgaaccgcacgaaacgtcgttcacccgctccataaccgccgccccctcccactaacccgaccgctacacctacccgccccctcccttcccctcaacaacgaaaaacgaaacgcacgaaacgtatccacactccccacacgtaccgacccgtaactctataatctcgcaaatacgccgaatatacacgcccccaacccgaatcaaactatctaaactacgaaatacaccacccccacataaccaacccccgccctcgctaaactacgcgcaactctctcctctccgaccgcccgcatccccttcccgatctacccttccgaaaaaatacgcgaacgaaaaaatacgcccctcctacaaacgcgcctaccacctcccgcgtaccgcccgccaaacgaccgacgcgcaaccaaaaaaaacacgcgcacgcgaaaaaacgaaaaaaaatattaccgcgcaacgacgcgcgccgcgacttttcccgaaccgctaaaaacgccgctacgtcccctacaaaacgcgaaccgatacgaaaacgccgaaacgaaaaaaacaaaaaacgaaaacgaaaacgtacgacgacgaaacgcgcacgaaaacgataacgcgaaccgaatcccgaaacctaaaaaacgataacgacgacgacgacgactaaaacgaacgaacgacgacgacgacaaaataaacccttcctcaaaccgaaaaaaaacgacgacgaaacgacgactatacgaccccgaactccgtatattcgaaacgaaaaaaaaataacaacgactacacttcctcttacactttcacccctaaaaaaaaaaaaaaaaaaaaacgat

SEQ ID NO: 2757 - DNA, 623 bp, Artificial Sequence
  chemically treated genomic DNA (Homo sapiens) CpG-island No: 2757
gtacgcgggttttagttgcgcgtttttcgtttcgtcgtttttttcgggttttttcgatttttcgtttcgtttcgtttcggagtcgggttcggagtgtttggtgggttgatttcggagcgtggaagggagtacggagtacggaagcgagagggaggcggcggcggcgggaggcgggaaggagggggatttttttcgttgtttttttaagtcggcgcggagtcgtttcgggtcgggtcgagggttgcgcggcggcggcggcggcggggttcggttaggatgcggggttttcgggatcgcgcggggcggggcgggcggcggcggcgggttgcgggcgggagttgttcgcggtgttgaagcggcggttgtttagggacgcggggacgagagtaggggagtttttttgggagttttatcgcgatcgcgaggcgggggcgtcgtcgtttatcggtttatgtcgagttttcgagtttcgcggaggaggcgggatcgttcgcggcgggataggtaaggggcggtttgggggcgtcgcgggagcgtagagttaggtacggagcggggagtgagttggggagggtacgggagttttttcggggttaggggttttgattttttgtttggtcgta

SEQ ID NO: 2758 - DNA, 623 bp, Artificial Sequence
  chemically treated genomic DNA (Homo sapiens) CpG-island No: 2758
tacgaccaaacaaaaaatcaaaacccctaaccccgaaaaaactcccgtaccctccccaactcactccccgctccgtacctaactctacgctcccgcgacgcccccaaaccgccccttacctatcccgccgcgaacgatcccgcctcctccgcgaaactcgaaaactcgacataaaccgataaacgacgacgcccccgcctcgcgatcgcgataaaactcccaaaaaaactcccctactctcgtccccgcgtccctaaacaaccgccgcttcaacaccgcgaacaactcccgcccgcaacccgccgccgccgcccgccccgccccgcgcgatcccgaaaaccccgcatcctaaccgaaccccgccgccgccgccgccgcgcaaccctcgacccgacccgaaacgactccgcgccgacttaaaaaaacaacgaaaaaaatccccctccttcccgcctcccgccgccgccgcctccctctcgcttccgtactccgtactcccttccacgctccgaaatcaacccaccaaacactccgaacccgactccgaaacgaaacgaaacgaaaaatcgaaaaaacccgaaaaaaacgacgaaacgaaaaacgcgcaactaaaacccgcgtac

SEQ ID NO: 2759 - DNA, 623 bp, Artificial Sequence
  chemically treated genomic DNA (Homo sapiens) CpG-island No: 2759
tgcggttaagtagggagttagagtttttagtttcgagagggttttcgtgttttttttagtttatttttcgtttcgtgtttagttttgcgttttcgcggcgtttttagatcgttttttatttgtttcgtcgcggacggtttcgtttttttcgcggggttcgggggttcggtatgggtcggtgagcgacggcgttttcgtttcgcggtcgcggtggaatttttaggagggtttttttgttttcgttttcgcgtttttgagtagtcgtcgttttagtatcgcggatagttttcgttcgtagttcgtcgtcgtcgttcgtttcgtttcgcgcggtttcgggagtttcgtattttggtcgggtttcgtcgtcgtcgtcgtcgcgtagttttcggttcggttcgaggcggtttcgcgtcgatttgggagagtagcgaggagggtttttttttttttcgtttttcgtcgtcgtcgtttttttttcgttttcgtgtttcgtgtttttttttacgtttcggaattagtttattaggtatttcggattcggtttcggggcggggcggggcgggaagtcgggggagttcggaggaggcggcgaagcgaggggcgcgtagttggaattcgcgtat

SEQ ID NO: 2760 - DNA, 623 bp, Artificial Sequence
  chemically treated genomic DNA (Homo sapiens) CpG-island No: 2760
atacgcgaattccaactacgcgcccctcgcttcgccgcctcctccgaactcccccgacttcccgccccgccccgccccgaaaccgaatccgaaatacctaataaactaattccgaaacgtaaaaaaaaacacgaaacacgaaaacgaaaaaaaaacgacgacgacgaaaaacgaaaaaaaaaaaaaccctcctcgctactctcccaaatcgacgcgaaaccgcctcgaaccgaaccgaaaactacgcgacgacgacgacgacgaaacccgaccaaaatacgaaactcccgaaaccgcgcgaaacgaaacgaacgacgacgacgaactacgaacgaaaactatccgcgatactaaaacgacgactactcaaaaacgcgaaaacgaaaacaaaaaaaccctcctaaaaattccaccgcgaccgcgaaacgaaaacgccgtcgctcaccgacccataccgaacccccgaaccccgcgaaaaaaacgaaaccgtccgcgacgaaacaaataaaaaacgatctaaaaacgccgcgaaaacgcaaaactaaacacgaaacgaaaaataaactaaaaaaaacacgaaaaccctctcgaaactaaaaactctaactccctacttaaccgca

SEQ ID NO: 2761 - DNA, 2110 bp, Artificial Sequence
  chemically treated genomic DNA (Homo sapiens) CpG-island No: 2761
tgtatgggacggaaaagggtaattgtgttgggcgtatgggacgggaaagggtaattgtgttgggcgtatgggacggaaaagggtaattgtgttgggcgtatgggacgggaaagggtaattgtgttgggcgtatgggacgggaaagggtaattgtgttgggcgtttgggacggaaaagggtaattgtgttgggcgtatgggacggaaaagagtaattgtgttgggcgtatgggacggaagagtaattgtgttgggcgcgtgggacggaaaagagtaattgtgttgggcgcgtgggacgggaaagggtaattgtgttgggcgtttgggacgggaaagggtaattgtgttgggcgtatgggacgggaaagggtaattgtgttgggcgtatgggacgggaaagggtaattgtgttgggcgtatgggacgggaaagggtaattgtgttgggcgtatgggacgggaaagggtaattgtgttgggcgtatgggacgggaaagggtaattgtgttgggcgtatgggacggtaaagagtaattgtgttgggcgtatgggacggtaaagagtaattgtgttgggcgtatgggacggaaaagagtatttgtgttgggcgtatggggcggaaaagagtatttgtgttgcgcgtatgggacgtaaaagagtaattgtgttgcgcgtatggggtggaagggtaattgtgttgggcgtatgggacggaaaagagtaattgtgttgggcgtatggtacggaatagagtaattgtgttgggcgcgtgggacggaaaagggtaattgtgttgggcgtatggtacgaaagagtaattgtgttgggcgcgtgggacggaaaagagtaattgtgttgggcgcgtgggacgggaaagggtaattgtgttgggcgtatgggacgggaaagggtaattgtgttgggcgtttgggacgggaaagagtaattgtgttgggcgtttgggacgggaaagagtaattgtgttgggcgtatgggacggaagagtaattgtgttgggcgcgtgggacggaaaagggtaattgtgttgggcgcgtgggacgggaaagggtaattgtgttgggcgtttgggacgggaaagggtaattgtgttgggcgtatgggacgggaaagggtaattgtgttgggcgtatgggacgggaaagggtaattgtgttgggcgtatgggacgggaaagagtaattgtgttgggcgtatgggacggaaaagagtaattgtgttgggcgcgtgggacgggaaagggtaattgtgttgggcgcgtgggacggaagagtaattgtgttgggcgcgtgggacggaaaagagtaattgtgttgggcgcgtgggacgggaaagggtaattgtgttgggcgcgtggggcgggaaagggtaattgtgttgggcgcgtgggacgggaaagggtaattgtgttgggcgcgtgggacgggaaagggtaattgtgttgggcgcgtggggcggaaaagggtaattgtgttgggttcgtgggacgggaaagggtaattgtgttgggcgtatggggcggaaaagggtaattgtgttgtgtttatgggacggtaaatggttattgtgttgggcgtatgggacgggaaagggtaattgtgttgggcgtatgggacgggaaagggtaattgtgttgggcgtatgggacgggaaagagtaattgtgttgggcgtatggggcggaaaagggtaattgtgttgggcgcgtggggcgggaaagggtaattgtgttgggcgcgtgggacgggaaagggtaattgtgttgggcgcgtgggacgggaaagggtaattgtgttgggcgcgtgggacgggaaagggtaattgtgttgggcgcgtggggcgggaaagggtaattgtgttgggcgcgtggggcgggaaagggtaattgtgttgggcgcgtgggacgggaaagggtaattgtgttgggcgcgtgggacgggaaagggtaattgtgttgggcgcgtgggacgggaaagggtaattgtgttgggcgcgtggggcgggaaagggtaattgtgttgggcgcgtgggacgggaaagcgatttgtcgcggggacggatatgagtaggtttttttttaaagtttcggggtttt

SEQ ID NO: 2762 - DNA, 2110 bp, Artificial Sequence
  chemically treated genomic DNA (Homo sapiens) CpG-island No: 2762
aaaaccccgaaactttaaaaaaaaacctactcatatccgtccccgcgacaaatcgctttcccgtcccacgcgcccaacacaattaccctttcccgccccacgcgcccaacacaattaccctttcccgtcccacgcgcccaacacaattaccctttcccgtcccacgcgcccaacacaattaccctttcccgtcccacgcgcccaacacaattaccctttcccgccccacgcgcccaacacaattaccctttcccgccccacgcgcccaacacaattaccctttcccgtcccacgcgcccaacacaattaccctttcccgtcccacgcgcccaacacaattaccctttcccgtcccacgcgcccaacacaattaccctttcccgccccacgcgcccaacacaattacccttttccgccccatacgcccaacacaattactctttcccgtcccatacgcccaacacaattaccctttcccgtcccatacgcccaacacaattaccctttcccgtcccatacgcccaacacaataaccatttaccgtcccataaacacaacacaattacccttttccgccccatacgcccaacacaattaccctttcccgtcccacgaacccaacacaattacccttttccgccccacgcgcccaacacaattaccctttcccgtcccacgcgcccaacacaattaccctttcccgtcccacgcgcccaacacaattaccctttcccgccccacgcgcccaacacaattaccctttcccgtcccacgcgcccaacacaattactcttttccgtcccacgcgcccaacacaattactcttccgtcccacgcgcccaacacaattaccctttcccgtcccacgcgcccaacacaattactcttttccgtcccatacgcccaacacaattactctttcccgtcccatacgcccaacacaattaccctttcccgtcccatacgcccaacacaattaccctttcccgtcccatacgcccaacacaattaccctttcccgtcccaaacgcccaacacaattaccctttcccgtcccacgcgcccaacacaattacccttttccgtcccacgcgcccaacacaattactcttccgtcccatacgcccaacacaattactctttcccgtcccaaacgcccaacacaattactctttcccgtcccaaacgcccaacacaattaccctttcccgtcccatacgcccaacacaattaccctttcccgtcccacgcgcccaacacaattactcttttccgtcccacgcgcccaacacaattactctttcgtaccatacgcccaacacaattacccttttccgtcccacgcgcccaacacaattactctattccgtaccatacgcccaacacaattactcttttccgtcccatacgcccaacacaattacccttccaccccatacgcgcaacacaattactcttttacgtcccatacgcgcaacacaaatactcttttccgccccatacgcccaacacaaatactcttttccgtcccatacgcccaacacaattactctttaccgtcccatacgcccaacacaattactctttaccgtcccatacgcccaacacaattaccctttcccgtcccatacgcccaacacaattaccctttcccgtcccatacgcccaacacaattaccctttcccgtcccatacgcccaacacaattaccctttcccgtcccatacgcccaacacaattaccctttcccgtcccatacgcccaacacaattaccctttcccgtcccaaacgcccaacacaattaccctttcccgtcccacgcgcccaacacaattactcttttccgtcccacgcgcccaacacaattactcttccgtcccatacgcccaacacaattactcttttccgtcccatacgcccaacacaattacccttttccgtcccaaacgcccaacacaattaccctttcccgtcccatacgcccaacacaattaccctttcccgtcccatacgcccaacacaattacccttttccgtcccatacgcccaacacaattaccctttcccgtcccatacgcccaacacaattacccttttccgtcccataca

SEQ ID NO: 2763 - DNA, 2110 bp, Artificial Sequence
  chemically treated genomic DNA (Homo sapiens) CpG-island No: 2763
aagatttcggggttttagaagaaaatttatttatattcgttttcgcggtaggtcgttttttcgttttacgcgtttagtatagttattttttttcgttttacgcgtttagtatagttattttttttcgttttacgcgtttagtatagttattttttttcgttttacgcgtttagtatagttattttttttcgttttacgcgtttagtatagttattttttttcgttttacgcgtttagtatagttattttttttcgttttacgcgtttagtatagttattttttttcgttttacgcgtttagtatagttattttttttcgttttacgcgtttagtatagttattttttttcgttttacgcgtttagtatagttattttttttcgttttacgcgtttagtatagttattttttttcgttttatgcgtttagtatagttattttttttcgttttatgcgtttagtatagttattttttttcgttttatgcgtttagtatagttattttttttcgttttatgcgtttagtatagtaattatttatcgttttatgagtatagtatagttattttttttcgttttatgcgtttagtatagttattttttttcgttttacgagtttagtatagttattttttttcgttttacgcgtttagtatagttattttttttcgttttacgcgtttagtatagttattttttttcgttttacgcgtttagtatagttattttttttcgttttacgcgtttagtatagttattttttttcgttttacgcgtttagtatagttattttttttcgttttacgcgtttagtatagttattttttcgttttacgcgtttagtatagttattttttttcgttttacgcgtttagtatagttattttttttcgttttatgcgtttagtatagttattttttttcgttttatgcgtttagtatagttattttttttcgttttatgcgtttagtatagttattttttttcgttttatgcgtttagtatagttattttttttcgttttaggcgtttagtatagttattttttttcgttttacgcgtttagtatagttattttttttcgttttacgcgtttagtatagttattttttcgttttatgcgtttagtatagttattttttttcgttttaggcgtttagtatagttattttttttcgttttaggcgtttagtatagttattttttttcgttttatgcgtttagtatagttattttttttcgttttacgcgtttagtatagttattttttttcgttttacgcgtttagtatagttattttttcgtattatgcgtttagtatagttattttttttcgttttacgcgtttagtatagttattttgtttcgtattatgcgtttagtatagttattttttttcgttttatgcgtttagtatagttatttttttattttatgcgcgtagtatagttatttttttacgttttatgcgcgtagtatagatattttttttcgttttatgcgtttagtatagatattttttttcgttttatgcgtttagtatagttattttttgtcgttttatgcgtttagtatagttattttttgtcgttttatgcgtttagtatagttattttttttcgttttatgcgtttagtatagttattttttttcgttttatgcgtttagtatagttattttttttcgttttatgcgtttagtatagttattttttttcgttttatgcgtttagtatagttattttttttcgttttatgcgtttagtatagttattttttttcgttttaggcgtttagtatagttattttttttcgttttacgcgtttagtatagttattttttttcgttttacgcgtttagtatagttattttttcgttttatgcgtttagtatagttattttttttcgttttatgcgtttagtatagttattttttttcgttttaggcgtttagtatagttattttttttcgttttatgcgtttagtatagttattttttttcgttttatgcgtttagtatagttattttttttcgttttatgcgtttagtatagttattttttttcgttttatgcgtttagtatagttattttttttcgttttatgta

SEQ ID NO: 2764 - DNA, 2110 bp, Artificial Sequence
  chemically treated genomic DNA (Homo sapiens) CpG-island No: 2764
tacataaaacgaaaaaaaataactatactaaacgcataaaacgaaaaaaaataactatactaaacgcataaaacgaaaaaaaataactatactaaacgcataaaacgaaaaaaaataactatactaaacgcataaaacgaaaaaaaataactatactaaacgcctaaaacgaaaaaaaataactatactaaacgcataaaacgaaaaaaaataactatactaaacgcataaaacgaaaaaataactatactaaacgcgtaaaacgaaaaaaaataactatactaaacgcgtaaaacgaaaaaaaataactatactaaacgcctaaaacgaaaaaaaataactatactaaacgcataaaacgaaaaaaaataactatactaaacgcataaaacgaaaaaaaataactatactaaacgcataaaacgaaaaaaaataactatactaaacgcataaaacgaaaaaaaataactatactaaacgcataaaacgaaaaaaaataactatactaaacgcataaaacgacaaaaaataactatactaaacgcataaaacgacaaaaaataactatactaaacgcataaaacgaaaaaaaatatctatactaaacgcataaaacgaaaaaaaatatctatactacgcgcataaaacgtaaaaaaataactatactacgcgcataaaataaaaaaataactatactaaacgcataaaacgaaaaaaaataactatactaaacgcataatacgaaacaaaataactatactaaacgcgtaaaacgaaaaaaaataactatactaaacgcataatacgaaaaaataactatactaaacgcgtaaaacgaaaaaaaataactatactaaacgcgtaaaacgaaaaaaaataactatactaaacgcataaaacgaaaaaaaataactatactaaacgcctaaaacgaaaaaaaataactatactaaacgcctaaaacgaaaaaaaataactatactaaacgcataaaacgaaaaaataactatactaaacgcgtaaaacgaaaaaaaataactatactaaacgcgtaaaacgaaaaaaaataactatactaaacgcctaaaacgaaaaaaaataactatactaaacgcataaaacgaaaaaaaataactatactaaacgcataaaacgaaaaaaaataactatactaaacgcataaaacgaaaaaaaataactatactaaacgcataaaacgaaaaaaaataactatactaaacgcgtaaaacgaaaaaaaataactatactaaacgcgtaaaacgaaaaaataactatactaaacgcgtaaaacgaaaaaaaataactatactaaacgcgtaaaacgaaaaaaaataactatactaaacgcgtaaaacgaaaaaaaataactatactaaacgcgtaaaacgaaaaaaaataactatactaaacgcgtaaaacgaaaaaaaataactatactaaacgcgtaaaacgaaaaaaaataactatactaaactcgtaaaacgaaaaaaaataactatactaaacgcataaaacgaaaaaaaataactatactatactcataaaacgataaataattactatactaaacgcataaaacgaaaaaaaataactatactaaacgcataaaacgaaaaaaaataactatactaaacgcataaaacgaaaaaaaataactatactaaacgcataaaacgaaaaaaaataactatactaaacgcgtaaaacgaaaaaaaataactatactaaacgcgtaaaacgaaaaaaaataactatactaaacgcgtaaaacgaaaaaaaataactatactaaacgcgtaaaacgaaaaaaaataactatactaaacgcgtaaaacgaaaaaaaataactatactaaacgcgtaaaacgaaaaaaaataactatactaaacgcgtaaaacgaaaaaaaataactatactaaacgcgtaaaacgaaaaaaaataactatactaaacgcgtaaaacgaaaaaaaataactatactaaacgcgtaaaacgaaaaaaaataactatactaaacgcgtaaaacgaaaaaacgacctaccgcgaaaacgaatataaataaattttcttctaaaaccccgaaatctt

SEQ ID NO: 2765 - DNA, 534 bp, Artificial Sequence
  chemically treated genomic DNA (Homo sapiens) CpG-island No: 2765
agagtcgggtaggtgttggtgtaattgacgcgggttgtgtatttataagaaagttcggtcggtgttggtgtaattgatacgggttgtgggtttgtaagagagtcgggtaggtgttggtgtaattgacgcgggttgtgtatttataagaaagttcggtcggtgttggtgtaattgacgcgggttgtgggtttgtaagagagtcgggtaggtgttggtgtaattgacgcgggttgtgtatttataagaaagttcggtcggtgttggtgtaattgacgtgggttgtgtatttataagaaagtttggtcggttttggtgtaattgttgcgggttttgtttttgtgtgaaagttcggtcggttttggtgtaattgatacgggttgtgggtttgtaagagagtcgggtaggtgttggtgtaattgacgtgggttgtgtatttatgagaaagtttggtcggttttggtgtaattgacgtgggttgtgtatttataagaaagtttggtcggttttggtgtaattgttgcgggttttgttttt

SEQ ID NO: 2766 - DNA, 534 bp, Artificial Sequence
  chemically treated genomic DNA (Homo sapiens) CpG-island No: 2766
aaaaacaaaacccgcaacaattacaccaaaaccgaccaaactttcttataaatacacaacccacgtcaattacaccaaaaccgaccaaactttctcataaatacacaacccacgtcaattacaccaacacctacccgactctcttacaaacccacaacccgtatcaattacaccaaaaccgaccgaactttcacacaaaaacaaaacccgcaacaattacaccaaaaccgaccaaactttcttataaatacacaacccacgtcaattacaccaacaccgaccgaactttcttataaatacacaacccgcgtcaattacaccaacacctacccgactctcttacaaacccacaacccgcgtcaattacaccaacaccgaccgaactttcttataaatacacaacccgcgtcaattacaccaacacctacccgactctcttacaaacccacaacccgtatcaattacaccaacaccgaccgaactttcttataaatacacaacccgcgtcaattacaccaacacctacccgactct

SEQ ID NO: 2767 - DNA, 534 bp, Artificial Sequence
  chemically treated genomic DNA (Homo sapiens) CpG-island No: 2767
aaaggtagagttcgtaatagttatattaggatcgattaggtttttttataaatgtatagtttacgttagttatattaggatcgattaggtttttttataaatgtatagtttacgttagttatattagtatttattcggtttttttataaatttatagttcgtgttagttatattaggatcgatcgggtttttatataaaggtagagttcgtaatagttatattaggatcgattaggtttttttataaatgtatagtttacgttagttatattagtatcgatcgggtttttttataaatgtatagttcgcgttagttatattagtatttattcggtttttttataaatttatagttcgcgttagttatattagtatcgatcgggtttttttataaatgtatagttcgcgttagttatattagtatttattcggtttttttataaatttatagttcgtgttagttatattagtatcgatcgggtttttttataaatgtatagttcgcgttagttatattagtatttattcggtttt

SEQ ID NO: 2768 - DNA, 534 bp, Artificial Sequence
  chemically treated genomic DNA (Homo sapiens) CpG-island No: 2768
aaaaccgaataaatactaatataactaacgcgaactatacatttataaaaaaacccgatcgatactaatataactaacacgaactataaatttataaaaaaaccgaataaatactaatataactaacgcgaactatacatttataaaaaaacccgatcgatactaatataactaacgcgaactataaatttataaaaaaaccgaataaatactaatataactaacgcgaactatacatttataaaaaaacccgatcgatactaatataactaacgtaaactatacatttataaaaaaacctaatcgatcctaatataactattacgaactctacctttatataaaaacccgatcgatcctaatataactaacacgaactataaatttataaaaaaaccgaataaatactaatataactaacgtaaactatacatttataaaaaaacctaatcgatcctaatataactaacgtaaactatacatttataaaaaaacctaatcgatcctaatataactattacgaactctaccttt

SEQ ID NO: 2769 - DNA, 601 bp, Artificial Sequence
  chemically treated genomic DNA (Homo sapiens) CpG-island No: 2769
gtttgttcgtggtgagagatttcgagtttcggtatattgtgggggggtcgtaggacggcggttcggggtgttttcgggatttttgcgtttcgagattcgaggattacgcgataaacggtagtttaggttgtcgcgggtgtaggtttgtttatttacggtcgtcgggttagggagacgattttggtacgttttaggtaggtcggtgtcgggagagggtttttgcgtgtgggagaatcgagcggcggggtcggttgagaatcggggaaggaacgcggcggttttttttcgcgggaagaggtttaagtcgggttcgttttgcggtttagcgaggagttcgttttgtcggtttttgaggacgcgtttcggattttgtttttttgggtttgaggtgatacgttttgtcgattgaggtttcgaggtttgcggaagtttttggtcgtagtcgcgggaggcgtaatacgttgaggttgcgcgacgtggggttcgttcggattcgttttcgttcgtgttttttcgtagtcgtttttgttagaattatcggaagagatcggaattgttggttttgtgtttgtgagaagagtagtattgggaataagttatt

SEQ ID NO: 2770 - DNA, 601 bp, Artificial Sequence
  chemically treated genomic DNA (Homo sapiens) CpG-island No: 2770
aataacttattcccaatactactcttctcacaaacacaaaaccaacaattccgatctcttccgataattctaacaaaaacgactacgaaaaaacacgaacgaaaacgaatccgaacgaaccccacgtcgcgcaacctcaacgtattacgcctcccgcgactacgaccaaaaacttccgcaaacctcgaaacctcaatcgacaaaacgtatcacctcaaacccaaaaaaacaaaatccgaaacgcgtcctcaaaaaccgacaaaacgaactcctcgctaaaccgcaaaacgaacccgacttaaacctcttcccgcgaaaaaaaaccgccgcgttccttccccgattctcaaccgaccccgccgctcgattctcccacacgcaaaaaccctctcccgacaccgacctacctaaaacgtaccaaaatcgtctccctaacccgacgaccgtaaataaacaaacctacacccgcgacaacctaaactaccgtttatcgcgtaatcctcgaatctcgaaacgcaaaaatcccgaaaacaccccgaaccgccgtcctacgacccccccacaatataccgaaactcgaaatctctcaccacgaacaaac

SEQ ID NO: 2771 - DNA, 601 bp, Artificial Sequence
  chemically treated genomic DNA (Homo sapiens) CpG-island No: 2771
ggtgatttatttttagtgttgttttttttatagatataaaattaatagtttcggtttttttcgatagttttggtagagacggttgcggggagatacgggcggaggcgggttcgggcgggttttacgtcgcgtagttttagcgtgttgcgtttttcgcggttgcggttagagattttcgtaaatttcggggttttaatcgatagaacgtgttattttaggtttaggagagtagggttcggggcgcgtttttagaagtcggtagggcgggtttttcgttgagtcgtagggcgagttcggtttgggttttttttcgcgggaggaggtcgtcgcgtttttttttcggtttttaatcgatttcgtcgttcggtttttttatacgtaggaattttttttcgatatcggtttgtttggaacgtgttagaatcgtttttttaattcggcggtcgtggatgagtaaatttgtattcgcggtagtttgaattgtcgtttgtcgcgtagttttcgagtttcggagcgtaggggtttcgagggtatttcgggtcgtcgttttgcggtttttttatagtgtgtcgggattcggggttttttattacgagtagat

SEQ ID NO: 2772 - DNA, 601 bp, Artificial Sequence
  chemically treated genomic DNA (Homo sapiens) CpG-island No: 2772
atctactcgtaataaaaaaccccgaatcccgacacactataaaaaaaccgcaaaacgacgacccgaaataccctcgaaacccctacgctccgaaactcgaaaactacgcgacaaacgacaattcaaactaccgcgaatacaaatttactcatccacgaccgccgaattaaaaaaacgattctaacacgttccaaacaaaccgatatcgaaaaaaaattcctacgtataaaaaaaccgaacgacgaaatcgattaaaaaccgaaaaaaaaacgcgacgacctcctcccgcgaaaaaaaacccaaaccgaactcgccctacgactcaacgaaaaacccgccctaccgacttctaaaaacgcgccccgaaccctactctcctaaacctaaaataacacgttctatcgattaaaaccccgaaatttacgaaaatctctaaccgcaaccgcgaaaaacgcaacacgctaaaactacgcgacgtaaaacccgcccgaacccgcctccgcccgtatctccccgcaaccgtctctaccaaaactatcgaaaaaaaccgaaactattaattttatatctataaaaaaaacaacactaaaaataaatcacc

SEQ ID NO: 2773 - DNA, 596 bp, Artificial Sequence
  chemically treated genomic DNA (Homo sapiens) CpG-island No: 2773
gggtttcgttgtcgtagttgtttagtcgcggtcgttttggttagttttgtttttaagggaatcgggacgtcgagttggtaatgttttattcgcgtcgttgacggcgcgcggagagcgtacgcgttcgtgacgtagtttaggcgtcgcggcgcgcggggtggggcggaggtcgcgtcgagggcggcgggttgtcgcgtaagggtggcgcgcgcgcggtgagtgtgcgagtgtcggcggcgtcggattttttacgtggggttcgggttttgcgggcgggaggcgggagttggtagttttaggcggtagcgtttcgttttgcggtttgggtgtgttaggagtcgttgcggtcggggcgtttttgttttaggagatttagattttcgttgattcgttcgtttcgtcgtagtggtttgagtcgtagttttttttcgtgtcgttcgcgggtttcgtttttttcgtgtttttatgtcgtagttagcgtggtcgcggttattttgttttcgttttcgtttcgtttttgtcgttttcggtattgttttatttttttgggttgtattttttttttggttttttatttttgttgattttgtaaggga

SEQ ID NO: 2774 - DNA, 596 bp, Artificial Sequence
  chemically treated genomic DNA (Homo sapiens) CpG-island No: 2774
tcccttacaaaatcaacaaaaataaaaaaccaaaaaaaaaatacaacccaaaaaaataaaacaataccgaaaacgacaaaaacgaaacgaaaacgaaaacaaaataaccgcgaccacgctaactacgacataaaaacacgaaaaaaacgaaacccgcgaacgacacgaaaaaaaactacgactcaaaccactacgacgaaacgaacgaatcaacgaaaatctaaatctcctaaaacaaaaacgccccgaccgcaacgactcctaacacacccaaaccgcaaaacgaaacgctaccgcctaaaactaccaactcccgcctcccgcccgcaaaacccgaaccccacgtaaaaaatccgacgccgccgacactcgcacactcaccgcgcgcgcgccacccttacgcgacaacccgccgccctcgacgcgacctccgccccaccccgcgcgccgcgacgcctaaactacgtcacgaacgcgtacgctctccgcgcgccgtcaacgacgcgaataaaacattaccaactcgacgtcccgattcccttaaaaacaaaactaaccaaaacgaccgcgactaaacaactacgacaacgaaaccc

SEQ ID NO: 2775 - DNA, 596 bp, Artificial Sequence
  chemically treated genomic DNA (Homo sapiens) CpG-island No: 2775
ttttttatagaattagtaagggtgaaaagttaggaaagagatgtaatttaaaggagtaaggtagtgtcgggagcggtagaagcggagcgggggcgagggtaaggtagtcgcggttacgttggttgcggtatggagatacgggaggaacgggattcgcgggcggtacgggaaagggttgcggtttagattattgcggcgggacgggcggattagcggggatttaagttttttgaggtaagggcgtttcgatcgtagcgatttttgatatatttaggtcgtaggacgaagcgttatcgtttggggttgttagttttcgtttttcgttcgtagagttcgggttttacgtagaggattcggcgtcgtcgatattcgtatatttatcgcgcgcgcgttatttttgcgcggtagttcgtcgttttcggcgcgattttcgttttatttcgcgcgtcgcggcgtttgggttacgttacgggcgcgtgcgtttttcgcgcgtcgttagcggcgcgggtggggtattgttagttcggcgtttcggtttttttggagatagagttggttagggcggtcgcggttgggtaattacgatagcggagttt

SEQ ID NO: 2776 - DNA, 596 bp, Artificial Sequence
  chemically treated genomic DNA (Homo sapiens) CpG-island No: 2776
aaactccgctatcgtaattacccaaccgcgaccgccctaaccaactctatctccaaaaaaaccgaaacgccgaactaacaataccccacccgcgccgctaacgacgcgcgaaaaacgcacgcgcccgtaacgtaacccaaacgccgcgacgcgcgaaataaaacgaaaatcgcgccgaaaacgacgaactaccgcgcaaaaataacgcgcgcgcgataaatatacgaatatcgacgacgccgaatcctctacgtaaaacccgaactctacgaacgaaaaacgaaaactaacaaccccaaacgataacgcttcgtcctacgacctaaatatatcaaaaatcgctacgatcgaaacgcccttacctcaaaaaacttaaatccccgctaatccgcccgtcccgccgcaataatctaaaccgcaaccctttcccgtaccgcccgcgaatcccgttcctcccgtatctccataccgcaaccaacgtaaccgcgactaccttaccctcgcccccgctccgcttctaccgctcccgacactaccttactcctttaaattacatctctttcctaacttttcacccttactaattctataaaaaa

SEQ ID NO: 2777 - DNA, 570 bp, Artificial Sequence
  chemically treated genomic DNA (Homo sapiens) CpG-island No: 2777
tttagcgtcggttgtcgattttttttagagttcggcggtgttagtttttttttgttgttcgttaggcgcggtgtttgcggtcgtttcggtaggaggggttggggggttcgggtcggcggtagtttcggcggcgttttttttttttaagtttttggcggcgggcggtcgggtcgagggcggggcgtttgtatagattttttttttgtgagcggcgtttttttcgggcggtttggcgcgtagggttcgggtattgcgttagggttcggaatagtttttttgttcggtcgttcgttttacgtttcggcggagtcgtttgatttgttcggtcgggcgtagaagagtttggggtcgcggtggtataggaatcgggtgcgtgtttagttgtacggggttgtagtcgttatttttcgttgggtcggtattggacgcgtgtagtcgggtttattgtgcgtagttcgttttttgtgtgaaaacgttcgttgtgtgtagattttcgttttcgtgtagggtttattgtgcgtcgtattttttttttatgtaaagtttattgtgtgtagaattttatttgtt

SEQ ID NO: 2778 - DNA, 570 bp, Artificial Sequence
  chemically treated genomic DNA (Homo sapiens) CpG-island No: 2778
aacaaataaaattctacacacaataaactttacataaaaaaaaaatacgacgcacaataaaccctacacgaaaacgaaaatctacacacaacgaacgttttcacacaaaaaacgaactacgcacaataaacccgactacacgcgtccaataccgacccaacgaaaaataacgactacaaccccgtacaactaaacacgcacccgattcctataccaccgcgaccccaaactcttctacgcccgaccgaacaaatcaaacgactccgccgaaacgtaaaacgaacgaccgaacaaaaaaactattccgaaccctaacgcaatacccgaaccctacgcgccaaaccgcccgaaaaaaacgccgctcacaaaaaaaaaatctatacaaacgccccgccctcgacccgaccgcccgccgccaaaaacttaaaaaaaaaaaacgccgccgaaactaccgccgacccgaaccccccaacccctcctaccgaaacgaccgcaaacaccgcgcctaacgaacaacaaaaaaaaactaacaccgccgaactctaaaaaaaatcgacaaccgacgctaaa

SEQ ID NO: 2779 - DNA, 570 bp, Artificial Sequence
  chemically treated genomic DNA (Homo sapiens) CpG-island No: 2779
ggtaaatggggttttgtatatagtaggttttgtatggaaggggggtgcggcgtatagtaggttttgtacgaagacggagatttgtatatagcgggcgtttttatataaaagacgggttgcgtatagtaggttcggttgtacgcgtttagtgtcggtttagcggagagtagcggttgtagtttcgtgtagttgagtacgtattcggtttttgtgttatcgcggttttaggtttttttgcgttcgatcgggtaggttaggcggtttcgtcggggcgtggggcgggcggtcgggtagggaggttatttcgggttttggcgtagtgttcgagttttgcgcgttaggtcgttcggggaaggcgtcgtttataaaaggagggtttgtgtagacgtttcgttttcggttcggtcgttcgtcgttaggggtttggaggagggagacgtcgtcggagttgtcgtcggttcggattttttaattttttttgtcggggcggtcgtagatatcgcgtttggcgggtaatagagggaggttggtatcgtcgggttttggagggggtcgatagtcggcgttggg

SEQ ID NO: 2780 - DNA, 570 bp, Artificial Sequence
  chemically treated genomic DNA (Homo sapiens) CpG-island No: 2780
cccaacgccgactatcgaccccctccaaaacccgacgataccaacctccctctattacccgccaaacgcgatatctacgaccgccccgacaaaaaaaattaaaaaatccgaaccgacgacaactccgacgacgtctccctcctccaaacccctaacgacgaacgaccgaaccgaaaacgaaacgtctacacaaaccctccttttataaacgacgccttccccgaacgacctaacgcgcaaaactcgaacactacgccaaaacccgaaataacctccctacccgaccgcccgccccacgccccgacgaaaccgcctaacctacccgatcgaacgcaaaaaaacctaaaaccgcgataacacaaaaaccgaatacgtactcaactacacgaaactacaaccgctactctccgctaaaccgacactaaacgcgtacaaccgaacctactatacgcaacccgtcttttatataaaaacgcccgctatatacaaatctccgtcttcgtacaaaacctactatacgccgcaccccccttccatacaaaacctactatatacaaaaccccatttacc

SEQ ID NO: 2781 - DNA, 574 bp, Artificial Sequence
  chemically treated genomic DNA (Homo sapiens) CpG-island No: 2781
acgaaggatcgtgtatacgtatgtttatttttgtattttacgcgggattgtgtatacgtatgtttatcgtgttttttacgcgggatcgtgtatacgtatgtttacgaatttttgtatatttatatttattaggtttgtttatgcgatgcgtttttgtagatttattgtggacgtttgtttgtcggcgttttgcgtatttcgcgtgagtggagtgtgtattcgtggagggggcgattgagtgcggggtaagcgtaagcgtaagtatattgggttcgcggagggtggagagaggtcgtgcgcgttttcggggttggcgcggaggtggggttagcggcgcgggagaacgtttcgtttcgttatcgttagttcggaagatttacggcggcgggcgttggcgttacgggtttttattggggtttcggcgtcggggtcgggattttttggcgtaggaacgttcgtgacggcggcgtttgtttgcgtcggttacgttgggaggtttgagtttggggatgatattagtttttgcgtttttggagttggttcgggcgggacggggatttggagaaagtagtga

SEQ ID NO: 2782 - DNA, 574 bp, Artificial Sequence
  chemically treated genomic DNA (Homo sapiens) CpG-island No: 2782
tcactactttctccaaatccccgtcccgcccgaaccaactccaaaaacgcaaaaactaatatcatccccaaactcaaacctcccaacgtaaccgacgcaaacaaacgccgccgtcacgaacgttcctacgccaaaaaatcccgaccccgacgccgaaaccccaataaaaacccgtaacgccaacgcccgccgccgtaaatcttccgaactaacgataacgaaacgaaacgttctcccgcgccgctaaccccacctccgcgccaaccccgaaaacgcgcacgacctctctccaccctccgcgaacccaatatacttacgcttacgcttaccccgcactcaatcgccccctccacgaatacacactccactcacgcgaaatacgcaaaacgccgacaaacaaacgtccacaataaatctacaaaaacgcatcgcataaacaaacctaataaatataaatatacaaaaattcgtaaacatacgtatacacgatcccgcgtaaaaaacacgataaacatacgtatacacaatcccgcgtaaaatacaaaaataaacatacgtatacacgatccttcgt

SEQ ID NO: 2783 - DNA, 574 bp, Artificial Sequence
  chemically treated genomic DNA (Homo sapiens) CpG-island No: 2783
ttattgttttttttaagttttcgtttcgttcgggttagttttagaaacgtaggggttgatgttatttttaggtttaaattttttagcgtggtcgacgtaggtaggcgtcgtcgttacgggcgtttttgcgttagggaatttcggtttcggcgtcggggttttagtggaaattcgtgacgttagcgttcgtcgtcgtgggtttttcgggttggcggtagcggggcggggcgttttttcgcgtcgttgattttattttcgcgttagtttcgggaacgcgtacggtttttttttatttttcgcgagtttagtgtgtttgcgtttgcgtttgtttcgtatttagtcgttttttttacgagtgtatattttatttacgcgggatgcgtaggacgtcgataagtaggcgtttatagtgggtttgtagggacgtatcgtatgggtaggtttggtgggtgtaggtgtgtaggagttcgtggatatgcgtgtgtacgatttcgcgtggaaggtacggtggatatgcgtgtgtataatttcgcgtgaaatgtaaaggtaggtatgcgtgtgtacgatttttcgt

SEQ ID NO: 2784 - DNA, 574 bp, Artificial Sequence
  chemically treated genomic DNA (Homo sapiens) CpG-island No: 2784
acgaaaaatcgtacacacgcatacctacctttacatttcacgcgaaattatacacacgcatatccaccgtaccttccacgcgaaatcgtacacacgcatatccacgaactcctacacacctacacccaccaaacctacccatacgatacgtccctacaaacccactataaacgcctacttatcgacgtcctacgcatcccgcgtaaataaaatatacactcgtaaaaaaaacgactaaatacgaaacaaacgcaaacgcaaacacactaaactcgcgaaaaataaaaaaaaaccgtacgcgttcccgaaactaacgcgaaaataaaatcaacgacgcgaaaaaacgccccgccccgctaccgccaacccgaaaaacccacgacgacgaacgctaacgtcacgaatttccactaaaaccccgacgccgaaaccgaaattccctaacgcaaaaacgcccgtaacgacgacgcctacctacgtcgaccacgctaaaaaatttaaacctaaaaataacatcaacccctacgtttctaaaactaacccgaacgaaacgaaaacttaaaaaaaacaataa

SEQ ID NO: 2785 - DNA, 922 bp, Artificial Sequence
  chemically treated genomic DNA (Homo sapiens) CpG-island No: 2785
ggcggatatttacgggtcgtgtgttcgttatacgttgtaggcgtcgcgcgtggggatttttgcgcgtgttcgtgtgcggtgtgtgtgtgttcgtggttgagtcgaggaggttcggttcgtcggtgttttcgagtcgtttgcgcgtgagtgtgtgtgtgcgcgtgtgtgtgcgcgcgcgtcgcggcgaaggtggattcgttcgtttcgtagcgagtttagtcggggtttcgcgatttgtagtcgtcgtcgttatcgttttcgtcgtttttcgggtttttttttgcgcgggtcgggtcggggatggagtcgtagtcggagtcgtcgtagtcggggtcgcggcgcggagtagtttgaggcgcgggcggtgcgcgggatcggggggagggcgggtcgaggggagggttttgcgggtcgggggggcgggcgcggcgcgttttttttttggcgcgttcgttttttttttcgcgcgttttttttcgtcgttttttttcgtcgtttgcggtttttttttcgtcggggatcgagcgcgttcgtttcggcgtcggtttcgttttttcgtagtagcgttatggtacgtcgtcgtatttattttcgttttcgttcggggattttttggggtggtgcgtgggtttcgggcgaaagttgtaagatttggggggatagggggcgggggtcgttcggaggaggggttcgaggcggggatttttattcgttagtcgttacgggatttttatttacgattttttttcgtatttcggttgggggcggagttggcgcgcggggcgtcgcgggagattttaagtggggggtttttcgcgggcgtcgcgagttggcgaggagggcggggtttttcggagaaggttttcgtaattttaggtcgggttttcgtttttttttcgggttagattttaggcgggagggt

SEQ ID NO: 2786 - DNA, 922 bp, Artificial Sequence
  chemically treated genomic DNA (Homo sapiens) CpG-island No: 2786
accctcccgcctaaaatctaacccgaaaaaaaaacgaaaacccgacctaaaattacgaaaaccttctccgaaaaaccccgccctcctcgccaactcgcgacgcccgcgaaaaaccccccacttaaaatctcccgcgacgccccgcgcgccaactccgcccccaaccgaaatacgaaaaaaaatcgtaaataaaaatcccgtaacgactaacgaataaaaatccccgcctcgaacccctcctccgaacgacccccgccccctatccccccaaatcttacaactttcgcccgaaacccacgcaccaccccaaaaaatccccgaacgaaaacgaaaataaatacgacgacgtaccataacgctactacgaaaaaacgaaaccgacgccgaaacgaacgcgctcgatccccgacgaaaaaaaaaccgcaaacgacgaaaaaaaacgacgaaaaaaaacgcgcgaaaaaaaaaacgaacgcgccaaaaaaaaaacgcgccgcgcccgcccccccgacccgcaaaaccctcccctcgacccgccctccccccgatcccgcgcaccgcccgcgcctcaaactactccgcgccgcgaccccgactacgacgactccgactacgactccatccccgacccgacccgcgcaaaaaaaaacccgaaaaacgacgaaaacgataacgacgacgactacaaatcgcgaaaccccgactaaactcgctacgaaacgaacgaatccaccttcgccgcgacgcgcgcgcacacacacgcgcacacacacactcacgcgcaaacgactcgaaaacaccgacgaaccgaacctcctcgactcaaccacgaacacacacacaccgcacacgaacacgcgcaaaaatccccacgcgcgacgcctacaacgtataacgaacacacgacccgtaaatatccgcc

SEQ ID NO: 2787 - DNA, 922 bp, Artificial Sequence
  chemically treated genomic DNA (Homo sapiens) CpG-island No: 2787
gttttttcgtttggggtttggttcggggagggggcgggggttcggtttggggttgcgggggtttttttcggggagtttcgtttttttcgttaattcgcggcgttcgcgaggggttttttatttggggtttttcgcggcgtttcgcgcgttagtttcgtttttagtcggggtgcggggggggatcgtgggtaggggtttcgtggcgattggcgagtgggggttttcgtttcgagtttttttttcgggcggttttcgttttttgtttttttagattttgtaattttcgttcggagtttacgtattattttaaaaagttttcgggcgaaaacgaaagtgggtgcggcgacgtattatggcgttgttgcgaggaggcgaggtcggcgtcggagcgagcgcgttcggttttcggcgaggggggggtcgtaggcggcgggaggaggcggcgagggagggcgcgcgggggagggagcgagcgcgttagggagggggcgcgtcgcgttcgttttttcggttcgtaggatttttttttcggttcgtttttttttcggtttcgcgtatcgttcgcgttttaggttgtttcgcgtcgcggtttcggttgcggcggtttcggttgcggttttattttcggttcggttcgcgtaaggggaggttcggggagcggcggaggcggtggcggcggcggttgtaggtcgcggggtttcggttgggttcgttgcggagcgagcggatttattttcgtcgcggcgcgcgcgtatatatacgcgtatatatatatttacgcgtaggcgattcggggatatcggcgggtcgggttttttcgatttagttacggatatatatatatcgtatacggatacgcgtagagatttttacgcgcggcgtttatagcgtgtgacggatatacggttcgtgggtgttcgtt

SEQ ID NO: 2788 - DNA, 922 bp, Artificial Sequence
  chemically treated genomic DNA (Homo sapiens) CpG-island No: 2788
aacgaacacccacgaaccgtatatccgtcacacgctataaacgccgcgcgtaaaaatctctacgcgtatccgtatacgatatatatatatccgtaactaaatcgaaaaaacccgacccgccgatatccccgaatcgcctacgcgtaaatatatatatacgcgtatatatacgcgcgcgccgcgacgaaaataaatccgctcgctccgcaacgaacccaaccgaaaccccgcgacctacaaccgccgccgccaccgcctccgccgctccccgaacctccccttacgcgaaccgaaccgaaaataaaaccgcaaccgaaaccgccgcaaccgaaaccgcgacgcgaaacaacctaaaacgcgaacgatacgcgaaaccgaaaaaaaaacgaaccgaaaaaaaaatcctacgaaccgaaaaaacgaacgcgacgcgccccctccctaacgcgctcgctccctcccccgcgcgccctccctcgccgcctcctcccgccgcctacgacccccccctcgccgaaaaccgaacgcgctcgctccgacgccgacctcgcctcctcgcaacaacgccataatacgtcgccgcacccactttcgttttcgcccgaaaactttttaaaataatacgtaaactccgaacgaaaattacaaaatctaaaaaaacaaaaaacgaaaaccgcccgaaaaaaaaactcgaaacgaaaacccccactcgccaatcgccacgaaacccctacccacgatccccccccgcaccccgactaaaaacgaaactaacgcgcgaaacgccgcgaaaaaccccaaataaaaaacccctcgcgaacgccgcgaattaacgaaaaaaacgaaactccccgaaaaaaacccccgcaaccccaaaccgaacccccgccccctccccgaaccaaaccccaaacgaaaaaac

SEQ ID NO: 2789 - DNA, 901 bp, Artificial Sequence
  chemically treated genomic DNA (Homo sapiens) CpG-island No: 2789
cgattttcgagcgcgtagttcgtgggggagttcgggttagggagggggcgtacggcgggacggcgcgtggggcgggggtcgcggcggttttcgcggggtgtttcggttcgggcgagcgcggcgcgttagttagcggaaaatggtcgttgcggagaggggcggagagcgcgtcgcggtcgtcgtcgggcgttttgaatttggagtcgggcgggcggtcgcgttcggcgtcgcgtaggagtagtcgtttcgtttgttttcgtatcgttttcgtttcgtttttcggtagattttcggtttcgttgtcgcgcgcgcggggtttttagttgggagggattttcgggtttcggttcggcgcgttttaggttttggagcggcggtggttgtatttggggtttcggtgttcggtcgattggcgtcggtgtcgtgcgtatttcgaggggtgcgtgggagtttttgcgtttcgtaacgggtcggtattggtatttgggggagcgtttggggtgtgcgcggcggggtggtagtgtatttgttttggggtcgcgggtttcggcgcgtcggtttcgtcgttttttgtgttcgcgtgtgtttgtatatttacgtgttggcgcgtgttgtgttgtgagcgtcgttcgtattgtgcggttgcgggatatttgtgtttttggataattgggcgattgtgcgcgcgtttttgcgggacggtgttgtgaaattatggttgggttgcgtgttcgcggagtcgcgtgtttttgggtgatcgtggggtgttttcgtgtgggtgtgtggcggttggggggggtcgttagggagtggagaattgtcgagtggtcgcgttttaggggatagttgggtgtcgtttgttgtgtgcgagtgattggcgttgagtttttttttagggaag

SEQ ID NO: 2790 - DNA, 901 bp, Artificial Sequence
  chemically treated genomic DNA (Homo sapiens) CpG-island No: 2790
cttccctaaaaaaaaactcaacgccaatcactcgcacacaacaaacgacacccaactatcccctaaaacgcgaccactcgacaattctccactccctaacgaccccccccaaccgccacacacccacacgaaaacaccccacgatcacccaaaaacacgcgactccgcgaacacgcaacccaaccataatttcacaacaccgtcccgcaaaaacgcgcgcacaatcgcccaattatccaaaaacacaaatatcccgcaaccgcacaatacgaacgacgctcacaacacaacacgcgccaacacgtaaatatacaaacacacgcgaacacaaaaaacgacgaaaccgacgcgccgaaacccgcgaccccaaaacaaatacactaccaccccgccgcgcacaccccaaacgctcccccaaataccaataccgacccgttacgaaacgcaaaaactcccacgcacccctcgaaatacgcacgacaccgacgccaatcgaccgaacaccgaaaccccaaatacaaccaccgccgctccaaaacctaaaacgcgccgaaccgaaacccgaaaatccctcccaactaaaaaccccgcgcgcgcgacaacgaaaccgaaaatctaccgaaaaacgaaacgaaaacgatacgaaaacaaacgaaacgactactcctacgcgacgccgaacgcgaccgcccgcccgactccaaattcaaaacgcccgacgacgaccgcgacgcgctctccgcccctctccgcaacgaccattttccgctaactaacgcgccgcgctcgcccgaaccgaaacaccccgcgaaaaccgccgcgacccccgccccacgcgccgtcccgccgtacgccccctccctaacccgaactcccccacgaactacgcgctcgaaaatcg

SEQ ID NO: 2791 - DNA, 901 bp, Artificial Sequence
  chemically treated genomic DNA (Homo sapiens) CpG-island No: 2791
tttttttagggggaggtttagcgttagttattcgtatatagtaagcggtatttaattgttttttggaacgcggttattcgatagttttttattttttggcgattttttttaatcgttatatatttatacggggatattttacggttatttagggatacgcggtttcgcggatacgtagtttagttatagttttataatatcgtttcgtagggacgcgcgtatagtcgtttagttatttaaagatataagtgtttcgtagtcgtataatgcgggcggcgtttataatataatacgcgttagtacgtggatgtgtagatatacgcggatatagaaagcggcggagtcgacgcgtcgggattcgcggttttaaggtaggtatattattatttcgtcgcgtatattttagacgtttttttagatgttaatgtcggttcgttacggagcgtaggggtttttacgtatttttcgaggtgcgtacgatatcgacgttagtcgatcggatatcggaattttaagtgtagttatcgtcgttttagggtttggggcgcgtcgggtcgagattcgggggttttttttagttggggatttcgcgcgcgcggtagcggggtcgggggtttgtcgaggggcggggcgggggcggtgcgagggtaggcggggcggttgtttttgcgcggcgtcgagcgcggtcgttcgttcggttttaagtttaaggcgttcggcggcggtcgcggcgcgtttttcgttttttttcgtagcggttatttttcgttagttggcgcgtcgcgttcgttcgggtcggggtatttcgcgggggtcgtcgcgattttcgttttacgcgtcgtttcgtcgtgcgttttttttttggttcgggtttttttacggattgcgcgttcgggggtcg

SEQ ID NO: 2792 - DNA, 901 bp, Artificial Sequence
  chemically treated genomic DNA (Homo sapiens) CpG-island No: 2792
cgacccccgaacgcgcaatccgtaaaaaaacccgaaccaaaaaaaaaacgcacgacgaaacgacgcgtaaaacgaaaatcgcgacgacccccgcgaaataccccgacccgaacgaacgcgacgcgccaactaacgaaaaataaccgctacgaaaaaaaacgaaaaacgcgccgcgaccgccgccgaacgccttaaacttaaaaccgaacgaacgaccgcgctcgacgccgcgcaaaaacaaccgccccgcctaccctcgcaccgcccccgccccgcccctcgacaaacccccgaccccgctaccgcgcgcgcgaaatccccaactaaaaaaaacccccgaatctcgacccgacgcgccccaaaccctaaaacgacgataactacacttaaaattccgatatccgatcgactaacgtcgatatcgtacgcacctcgaaaaatacgtaaaaacccctacgctccgtaacgaaccgacattaacatctaaaaaaacgtctaaaatatacgcgacgaaataataatatacctaccttaaaaccgcgaatcccgacgcgtcgactccgccgctttctatatccgcgtatatctacacatccacgtactaacgcgtattatattataaacgccgcccgcattatacgactacgaaacacttatatctttaaataactaaacgactatacgcgcgtccctacgaaacgatattataaaactataactaaactacgtatccgcgaaaccgcgtatccctaaataaccgtaaaatatccccgtataaatatataacgattaaaaaaaatcgccaaaaaataaaaaactatcgaataaccgcgttccaaaaaacaattaaataccgcttactatatacgaataactaacgctaaacctccccctaaaaaaa

SEQ ID NO: 2793 - DNA, 640 bp, Artificial Sequence
  chemically treated genomic DNA (Homo sapiens) CpG-island No: 2793
ttcgttttttcggtttgtaggatgagttttattcgtttatcgaggttttgttgttttacgttcgcgttttcgtttatatttggtttaatttgtaggcgcggaagcgtaagtattttaagaagtacgagaagcggatgtcgaaggacgaggagcgtgcggttaaggacgagttgttgggcgagaagttcgaggttaagtagaagtgggcgtcgcggttgttggttaagttgcgtaaggatattcggttcgagtgtcgcgaggatttcgtgttgagtattatcggtaagaaggcgtcgggttgcgtgttttttaatttcgattagaagggtaagatgcggcgtatcgattgttttcggtaggcggataaggtgtggcggttggatttggttatggttattttgtttaagggtatttcgttggagagtatcgacggcgagcgtttggttaaggttgcgtagtgcggttattcggttttgtgcgtgtagtcgtattatattggcgtggtcgttaaggagttggatttttatttggtttatttcgtgcgtgagcgaggtgaggtgtggtggtttgagcggagcggttagcggggagggtgtttgatggtggtgatacggggttaggagggtttgagggaggaggt

SEQ ID NO: 2794 - DNA, 640 bp, Artificial Sequence
  chemically treated genomic DNA (Homo sapiens) CpG-island No: 2794
acctcctccctcaaaccctcctaaccccgtatcaccaccatcaaacaccctccccgctaaccgctccgctcaaaccaccacacctcacctcgctcacgcacgaaataaaccaaataaaaatccaactccttaacgaccacgccaatataatacgactacacgcacaaaaccgaataaccgcactacgcaaccttaaccaaacgctcgccgtcgatactctccaacgaaatacccttaaacaaaataaccataaccaaatccaaccgccacaccttatccgcctaccgaaaacaatcgatacgccgcatcttacccttctaatcgaaattaaaaaacacgcaacccgacgccttcttaccgataatactcaacacgaaatcctcgcgacactcgaaccgaatatccttacgcaacttaaccaacaaccgcgacgcccacttctacttaacctcgaacttctcgcccaacaactcgtccttaaccgcacgctcctcgtccttcgacatccgcttctcgtacttcttaaaatacttacgcttccgcgcctacaaattaaaccaaatataaacgaaaacgcgaacgtaaaacaacaaaacctcgataaacgaataaaactcatcctacaaaccgaaaaaacgaa

SEQ ID NO: 2795 - DNA, 640 bp, Artificial Sequence
  chemically treated genomic DNA (Homo sapiens) CpG-island No: 2795
gtttttttttttaggtttttttggtttcgtgttattattattagatatttttttcgttggtcgtttcgtttaggttattatattttatttcgtttacgtacgaagtaggttaggtagaggtttagttttttgacggttacgttaatgtggtgcggttgtacgtataggatcgggtgatcgtattgcgtagttttgattaggcgttcgtcgtcggtgttttttagcgggatgtttttgaataggatgattatgattaggtttagtcgttatattttgttcgtttgtcggagatagtcgatgcgtcgtattttgtttttttggtcggggttggagagtacgtagttcggcgtttttttgtcggtgatgtttagtacgaagttttcgcggtattcgggtcggatgtttttgcgtagtttggttagtagtcgcgacgtttatttttgtttgatttcgggtttttcgtttagtagttcgtttttgatcgtacgtttttcgtttttcgatattcgtttttcgtgttttttgaagtatttgcgttttcgcgtttgtaggttgaattaggtgtaggcgaaggcgcggacgtgaggtagtagggtttcgatgaacgggtggaatttattttgtaggtcggagaggcgag

SEQ ID NO: 2796 - DNA, 640 bp, Artificial Sequence
  chemically treated genomic DNA (Homo sapiens) CpG-island No: 2796
ctcgcctctccgacctacaaaataaattccacccgttcatcgaaaccctactacctcacgtccgcgccttcgcctacacctaattcaacctacaaacgcgaaaacgcaaatacttcaaaaaacacgaaaaacgaatatcgaaaaacgaaaaacgtacgatcaaaaacgaactactaaacgaaaaacccgaaatcaaacaaaaataaacgtcgcgactactaaccaaactacgcaaaaacatccgacccgaataccgcgaaaacttcgtactaaacatcaccgacaaaaaaacgccgaactacgtactctccaaccccgaccaaaaaaacaaaatacgacgcatcgactatctccgacaaacgaacaaaatataacgactaaacctaatcataatcatcctattcaaaaacatcccgctaaaaaacaccgacgacgaacgcctaatcaaaactacgcaatacgatcacccgatcctatacgtacaaccgcaccacattaacgtaaccgtcaaaaaactaaacctctacctaacctacttcgtacgtaaacgaaataaaatataataacctaaacgaaacgaccaacgaaaaaaatatctaataataataacacgaaaccaaaaaaacctaaaaaaaaaaac

SEQ ID NO: 2797 - DNA, 533 bp, Artificial Sequence
  chemically treated genomic DNA (Homo sapiens) CpG-island No: 2797
tacgatttatatatcgtttcgatttagagttttaagaaagttaggagcggttcgttacgttcgggttcgttcgttttggtggggtttatattgttcgttcgtttatttgtattggaaggttatgttggtgattttgattttgattttttcgtttagtttgcgttcgtcggttatttcgaagagtttgttggttattttttcgtatattttggcgttgcgtttggtttgtttgagttcgtcgaagaattttttttagattagtatgaggtcgcgtatttcggcgttcgtttagttgcgggttcgtcggtgttttttcgtttggggagatacgaggtagtcgggtttttcggtcgtcgttatgtcggaggcgtttgtggggtgagagagcgcgtttagcgagggtttcggttcggttttacgtattatgggcgggaggcgtcgtttacgttcgttcgaaggtagttttacgtttaaaatggggtttatatttgataggtaggaatttagttaaaagtttttaaacgggaaacgtt

SEQ ID NO: 2798 - DNA, 533 bp, Artificial Sequence
  chemically treated genomic DNA (Homo sapiens) CpG-island No: 2798
aacgtttcccgtttaaaaacttttaactaaattcctacctatcaaatataaaccccattttaaacgtaaaactaccttcgaacgaacgtaaacgacgcctcccgcccataatacgtaaaaccgaaccgaaaccctcgctaaacgcgctctctcaccccacaaacgcctccgacataacgacgaccgaaaaacccgactacctcgtatctccccaaacgaaaaaacaccgacgaacccgcaactaaacgaacgccgaaatacgcgacctcatactaatctaaaaaaaattcttcgacgaactcaaacaaaccaaacgcaacgccaaaatatacgaaaaaataaccaacaaactcttcgaaataaccgacgaacgcaaactaaacgaaaaaatcaaaatcaaaatcaccaacataaccttccaatacaaataaacgaacgaacaatataaaccccaccaaaacgaacgaacccgaacgtaacgaaccgctcctaactttcttaaaactctaaatcgaaacgatatataaatcgta

SEQ ID NO: 2799 - DNA, 533 bp, Artificial Sequence
  chemically treated genomic DNA (Homo sapiens) CpG-island No: 2799
gacgtttttcgtttaaaagtttttaattaaatttttgtttgttagatgtaggttttattttgagcgtggagttgttttcgagcgagcgtgagcggcgtttttcgtttatggtgcgtggggtcgggtcggggttttcgttgagcgcgtttttttattttataggcgttttcggtatggcggcggtcgaggggttcggttatttcgtgtttttttaggcggagaagtatcggcgggttcgtaattggacggacgtcgagatgcgcggttttatgttggtttgggaggagtttttcgacgagtttaagtagattaagcgtaacgttaaggtgtacgagaagatggttagtaagtttttcgagatgatcggcgagcgtaggttgggcgaggagattaagattaagattattaatatgattttttagtataggtgggcgagcgggtagtgtgggttttattaggacgggcgggttcgggcgtggcgggtcgtttttgatttttttggagttttgagtcgggacgatgtgtgggtcgtg

SEQ ID NO: 2800 - DNA, 533 bp, Artificial Sequence
  chemically treated genomic DNA (Homo sapiens) CpG-island No: 2800
cacgacccacacatcgtcccgactcaaaactccaaaaaaatcaaaaacgacccgccacgcccgaacccgcccgtcctaataaaacccacactacccgctcgcccacctatactaaaaaatcatattaataatcttaatcttaatctcctcgcccaacctacgctcgccgatcatctcgaaaaacttactaaccatcttctcgtacaccttaacgttacgcttaatctacttaaactcgtcgaaaaactcctcccaaaccaacataaaaccgcgcatctcgacgtccgtccaattacgaacccgccgatacttctccgcctaaaaaaacacgaaataaccgaacccctcgaccgccgccataccgaaaacgcctataaaataaaaaaacgcgctcaacgaaaaccccgacccgaccccacgcaccataaacgaaaaacgccgctcacgctcgctcgaaaacaactccacgctcaaaataaaacctacatctaacaaacaaaaatttaattaaaaacttttaaacgaaaaacgtc

SEQ ID NO: 2801 - DNA, 655 bp, Artificial Sequence
  chemically treated genomic DNA (Homo sapiens) CpG-island No: 2801
ggtaaagcggcgataatatcggcgttagttcgcgtttcgatttcggtcgtcgagttttttttttgtagtatttcggtattttagcgttcggtttaattcggttcgttatattcgcgttcgcgcgtttagttcgagtttcggaacgatttcgagttttacgtcggcgttcggtggcgggagggggcgtcgagttcgcggtttatttgcgtgttggattttcgggttgttcggaggggtgcggggcgtaggcgagtgcggttcgtagattttaattttgttgttttcgggacggcgtagtcgttattttttcgcggagcgggcggtgcggttcgggttgtgcggttcgggttgtgatttagcggttcgcgcggtggcgcgtagggttttgtagttagtcgtttcgttcgcgttttcggtttcgcgcgtttttggttttaggcgtcgtttttttattttgcgcgttttcggttgcggggtagcgggtagttttgcgttgtcggtcgtttagtttgtatttttcgttttgggagggaagtttcgttttagtcgcgtcgttttcgcgtcgaagtgcgattcggggtttcgcgttggagttttttgtttttaggttggtttggaaggtggtggtggggtttagggttttcggaaagttggg

SEQ ID NO: 2802 - DNA, 655 bp, Artificial Sequence
  chemically treated genomic DNA (Homo sapiens) CpG-island No: 2802
cccaactttccgaaaaccctaaaccccaccaccaccttccaaaccaacctaaaaacaaaaaactccaacgcgaaaccccgaatcgcacttcgacgcgaaaacgacgcgactaaaacgaaacttccctcccaaaacgaaaaatacaaactaaacgaccgacaacgcaaaactacccgctaccccgcaaccgaaaacgcgcaaaataaaaaaacgacgcctaaaaccaaaaacgcgcgaaaccgaaaacgcgaacgaaacgactaactacaaaaccctacgcgccaccgcgcgaaccgctaaatcacaacccgaaccgcacaacccgaaccgcaccgcccgctccgcgaaaaaataacgactacgccgtcccgaaaacaacaaaattaaaatctacgaaccgcactcgcctacgccccgcacccctccgaacaacccgaaaatccaacacgcaaataaaccgcgaactcgacgccccctcccgccaccgaacgccgacgtaaaactcgaaatcgttccgaaactcgaactaaacgcgcgaacgcgaatataacgaaccgaattaaaccgaacgctaaaataccgaaatactacaaaaaaaaaactcgacgaccgaaatcgaaacgcgaactaacgccgatattatcgccgctttacc

SEQ ID NO: 2803 - DNA, 655 bp, Artificial Sequence
  chemically treated genomic DNA (Homo sapiens) CpG-island No: 2803
tttagtttttcggggattttgaattttattattattttttagattagtttgagagtaggggattttagcgcggggtttcggatcgtatttcggcgcggaaacgacgcggttggagcgaggttttttttttagggcggggggtgtaggttaggcggtcggtagcgtagggttgttcgttatttcgtagtcgagggcgcgtagagtggggagacggcgtttggggttaggggcgcgcggagtcgggggcgcgggcggggcggttggttgtagggttttgcgcgttatcgcgcgagtcgttgggttatagttcgggtcgtatagttcgggtcgtatcgttcgtttcgcgaggaagtgacgattgcgtcgtttcgagagtaataaagttagagtttgcgggtcgtattcgtttgcgtttcgtattttttcgagtagttcggggatttagtacgtaggtaagtcgcgggttcggcgttttttttcgttatcgggcgtcggcgtggggttcggaatcgtttcggggttcgggttgggcgcgcgggcgcggatgtggcgggtcgggttgggtcgggcgttggggtgtcggggtgttgtagggagggagttcggcggtcggggtcggggcgcgggttggcgtcggtgttgtcgtcgttttgtt

SEQ ID NO: 2804 - DNA, 655 bp, Artificial Sequence
  chemically treated genomic DNA (Homo sapiens) CpG-island No: 2804
aacaaaacgacgacaacaccgacgccaacccgcgccccgaccccgaccgccgaactccctccctacaacaccccgacaccccaacgcccgacccaacccgacccgccacatccgcgcccgcgcgcccaacccgaaccccgaaacgattccgaaccccacgccgacgcccgataacgaaaaaaaacgccgaacccgcgacttacctacgtactaaatccccgaactactcgaaaaaatacgaaacgcaaacgaatacgacccgcaaactctaactttattactctcgaaacgacgcaatcgtcacttcctcgcgaaacgaacgatacgacccgaactatacgacccgaactataacccaacgactcgcgcgataacgcgcaaaaccctacaaccaaccgccccgcccgcgcccccgactccgcgcgcccctaaccccaaacgccgtctccccactctacgcgccctcgactacgaaataacgaacaaccctacgctaccgaccgcctaacctacaccccccgccctaaaaaaaaaacctcgctccaaccgcgtcgtttccgcgccgaaatacgatccgaaaccccgcgctaaaatcccctactctcaaactaatctaaaaaataataataaaattcaaaatccccgaaaaactaaa

SEQ ID NO: 2805 - DNA, 907 bp, Artificial Sequence
  chemically treated genomic DNA (Homo sapiens) CpG-island No: 2805
attcgtcgggtcgcggtagttattttgtttcgttcgaggagattttaagatggcggcgagggggacggtgaaggttgtttttcgttcgttcgggttttgatttttcgttttttcgtttttcggcggtcggtttatggtttggcggaggttcgaattatggattttcgtatcgtcgtgtataacgtcgttcgtgatggtaagttgtagttgttttagaagttgtttagcggtcggagtcgggaggaattggacgagttgacgggcgaggtggtcggcgggggaacgtcgttatttatcgtcgttcgttacggttatttggacgtggtggagtatttggtggatcggtgcggcgcgagcgtggaggtcggtggttcggtgtatttcgatggcgagattatcgagggcgcgtcgtcgttgtgggtcgttttcgtagtcggttatttggacgtggtgcggagtttgttgcgtcgcggggtttcggtgaatcgtattacgcgtattaattttacgttttttcgcgtcgtttgtttcgacggttatttggaggtggtgcgttatttggtcggcgagtattaggtcgatttggaggtggttaatcggtacggttatacgtgttttatgatttcgtgttataagggttatcgtgagatcgttcgttatttgttggagtagggcgtttaggtgaatcggcgtagcgttaagggtaatacggttttgtatgattgcgtcgagttcggtagtttggagattttgtagttgttgttggggtgtaaggttcgtatggaacgtgacggttacggtatgatttcgttgttcgcggttagcgtgacgggttatattaatatcgtggagtattttatttaggagtagttcggttaggagtaggtcgtagggggagaggtttagt

SEQ ID NO: 2806 - DNA, 907 bp, Artificial Sequence
  chemically treated genomic DNA (Homo sapiens) CpG-island No: 2806
actaaacctctccccctacgacctactcctaaccgaactactcctaaataaaatactccacgatattaatataacccgtcacgctaaccgcgaacaacgaaatcataccgtaaccgtcacgttccatacgaaccttacaccccaacaacaactacaaaatctccaaactaccgaactcgacgcaatcatacaaaaccgtattacccttaacgctacgccgattcacctaaacgccctactccaacaaataacgaacgatctcacgataacccttataacacgaaatcataaaacacgtataaccgtaccgattaaccacctccaaatcgacctaatactcgccgaccaaataacgcaccacctccaaataaccgtcgaaacaaacgacgcgaaaaaacgtaaaattaatacgcgtaatacgattcaccgaaaccccgcgacgcaacaaactccgcaccacgtccaaataaccgactacgaaaacgacccacaacgacgacgcgccctcgataatctcgccatcgaaatacaccgaaccaccgacctccacgctcgcgccgcaccgatccaccaaatactccaccacgtccaaataaccgtaacgaacgacgataaataacgacgttcccccgccgaccacctcgcccgtcaactcgtccaattcctcccgactccgaccgctaaacaacttctaaaacaactacaacttaccatcacgaacgacgttatacacgacgatacgaaaatccataattcgaacctccgccaaaccataaaccgaccgccgaaaaacgaaaaaacgaaaaatcaaaacccgaacgaacgaaaaacaaccttcaccgtccccctcgccgccatcttaaaatctcctcgaacgaaacaaaataactaccgcgacccgacgaat

SEQ ID NO: 2807 - DNA, 907 bp, Artificial Sequence
  chemically treated genomic DNA (Homo sapiens) CpG-island No: 2807
gttgagtttttttttttgcgatttgtttttggtcgggttgtttttggatgaggtattttacgatgttggtgtggttcgttacgttggtcgcgagtagcggggttatgtcgtagtcgttacgttttatgcgggttttgtattttagtagtagttgtaggatttttaggttgtcggattcggcgtagttatgtagggtcgtgttgtttttggcgttgcgtcggtttatttgggcgttttgttttagtaggtagcgggcgattttacggtggtttttgtagtacgagattatgaggtacgtgtggtcgtgtcggttggttatttttaggtcggtttggtgttcgtcgattaggtagcgtattatttttaggtggtcgtcgaagtaggcggcgcggagaggcgtggagttggtgcgcgtggtgcggtttatcgaggtttcgcggcgtagtaggtttcgtattacgtttaggtggtcggttgcggaggcggtttatagcggcggcgcgttttcgatggtttcgttatcgaagtgtatcgagttatcggtttttacgttcgcgtcgtatcggtttattaggtattttattacgtttaggtggtcgtagcgggcggcgatgagtagcggcgttttttcgtcggttatttcgttcgttagttcgtttagtttttttcggtttcggtcgttgagtagtttttggagtagttgtagtttgttattacgggcggcgttgtatacggcggtgcggaggtttatggttcgggttttcgttaggttatgggtcggtcgtcgggggacggggagacggaggattagagttcggacgggcgggaggtaatttttatcgtttttttcgtcgttattttagggttttttcgggcggaataaaatggttgtcgcgattcgacggat

SEQ ID NO: 2808 - DNA, 907 bp, Artificial Sequence
  chemically treated genomic DNA (Homo sapiens) CpG-island No: 2808
atccgtcgaatcgcgacaaccattttattccgcccgaaaaaaccctaaaataacgacgaaaaaaacgataaaaattacctcccgcccgtccgaactctaatcctccgtctccccgtcccccgacgaccgacccataacctaacgaaaacccgaaccataaacctccgcaccgccgtatacaacgccgcccgtaataacaaactacaactactccaaaaactactcaacgaccgaaaccgaaaaaaactaaacgaactaacgaacgaaataaccgacgaaaaaacgccgctactcatcgccgcccgctacgaccacctaaacgtaataaaatacctaataaaccgatacgacgcgaacgtaaaaaccgataactcgatacacttcgataacgaaaccatcgaaaacgcgccgccgctataaaccgcctccgcaaccgaccacctaaacgtaatacgaaacctactacgccgcgaaacctcgataaaccgcaccacgcgcaccaactccacgcctctccgcgccgcctacttcgacgaccacctaaaaataatacgctacctaatcgacgaacaccaaaccgacctaaaaataaccaaccgacacgaccacacgtacctcataatctcgtactacaaaaaccaccgtaaaatcgcccgctacctactaaaacaaaacgcccaaataaaccgacgcaacgccaaaaacaacacgaccctacataactacgccgaatccgacaacctaaaaatcctacaactactactaaaatacaaaacccgcataaaacgtaacgactacgacataaccccgctactcgcgaccaacgtaacgaaccacaccaacatcgtaaaatacctcatccaaaaacaacccgaccaaaaacaaatcgcaaaaaaaaaaactcaac

SEQ ID NO: 2809 - DNA, 714 bp, Artificial Sequence
  chemically treated genomic DNA (Homo sapiens) CpG-island No: 2809
cgattagcggatcgatttttatagcgttttaaggcggagcgttcggtttttttaggatgttttagggcggtataaacgcgtagggggagaaaaagaagttttcgggttattacggttttagatcgtcggtttttcggtgacgggagtcgtcgtttttattatgtagcggggtcgtagcgttcgtttttcggtatgtttcgcgtatttttgttcgggatatttatcggcgtcggcggttttcgtttcggttttgcggcggcggttgtacgtttagtttttgcgtttgcgtcgtaagtagggtaggatagcgcgtagggggcgtgaagagtttagggcgtttgcgcggcgagacggattagttttgtagcgttgtgggaagaggggttatgcgcgtcgggtcgtcgacgagattcgcgcggggggcgtcgtgttttgtttttcgttgtttgggtttatttggtatagttcgcggtttaaaggaataagaagttgaagggttcgcgcgtgcgtgtgcggggtaggaacgcgttttataaaattgggatgcgttgggggtggagggcgttagttcggattggattttgggttcgaggtttgtttatttgtataattttagcgcgggataatgaaaggtttttcgtattggaaggagtgatttgtatatttttcggaggggttttattttagagcgtagtgattagtatatggcggggg

SEQ ID NO: 2810 - DNA, 714 bp, Artificial Sequence
  chemically treated genomic DNA (Homo sapiens) CpG-island No: 2810
cccccgccatatactaatcactacgctctaaaataaaacccctccgaaaaatatacaaatcactccttccaatacgaaaaacctttcattatcccgcgctaaaattatacaaataaacaaacctcgaacccaaaatccaatccgaactaacgccctccacccccaacgcatcccaattttataaaacgcgttcctaccccgcacacgcacgcgcgaacccttcaacttcttattcctttaaaccgcgaactataccaaataaacccaaacaacgaaaaacaaaacacgacgccccccgcgcgaatctcgtcgacgacccgacgcgcataacccctcttcccacaacgctacaaaactaatccgtctcgccgcgcaaacgccctaaactcttcacgccccctacgcgctatcctaccctacttacgacgcaaacgcaaaaactaaacgtacaaccgccgccgcaaaaccgaaacgaaaaccgccgacgccgataaatatcccgaacaaaaatacgcgaaacataccgaaaaacgaacgctacgaccccgctacataataaaaacgacgactcccgtcaccgaaaaaccgacgatctaaaaccgtaataacccgaaaacttctttttctccccctacgcgtttataccgccctaaaacatcctaaaaaaaccgaacgctccgccttaaaacgctataaaaatcgatccgctaatcg

SEQ ID NO: 2811 - DNA, 714 bp, Artificial Sequence
  chemically treated genomic DNA (Homo sapiens) CpG-island No: 2811
ttttcgttatatgttaattattgcgttttggagtaaggttttttcggggaatatgtaaattattttttttagtgcgggaggttttttattgtttcgcgttaggattatgtaaataagtaggtttcgggtttaggatttagttcgaattagcgttttttatttttagcgtattttagttttgtaaggcgcgtttttgtttcgtatacgtacgcgcgaattttttagttttttgtttttttgggtcgcgggttgtattaagtaaatttaggtagcgaggggtaaagtacggcgtttttcgcgcgggtttcgtcgacggttcgacgcgtatagtttttttttttatagcgttataggattagttcgtttcgtcgcgtaagcgttttaggttttttacgttttttgcgcgttgttttattttatttgcgacgtaggcgtagaggttgggcgtgtagtcgtcgtcgtagagtcggagcgggggtcgtcggcgtcggtgagtgtttcgggtaggggtgcgcgaggtatgtcgggaagcgggcgttacggtttcgttgtatgatgggagcgacgattttcgttatcggggagtcggcggtttggggtcgtggtgattcgagggtttttttttttttttttacgcgtttgtgtcgttttggggtattttgggagaatcgagcgtttcgttttgaagcgttgtgggagtcggttcgttagtcg

SEQ ID NO: 2812 - DNA, 714 bp, Artificial Sequence
  chemically treated genomic DNA (Homo sapiens) CpG-island No: 2812
cgactaacgaaccgactcccacaacgcttcaaaacgaaacgctcgattctcccaaaataccccaaaacgacacaaacgcgtaaaaaaaaaaaaaaaaaccctcgaatcaccacgaccccaaaccgccgactccccgataacgaaaatcgtcgctcccatcatacaacgaaaccgtaacgcccgcttcccgacatacctcgcgcacccctacccgaaacactcaccgacgccgacgacccccgctccgactctacgacgacgactacacgcccaacctctacgcctacgtcgcaaataaaataaaacaacgcgcaaaaaacgtaaaaaacctaaaacgcttacgcgacgaaacgaactaatcctataacgctataaaaaaaaaaactatacgcgtcgaaccgtcgacgaaacccgcgcgaaaaacgccgtactttacccctcgctacctaaatttacttaatacaacccgcgacccaaaaaaacaaaaaactaaaaaattcgcgcgtacgtatacgaaacaaaaacgcgccttacaaaactaaaatacgctaaaaataaaaaacgctaattcgaactaaatcctaaacccgaaacctacttatttacataatcctaacgcgaaacaataaaaaacctcccgcactaaaaaaaataatttacatattccccgaaaaaaccttactccaaaacgcaataattaacatataacgaaaa

SEQ ID NO: 2813 - DNA, 1021 bp, Artificial Sequence
  chemically treated genomic DNA (Homo sapiens) CpG-island No: 2813
agacgggcggatagagggacgtagagattggatagaaggatagcgggatcggtttggggagggcggatttgtgtgtgtaggggggtttcgggttttttgttttcgtcgggatttagtttgcgcgggtgggggggttgcggtacggcggtcgggtttcgcgttttttttttcgttcgtcgttttcggttttcggttcgcgttgcgttttgtttcggggagggggttcggttcggtttcgcgcgtattgttcggtttttgcggtttcgaggttgtcgggttgttattatagcgcgtttttcgttttagttcggtcggtcgatttcggttttcgattttatttggtttcgtcgcggtcgtttatagtagtagtagcggttattggaagcgtcgggttcggtttatggtgtcgtcgtcgtcgtcgtcgtcgttcgttttcggttcggtatttgtatcgttcgcgtcgttcgtttcgtttttcgcgtttcgttttttgttcgttcgggggcggggcgtcgaggtcggggcggggtcggggaggggagggggagacggaggagaggttcggagataatcggggggacggtacggtgggggaacggtgcggggtgcgaaagttggagaggagaggggtgaggagggcgggaaggggtgcgcgggagggcgatagcggcgtgggagtaggtgggggatttcggtgagcgcgggaaatggagggtgttgggtgagggtgttgcgtgcgggtttaggtgttgcgcgcgagggtgcggagttgttggtatgtagggtgtttgcgttgcgcggaggggagggtggtagggtgttgttggaggttgtgcgagggtgggggcgcgggcgtcgtggggtgcggtgtgtgcgaagggagagcgtggttagcgtgacgggggagcgtaagggagggagtgcgacgtgggaaaggtgagtgtgagaggcgtgttgcgggtaggtgggtgtttggagtttagcgagaggttgtgagttgagttatcgggataggggaggt

SEQ ID NO: 2814 - DNA, 1021 bp, Artificial Sequence
  chemically treated genomic DNA (Homo sapiens) CpG-island No: 2814
acctcccctatcccgataactcaactcacaacctctcgctaaactccaaacacccacctacccgcaacacgcctctcacactcacctttcccacgtcgcactccctcccttacgctcccccgtcacgctaaccacgctctcccttcgcacacaccgcaccccacgacgcccgcgcccccaccctcgcacaacctccaacaacaccctaccaccctcccctccgcgcaacgcaaacaccctacataccaacaactccgcaccctcgcgcgcaacacctaaacccgcacgcaacaccctcacccaacaccctccatttcccgcgctcaccgaaatcccccacctactcccacgccgctatcgccctcccgcgcaccccttcccgccctcctcacccctctcctctccaactttcgcaccccgcaccgttcccccaccgtaccgtccccccgattatctccgaacctctcctccgtctccccctcccctccccgaccccgccccgacctcgacgccccgcccccgaacgaacaaaaaacgaaacgcgaaaaacgaaacgaacgacgcgaacgatacaaataccgaaccgaaaacgaacgacgacgacgacgacgacgacaccataaaccgaacccgacgcttccaataaccgctactactactataaacgaccgcgacgaaaccaaataaaatcgaaaaccgaaatcgaccgaccgaactaaaacgaaaaacgcgctataataacaacccgacaacctcgaaaccgcaaaaaccgaacaatacgcgcgaaaccgaaccgaaccccctccccgaaacaaaacgcaacgcgaaccgaaaaccgaaaacgacgaacgaaaaaaaaaacgcgaaacccgaccgccgtaccgcaacccccccacccgcgcaaactaaatcccgacgaaaacaaaaaacccgaaacccccctacacacacaaatccgccctccccaaaccgatcccgctatccttctatccaatctctacgtccctctatccgcccgtct

SEQ ID NO: 2815 - DNA, 1021 bp, Artificial Sequence
  chemically treated genomic DNA (Homo sapiens) CpG-island No: 2815
gttttttttgtttcggtggtttagtttatagtttttcgttagattttagatatttatttgttcgtagtacgttttttatatttattttttttacgtcgtatttttttttttacgttttttcgttacgttggttacgtttttttttcgtatatatcgtattttacgacgttcgcgtttttattttcgtatagtttttagtaatattttgttattttttttttcgcgtagcgtaagtattttgtatgttagtaatttcgtattttcgcgcgtagtatttgggttcgtacgtagtatttttatttaatattttttatttttcgcgtttatcgagattttttatttgtttttacgtcgttgtcgttttttcgcgtattttttttcgttttttttattttttttttttttagttttcgtatttcgtatcgtttttttatcgtgtcgttttttcgattgttttcgggtttttttttcgtttttttttttttttttcggtttcgtttcggtttcggcgtttcgttttcgggcgggtagggggcggggcgcggggggcggggcgggcggcgcgggcggtgtaggtgtcgggtcgggagcgagcggcggcggcggcggcggcggtattatgggtcgggttcggcgtttttagtggtcgttgttgttgttgtgggcggtcgcggcggggttaggtagggtcgggggtcggggtcggtcggtcgggttggggcggggggcgcgttgtggtgatagttcggtagtttcggggtcgtagaggtcgaataatgcgcgcggggtcgggtcgggtttttttttcgggataaagcgtagcgcgggtcgggagtcgggagcgacgagcgggggagggggcgcggggttcggtcgtcgtgtcgtagtttttttattcgcgtaggttggatttcggcggggataaagggttcgagatttttttatatatataagttcgttttttttaggtcggtttcgttgtttttttgtttagtttttgcgtttttttgttcgttcgttt

SEQ ID NO: 2816 - DNA, 1021 bp, Artificial Sequence
  chemically treated genomic DNA (Homo sapiens) CpG-island No: 2816
aaacgaacgaacaaaaaaacgcaaaaactaaacaaaaaaacaacgaaaccgacctaaaaaaaacgaacttatatatataaaaaaatctcgaaccctttatccccgccgaaatccaacctacgcgaataaaaaaactacgacacgacgaccgaaccccgcgccccctcccccgctcgtcgctcccgactcccgacccgcgctacgctttatcccgaaaaaaaaacccgacccgaccccgcgcgcattattcgacctctacgaccccgaaactaccgaactatcaccacaacgcgccccccgccccaacccgaccgaccgaccccgacccccgaccctacctaaccccgccgcgaccgcccacaacaacaacaacgaccactaaaaacgccgaacccgacccataataccgccgccgccgccgccgccgctcgctcccgacccgacacctacaccgcccgcgccgcccgccccgccccccgcgccccgccccctacccgcccgaaaacgaaacgccgaaaccgaaacgaaaccgaaaaaaaaaaaaaaaaacgaaaaaaaaacccgaaaacaatcgaaaaaacgacacgataaaaaaacgatacgaaatacgaaaactaaaaaaaaaaaaaataaaaaaaacgaaaaaaaatacgcgaaaaaacgacaacgacgtaaaaacaaataaaaaatctcgataaacgcgaaaaataaaaaatattaaataaaaatactacgtacgaacccaaatactacgcgcgaaaatacgaaattactaacatacaaaatacttacgctacgcgaaaaaaaaaataacaaaatattactaaaaactatacgaaaataaaaacgcgaacgtcgtaaaatacgatatatacgaaaaaaaaacgtaaccaacgtaacgaaaaaacgtaaaaaaaaaaatacgacgtaaaaaaaataaatataaaaaacgtactacgaacaaataaatatctaaaatctaacgaaaaactataaactaaaccaccgaaacaaaaaaaac

SEQ ID NO: 2817 - DNA, 565 bp, Artificial Sequence
  chemically treated genomic DNA (Homo sapiens) CpG-island No: 2817
atcgtcgtagtagtttttcggggtcgcgggttttagtttttgcgggcgaacgcggtttgggggcggcgggggcgggcgcggggcgcgcggcgaggggcggcggcggtcgggttcgcgaggggggttttcgggtcggttttatgcggggcgtttcgtcgcgtcgcgttcgcgtttttgtatcggggtgcggggtttagttcgacgcgtattcggcgtttcgcgcgttttgcgggttttttaggtcggtttcgggtgggttaggatcgcggcgttggtaggtcggggttgagttcggtttttcgcgttggagtttttgcgtcgggtgtcgtcgcggtgcgtttagcgtttgtttcgtcgagtcgtagtttttacgtatagtcgggttggggaggagcgcgaggcggcgcgcgggagtcgggagtcgtggattcgggcggggcggggtaggggcggagagggaggaggcgcggaggagcggggatagtcggtttttcgatttcgttatttgggttggaggttggatgttgtcgagttgggagcgtagttttggagtcgggagatttgg

SEQ ID NO: 2818 - DNA, 565 bp, Artificial Sequence
  chemically treated genomic DNA (Homo sapiens) CpG-island No: 2818
ccaaatctcccgactccaaaactacgctcccaactcgacaacatccaacctccaacccaaataacgaaatcgaaaaaccgactatccccgctcctccgcgcctcctccctctccgcccctaccccgccccgcccgaatccacgactcccgactcccgcgcgccgcctcgcgctcctccccaacccgactatacgtaaaaactacgactcgacgaaacaaacgctaaacgcaccgcgacgacacccgacgcaaaaactccaacgcgaaaaaccgaactcaaccccgacctaccaacgccgcgatcctaacccacccgaaaccgacctaaaaaacccgcaaaacgcgcgaaacgccgaatacgcgtcgaactaaaccccgcaccccgatacaaaaacgcgaacgcgacgcgacgaaacgccccgcataaaaccgacccgaaaacccccctcgcgaacccgaccgccgccgcccctcgccgcgcgccccgcgcccgcccccgccgcccccaaaccgcgttcgcccgcaaaaactaaaacccgcgaccccgaaaaactactacgacgat

SEQ ID NO: 2819 - DNA, 565 bp, Artificial Sequence
  chemically treated genomic DNA (Homo sapiens) CpG-island No: 2819
ttaggtttttcggttttaagattgcgtttttagttcgatagtatttagtttttagtttaggtggcggggtcggggagtcggttgttttcgttttttcgcgtttttttttttttcgtttttgtttcgtttcgttcgggtttacggttttcggttttcgcgcgtcgtttcgcgtttttttttagttcggttgtgcgtggaggttgcggttcggcggggtaggcgttgagcgtatcgcggcggtattcggcgtagaggttttagcgcggggagtcgggtttagtttcggtttgttagcgtcgcggttttagtttattcgaggtcggtttggggggttcgtagggcgcgcggagcgtcgagtgcgcgtcgggttgggtttcgtatttcggtgtaggagcgcgggcgcggcgcggcggagcgtttcgtatggagtcggttcgggagtttttttcgcgggttcggtcgtcgtcgtttttcgtcgcgcgtttcgcgttcgttttcgtcgtttttaggtcgcgttcgttcgtagaggttgaggttcgcggtttcgaggggttgttgcggcgat

SEQ ID NO: 2820 - DNA, 565 bp, Artificial Sequence
  chemically treated genomic DNA (Homo sapiens) CpG-island No: 2820
atcgccgcaacaacccctcgaaaccgcgaacctcaacctctacgaacgaacgcgacctaaaaacgacgaaaacgaacgcgaaacgcgcgacgaaaaacgacgacgaccgaacccgcgaaaaaaactcccgaaccgactccatacgaaacgctccgccgcgccgcgcccgcgctcctacaccgaaatacgaaacccaacccgacgcgcactcgacgctccgcgcgccctacgaaccccccaaaccgacctcgaataaactaaaaccgcgacgctaacaaaccgaaactaaacccgactccccgcgctaaaacctctacgccgaataccgccgcgatacgctcaacgcctaccccgccgaaccgcaacctccacgcacaaccgaactaaaaaaaaacgcgaaacgacgcgcgaaaaccgaaaaccgtaaacccgaacgaaacgaaacaaaaacgaaaaaaaaaaaaacgcgaaaaaacgaaaacaaccgactccccgaccccgccacctaaactaaaaactaaatactatcgaactaaaaacgcaatcttaaaaccgaaaaacctaa

SEQ ID NO: 2821 - DNA, 800 bp, Artificial Sequence
  chemically treated genomic DNA (Homo sapiens) CpG-island No: 2821
gaaggtgcgataatttgaaggtttcgaaagtagtttaagttcggtcggggtcgtggagaaggcggcgggcgtaggtttggagttttcgagtaagaaaaagtcgttttcgtttcgtttcgggttttcgcgcgtgtcgtcgtttagtttgggttacggggtttgtttcgagtcgtcgttatcgggttttgttttggttaagttgtttcggaatggcgaggcgttcggggttgagtttgcgtttagcgtttgggcgtttatggagttgtaggtagatgtgcgcgtgaagttcgtgggcgcggtcggtggtagtagtacgttatcgtttaggttttttacgcgtttttttaaggtgtcggtgttcgagttttttgttttttttcgttacgcggattcggcgtattagtttttgttgcgcgtattattttagggcggtacgtggggtcgtcgttcgtcgttggttgtagttcggacggagagcggttgcgacgtagagggtcgggttagtttcgcggaaggaagcgtcggtttttcgggtttttttacgtgttgtcgttgtaaggagttggggttggagaaggaggatgcggcgttgttgtttcgcgcggggttggacggcgacgagaagttgtttcgggtcgtaacgtttacgggtgagtgtttatttgcgtcggtagtcgacgtcgttaggtcgggtggacgtagtcgaaatttttatattcgtttagttttggatcgttgggtagttgatcgattaagggatttagttggttatttcgatttttaattcgatttggtttttt

SEQ ID NO: 2822 - DNA, 800 bp, Artificial Sequence
  chemically treated genomic DNA (Homo sapiens) CpG-island No: 2822
aaaaaaccaaatcgaattaaaaatcgaaataaccaactaaatcccttaatcgatcaactacccaacgatccaaaactaaacgaatataaaaatttcgactacgtccacccgacctaacgacgtcgactaccgacgcaaataaacactcacccgtaaacgttacgacccgaaacaacttctcgtcgccgtccaaccccgcgcgaaacaacaacgccgcatcctccttctccaaccccaactccttacaacgacaacacgtaaaaaaacccgaaaaaccgacgcttccttccgcgaaactaacccgaccctctacgtcgcaaccgctctccgtccgaactacaaccaacgacgaacgacgaccccacgtaccgccctaaaataatacgcgcaacaaaaactaatacgccgaatccgcgtaacgaaaaaaaacaaaaaactcgaacaccgacaccttaaaaaaacgcgtaaaaaacctaaacgataacgtactactaccaccgaccgcgcccacgaacttcacgcgcacatctacctacaactccataaacgcccaaacgctaaacgcaaactcaaccccgaacgcctcgccattccgaaacaacttaaccaaaacaaaacccgataacgacgactcgaaacaaaccccgtaacccaaactaaacgacgacacgcgcgaaaacccgaaacgaaacgaaaacgactttttcttactcgaaaactccaaacctacgcccgccgccttctccacgaccccgaccgaacttaaactactttcgaaaccttcaaattatcgcaccttc

SEQ ID NO: 2823 - DNA, 800 bp, Artificial Sequence
  chemically treated genomic DNA (Homo sapiens) CpG-island No: 2823
gagaggttagatcgggttggggatcgggatggttaattgggttttttagtcggttagttgtttagcggtttagggttgggcgggtgtgggggtttcggttacgtttattcgatttggcggcgtcggttgtcggcgtaggtgagtatttattcgtaagcgttacggttcggggtagtttttcgtcgtcgtttaatttcgcgcggggtaatagcgtcgtattttttttttttagttttagttttttgtagcggtagtacgtgggggagttcggggagtcggcgttttttttcgcggggttggttcggttttttgcgtcgtagtcgtttttcgttcgggttgtagttagcggcgagcggcggttttacgtgtcgttttgggatggtgcgcgtagtaggagttggtgcgtcgggttcgcgtggcgggagaaggtaggggattcgggtatcggtattttgaggaagcgcgtggagggtttgggcgatggcgtgttgttgttatcggtcgcgtttacgggttttacgcgtatatttatttgtagttttatgggcgtttaggcgttgggcgtaggtttagtttcgggcgtttcgttatttcggggtagtttgattaaggtagggttcggtgacggcggttcggggtagatttcgtagtttaggttgagcggcggtacgcgcggggattcggggcgaggcgaaggcggtttttttttgttcgagggttttaggtttgcgttcgtcgttttttttacggtttcggtcggatttgggttgttttcgggatttttaggttgtcgtattttt

SEQ ID NO: 2824 - DNA, 800 bp, Artificial Sequence
  chemically treated genomic DNA (Homo sapiens) CpG-island No: 2824
aaaaatacgacaacctaaaaatcccgaaaacaacccaaatccgaccgaaaccgtaaaaaaaacgacgaacgcaaacctaaaaccctcgaacaaaaaaaaaccgccttcgcctcgccccgaatccccgcgcgtaccgccgctcaacctaaactacgaaatctaccccgaaccgccgtcaccgaaccctaccttaatcaaactaccccgaaataacgaaacgcccgaaactaaacctacgcccaacgcctaaacgcccataaaactacaaataaatatacgcgtaaaacccgtaaacgcgaccgataacaacaacacgccatcgcccaaaccctccacgcgcttcctcaaaataccgatacccgaatcccctaccttctcccgccacgcgaacccgacgcaccaactcctactacgcgcaccatcccaaaacgacacgtaaaaccgccgctcgccgctaactacaacccgaacgaaaaacgactacgacgcaaaaaaccgaaccaaccccgcgaaaaaaaacgccgactccccgaactcccccacgtactaccgctacaaaaaactaaaactaaaaaaaaaaaatacgacgctattaccccgcgcgaaattaaacgacgacgaaaaactaccccgaaccgtaacgcttacgaataaatactcacctacgccgacaaccgacgccgccaaatcgaataaacgtaaccgaaacccccacacccgcccaaccctaaaccgctaaacaactaaccgactaaaaaacccaattaaccatcccgatccccaacccgatctaacctctc

SEQ ID NO: 2825 - DNA, 567 bp, Artificial Sequence
  chemically treated genomic DNA (Homo sapiens) CpG-island No: 2825
ggcgcggtagtcgagtggtttttcggcgaaggtgtttaatatttgggcgtttagttcggcgggatttataggtttgcggcggggcggggagggttcgggaggagggattgggagggttcggcggggtaggatcgttaagtggttcggttcgggcgtattgcgcgtttcgtcgcgtcgttaggtagcgcgcgagtagaagaggggcgcgagcgggtataagggaaggatttacgacgaagaggagggtatatgtttataaaattgaggtcgggtacgtagtcgaacgttgtggtagatcgttaaggtttcgggagcgggaagttttcgcgttttttttaggagttcggacgattttagttcggttttgatttcgagatatttgtttcgtcgcgttcggggtttggttttattttttacgtttttttattaattcggagaggggggagggcgaggggagacgagattttggattcgtagtttgagggcgttttcgtcggttatatttgatattagttgcggttttttttcgttttttttggggggcggagagggggacgatttgggatt

SEQ ID NO: 2826 - DNA, 567 bp, Artificial Sequence
  chemically treated genomic DNA (Homo sapiens) CpG-island No: 2826
aatcccaaatcgtccccctctccgccccccaaaaaaaacgaaaaaaaaccgcaactaatatcaaatataaccgacgaaaacgccctcaaactacgaatccaaaatctcgtctcccctcgccctcccccctctccgaattaataaaaaaacgtaaaaaataaaaccaaaccccgaacgcgacgaaacaaatatctcgaaatcaaaaccgaactaaaatcgtccgaactcctaaaaaaaacgcgaaaacttcccgctcccgaaaccttaacgatctaccacaacgttcgactacgtacccgacctcaattttataaacatataccctcctcttcgtcgtaaatccttcccttatacccgctcgcgcccctcttctactcgcgcgctacctaacgacgcgacgaaacgcgcaatacgcccgaaccgaaccacttaacgatcctaccccgccgaaccctcccaatccctcctcccgaaccctccccgccccgccgcaaacctataaatcccgccgaactaaacgcccaaatattaaacaccttcgccgaaaaaccactcgactaccgcgcc

SEQ ID NO: 2827 - DNA, 567 bp, Artificial Sequence
  chemically treated genomic DNA (Homo sapiens) CpG-island No: 2827
agttttaagtcgttttttttttcgttttttaggaggggcgagagggagtcgtagttgatgttaggtatggtcggcggaggcgtttttaggttacgggtttaaggtttcgttttttttcgttttttttttttttcgggttggtggggaagcgtggaggatggaattaaatttcgggcgcggcggaataggtgtttcggggttaaagtcgggttggggtcgttcgggtttttgaggaaggcgcgaggatttttcgttttcggagttttagcgatttgttatagcgttcggttgcgtattcggttttaattttgtggatatgtattttttttttcgtcgtgggttttttttttgtgttcgttcgcgttttttttttgttcgcgcgttgtttggcggcgcggcggggcgcgtagtgcgttcggatcggattatttagcggttttgtttcgtcgggtttttttagttttttttttcgggtttttttcgtttcgtcgtagatttgtgggtttcgtcggattgggcgtttaggtgttgggtattttcgtcggggagttattcggttgtcgcgtt

SEQ ID NO: 2828 - DNA, 567 bp, Artificial Sequence
  chemically treated genomic DNA (Homo sapiens) CpG-island No: 2828
aacgcgacaaccgaataactccccgacgaaaatacccaacacctaaacgcccaatccgacgaaacccacaaatctacgacgaaacgaaaaaaacccgaaaaaaaaaactaaaaaaacccgacgaaacaaaaccgctaaataatccgatccgaacgcactacgcgccccgccgcgccgccaaacaacgcgcgaacaaaaaaaaaacgcgaacgaacacaaaaaaaaaacccacgacgaaaaaaaaaatacatatccacaaaattaaaaccgaatacgcaaccgaacgctataacaaatcgctaaaactccgaaaacgaaaaatcctcgcgccttcctcaaaaacccgaacgaccccaacccgactttaaccccgaaacacctattccgccgcgcccgaaatttaattccatcctccacgcttccccaccaacccgaaaaaaaaaaaaaacgaaaaaaaacgaaaccttaaacccgtaacctaaaaacgcctccgccgaccatacctaacatcaactacgactccctctcgcccctcctaaaaaacgaaaaaaaaaacgacttaaaact

SEQ ID NO: 2829 - DNA, 971 bp, Artificial Sequence
  chemically treated genomic DNA (Homo sapiens) CpG-island No: 2829
gcgcgtcgttacgggattcgatttcgttttatagttgcggttatcgtcggttcggttcggaggaggcgaaagcgaggtcgcggacggtttttatttcgaatttatggatttcgttcgtttggcgggttattttttttttcgtttttttttcgaagttttttcgtgtttcgattttttcgcgaatatcggaatttagggacgtttgtttttttttttttaggtaattttttggtcgtttatcgttgtcgtagtaacgttcgttttcgcgttcgtttttcgcgggtttgtttattagttttgtttcgtttcgttttatattgcgtatgttcgttagtttcgttcggtttatattgcgtatgtttgttaattacgttttgtttatattatattgcgtatgttcgtcggttttcgtttcgcgtacggcgttagcgtttagacgtaggtgcgttttcgtcgaggttcgcgtagcgggcgtttttggggatcgtttggcgggggtgttcgggagtcgcgggttgaagtacgggggcgtgtaggcgtttaggtttcgtgtagtgagggtcgagtttcgcgtcggtttcgttgtagttcgtagttttcggcggttttgtgggcgtagttacgttttttagtcgttcgtttatttgggtttgggtttcggttgtttttttgcggtggttgtggtcgttttcgttttagggtttcgagcgtatcgttttttcgttgcgttgttagtcgagggtagttttttgggggatttttcgattttttcgcgtcgtttaggcgttttggttcgcggaagcgtaggcgtcgattgtttggcgtcgttcgtgatttttggtttttttttgtggatttttttgtttttcgttgcgggttgtgttttttgtttcgtgggtttggtcgtttgcgtttggatgtaggttcgggtgagttttgcgtggttcgttggtttttttttgttttttagg

SEQ ID NO: 2830 - DNA, 971 bp, Artificial Sequence
  chemically treated genomic DNA (Homo sapiens) CpG-island No: 2830
cctaaaaaacaaaaaaaaaccaacgaaccacgcaaaactcacccgaacctacatccaaacgcaaacgaccaaacccacgaaacaaaaaacacaacccgcaacgaaaaacaaaaaaatccacaaaaaaaaaccaaaaatcacgaacgacgccaaacaatcgacgcctacgcttccgcgaaccaaaacgcctaaacgacgcgaaaaaatcgaaaaatcccccaaaaaactaccctcgactaacaacgcaacgaaaaaacgatacgctcgaaaccctaaaacgaaaacgaccacaaccaccgcaaaaaaacaaccgaaacccaaacccaaataaacgaacgactaaaaaacgtaactacgcccacaaaaccgccgaaaactacgaactacaacgaaaccgacgcgaaactcgaccctcactacacgaaacctaaacgcctacacgcccccgtacttcaacccgcgactcccgaacacccccgccaaacgatccccaaaaacgcccgctacgcgaacctcgacgaaaacgcacctacgtctaaacgctaacgccgtacgcgaaacgaaaaccgacgaacatacgcaatataatataaacaaaacgtaattaacaaacatacgcaatataaaccgaacgaaactaacgaacatacgcaatataaaacgaaacgaaacaaaactaataaacaaacccgcgaaaaacgaacgcgaaaacgaacgttactacgacaacgataaacgaccaaaaaattacctaaaaaaaaaaaaacaaacgtccctaaattccgatattcgcgaaaaaatcgaaacacgaaaaaacttcgaaaaaaaaacgaaaaaaaaaataacccgccaaacgaacgaaatccataaattcgaaataaaaaccgtccgcgacctcgctttcgcctcctccgaaccgaaccgacgataaccgcaactataaaacgaaatcgaatcccgtaacgacgcgc

SEQ ID NO: 2831 - DNA, 971 bp, Artificial Sequence
  chemically treated genomic DNA (Homo sapiens) CpG-island No: 2831
tttagggagtaggaaaaggttagcgggttacgtagggtttattcgggtttgtatttaaacgtaaacggttaggtttacgaagtaggaaatataattcgtaacgagaagtaaagggatttatagagaagggttaggagttacggacgacgttaggtagtcggcgtttgcgttttcgcgagttaagacgtttgagcggcgcggggggatcgggggattttttagaaaattgttttcgattaatagcgtagcgaaggggcggtgcgttcgagattttggaacgggaacgattatagttatcgtagggaaataatcggggtttaggtttaggtgggcgggcggttgaggagcgtggttgcgtttataaagtcgtcgggggttgcggattatagcgaagtcggcgcggggttcggtttttattatacgaggtttgggcgtttgtacgttttcgtgttttagttcgcggttttcgaatattttcgttaggcgatttttaaaaacgttcgttgcgcgagtttcgacgggaacgtatttgcgtttagacgttgacgtcgtgcgcggggcgggggtcggcgagtatgcgtagtgtggtgtggatagggcgtggttggtaagtatgcgtaatgtgggtcgggcggggttggcgagtatgcgtagtatggggcggggcggggtagggttggtgagtaagttcgcggggagcgagcgcggaggcgggcgttgttacggtaacggtgggcggttagggagttgtttgagggaaaaggggtagacgtttttgggtttcggtgttcgcggaggagtcgaggtacggagaggtttcgggggagggacggaaagaagggtggttcgttaggcgggcggggtttatggattcggggtgagggtcgttcgcggtttcgttttcgtttttttcgagtcgggtcggcgatggtcgtagttgtgaggcgaggtcgggtttcgtagcggcgcgt

SEQ ID NO: 2832 - DNA, 971 bp, Artificial Sequence
  chemically treated genomic DNA (Homo sapiens) CpG-island No: 2832
acgcgccgctacgaaacccgacctcgcctcacaactacgaccatcgccgacccgactcgaaaaaaacgaaaacgaaaccgcgaacgaccctcaccccgaatccataaaccccgcccgcctaacgaaccacccttctttccgtccctcccccgaaacctctccgtacctcgactcctccgcgaacaccgaaacccaaaaacgtctaccccttttccctcaaacaactccctaaccgcccaccgttaccgtaacaacgcccgcctccgcgctcgctccccgcgaacttactcaccaaccctaccccgccccgccccatactacgcatactcgccaaccccgcccgacccacattacgcatacttaccaaccacgccctatccacaccacactacgcatactcgccgacccccgccccgcgcacgacgtcaacgtctaaacgcaaatacgttcccgtcgaaactcgcgcaacgaacgtttttaaaaatcgcctaacgaaaatattcgaaaaccgcgaactaaaacacgaaaacgtacaaacgcccaaacctcgtataataaaaaccgaaccccgcgccgacttcgctataatccgcaacccccgacgactttataaacgcaaccacgctcctcaaccgcccgcccacctaaacctaaaccccgattatttccctacgataactataatcgttcccgttccaaaatctcgaacgcaccgccccttcgctacgctattaatcgaaaacaattttctaaaaaatcccccgatccccccgcgccgctcaaacgtcttaactcgcgaaaacgcaaacgccgactacctaacgtcgtccgtaactcctaacccttctctataaatccctttacttctcgttacgaattatatttcctacttcgtaaacctaaccgtttacgtttaaatacaaacccgaataaaccctacgtaacccgctaaccttttcctactccctaaa

SEQ ID NO: 2833 - DNA, 798 bp, Artificial Sequence
  chemically treated genomic DNA (Homo sapiens) CpG-island No: 2833
atatttagagtaagttacgtagaaatttttaggtcgtatttattttcggtgtatagcgcgggagatgatacgtattttatcggatttcgtatagtatcgttgatgaataagtatatagttgtttgtataattattatcggtcgtggcggtcggagattttttttttttttcgtcggatattggggcgtggttggaaattcgggagtggattggtcggaaggtgggacgtaaatttgtttgaaaggtttaattagtgttcggttttttcgttttagttaatagaaaatcgagaggaaggtagggagggcggagttttttatttgagtttgtggcgcgcgaggttttgtagttcgggttggcgtttgggtattggttgggttcgatgttgggtacgttgcgcgttatggagggcgaggacgtggaagacgattagttgttgtagaagtttagggttagtcgtcgtcgtttttagaggcgtatgtagcggttgatagagaaggtgcggttttcgtcggttcgtcgggaggggaggtttgcgtgtcggagtgaggttgggaggggacgtaggacgggaagggaaggggttttgaggattcggagcgggggttggggaagcgggattggggtttggatgcggagagaaggtggaggcggagttgggggtttcggagagggaaaaaggaggtagcgtcgaaggtttcggtgcggggacggggaggaaagattggggttttcggaacggggagtggggaagtaggtttggggttcgggtgtagagaggagggtttggtggggttg

SEQ ID NO: 2834 - DNA, 798 bp, Artificial Sequence
  chemically treated genomic DNA (Homo sapiens) CpG-island No: 2834
caaccccaccaaaccctcctctctacacccgaaccccaaacctacttccccactccccgttccgaaaaccccaatctttcctccccgtccccgcaccgaaaccttcgacgctacctcctttttccctctccgaaacccccaactccgcctccaccttctctccgcatccaaaccccaatcccgcttccccaacccccgctccgaatcctcaaaaccccttcccttcccgtcctacgtcccctcccaacctcactccgacacgcaaacctcccctcccgacgaaccgacgaaaaccgcaccttctctatcaaccgctacatacgcctctaaaaacgacgacgactaaccctaaacttctacaacaactaatcgtcttccacgtcctcgccctccataacgcgcaacgtacccaacatcgaacccaaccaatacccaaacgccaacccgaactacaaaacctcgcgcgccacaaactcaaataaaaaactccgccctccctaccttcctctcgattttctattaactaaaacgaaaaaaccgaacactaattaaacctttcaaacaaatttacgtcccaccttccgaccaatccactcccgaatttccaaccacgccccaatatccgacgaaaaaaaaaaaaaatctccgaccgccacgaccgataataattatacaaacaactatatacttattcatcaacgatactatacgaaatccgataaaatacgtatcatctcccgcgctatacaccgaaaataaatacgacctaaaaatttctacgtaacttactctaaatat

SEQ ID NO: 2835 - DNA, 798 bp, Artificial Sequence
  chemically treated genomic DNA (Homo sapiens) CpG-island No: 2835
tagttttattaaatttttttttttgtattcgagttttaggtttgtttttttatttttcgtttcggaggttttagtttttttttttcgttttcgtatcgaagttttcggcgttgtttttttttttttttttcggagtttttagtttcgtttttatttttttttcgtatttaagttttagtttcgtttttttaattttcgtttcgagtttttagagtttttttttttttcgttttacgtttttttttagttttatttcgatacgtaggttttttttttcggcggatcggcgggggtcgtattttttttattagtcgttgtatgcgtttttggaagcggcggcgattggttttgagtttttgtagtagttggtcgttttttacgttttcgttttttatggcgcgtagcgtatttagtatcggatttagttagtatttaagcgttaattcggattgtagggtttcgcgcgttataaatttaaataggagatttcgttttttttgtttttttttcggttttttattggttagagcggagaagtcgggtattgattgggttttttaaataaatttgcgttttatttttcggttaatttattttcgagtttttagttacgttttaatgttcggcggaagggagggagggttttcggtcgttacggtcggtggtagttgtataaatagttgtgtgtttatttattagcggtgttgtgcgagattcggtgggatgcgtgttatttttcgcgttgtgtatcggagataagtgcggtttggagatttttgcgtgatttgttttgggtgt

SEQ ID NO: 2836 - DNA, 798 bp, Artificial Sequence
  chemically treated genomic DNA (Homo sapiens) CpG-island No: 2836
acacccaaaacaaatcacgcaaaaatctccaaaccgcacttatctccgatacacaacgcgaaaaataacacgcatcccaccgaatctcgcacaacaccgctaataaataaacacacaactatttatacaactaccaccgaccgtaacgaccgaaaaccctccctcccttccgccgaacattaaaacgtaactaaaaactcgaaaataaattaaccgaaaaataaaacgcaaatttatttaaaaaacccaatcaatacccgacttctccgctctaaccaataaaaaaccgaaaaaaaaacaaaaaaaacgaaatctcctatttaaatttataacgcgcgaaaccctacaatccgaattaacgcttaaatactaactaaatccgatactaaatacgctacgcgccataaaaaacgaaaacgtaaaaaacgaccaactactacaaaaactcaaaaccaatcgccgccgcttccaaaaacgcatacaacgactaataaaaaaaatacgacccccgccgatccgccgaaaaaaaaaacctacgtatcgaaataaaactaaaaaaaaacgtaaaacgaaaaaaaaaaaaactctaaaaactcgaaacgaaaattaaaaaaacgaaactaaaacttaaatacgaaaaaaaaataaaaacgaaactaaaaactccgaaaaaaaaaaaaaaaaacaacgccgaaaacttcgatacgaaaacgaaaaaaaaaaactaaaacctccgaaacgaaaaataaaaaaacaaacctaaaactcgaatacaaaaaaaaaaatttaataaaacta

SEQ ID NO: 2837 - DNA, 855 bp, Artificial Sequence
  chemically treated genomic DNA (Homo sapiens) CpG-island No: 2837
gcgtatgatgcggttgcgaggttcggggatgttgcgggatttgtttttgcggtcgtttcgcgggttgagttgattttgcgcggatagttttggttattttgtgtcggcgttttcgaggcggcggtacgggattcgttgtcgcgcgcgattttattcgtggtggacggtggcgtggcgcgtgagatttttcgcgcggggtttgtttagttttttttcggaattttgtaggagttgggtaaggggagtacgtatcgtagttcgggtgttttacgttgttcggtttcgttttaaggacggtttcggggagacggacgcgtttggtaatagcgagggtaaagagttggtggttttaggtgaaaagtgagtgttttcgcgagcgtaggaggtttcgtttttttcggggttcgggtttaggttgtgtggggttttgcggtggggcgggataggagtcgagggtttagaaaagagaaagaaagaggtgtcgggcggtttgcgcgttttgcgttatgtgattaggttcggtttcgttcgcgtttttttcgttcgtaatttttcgttaggtatttatttttttttttcgttttcgggggttcgttttggtggggtcgcggtggggttgtatgggttcgtttggcgtttttagcgttagagaggtcgtttttttgttcgcgttgcgtgtttagttttttggtttgcggttgtagcgtttggtcgttcgttttagttattcgtgggcgatgttgtacgaatatttttatcgagtgatatttaggagttgggcgtttagtagagtttttatttttttgatttgtcgttttttttggttcgttttcgttttgtttgtttttttttggt

SEQ ID NO: 2838 - DNA, 855 bp, Artificial Sequence
  chemically treated genomic DNA (Homo sapiens) CpG-island No: 2838
accaaaaaaaaacaaacaaaacgaaaacgaaccaaaaaaaacgacaaatcaaaaaaataaaaactctactaaacgcccaactcctaaatatcactcgataaaaatattcgtacaacatcgcccacgaataactaaaacgaacgaccaaacgctacaaccgcaaaccaaaaaactaaacacgcaacgcgaacaaaaaaacgacctctctaacgctaaaaacgccaaacgaacccatacaaccccaccgcgaccccaccaaaacgaacccccgaaaacgaaaaaaaaaaataaatacctaacgaaaaattacgaacgaaaaaaacgcgaacgaaaccgaacctaatcacataacgcaaaacgcgcaaaccgcccgacacctctttctttctcttttctaaaccctcgactcctatcccgccccaccgcaaaaccccacacaacctaaacccgaaccccgaaaaaaacgaaacctcctacgctcgcgaaaacactcacttttcacctaaaaccaccaactctttaccctcgctattaccaaacgcgtccgtctccccgaaaccgtccttaaaacgaaaccgaacaacgtaaaacacccgaactacgatacgtactccccttacccaactcctacaaaattccgaaaaaaaactaaacaaaccccgcgcgaaaaatctcacgcgccacgccaccgtccaccacgaataaaatcgcgcgcgacaacgaatcccgtaccgccgcctcgaaaacgccgacacaaaataaccaaaactatccgcgcaaaatcaactcaacccgcgaaacgaccgcaaaaacaaatcccgcaacatccccgaacctcgcaaccgcatcatacgc

SEQ ID NO: 2839 - DNA, 855 bp, Artificial Sequence
  chemically treated genomic DNA (Homo sapiens) CpG-island No: 2839
attaagggagggtaggtagagcggaaacgagttaggaaaagcgataagttaggaaggtaaaggttttgttgaacgtttaatttttaaatgttattcggtggagatgttcgtgtagtatcgtttacgaatggttggggcgggcggttaggcgttgtagtcgtaagttagggagttgagtacgtagcgcgggtaggggagcggtttttttggcgttggggacgttaggcgagtttatatagttttatcgcggttttattagggcgaattttcgggggcggagaagggaagtgggtgtttggcggagggttgcgggcggggaaggcgcgggcggggtcgggtttaattatatggcgtaggacgcgtaggtcgttcggtattttttttttttttttttttagattttcggtttttatttcgttttatcgtagggttttatatagtttgagttcgggtttcgaaaggaacgaggttttttgcgttcgcggagatatttattttttatttgaggttattagttttttgttttcgttgttgttaaacgcgttcgttttttcggggtcgtttttggggcggggtcgggtagcgtgggatattcgggttgcgatgcgtgttttttttgtttagtttttgtaagatttcgaaggagagttggataggtttcgcgcgaggggttttacgcgttacgttatcgtttattacgggtggagtcgcgcgcggtagcgggtttcgtgtcgtcgtttcggggacgtcggtatagggtgattaaggttgttcgcgtagagttagtttagttcgcggggcgatcgtaggagtaggtttcgtagtattttcgagtttcgtagtcgtattatgcgt

SEQ ID NO: 2840 - DNA, 855 bp, Artificial Sequence
  chemically treated genomic DNA (Homo sapiens) CpG-island No: 2840
acgcataatacgactacgaaactcgaaaatactacgaaacctactcctacgatcgccccgcgaactaaactaactctacgcgaacaaccttaatcaccctataccgacgtccccgaaacgacgacacgaaacccgctaccgcgcgcgactccacccgtaataaacgataacgtaacgcgtaaaacccctcgcgcgaaacctatccaactctccttcgaaatcttacaaaaactaaacaaaaaaaacacgcatcgcaacccgaatatcccacgctacccgaccccgccccaaaaacgaccccgaaaaaacgaacgcgtttaacaacaacgaaaacaaaaaactaataacctcaaataaaaaataaatatctccgcgaacgcaaaaaacctcgttcctttcgaaacccgaactcaaactatataaaaccctacgataaaacgaaataaaaaccgaaaatctaaaaaaaaaaaaaaaaaaaataccgaacgacctacgcgtcctacgccatataattaaacccgaccccgcccgcgccttccccgcccgcaaccctccgccaaacacccacttcccttctccgcccccgaaaattcgccctaataaaaccgcgataaaactatataaactcgcctaacgtccccaacgccaaaaaaaccgctcccctacccgcgctacgtactcaactccctaacttacgactacaacgcctaaccgcccgccccaaccattcgtaaacgatactacacgaacatctccaccgaataacatttaaaaattaaacgttcaacaaaacctttaccttcctaacttatcgcttttcctaactcgtttccgctctacctaccctcccttaat

SEQ ID NO: 2841 - DNA, 834 bp, Artificial Sequence
  chemically treated genomic DNA (Homo sapiens) CpG-island No: 2841
tacgttttttgtttagcgcgggagttaattgttattcggtattatgtttatacgttttttgtttagcgcgggagttaattgttattcggtattatgtttatacgttttttgtttagcgcgggagttaattgttattcggtattatgtttatacgttttttgtttagcgcgggagttaattgttattcggtatcgtgtttatacgttttttgtttagcgcgggagttaattgttattcggtatcgtgtttatacgttttttgtttagcgcgggagttaattgttattcggtatcgtgtttatacgttttttgtttagcgcgggagttaattgttattcggtatcgtgtttatacgttttttgtttagcgcgggagttaattgttattcggtattatgtttatacgttttttgtttagcgcgggagttaattgttattcggtatcgtgtttatacgttttttgtttagcgcgggagttaattgttattcggtatcgtgtttatacgttttttgtttagcgcgggagttaattgttattcggtatcgtgtttatacgttttttgtttagcgcgggagttaattgttattcggtatcgtgtttatacgttttttgtttagcgcgggagttaattgttattcggtatcgtgtttatacgttttttgtttagcgcgggagttaattgttattcggtatcgtgtttatacgttttttgtttagcgcgggagttaattgttattcggtatcgtgtttatacgttttttgtttagcgcggttagtgaggttatacgtgtagtagttattttgaagttattgggatttagattcgttgggttgg

SEQ ID NO: 2842 - DNA, 834 bp, Artificial Sequence
  chemically treated genomic DNA (Homo sapiens) CpG-island No: 2842
ccaacccaacgaatctaaatcccaataacttcaaaataactactacacgtataacctcactaaccgcgctaaacaaaaaacgtataaacacgataccgaataacaattaactcccgcgctaaacaaaaaacgtataaacacgataccgaataacaattaactcccgcgctaaacaaaaaacgtataaacacgataccgaataacaattaactcccgcgctaaacaaaaaacgtataaacacgataccgaataacaattaactcccgcgctaaacaaaaaacgtataaacacgataccgaataacaattaactcccgcgctaaacaaaaaacgtataaacacgataccgaataacaattaactcccgcgctaaacaaaaaacgtataaacacgataccgaataacaattaactcccgcgctaaacaaaaaacgtataaacataataccgaataacaattaactcccgcgctaaacaaaaaacgtataaacacgataccgaataacaattaactcccgcgctaaacaaaaaacgtataaacacgataccgaataacaattaactcccgcgctaaacaaaaaacgtataaacacgataccgaataacaattaactcccgcgctaaacaaaaaacgtataaacacgataccgaataacaattaactcccgcgctaaacaaaaaacgtataaacataataccgaataacaattaactcccgcgctaaacaaaaaacgtataaacataataccgaataacaattaactcccgcgctaaacaaaaaacgtataaacataataccgaataacaattaactcccgcgctaaacaaaaaacgta

SEQ ID NO: 2843 - DNA, 834 bp, Artificial Sequence
  chemically treated genomic DNA (Homo sapiens) CpG-island No: 2843
ttagtttagcgggtttgggttttagtggttttaggatgattgttgtacgtgtggttttattaatcgcgttgggtaggggacgtgtgggtacggtgtcgggtgatagttaattttcgcgttgggtaggggacgtgtgggtacggtgtcgggtgatagttaattttcgcgttgggtaggggacgtgtgggtacggtgtcgggtgatagttaattttcgcgttgggtaggggacgtgtgggtacggtgtcgggtgatagttaattttcgcgttgggtaggggacgtgtgggtacggtgtcgggtgatagttaattttcgcgttgggtaggggacgtgtgggtacggtgtcgggtgatagttaattttcgcgttgggtaggggacgtgtgggtacggtgtcgggtgatagttaattttcgcgttgggtaggggacgtgtgggtatggtgtcgggtgatagttaattttcgcgttgggtaggggacgtgtgggtacggtgtcgggtgatagttaattttcgcgttgggtaggggacgtgtgggtacggtgtcgggtgatagttaattttcgcgttgggtaggggacgtgtgggtacggtgtcgggtgatagttaattttcgcgttgggtaggggacgtgtgggtacggtgtcgggtgatagttaattttcgcgttgggtaggggacgtgtgggtatggtgtcgggtgatagttaattttcgcgttgggtaggggacgtgtgggtatggtgtcgggtgatagttaattttcgcgttgggtaggggacgtgtgggtatggtgtcgggtgatagttaattttcgcgttgggtaggggacgtg

SEQ ID NO: 2844 - DNA, 834 bp, Artificial Sequence
  chemically treated genomic DNA (Homo sapiens) CpG-island No: 2844
cacgtcccctacccaacgcgaaaattaactatcacccgacaccatacccacacgtcccctacccaacgcgaaaattaactatcacccgacaccatacccacacgtcccctacccaacgcgaaaattaactatcacccgacaccatacccacacgtcccctacccaacgcgaaaattaactatcacccgacaccgtacccacacgtcccctacccaacgcgaaaattaactatcacccgacaccgtacccacacgtcccctacccaacgcgaaaattaactatcacccgacaccgtacccacacgtcccctacccaacgcgaaaattaactatcacccgacaccgtacccacacgtcccctacccaacgcgaaaattaactatcacccgacaccatacccacacgtcccctacccaacgcgaaaattaactatcacccgacaccgtacccacacgtcccctacccaacgcgaaaattaactatcacccgacaccgtacccacacgtcccctacccaacgcgaaaattaactatcacccgacaccgtacccacacgtcccctacccaacgcgaaaattaactatcacccgacaccgtacccacacgtcccctacccaacgcgaaaattaactatcacccgacaccgtacccacacgtcccctacccaacgcgaaaattaactatcacccgacaccgtacccacacgtcccctacccaacgcgaaaattaactatcacccgacaccgtacccacacgtcccctacccaacgcgattaataaaaccacacgtacaacaatcatcctaaaaccactaaaacccaaacccgctaaactaa

SEQ ID NO: 2845 - DNA, 708 bp, Artificial Sequence
  chemically treated genomic DNA (Homo sapiens) CpG-island No: 2845
agtcggttcgttttcgtcgtttcgatattgtatttcgtggagtcggttcgttttatagtttcgatattgtatttcgtggagtcggttcgttttatagtttcgatattgtatttcgtggagtcggttcgttttcgtcgtttcgatattgtatttcgtggagtcggttcgttttcgtcgtttcgatattgtatttcgtggagtcggttcgttttatagtttcgatattgtatttcgtggagtcggttcgttttcgtcgtttcgatattgtatttcgtggagtcggttcgttttatagtttcgatattgtatttcgtggagtcggttcgttttcgtcgtttcgatattgtatttcgtggagtcggttcgttttatagtttcgatattgtatttcgtggagtcggttcgttttcgtcgtttcgatattgtatttcgtggagtcggttcgttttcgtcgttttaatattgtatttcgtggagtcggttcgttttcgtcgtttcgatattgtatttcgtggagtcggttcgttttcgtcgtttcgatattgtatttcgtggagtcggttcgttttcgtcgtttcgatattgtatttcgtggagtcggttcgtttttatcgcgtatggtttgtatttatttgtggatgagattggtgaggggttcgattagttttttgtttagtcgcggttttaaaggagtaagagtatcgaatt

SEQ ID NO: 2846 - DNA, 708 bp, Artificial Sequence
  chemically treated genomic DNA (Homo sapiens) CpG-island No: 2846
aattcgatactcttactcctttaaaaccgcgactaaacaaaaaactaatcgaacccctcaccaatctcatccacaaataaatacaaaccatacgcgataaaaacgaaccgactccacgaaatacaatatcgaaacgacgaaaacgaaccgactccacgaaatacaatatcgaaacgacgaaaacgaaccgactccacgaaatacaatatcgaaacgacgaaaacgaaccgactccacgaaatacaatattaaaacgacgaaaacgaaccgactccacgaaatacaatatcgaaacgacgaaaacgaaccgactccacgaaatacaatatcgaaactataaaacgaaccgactccacgaaatacaatatcgaaacgacgaaaacgaaccgactccacgaaatacaatatcgaaactataaaacgaaccgactccacgaaatacaatatcgaaacgacgaaaacgaaccgactccacgaaatacaatatcgaaactataaaacgaaccgactccacgaaatacaatatcgaaacgacgaaaacgaaccgactccacgaaatacaatatcgaaacgacgaaaacgaaccgactccacgaaatacaatatcgaaactataaaacgaaccgactccacgaaatacaatatcgaaactataaaacgaaccgactccacgaaatacaatatcgaaacgacgaaaacgaaccgact

SEQ ID NO: 2847 - DNA, 708 bp, Artificial Sequence
  chemically treated genomic DNA (Homo sapiens) CpG-island No: 2847
agttcggtgtttttatttttttggaatcgcggttgggtaagaagttgatcgagttttttattaattttatttataggtgagtgtaggttatgcgcggtgggggcgggtcggttttacggggtgtagtgtcggagcggcgggggcgggtcggttttacggggtgtagtgtcggagcggcgggggcgggtcggttttacggggtgtagtgtcggagcggcgggggcgggtcggttttacggggtgtagtgttggagcggcgggggcgggtcggttttacggggtgtagtgtcggagcggcgggggcgggtcggttttacggggtgtagtgtcggagttgtggggcgggtcggttttacggggtgtagtgtcggagcggcgggggcgggtcggttttacggggtgtagtgtcggagttgtggggcgggtcggttttacggggtgtagtgtcggagcggcgggggcgggtcggttttacggggtgtagtgtcggagttgtggggcgggtcggttttacggggtgtagtgtcggagcggcgggggcgggtcggttttacggggtgtagtgtcggagcggcgggggcgggtcggttttacggggtgtagtgtcggagttgtggggcgggtcggttttacggggtgtagtgtcggagttgtggggcgggtcggttttacggggtgtagtgtcggagcggcgggggcgggtcggtt

SEQ ID NO: 2848 - DNA, 708 bp, Artificial Sequence
  chemically treated genomic DNA (Homo sapiens) CpG-island No: 2848
aaccgacccgcccccgccgctccgacactacaccccgtaaaaccgacccgccccacaactccgacactacaccccgtaaaaccgacccgccccacaactccgacactacaccccgtaaaaccgacccgcccccgccgctccgacactacaccccgtaaaaccgacccgcccccgccgctccgacactacaccccgtaaaaccgacccgccccacaactccgacactacaccccgtaaaaccgacccgcccccgccgctccgacactacaccccgtaaaaccgacccgccccacaactccgacactacaccccgtaaaaccgacccgcccccgccgctccgacactacaccccgtaaaaccgacccgccccacaactccgacactacaccccgtaaaaccgacccgcccccgccgctccgacactacaccccgtaaaaccgacccgcccccgccgctccaacactacaccccgtaaaaccgacccgcccccgccgctccgacactacaccccgtaaaaccgacccgcccccgccgctccgacactacaccccgtaaaaccgacccgcccccgccgctccgacactacaccccgtaaaaccgacccgcccccaccgcgcataacctacactcacctataaataaaattaataaaaaactcgatcaacttcttacccaaccgcgattccaaaaaaataaaaacaccgaact

SEQ ID NO: 2849 - DNA, 500 bp, Artificial Sequence
  chemically treated genomic DNA (Homo sapiens) CpG-island No: 2849
tgttaacgaataaacgtttttttttttttttttttttcgtttcgagcgtttttttttgagttagacgttaatttgatttttattagtattattaggagcgcgtttagtaagttggtagtttttttttttttttttcggcgtttttttcgtttttatttaatattttttattttattttcgatttttttcggggaatatcgggaaggttcgacgttttaggataggattagttacgtagataggtcgatttgtttaggttcgcgttcgtacgtacgtacgtatacggtttcgtatatagtttcgttttatttcgtaattagttttgtcgattgttttatatattcgttttcgcgttggtcggtcgatttagtgttttgtttttattttcgtgttggcggagcggacgtcgcgttttgggttttagaggggtcgggtggtttagacgatttattatttttttattttgatcgtgttgaatagatttttttatacgagagaaa

SEQ ID NO: 2850 - DNA, 500 bp, Artificial Sequence
  chemically treated genomic DNA (Homo sapiens) CpG-island No: 2850
tttctctcgtataaaaaaatctattcaacacgatcaaaataaaaaaataataaatcgtctaaaccacccgacccctctaaaacccaaaacgcgacgtccgctccgccaacacgaaaataaaaacaaaacactaaatcgaccgaccaacgcgaaaacgaatatataaaacaatcgacaaaactaattacgaaataaaacgaaactatatacgaaaccgtatacgtacgtacgtacgaacgcgaacctaaacaaatcgacctatctacgtaactaatcctatcctaaaacgtcgaaccttcccgatattccccgaaaaaaatcgaaaataaaataaaaaatattaaataaaaacgaaaaaaacgccgaaaaaaaaaaaaaaaaactaccaacttactaaacgcgctcctaataatactaataaaaatcaaattaacgtctaactcaaaaaaaaacgctcgaaacgaaaaaaaaaaaaaaaaaaaaacgtttattcgttaaca

SEQ ID NO: 2851 - DNA, 500 bp, Artificial Sequence
  chemically treated genomic DNA (Homo sapiens) CpG-island No: 2851
tttttttcgtgtgggggggtttgtttagtacggttagggtgggggagtggtgggtcgtttgagttattcggtttttttgggatttagagcgcggcgttcgtttcgttagtacgggggtgagaataaggtattaggtcggtcggttagcgcgggggcgggtgtataaggtagtcgatagggttggttgcggggtggggcggggttgtgtgcggggtcgtgtgcgtgcgtgcgtgcgggcgcgggtttgggtaaatcgatttgtttgcgtggttggttttgttttggagcgtcgagttttttcggtgtttttcggagggggtcggggataggatgagagatgttgaatgggggcgggaggggcgtcgggaaaggggggaggaaattattaatttgttgagcgcgtttttgataatgttggtgagggttaagttggcgtttggtttaaagaagggcgttcggggcggagagggagggagggaggggacgtttgttcgttggta

SEQ ID NO: 2852 - DNA, 500 bp, Artificial Sequence
  chemically treated genomic DNA (Homo sapiens) CpG-island No: 2852
taccaacgaacaaacgtcccctccctccctccctctccgccccgaacgcccttctttaaaccaaacgccaacttaaccctcaccaacattatcaaaaacgcgctcaacaaattaataatttcctcccccctttcccgacgcccctcccgcccccattcaacatctctcatcctatccccgaccccctccgaaaaacaccgaaaaaactcgacgctccaaaacaaaaccaaccacgcaaacaaatcgatttacccaaacccgcgcccgcacgcacgcacgcacacgaccccgcacacaaccccgccccaccccgcaaccaaccctatcgactaccttatacacccgcccccgcgctaaccgaccgacctaataccttattctcacccccgtactaacgaaacgaacgccgcgctctaaatcccaaaaaaaccgaataactcaaacgacccaccactcccccaccctaaccgtactaaacaaacccccccacacgaaaaaaa

SEQ ID NO: 2853 - DNA, 559 bp, Artificial Sequence
  chemically treated genomic DNA (Homo sapiens) CpG-island No: 2853
tttttttcgggggagttcgttttcgaatatgcgtagtacgtttattgttttttttttgacggttttgggtcgagtttttggtgtttttcggtttagaggtgttgtcgcgtgcggttatcgtatttttgggtttaaagcggtttgttttattttgatgggtcgggtcgttttatcggggttgtcgtcggggtcggtcgggggcgcgggttgcgagcgcgttgtcgtttcggttttgcgttcggattttcggcgggcgtcgtcgtttgggattcggtgtatcggtcgtttgcgaggttcgggaggggtggggtttgcggttagagttgcggtttggtcgcgtagtagtcgtattaggaagtcgatgtattttatggttaggcggagtatttcgtttttgtttagttttcggtcgggcgggtgcgtcggtagtagtttttttagttcggcgaaggcgtcgttaacgttttgttgtcgttagcgttttcggttgttggtgaatacgcgtcgggttattttttggggttggtgttttgtggataaggagggtcgggttggtgtt

SEQ ID NO: 2854 - DNA, 559 bp, Artificial Sequence
  chemically treated genomic DNA (Homo sapiens) CpG-island No: 2854
aacaccaacccgaccctccttatccacaaaacaccaaccccaaaaaataacccgacgcgtattcaccaacaaccgaaaacgctaacgacaacaaaacgttaacgacgccttcgccgaactaaaaaaactactaccgacgcacccgcccgaccgaaaactaaacaaaaacgaaatactccgcctaaccataaaatacatcgacttcctaatacgactactacgcgaccaaaccgcaactctaaccgcaaaccccacccctcccgaacctcgcaaacgaccgatacaccgaatcccaaacgacgacgcccgccgaaaatccgaacgcaaaaccgaaacgacaacgcgctcgcaacccgcgcccccgaccgaccccgacgacaaccccgataaaacgacccgacccatcaaaataaaacaaaccgctttaaacccaaaaatacgataaccgcacgcgacaacacctctaaaccgaaaaacaccaaaaactcgacccaaaaccgtcaaaaaaaaaacaataaacgtactacgcatattcgaaaacgaactcccccgaaaaaaa

SEQ ID NO: 2855 - DNA, 559 bp, Artificial Sequence
  chemically treated genomic DNA (Homo sapiens) CpG-island No: 2855
ggtattaattcggttttttttgtttatagggtattagttttagaaggtggttcggcgcgtgtttattaatagtcgggagcgttggcggtagtagaacgttaacggcgttttcgtcgagttgaggaagttgttgtcgacgtattcgttcgatcggaagttgagtaagaacgaggtgtttcgtttagttatgaagtatatcggttttttggtgcggttgttgcgcgattaagtcgtagttttggtcgtaggttttatttttttcgggtttcgtaaacggtcggtgtatcgggttttagacgacggcgttcgtcggggattcggacgtagggtcgaggcggtagcgcgttcgtagttcgcgttttcggtcgatttcgacggtagtttcggtggagcggttcggtttattaagatggagtaaatcgttttgagtttagaggtgcggtgatcgtacgcggtagtatttttgagtcggagggtattagggattcggtttagggtcgttaaggaaagggtagtggacgtgttgcgtatgttcgggagcgaattttttcgaagaagg

SEQ ID NO: 2856 - DNA, 559 bp, Artificial Sequence
  chemically treated genomic DNA (Homo sapiens) CpG-island No: 2856
ccttcttcgaaaaaattcgctcccgaacatacgcaacacgtccactaccctttccttaacgaccctaaaccgaatccctaataccctccgactcaaaaatactaccgcgtacgatcaccgcacctctaaactcaaaacgatttactccatcttaataaaccgaaccgctccaccgaaactaccgtcgaaatcgaccgaaaacgcgaactacgaacgcgctaccgcctcgaccctacgtccgaatccccgacgaacgccgtcgtctaaaacccgatacaccgaccgtttacgaaacccgaaaaaaataaaacctacgaccaaaactacgacttaatcgcgcaacaaccgcaccaaaaaaccgatatacttcataactaaacgaaacacctcgttcttactcaacttccgatcgaacgaatacgtcgacaacaacttcctcaactcgacgaaaacgccgttaacgttctactaccgccaacgctcccgactattaataaacacgcgccgaaccaccttctaaaactaataccctataaacaaaaaaaaccgaattaatacc

SEQ ID NO: 2857 - DNA, 605 bp, Artificial Sequence
  chemically treated genomic DNA (Homo sapiens) CpG-island No: 2857
tggcgcgcgttcggggttgttgtttcgtttcgcgttttcggaggagagtacgtcgagttcgcggcgtcgtcgcgttttttcgttttttcggaggcggtttattcgaggttgggtaggcgtagggtcggtagtatgagtcgtcgggagagtttttcgcgtagcgtcggtttttatcggggcggaagaaaggtatataagttggtcgtaatttttttttcgggtttattggggaaggcggtcgcggttgggtattcgaaattattttagggcgatcgcggggcgcgggaggcgtcggtttttcgttgttttttcgggtcggcggcggcgtagggcgcgtggacgagtcgtttttttttttttttttcgttgtttttcgttcggtcgttttgtgtaagcgtcgttggttgagttggttttaggggtattttttttcgtttgtttcgggtttcgcggtcggttttgttcggcggattttagcggcggcggcggcggcggcgttcgcgtacgttggtatcggtttgtttgtttcgtagggtttaagtttttaaattttttgtatttttagttttattattatggaaattattgattttttcggcgttgtt

SEQ ID NO: 2858 - DNA, 605 bp, Artificial Sequence
  chemically treated genomic DNA (Homo sapiens) CpG-island No: 2858
aacaacgccgaaaaaatcaataatttccataataataaaactaaaaatacaaaaaatttaaaaacttaaaccctacgaaacaaacaaaccgataccaacgtacgcgaacgccgccgccgccgccgccgctaaaatccgccgaacaaaaccgaccgcgaaacccgaaacaaacgaaaaaaaatacccctaaaaccaactcaaccaacgacgcttacacaaaacgaccgaacgaaaaacaacgaaaaaaaaaaaaaaaaacgactcgtccacgcgccctacgccgccgccgacccgaaaaaacaacgaaaaaccgacgcctcccgcgccccgcgatcgccctaaaataatttcgaatacccaaccgcgaccgccttccccaataaacccgaaaaaaaaattacgaccaacttatatacctttcttccgccccgataaaaaccgacgctacgcgaaaaactctcccgacgactcatactaccgaccctacgcctacccaacctcgaataaaccgcctccgaaaaaacgaaaaaacgcgacgacgccgcgaactcgacgtactctcctccgaaaacgcgaaacgaaacaacaaccccgaacgcgcgcca

SEQ ID NO: 2859 - DNA, 605 bp, Artificial Sequence
  chemically treated genomic DNA (Homo sapiens) CpG-island No: 2859
ggtaacgtcgagagagttagtggtttttatggtgatggagttgaaagtgtaggaaatttaaaggtttggattttgcgagatagataaatcggtgttaacgtgcgcggacgtcgtcgtcgtcgtcgtcgttggagttcgtcgggtagagtcggtcgcggagttcggagtaggcggagggaagtgtttttagaattagtttagttagcggcgtttgtatagagcggtcggacgaagagtagcgagaggaggaggggagagcggttcgtttacgcgttttgcgtcgtcgtcggttcgggaaggtagcgaggagtcggcgtttttcgcgtttcgcggtcgttttggagtaatttcggatgtttagtcgcggtcgttttttttagtagattcgggagaggagttgcggttaatttgtgtgtttttttttcgtttcggtgggagtcggcgttgcgcgaagggttttttcggcggtttatgttgtcggttttgcgtttgtttagtttcgggtgagtcgttttcggagagacgggggagcgcggcggcgtcgcgggttcggcgtgttttttttcggggacgcgggacgaagtagtagtttcgggcgcgcgtta

SEQ ID NO: 2860 - DNA, 605 bp, Artificial Sequence
  chemically treated genomic DNA (Homo sapiens) CpG-island No: 2860
taacgcgcgcccgaaactactacttcgtcccgcgtccccgaaaaaaaacacgccgaacccgcgacgccgccgcgctcccccgtctctccgaaaacgactcacccgaaactaaacaaacgcaaaaccgacaacataaaccgccgaaaaaacccttcgcgcaacgccgactcccaccgaaacgaaaaaaaaacacacaaattaaccgcaactcctctcccgaatctactaaaaaaaacgaccgcgactaaacatccgaaattactccaaaacgaccgcgaaacgcgaaaaacgccgactcctcgctaccttcccgaaccgacgacgacgcaaaacgcgtaaacgaaccgctctcccctcctcctctcgctactcttcgtccgaccgctctatacaaacgccgctaactaaactaattctaaaaacacttccctccgcctactccgaactccgcgaccgactctacccgacgaactccaacgacgacgacgacgacgacgtccgcgcacgttaacaccgatttatctatctcgcaaaatccaaacctttaaatttcctacactttcaactccatcaccataaaaaccactaactctctcgacgttacc

SEQ ID NO: 2861 - DNA, 551 bp, Artificial Sequence
  chemically treated genomic DNA (Homo sapiens) CpG-island No: 2861
tgcgtaggttttagtcgcgttttcgtaggttttattttcgttttttagtaacgtcgggttacgtgcgtcgtcgttcggatttcgtagcgtgagtttgtcggagtcggcgcgtatatgcgagcgtgtgcgcgcgtgcgtaggcggggcgatcggcgttttcggcgttcgtttcgttttcgagatgacgtcgtgcgtgcgcgcgttcggttcgcgttttcgtcgttttttatagcggtcgcgggcggcggcggtagcggttggaggttgtaggatcggcgaggaataggaattatggcggttgcgttgttcgtgttgttgggattcgcgttgttgggtatttacggagttttcggggttggtgaggagcgggtagggggcgggggtgcggttttgtaggggtcgggaatggaggtcgcggtgtcgattcgaagtcgacgggagtttggggtttcggcgcggggcggtttggggtgcgaaaggtcggtttcgggggtttttcgcgttagtatggagtttgggggtgaagttttagggtttgaggggggattaga

SEQ ID NO: 2862 - DNA, 551 bp, Artificial Sequence
  chemically treated genomic DNA (Homo sapiens) CpG-island No: 2862
tctaatcccccctcaaaccctaaaacttcacccccaaactccatactaacgcgaaaaacccccgaaaccgacctttcgcaccccaaaccgccccgcgccgaaaccccaaactcccgtcgacttcgaatcgacaccgcgacctccattcccgacccctacaaaaccgcacccccgccccctacccgctcctcaccaaccccgaaaactccgtaaatacccaacaacgcgaatcccaacaacacgaacaacgcaaccgccataattcctattcctcgccgatcctacaacctccaaccgctaccgccgccgcccgcgaccgctataaaaaacgacgaaaacgcgaaccgaacgcgcgcacgcacgacgtcatctcgaaaacgaaacgaacgccgaaaacgccgatcgccccgcctacgcacgcgcgcacacgctcgcatatacgcgccgactccgacaaactcacgctacgaaatccgaacgacgacgcacgtaacccgacgttactaaaaaacgaaaataaaacctacgaaaacgcgactaaaacctacgca

SEQ ID NO: 2863 - DNA, 551 bp, Artificial Sequence
  chemically treated genomic DNA (Homo sapiens) CpG-island No: 2863
tttagtttttttttaaattttgggattttatttttaagttttatgttggcgcgggaagttttcggggtcggtttttcgtattttaggtcgtttcgcgtcgaggttttaggttttcgtcggtttcgggtcggtatcgcggtttttattttcggtttttgtaggatcgtattttcgttttttattcgttttttattagtttcggaggtttcgtgggtgtttagtagcgcgaattttagtagtacgaatagcgtagtcgttatgatttttatttttcgtcggttttataatttttaatcgttgtcgtcgtcgttcgcggtcgttataaaaagcggcggaggcgcggatcgggcgcgcgtacgtacggcgttatttcgggggcggggcgagcgtcggggacgtcggtcgtttcgtttgcgtacgcgcgtatacgttcgtatgtacgcgtcggtttcggtaggtttacgttacggaattcgggcggcggcgtacgtgattcggcgttgttaggaaacgggagtggggtttgcggggacgcggttggagtttgcgta

SEQ ID NO: 2864 - DNA, 551 bp, Artificial Sequence
  chemically treated genomic DNA (Homo sapiens) CpG-island No: 2864
tacgcaaactccaaccgcgtccccgcaaaccccactcccgtttcctaacaacgccgaatcacgtacgccgccgcccgaattccgtaacgtaaacctaccgaaaccgacgcgtacatacgaacgtatacgcgcgtacgcaaacgaaacgaccgacgtccccgacgctcgccccgcccccgaaataacgccgtacgtacgcgcgcccgatccgcgcctccgccgctttttataacgaccgcgaacgacgacgacaacgattaaaaattataaaaccgacgaaaaataaaaatcataacgactacgctattcgtactactaaaattcgcgctactaaacacccacgaaacctccgaaactaataaaaaacgaataaaaaacgaaaatacgatcctacaaaaaccgaaaataaaaaccgcgataccgacccgaaaccgacgaaaacctaaaacctcgacgcgaaacgacctaaaatacgaaaaaccgaccccgaaaacttcccgcgccaacataaaacttaaaaataaaatcccaaaatttaaaaaaaaactaaa

SEQ ID NO: 2865 - DNA, 553 bp, Artificial Sequence
  chemically treated genomic DNA (Homo sapiens) CpG-island No: 2865
cggcgtcgtcgagtatcgttcgttttagtcgattagtttcgtcggttattgggtttagtttagaggagaggagggaaaggtcgcggaggtcgcgaggagacggttggggcgttagcggtcggttgtcgtttagttgtgttgttcggattaaggaaggagaagtgggaggagcggggagtttagcggtttaggacgacgacgttcgttatattcgggatttttcggtcgtggcggtcgtagcgtcggtagttcgggttttagtttttgtttttgtggtgatttcgtcgcgtttcgacgtcgtttttgttttcgtttcgttcgtcgttttcgttaatttcgtcgtcggggatatgtttaatttttgaagtcggaggaacgggttagttagattgcgttcgataggtgatggggagcggcggtcgggttgggtagtcgtcgggtgggcgagttggcgcggggtatttgttgatttgggaagggttaggatcgcgattaatggtgagttgggggtcggaggagtaggaaggtttagtttagggagagtaattggaaa

SEQ ID NO: 2866 - DNA, 553 bp, Artificial Sequence
  chemically treated genomic DNA (Homo sapiens) CpG-island No: 2866
tttccaattactctccctaaactaaaccttcctactcctccgacccccaactcaccattaatcgcgatcctaacccttcccaaatcaacaaataccccgcgccaactcgcccacccgacgactacccaacccgaccgccgctccccatcacctatcgaacgcaatctaactaacccgttcctccgacttcaaaaattaaacatatccccgacgacgaaattaacgaaaacgacgaacgaaacgaaaacaaaaacgacgtcgaaacgcgacgaaatcaccacaaaaacaaaaactaaaacccgaactaccgacgctacgaccgccacgaccgaaaaatcccgaatataacgaacgtcgtcgtcctaaaccgctaaactccccgctcctcccacttctccttccttaatccgaacaacacaactaaacgacaaccgaccgctaacgccccaaccgtctcctcgcgacctccgcgacctttccctcctctcctctaaactaaacccaataaccgacgaaactaatcgactaaaacgaacgatactcgacgacgccg

SEQ ID NO: 2867 - DNA, 553 bp, Artificial Sequence
  chemically treated genomic DNA (Homo sapiens) CpG-island No: 2867
tttttaattattttttttgaattaggtttttttattttttcgatttttaatttattattgatcgcgattttggttttttttaagttaataggtatttcgcgttagttcgtttattcggcggttgtttagttcggtcgtcgttttttattatttgtcgggcgtagtttgattggttcgttttttcggttttaggggttggatatgttttcggcggcggggttggcgggggcggcgggcgggacggggataggggcgacgtcgaagcgcggcggagttattatagaggtaggggttgaggttcgagttgtcggcgttgcgatcgttacggtcggagggtttcggatgtggcgagcgtcgtcgttttgagtcgttgagtttttcgttttttttatttttttttttttggttcgggtagtataattaggcggtagtcggtcgttggcgttttagtcgttttttcgcggttttcgcggtttttttttttttttttttaggttaggtttagtagtcgacggggttggtcggttgaggcgggcggtgttcggcggcgtcg

SEQ ID NO: 2868 - DNA, 553 bp, Artificial Sequence
  chemically treated genomic DNA (Homo sapiens) CpG-island No: 2868
cgacgccgccgaacaccgcccgcctcaaccgaccaaccccgtcgactactaaacctaacctaaaaaaaaaaaaaaaaaaaccgcgaaaaccgcgaaaaaacgactaaaacgccaacgaccgactaccgcctaattatactacccgaaccaaaaaaaaaaaaataaaaaaaacgaaaaactcaacgactcaaaacgacgacgctcgccacatccgaaaccctccgaccgtaacgatcgcaacgccgacaactcgaacctcaacccctacctctataataactccgccgcgcttcgacgtcgcccctatccccgtcccgcccgccgcccccgccaaccccgccgccgaaaacatatccaacccctaaaaccgaaaaaacgaaccaatcaaactacgcccgacaaataataaaaaacgacgaccgaactaaacaaccgccgaataaacgaactaacgcgaaatacctattaacttaaaaaaaaccaaaatcgcgatcaataataaattaaaaatcgaaaaaataaaaaaacctaattcaaaaaaaataattaaaaa

SEQ ID NO: 2869 - DNA, 1090 bp, Artificial Sequence
  chemically treated genomic DNA (Homo sapiens) CpG-island No: 2869
ttatttcgttttttaagaaagaattcggttcgaaatttgcgtgtttcgggtgcgtttggttatgtcgtatttattttttaatttttcgttttaatatcgttttttttatttttatttaatttaattcgggttttgtataatttttttagatttttttatttgcgtttttttttttcgggttcggcgtttttttttttattttattggaaaattcgtttcgggttttttttacgtttgtttttttttttcgatttttcgttttaacgcgggggtttagtacgtcgttttttttttttttgtttttttagggaggaggcgagaggaggcgaaaggaaggaaattttagtacgggttttcgggtcggtttttggggcgtttaagcgggttgcggcggttagtttcgggcggcgatttcgggtcggattttgcgcgcgtttatcgtttttttttcggagcgggtgcgtcggggagaggggagagttggcggtttgttattgttggttttcggtttcggttcggttcgcgcgttttgcggtgtttacgggttcggtttggcgttttttttttcggtcgcgtcgttttttttcgttagtttcgcgtcgttcgtttttaattcgagtttttcgcggttattgcggggagttcgagtcgtcggcgcgggagttgtcggcgttgcggtgttttcgtttcgtcgtttgtcgaggaggtttcggttgagggggtcgcgcgggtttcggagcggcgtcgtcgagcggcgggggtttgtaggggcgttttcgttgtttcgttaatttttcgtttatcgtcgtcgtcggagggggttgggaagtcgtttgggtatatacgtgtcgttttcgttggggtcgcggagttgcgggggagatgcgggtcgttgtcggcgtcgtttcggggcgtttcgtttcgttttagttttcggcgttttgacgtcgttttcgttttatagttttttttttcgggaggggcgtagattcgatcgtttttagtttcgagttttcgtcgtcgcgagggggtcgtttttggattcgtgtaattcgtttttttttttttattttttttttttttttttttt

SEQ ID NO: 2870 - DNA, 1090 bp, Artificial Sequence
  chemically treated genomic DNA (Homo sapiens) CpG-island No: 2870
aaaaaaaaaaaaaaaaaaaaataaaaaaaaaaaaacgaattacacgaatccaaaaacgaccccctcgcgacgacgaaaactcgaaactaaaaacgatcgaatctacgcccctcccgaaaaaaaaaactataaaacgaaaacgacgtcaaaacgccgaaaactaaaacgaaacgaaacgccccgaaacgacgccgacaacgacccgcatctcccccgcaactccgcgaccccaacgaaaacgacacgtatatacccaaacgacttcccaaccccctccgacgacgacgataaacgaaaaattaacgaaacaacgaaaacgcccctacaaacccccgccgctcgacgacgccgctccgaaacccgcgcgaccccctcaaccgaaacctcctcgacaaacgacgaaacgaaaacaccgcaacgccgacaactcccgcgccgacgactcgaactccccgcaataaccgcgaaaaactcgaattaaaaacgaacgacgcgaaactaacgaaaaaaaacgacgcgaccgaaaaaaaaaacgccaaaccgaacccgtaaacaccgcaaaacgcgcgaaccgaaccgaaaccgaaaaccaacaataacaaaccgccaactctcccctctccccgacgcacccgctccgaaaaaaaaacgataaacgcgcgcaaaatccgacccgaaatcgccgcccgaaactaaccgccgcaacccgcttaaacgccccaaaaaccgacccgaaaacccgtactaaaatttccttcctttcgcctcctctcgcctcctccctaaaaaaacaaaaaaaaaaaaaacgacgtactaaacccccgcgttaaaacgaaaaatcgaaaaaaaaaaacaaacgtaaaaaaaacccgaaacgaattttccaataaaataaaaaaaaaaacgccgaacccgaaaaaaaaaaacgcaaataaaaaaatctaaaaaaattatacaaaacccgaattaaattaaataaaaataaaaaaaacgatattaaaacgaaaaattaaaaaataaatacgacataaccaaacgcacccgaaacacgcaaatttcgaaccgaattctttcttaaaaaacgaaataa

SEQ ID NO: 2871 - DNA, 1090 bp, Artificial Sequence
  chemically treated genomic DNA (Homo sapiens) CpG-island No: 2871
aaaaaaaaaaaaaaaagaaaatagaaaaaaagaggcggattatacggatttaaaggcggttttttcgcggcggcggaggttcgggattgggggcgatcgggtttgcgtttttttcggggagggaggttgtggggcgggggcggcgttagagcgtcgggggttggggcgaggcggagcgtttcgaggcggcgtcggtagcggttcgtatttttttcgtagtttcgcggttttaacggaggcggtacgtgtgtgtttaggcgattttttagtttttttcgacggcggcggtggacgaggggttaacggggtagcgggggcgtttttgtaggttttcgtcgttcggcggcgtcgtttcggggttcgcgcggtttttttagtcggggttttttcggtagacggcggggcgggggtatcgtagcgtcgatagttttcgcgtcgacggttcgggtttttcgtagtggtcgcggggagttcgggttgggggcgggcggcgcggagttggcggagaggggcggcgcggtcggaggggggggcgttaggtcgggttcgtgggtatcgtaggacgcgcggatcgagtcggagtcgggaattagtaatgataagtcgttagttttttttttttttcggcgtattcgtttcgggaggggggcggtgggcgcgcgtaaaattcggttcggagtcgtcgttcgggattggtcgtcgtaattcgtttgagcgttttaggagtcggttcgaaaattcgtgttggagttttttttttttcgttttttttcgttttttttttggaaaagtagagagagggaaagcgacgtgttggattttcgcgttggagcggggagtcggggaagggagataggcgtaaggaagattcggagcggattttttagtgaagtaaaaggaaaggcgtcgagttcggggaaggagggcgtaaatggggagatttggaagggttgtgtaaaattcgagttggattagataaagatgggagaaacggtgttggagcggggggttggggggtagatgcgatatggttaaacgtattcggggtacgtaaatttcgggtcggatttttttttgggagacggagtaa

SEQ ID NO: 2872 - DNA, 1090 bp, Artificial Sequence
  chemically treated genomic DNA (Homo sapiens) CpG-island No: 2872
ttactccgtctcccaaaaaaaaatccgacccgaaatttacgtaccccgaatacgtttaaccatatcgcatctaccccccaaccccccgctccaacaccgtttctcccatctttatctaatccaactcgaattttacacaacccttccaaatctccccatttacgccctccttccccgaactcgacgcctttccttttacttcactaaaaaatccgctccgaatcttccttacgcctatctcccttccccgactccccgctccaacgcgaaaatccaacacgtcgctttccctctctctacttttccaaaaaaaaaacgaaaaaaaacgaaaaaaaaaaaactccaacacgaattttcgaaccgactcctaaaacgctcaaacgaattacgacgaccaatcccgaacgacgactccgaaccgaattttacgcgcgcccaccgcccccctcccgaaacgaatacgccgaaaaaaaaaaaaaactaacgacttatcattactaattcccgactccgactcgatccgcgcgtcctacgatacccacgaacccgacctaacgcccccccctccgaccgcgccgcccctctccgccaactccgcgccgcccgcccccaacccgaactccccgcgaccactacgaaaaacccgaaccgtcgacgcgaaaactatcgacgctacgatacccccgccccgccgtctaccgaaaaaaccccgactaaaaaaaccgcgcgaaccccgaaacgacgccgccgaacgacgaaaacctacaaaaacgcccccgctaccccgttaacccctcgtccaccgccgccgtcgaaaaaaactaaaaaatcgcctaaacacacacgtaccgcctccgttaaaaccgcgaaactacgaaaaaaatacgaaccgctaccgacgccgcctcgaaacgctccgcctcgccccaacccccgacgctctaacgccgcccccgccccacaacctccctccccgaaaaaaacgcaaacccgatcgcccccaatcccgaacctccgccgccgcgaaaaaaccgcctttaaatccgtataatccgcctctttttttctattttctttttttttttttttt

SEQ ID NO: 2873 - DNA, 691 bp, Artificial Sequence
  chemically treated genomic DNA (Homo sapiens) CpG-island No: 2873
cgggttcgtcgagtcgtaggagagatacgttgggtcgattttagagcggcgttggataggtgagtgtttgcgggtttagggcgaggggcgaagtcgtatttgggttaggtgtgcggggcgcgcggaagaggggaggcgggaaggatgggaggtcggggtttgttttggtcgcgagggcggaggggacgttggagtcgcgcggggtatcgtatttgagcgggaggggcgtcgggggtagttcgtattttatttttattggcgaggggttcgggaggggcggtttttacggagttttcggggcgcgggggtgcggacgggcgatcgtagggtgtttggcggggggaggggatagcgagtgtgttcgcgcgcgcgttagtttttgtggggaagcggcgtcgcggtgtttgcgtgttttcggtgcgtgtgcgcgcgggtttttggcgttttgtttgtgtaggtgtttgggtgtgagcggagggggtgcgtgtgcgtgtgcgcgtcgcgcgtcggtttcgggttttagaggattcgtgtcggggattggtattataggatgttgggcgagggggttgtttttttttgggaggtagtggcgcgggggatggggaggggttcgtttgggtgttaagtcggtcgtagttcggggggcgtcgttgttaggaagagggggtgtagttaggtagtatttttt

SEQ ID NO: 2874 - DNA, 691 bp, Artificial Sequence
  chemically treated genomic DNA (Homo sapiens) CpG-island No: 2874
aaaaaatactacctaactacaccccctcttcctaacaacgacgccccccgaactacgaccgacttaacacccaaacgaacccctccccatcccccgcgccactacctcccaaaaaaaaacaaccccctcgcccaacatcctataataccaatccccgacacgaatcctctaaaacccgaaaccgacgcgcgacgcgcacacgcacacgcaccccctccgctcacacccaaacacctacacaaacaaaacgccaaaaacccgcgcgcacacgcaccgaaaacacgcaaacaccgcgacgccgcttccccacaaaaactaacgcgcgcgcgaacacactcgctatcccctccccccgccaaacaccctacgatcgcccgtccgcacccccgcgccccgaaaactccgtaaaaaccgcccctcccgaacccctcgccaataaaaataaaatacgaactacccccgacgcccctcccgctcaaatacgataccccgcgcgactccaacgtcccctccgccctcgcgaccaaaacaaaccccgacctcccatccttcccgcctcccctcttccgcgcgccccgcacacctaacccaaatacgacttcgcccctcgccctaaacccgcaaacactcacctatccaacgccgctctaaaatcgacccaacgtatctctcctacgactcgacgaacccg

SEQ ID NO: 2875 - DNA, 691 bp, Artificial Sequence
  chemically treated genomic DNA (Homo sapiens) CpG-island No: 2875
agaaggtgttgtttggttgtattttttttttttgatagcggcgtttttcggattgcggtcggtttgatatttagacggatttttttttatttttcgcgttattgttttttagagaaaaataattttttcgtttagtattttgtggtgttaattttcgatacggattttttggggttcggggtcggcgcgcggcgcgtatacgtatacgtatttttttcgtttatatttagatatttatataaatagggcgttaaggattcgcgcgtatacgtatcggggatacgtaggtatcgcggcgtcgtttttttataaaggttggcgcgcgcgcgggtatattcgttgtttttttttttcgttaggtattttgcggtcgttcgttcgtattttcgcgtttcgggagtttcgtgggggtcgtttttttcgggtttttcgttagtgggggtgaggtgcgggttgttttcgacgtttttttcgtttaggtgcggtgtttcgcgcggttttagcgtttttttcgttttcgcggttaggataggtttcggttttttatttttttcgttttttttttttcgcgcgtttcgtatatttggtttaggtgcggtttcgtttttcgttttgggttcgtagatatttatttgtttagcgtcgttttggggtcggtttagcgtgttttttttgcggttcggcgaattcg

SEQ ID NO: 2876 - DNA, 691 bp, Artificial Sequence
  chemically treated genomic DNA (Homo sapiens) CpG-island No: 2876
cgaattcgccgaaccgcaaaaaaaacacgctaaaccgaccccaaaacgacgctaaacaaataaatatctacgaacccaaaacgaaaaacgaaaccgcacctaaaccaaatatacgaaacgcgcgaaaaaaaaaaaacgaaaaaaataaaaaaccgaaacctatcctaaccgcgaaaacgaaaaaaacgctaaaaccgcgcgaaacaccgcacctaaacgaaaaaaacgtcgaaaacaacccgcacctcacccccactaacgaaaaacccgaaaaaaacgacccccacgaaactcccgaaacgcgaaaatacgaacgaacgaccgcaaaatacctaacgaaaaaaaaaaacaacgaatatacccgcgcgcgcgccaacctttataaaaaaacgacgccgcgatacctacgtatccccgatacgtatacgcgcgaatccttaacgccctatttatataaatatctaaatataaacgaaaaaaatacgtatacgtatacgcgccgcgcgccgaccccgaaccccaaaaaatccgtatcgaaaattaacaccacaaaatactaaacgaaaaaattatttttctctaaaaaacaataacgcgaaaaataaaaaaaaatccgtctaaatatcaaaccgaccgcaatccgaaaaacgccgctatcaaaaaaaaaaaatacaaccaaacaacaccttct

SEQ ID NO: 2877 - DNA, 1216 bp, Artificial Sequence
  chemically treated genomic DNA (Homo sapiens) CpG-island No: 2877
gttaatcgcgagcgtaggtaggtttatagatttatacgggttatgtttatttacgtttttacgacggttaatcgtgagtgcgggtaggtttatagatttatacgggttatgtttatttaggtttttacgacggttaattgcgagtgcgggtaggtttatagatttatacgggttatgtttatttacgtttttacgacggttaatcgcgagtgcgggtaggtttatagatttattcgggttatgtttatggggttttttacgacggttagtcgcgagtgcgggtaggtttatagatttatacgggttatgtttgtggggttttttacgacggttagttgcgagtgcgggtaggtttatagatttatacgggttatgtttatggggttttttacgacggttaatcgcgaatgcgggtaggtttatagatttatatgggttatgtttatttatatttttacgatggttaatcgcgagtgcgggtaggtttatagatttatacgggttatgtttatttaggtttttacgacggttaatcgcgagtgcgggtaggtttatagatttatacgggttatgtttatttaggtttttataacggttaatcgcgagtgcgggtaggtttatagatttatacgggttatgtttatggggttttttacgacggttaatcgcgaatgcgggtaggtttatagatttatatgggttatgtttatttatatttttacgatggttaatcgcgagtgcgggtaggtttatagatttatacgggttatgtttatttaggtttttacgatggttaatcgcgagtgcgggtaggtttatagatttatacgggttatgtttatttaggtttttacgacggttaatcgtgagtataggtaggtttatagatttatacgggttatgtttatggggttttttacgacggttaatcgcgagcgcgggtaggtttatagatttatacgggttatgtttatttatgtttttacgacggttaatcgtgagtataggtaggtttatagatttatacgggttatgtttatttaggtttttacgacggttaatcgcgagcgtaggtaggtttatagatttatacgggttatgtttatttatgtttttacgacggttaatcgcgagcgtaggtaggtttatagatgttttcgtaaagagaagagttttgttgtaggattgtttttttgtgaggtaatttttgtttaga

SEQ ID NO: 2878 - DNA, 1216 bp, Artificial Sequence
  chemically treated genomic DNA (Homo sapiens) CpG-island No: 2878
tctaaacaaaaattacctcacaaaaaaacaatcctacaacaaaactcttctctttacgaaaacatctataaacctacctacgctcgcgattaaccgtcgtaaaaacataaataaacataacccgtataaatctataaacctacctacgctcgcgattaaccgtcgtaaaaacctaaataaacataacccgtataaatctataaacctacctatactcacgattaaccgtcgtaaaaacataaataaacataacccgtataaatctataaacctacccgcgctcgcgattaaccgtcgtaaaaaaccccataaacataacccgtataaatctataaacctacctatactcacgattaaccgtcgtaaaaacctaaataaacataacccgtataaatctataaacctacccgcactcgcgattaaccatcgtaaaaacctaaataaacataacccgtataaatctataaacctacccgcactcgcgattaaccatcgtaaaaatataaataaacataacccatataaatctataaacctacccgcattcgcgattaaccgtcgtaaaaaaccccataaacataacccgtataaatctataaacctacccgcactcgcgattaaccgttataaaaacctaaataaacataacccgtataaatctataaacctacccgcactcgcgattaaccgtcgtaaaaacctaaataaacataacccgtataaatctataaacctacccgcactcgcgattaaccatcgtaaaaatataaataaacataacccatataaatctataaacctacccgcattcgcgattaaccgtcgtaaaaaaccccataaacataacccgtataaatctataaacctacccgcactcgcaactaaccgtcgtaaaaaaccccacaaacataacccgtataaatctataaacctacccgcactcgcgactaaccgtcgtaaaaaaccccataaacataacccgaataaatctataaacctacccgcactcgcgattaaccgtcgtaaaaacgtaaataaacataacccgtataaatctataaacctacccgcactcgcaattaaccgtcgtaaaaacctaaataaacataacccgtataaatctataaacctacccgcactcacgattaaccgtcgtaaaaacgtaaataaacataacccgtataaatctataaacctacctacgctcgcgattaac

SEQ ID NO: 2879 - DNA, 1216 bp, Artificial Sequence
  chemically treated genomic DNA (Homo sapiens) CpG-island No: 2879
tttgagtaagggttattttataggaaggtagttttgtagtaagatttttttttttacggagatatttgtgaatttgtttgcgttcgcggttggtcgtcgtagaagtatggataagtatagttcgtgtgaatttgtgaatttgtttgcgttcgcggttggtcgtcgtagaagtttggataagtatagttcgtgtgaatttgtgaatttgtttgtgtttacggttggtcgtcgtagaagtatggataagtatagttcgtgtgaatttgtgaatttgttcgcgttcgcggttggtcgtcgtagaaggttttataagtatagttcgtgtgaatttgtgaatttgtttgtgtttacggttggtcgtcgtagaagtttggataagtatagttcgtgtgaatttgtgaatttgttcgtattcgcggttggttatcgtagaagtttggataagtatagttcgtgtgaatttgtgaatttgttcgtattcgcggttggttatcgtagaagtgtggataagtatagtttatgtgaatttgtgaatttgttcgtattcgcggttggtcgtcgtagaaggttttataagtatagttcgtgtgaatttgtgaatttgttcgtattcgcggttggtcgttgtagaagtttggataagtatagttcgtgtgaatttgtgaatttgttcgtattcgcggttggtcgtcgtagaagtttggataagtatagttcgtgtgaatttgtgaatttgttcgtattcgcggttggttatcgtagaagtgtggataagtatagtttatgtgaatttgtgaatttgttcgtattcgcggttggtcgtcgtagaaggttttataagtatagttcgtgtgaatttgtgaatttgttcgtattcgtagttggtcgtcgtagaaggttttataagtatagttcgtgtgaatttgtgaatttgttcgtattcgcggttggtcgtcgtagaaggttttataagtatagttcgggtgaatttgtgaatttgttcgtattcgcggttggtcgtcgtagaagcgtggataagtatagttcgtgtgaatttgtgaatttgttcgtattcgtagttggtcgtcgtagaagtttagataagtatagttcgtgtgaatttgtgaatttgttcgtatttacggttggtcgtcgtagaagcgtggataagtatagttcgtgtgaatttgtgaatttgtttgcgttcgcggttggt

SEQ ID NO: 2880 - DNA, 1216 bp, Artificial Sequence
  chemically treated genomic DNA (Homo sapiens) CpG-island No: 2880
accaaccgcgaacgcaaacaaattcacaaattcacacgaactatacttatccacgcttctacgacgaccaaccgtaaatacgaacaaattcacaaattcacacgaactatacttatctaaacttctacgacgaccaactacgaatacgaacaaattcacaaattcacacgaactatacttatccacgcttctacgacgaccaaccgcgaatacgaacaaattcacaaattcacccgaactatacttataaaaccttctacgacgaccaaccgcgaatacgaacaaattcacaaattcacacgaactatacttataaaaccttctacgacgaccaactacgaatacgaacaaattcacaaattcacacgaactatacttataaaaccttctacgacgaccaaccgcgaatacgaacaaattcacaaattcacataaactatacttatccacacttctacgataaccaaccgcgaatacgaacaaattcacaaattcacacgaactatacttatccaaacttctacgacgaccaaccgcgaatacgaacaaattcacaaattcacacgaactatacttatccaaacttctacaacgaccaaccgcgaatacgaacaaattcacaaattcacacgaactatacttataaaaccttctacgacgaccaaccgcgaatacgaacaaattcacaaattcacataaactatacttatccacacttctacgataaccaaccgcgaatacgaacaaattcacaaattcacacgaactatacttatccaaacttctacgataaccaaccgcgaatacgaacaaattcacaaattcacacgaactatacttatccaaacttctacgacgaccaaccgtaaacacaaacaaattcacaaattcacacgaactatacttataaaaccttctacgacgaccaaccgcgaacgcgaacaaattcacaaattcacacgaactatacttatccatacttctacgacgaccaaccgtaaacacaaacaaattcacaaattcacacgaactatacttatccaaacttctacgacgaccaaccgcgaacgcaaacaaattcacaaattcacacgaactatacttatccatacttctacgacgaccaaccgcgaacgcaaacaaattcacaaatatctccgtaaaaaaaaaaatcttactacaaaactaccttcctataaaataacccttactcaaa

SEQ ID NO: 2881 - DNA, 887 bp, Artificial Sequence
  chemically treated genomic DNA (Homo sapiens) CpG-island No: 2881
cgggacggacgttttagatcgggttttcgtcggttgtttcgttttcggttttattcgcggtttcgggtttcgcgtttcgatcgagtcgttttcgcgtagtaggaggttttcggtatttcgtaggcgtcggttcggcgagtttcgtagttcgcggtagttttggaagtatacggtttacgtttgtttttcgttgagcggttgttcgtaggtatttagttttttttttaggtatagttcgttagggtttcggtcgttttgcgttcgtcgcggacgtcgtcgtagttgttcgttcgggttatggcggggtcgttatcgtttttcgcgcgtcggattcgcgtttatgtagtcgcgtttttcgtcgcgtagggttagtttggtcgtttcgtttcgcgcgagcgttttaggttgggggcggggcggcgacgggggcggggcgcggagggcgcggggggcggggcgcggagggggagggacgcggggcggggcggggagtggagggcgcgcggggagaggttcggagggggacgggtgaggggtagggcggggcgcgggtaggtgcggaggggttggggtttagggttggggacgcgggggcgcggggtcgaggtcggggtgcgaattttttcggggtgttgggtaggatcggggggagggttgggggttgtagatatgggttagggttcgcgcgttcggatacgcggtgatattttcggcgttttttcgtagatttagacggtcgatgtttataaaagttcgggtcggtatttagttcgggatattgcggtgatcgcggggggtttgggaggtttgtcgttgggaacgcgggagggagtcgggaggagttgagtagataaagttcgtagtggttttttcgagtttcgggtaag

SEQ ID NO: 2882 - DNA, 887 bp, Artificial Sequence
  chemically treated genomic DNA (Homo sapiens) CpG-island No: 2882
cttacccgaaactcgaaaaaaccactacgaactttatctactcaactcctcccgactccctcccgcgttcccaacgacaaacctcccaaaccccccgcgatcaccgcaatatcccgaactaaataccgacccgaacttttataaacatcgaccgtctaaatctacgaaaaaacgccgaaaatatcaccgcgtatccgaacgcgcgaaccctaacccatatctacaacccccaaccctccccccgatcctacccaacaccccgaaaaaattcgcaccccgacctcgaccccgcgcccccgcgtccccaaccctaaaccccaacccctccgcacctacccgcgccccgccctacccctcacccgtccccctccgaacctctccccgcgcgccctccactccccgccccgccccgcgtccctccccctccgcgccccgccccccgcgccctccgcgccccgcccccgtcgccgccccgcccccaacctaaaacgctcgcgcgaaacgaaacgaccaaactaaccctacgcgacgaaaaacgcgactacataaacgcgaatccgacgcgcgaaaaacgataacgaccccgccataacccgaacgaacaactacgacgacgtccgcgacgaacgcaaaacgaccgaaaccctaacgaactatacctaaaaaaaaaactaaatacctacgaacaaccgctcaacgaaaaacaaacgtaaaccgtatacttccaaaactaccgcgaactacgaaactcgccgaaccgacgcctacgaaataccgaaaacctcctactacgcgaaaacgactcgatcgaaacgcgaaacccgaaaccgcgaataaaaccgaaaacgaaacaaccgacgaaaacccgatctaaaacgtccgtcccg

SEQ ID NO: 2883 - DNA, 887 bp, Artificial Sequence
  chemically treated genomic DNA (Homo sapiens) CpG-island No: 2883
tttgttcggggttcggggaggttattgcgggttttgtttgtttagtttttttcggttttttttcgcgtttttagcggtaaattttttaggtttttcgcggttatcgtagtgtttcgggttggatgtcggttcgggtttttgtgggtatcggtcgtttgggtttgcgggggagcgtcgggggtgttatcgcgtgttcgagcgcgcgggttttggtttatgtttgtagtttttaatttttttttcggttttgtttagtatttcggaggggttcgtatttcggtttcggtttcgcgttttcgcgtttttagttttgagttttagttttttcgtatttattcgcgtttcgttttgttttttattcgttttttttcgggttttttttcgcgcgttttttatttttcgtttcgtttcgcgttttttttttttcgcgtttcgtttttcgcgtttttcgcgtttcgttttcgtcgtcgtttcgtttttaatttgaggcgttcgcgcggggcggggcggttaggttgattttgcgcggcggaaggcgcggttgtatggacgcgggttcggcgcgcgggaggcgatgacggtttcgttatggttcgggcgggtagttgcggcggcgttcgcggcgggcgtaaggcggtcggagttttggcgagttgtatttggaggaggagttgaatgtttacgagtagtcgtttaacgaggagtaggcgtgggtcgtgtgtttttagggttgtcgcgggttgcggggttcgtcgggtcggcgtttgcgggatatcggggattttttgttgcgcggggacggttcggtcggggcgcgggattcgaggtcgcgggtgaggtcgggggcggggtagtcggcggggattcggtttggggcgttcgtttcg

SEQ ID NO: 2884 - DNA, 887 bp, Artificial Sequence
  chemically treated genomic DNA (Homo sapiens) CpG-island No: 2884
cgaaacgaacgccccaaaccgaatccccgccgactaccccgcccccgacctcacccgcgacctcgaatcccgcgccccgaccgaaccgtccccgcgcaacaaaaaatccccgatatcccgcaaacgccgacccgacgaaccccgcaacccgcgacaaccctaaaaacacacgacccacgcctactcctcgttaaacgactactcgtaaacattcaactcctcctccaaatacaactcgccaaaactccgaccgccttacgcccgccgcgaacgccgccgcaactacccgcccgaaccataacgaaaccgtcatcgcctcccgcgcgccgaacccgcgtccatacaaccgcgccttccgccgcgcaaaatcaacctaaccgccccgccccgcgcgaacgcctcaaattaaaaacgaaacgacgacgaaaacgaaacgcgaaaaacgcgaaaaacgaaacgcgaaaaaaaaaaaacgcgaaacgaaacgaaaaataaaaaacgcgcgaaaaaaaacccgaaaaaaaacgaataaaaaacaaaacgaaacgcgaataaatacgaaaaaactaaaactcaaaactaaaaacgcgaaaacgcgaaaccgaaaccgaaatacgaacccctccgaaatactaaacaaaaccgaaaaaaaaattaaaaactacaaacataaaccaaaacccgcgcgctcgaacacgcgataacacccccgacgctcccccgcaaacccaaacgaccgatacccacaaaaacccgaaccgacatccaacccgaaacactacgataaccgcgaaaaacctaaaaaatttaccgctaaaaacgcgaaaaaaaaccgaaaaaaactaaacaaacaaaacccgcaataacctccccgaaccccgaacaaa

SEQ ID NO: 2885 - DNA, 662 bp, Artificial Sequence
  chemically treated genomic DNA (Homo sapiens) CpG-island No: 2885
cgcgagacgttttcgcggattatatcgcggcggtaaagttaaacgtaaaaattattttatcgcgcgtaggcgttttttttaggattaatatggttacgacgtaaggtttcgatttgaggggcgtggtttggtcgtcgttagttaacgggtgtgcgcgtttggtcgtagttaataggaaggtagcgcgggttcgggcgtagggagtcgtcgtcggggttgtaggcgttaaggttatgttcgattcgtgggtttcgaatttcgtttcgggttaggatttagggggtcgtcggagggtttgggtcgagttgttgggtaggtgggcgcggtaggtcgcgggagtgggcggcgttcggttcgggacggtttcgtcggtttttcgattttttttcgttagagttttcgtcggtcggattttcggacgtcgcgttcggggggttgtgcggggtgggcgttcggttggggcggcgcggttgtttcggattcggttttttttgcgtttgggcggacgtttattagatcgtcgttcgcggggcgtttttttttttttcgaacgtcgttttcgtcggtcgttttgttaggcgggtttggggtgcgcggtttggggttttttttagcgtagaggtcgtttttcgttagtcgttttcgggtttttttgtttcggg

SEQ ID NO: 2886 - DNA, 662 bp, Artificial Sequence
  chemically treated genomic DNA (Homo sapiens) CpG-island No: 2886
cccgaaacaaaaaaacccgaaaacgactaacgaaaaacgacctctacgctaaaaaaaaccccaaaccgcgcaccccaaacccgcctaacaaaacgaccgacgaaaacgacgttcgaaaaaaaaaaaaacgccccgcgaacgacgatctaataaacgtccgcccaaacgcaaaaaaaaccgaatccgaaacaaccgcgccgccccaaccgaacgcccaccccgcacaaccccccgaacgcgacgtccgaaaatccgaccgacgaaaactctaacgaaaaaaaatcgaaaaaccgacgaaaccgtcccgaaccgaacgccgcccactcccgcgacctaccgcgcccacctacccaacaactcgacccaaaccctccgacgaccccctaaatcctaacccgaaacgaaattcgaaacccacgaatcgaacataaccttaacgcctacaaccccgacgacgactccctacgcccgaacccgcgctaccttcctattaactacgaccaaacgcgcacacccgttaactaacgacgaccaaaccacgcccctcaaatcgaaaccttacgtcgtaaccatattaatcctaaaaaaaacgcctacgcgcgataaaataatttttacgtttaactttaccgccgcgatataatccgcgaaaacgtctcgcg

SEQ ID NO: 2887 - DNA, 662 bp, Artificial Sequence
  chemically treated genomic DNA (Homo sapiens) CpG-island No: 2887
ttcgaggtaggggagttcggggacggttggcgaggggcggtttttgcgttgaggggagttttaggtcgcgtattttaggttcgtttgatagggcggtcggcgggggcggcgttcgggaaagaagggagcgtttcgcgggcggcggtttggtgggcgttcgtttaggcgtaggaggggtcgggttcgaggtagtcgcgtcgttttagtcgggcgtttatttcgtatagtttttcgggcgcggcgttcggggattcgatcggcggaggttttggcgggaagggatcggggaatcggcgaaatcgtttcgggtcggacgtcgtttattttcgcggtttgtcgcgtttatttatttagtagttcggtttaggtttttcggcggttttttgggttttggttcgaggcggagttcgggatttacgagtcggatatggttttggcgtttatagtttcggcggcggttttttgcgttcgagttcgcgttgtttttttattggttgcggttaggcgcgtatattcgttggttggcggcggttaggttacgttttttaggtcgaggttttgcgtcgtggttatgttggttttgggggaggcgtttgcgcgcggtgaggtagtttttgcgtttggttttgtcgtcgcggtgtagttcgcgggggcgtttcgcg

SEQ ID NO: 2888 - DNA, 662 bp, Artificial Sequence
  chemically treated genomic DNA (Homo sapiens) CpG-island No: 2888
cgcgaaacgcccccgcgaactacaccgcgacgacaaaaccaaacgcaaaaactacctcaccgcgcgcaaacgcctcccccaaaaccaacataaccacgacgcaaaacctcgacctaaaaaacgtaacctaaccgccgccaaccaacgaatatacgcgcctaaccgcaaccaataaaaaaacaacgcgaactcgaacgcaaaaaaccgccgccgaaactataaacgccaaaaccatatccgactcgtaaatcccgaactccgcctcgaaccaaaacccaaaaaaccgccgaaaaacctaaaccgaactactaaataaataaacgcgacaaaccgcgaaaataaacgacgtccgacccgaaacgatttcgccgattccccgatcccttcccgccaaaacctccgccgatcgaatccccgaacgccgcgcccgaaaaactatacgaaataaacgcccgactaaaacgacgcgactacctcgaacccgacccctcctacgcctaaacgaacgcccaccaaaccgccgcccgcgaaacgctcccttctttcccgaacgccgcccccgccgaccgccctatcaaacgaacctaaaatacgcgacctaaaactcccctcaacgcaaaaaccgcccctcgccaaccgtccccgaactcccctacctcgaa

SEQ ID NO: 2889 - DNA, 1296 bp, Artificial Sequence
  chemically treated genomic DNA (Homo sapiens) CpG-island No: 2889
ttcgatttattttaaaggcgtgtcgagtgggaaggtaatattttgattttttaaacgttgcggttagcggttttttttacggtaggcgtttttaggttttttcgtagggtcgggatttcgggcggcgcgcggtttttgggacgtcgagggaggtcgggtttatagcgttcggagcgcggatagcggttatagttcgtcgtttagaagcggcgtcgttcggggcggagggcggagtcgagcgcgcgtttcgtttcgtttcgtttcgtttcgtagttttagtttagcgcgcgtattaaggcggggcggcgcgcgggttcgtgcgcgtgttcggggttaggaggcggtggcggcgagcgcgggtcgcgcgtgcgcgttgcggttgggcgaggggcggcgcgggcgcgcgtttgttagtgatagcgggcggggtaggggtcggagatggtggcggcggtagttttttcgatatgaggtagcggtcgcgggggatacggcggcgggcgcggcggcggtcgtatttttagttcggggaggcggttttcggcgtgggcgcgggcgggcgggcgtttcggtcggcgtcgcgggagttcggttttgcggtagcgtttgtatcgtcgttcggcgaggggttcgcgttcgtggttttacgcgttcggtttcgggatagttgcggtcgcggcgggagcggcggcgtattcggggggaagtaggttttattagacgggtcgcgtcgacgggtttcgcgtattcgtagttcggggcgtttttatttttagcgttcgtcgtcgcgggtagggtcggttcggagcgcggggggcggtcggggagcgcgggtcgggggcgttcgtcgaagttcgttgtttcgggtcggggtcggggtcggggtcggtcgcgcgtcgtttttgacgtatcggagcgcggtttttgtaggatggagggtttcgcgtcgttagcggagttgtttgtgcgtaggcggttcgcggggttgggagcgtttaaggtttgaattttttttcggagtcgtagttggaggaggcgagcgcgcgaggaggagaagtcgcgcggcgcggaggttattttcggggcgagaggcgcggaaggcgagcgagtaaagcggtttcggagttacggcggttacgcggcggggattttcgggcgttttaggttcgtttcgagcggttttcgtgcgtttcgaaggtgggggcggtgggggcggtgggagtatcgttgagtcgggaattataggaatagatggtgtttgtttaggtcgcgtgttggagtcgttttttaggatag

SEQ ID NO: 2890 - DNA, 1296 bp, Artificial Sequence
  chemically treated genomic DNA (Homo sapiens) CpG-island No: 2890
ctatcctaaaaaacgactccaacacgcgacctaaacaaacaccatctattcctataattcccgactcaacgatactcccaccgcccccaccgcccccaccttcgaaacgcacgaaaaccgctcgaaacgaacctaaaacgcccgaaaatccccgccgcgtaaccgccgtaactccgaaaccgctttactcgctcgccttccgcgcctctcgccccgaaaataacctccgcgccgcgcgacttctcctcctcgcgcgctcgcctcctccaactacgactccgaaaaaaaattcaaaccttaaacgctcccaaccccgcgaaccgcctacgcacaaacaactccgctaacgacgcgaaaccctccatcctacaaaaaccgcgctccgatacgtcaaaaacgacgcgcgaccgaccccgaccccgaccccgacccgaaacaacgaacttcgacgaacgcccccgacccgcgctccccgaccgccccccgcgctccgaaccgaccctacccgcgacgacgaacgctaaaaataaaaacgccccgaactacgaatacgcgaaacccgtcgacgcgacccgtctaataaaacctacttccccccgaatacgccgccgctcccgccgcgaccgcaactatcccgaaaccgaacgcgtaaaaccacgaacgcgaacccctcgccgaacgacgatacaaacgctaccgcaaaaccgaactcccgcgacgccgaccgaaacgcccgcccgcccgcgcccacgccgaaaaccgcctccccgaactaaaaatacgaccgccgccgcgcccgccgccgtatcccccgcgaccgctacctcatatcgaaaaaactaccgccgccaccatctccgacccctaccccgcccgctatcactaacaaacgcgcgcccgcgccgcccctcgcccaaccgcaacgcgcacgcgcgacccgcgctcgccgccaccgcctcctaaccccgaacacgcgcacgaacccgcgcgccgccccgccttaatacgcgcgctaaactaaaactacgaaacgaaacgaaacgaaacgaaacgcgcgctcgactccgccctccgccccgaacgacgccgcttctaaacgacgaactataaccgctatccgcgctccgaacgctataaacccgacctccctcgacgtcccaaaaaccgcgcgccgcccgaaatcccgaccctacgaaaaaacctaaaaacgcctaccgtaaaaaaaaccgctaaccgcaacgtttaaaaaatcaaaatattaccttcccactcgacacgcctttaaaataaatcgaa

SEQ ID NO: 2891 - DNA, 1296 bp, Artificial Sequence
  chemically treated genomic DNA (Homo sapiens) CpG-island No: 2891
ttgttttaaggggcggttttagtacgcgatttggataggtattatttgtttttgtggttttcggtttagcggtgtttttatcgtttttatcgtttttattttcgaggcgtacgagaatcgttcgggacggatttagaacgttcgggggttttcgtcgcgtggtcgtcgtggtttcgggatcgttttgttcgttcgtttttcgcgtttttcgtttcgagggtggttttcgcgtcgcgcggtttttttttttcgcgcgttcgttttttttagttgcggtttcggagggaagtttagattttgagcgtttttagtttcgcgagtcgtttgcgtataaataatttcgttggcggcgcggagttttttattttgtaggagtcgcgtttcgatgcgttaaaggcggcgcgcggtcggtttcggtttcgatttcgattcggagtagcgagtttcggcgggcgttttcggttcgcgtttttcggtcgtttttcgcgtttcgggtcggttttgttcgcggcggcgggcgttgggggtgggggcgtttcgggttgcgagtgcgcggagttcgtcggcgcggttcgtttagtggggtttgttttttttcgagtgcgtcgtcgttttcgtcgcggtcgtagttgtttcgggatcgagcgcgtggaattacggacgcgggtttttcgtcgggcggcggtgtagacgttgtcgtagagtcgggttttcgcgacgtcggtcgggacgttcgttcgttcgcgtttacgtcgggggtcgttttttcgagttagagatgcggtcgtcgtcgcgttcgtcgtcgtgtttttcgcggtcgttgttttatgtcggaagagttgtcgtcgttattattttcggtttttgtttcgttcgttgttattgatagacgcgcgttcgcgtcgtttttcgtttagtcgtagcgcgtacgcgcggttcgcgttcgtcgttatcgttttttggtttcggatacgcgtacgggttcgcgcgtcgtttcgttttggtgcgcgcgttgggttggggttgcggggcggggcggggcggggcggggcgcgcgttcggtttcgtttttcgtttcgggcggcgtcgtttttaggcggcgggttgtggtcgttgttcgcgtttcgggcgttgtgggttcggtttttttcggcgttttagaggtcgcgcgtcgttcggggtttcgattttgcggagagatttgaaggcgtttgtcgtggaagaagtcgttggtcgtaacgtttgggaaattaaaatgttgtttttttattcggtacgtttttgggataaatcgaa

SEQ ID NO: 2892 - DNA, 1296 bp, Artificial Sequence
  chemically treated genomic DNA (Homo sapiens) CpG-island No: 2892
ttcgatttatcccaaaaacgtaccgaataaaaaaacaacattttaatttcccaaacgttacgaccaacgacttcttccacgacaaacgccttcaaatctctccgcaaaatcgaaaccccgaacgacgcgcgacctctaaaacgccgaaaaaaaccgaacccacaacgcccgaaacgcgaacaacgaccacaacccgccgcctaaaaacgacgccgcccgaaacgaaaaacgaaaccgaacgcgcgccccgccccgccccgccccgccccgcaaccccaacccaacgcgcgcaccaaaacgaaacgacgcgcgaacccgtacgcgtatccgaaaccaaaaaacgataacgacgaacgcgaaccgcgcgtacgcgctacgactaaacgaaaaacgacgcgaacgcgcgtctatcaataacaacgaacgaaacaaaaaccgaaaataataacgacgacaactcttccgacataaaacaacgaccgcgaaaaacacgacgacgaacgcgacgacgaccgcatctctaactcgaaaaaacgacccccgacgtaaacgcgaacgaacgaacgtcccgaccgacgtcgcgaaaacccgactctacgacaacgtctacaccgccgcccgacgaaaaacccgcgtccgtaattccacgcgctcgatcccgaaacaactacgaccgcgacgaaaacgacgacgcactcgaaaaaaaacaaaccccactaaacgaaccgcgccgacgaactccgcgcactcgcaacccgaaacgcccccacccccaacgcccgccgccgcgaacaaaaccgacccgaaacgcgaaaaacgaccgaaaaacgcgaaccgaaaacgcccgccgaaactcgctactccgaatcgaaatcgaaaccgaaaccgaccgcgcgccgcctttaacgcatcgaaacgcgactcctacaaaataaaaaactccgcgccgccaacgaaattatttatacgcaaacgactcgcgaaactaaaaacgctcaaaatctaaacttccctccgaaaccgcaactaaaaaaaacgaacgcgcgaaaaaaaaaaaccgcgcgacgcgaaaaccaccctcgaaacgaaaaacgcgaaaaacgaacgaacaaaacgatcccgaaaccacgacgaccacgcgacgaaaacccccgaacgttctaaatccgtcccgaacgattctcgtacgcctcgaaaataaaaacgataaaaacgataaaaacaccgctaaaccgaaaaccacaaaaacaaataatacctatccaaatcgcgtactaaaaccgccccttaaaacaa

SEQ ID NO: 2893 - DNA, 755 bp, Artificial Sequence
  chemically treated genomic DNA (Homo sapiens) CpG-island No: 2893
cgttcgaatttttatacgttgttttcgagggggttattattcgattttgcggatagggatcgatttcgcggtcgtttagttgtgatagtgtcggtcggttcgtttcgcgtatgcgtattgtttttttttcgggttcggtttcgtttttttcgggttgcgcgtttcggatcgagttcgggattggggttagcgtaggcgtagacgtagacgtttagcggcggcgtttttagaacgttgcgttcgggagagtttcggggtcggagtcgcgtgggcgttgggggcggggcgggcgtttattgtttgagtcggatggtagagtcgttttttcgttagtttttagcgttggttcgcgtttttgggtttcgagtttagcgacgcgtaagtttcgtggtcgttagcgtcggttttgttttttcgttgttgattttcgtcgttttacgtcgcggatttagttttcgggttttgcggtcgttgtcggtgggatggggagggtcgcgaatttttgtttttttaggtatttatcgcgtggttgggagggcgttaggaggtcgaggtcggggttgttatgcgttttcggtgttttatttcgtaggtcggttcgtttcgtgggttgtggggtagacgatcgggaagtttcgagatttttagattttcgatcgggatcgaaaaggttttgaatttgtgtagtgatttgttattgagttcgggaggttttggagatttgggtgacggaagaacgtttaaggtcgattgtt

SEQ ID NO: 2894 - DNA, 755 bp, Artificial Sequence
  chemically treated genomic DNA (Homo sapiens) CpG-island No: 2894
aacaatcgaccttaaacgttcttccgtcacccaaatctccaaaacctcccgaactcaataacaaatcactacacaaattcaaaaccttttcgatcccgatcgaaaatctaaaaatctcgaaacttcccgatcgtctaccccacaacccacgaaacgaaccgacctacgaaataaaacaccgaaaacgcataacaaccccgacctcgacctcctaacgccctcccaaccacgcgataaatacctaaaaaaacaaaaattcgcgaccctccccatcccaccgacaacgaccgcaaaacccgaaaactaaatccgcgacgtaaaacgacgaaaatcaacaacgaaaaaacaaaaccgacgctaacgaccacgaaacttacgcgtcgctaaactcgaaacccaaaaacgcgaaccaacgctaaaaactaacgaaaaaacgactctaccatccgactcaaacaataaacgcccgccccgcccccaacgcccacgcgactccgaccccgaaactctcccgaacgcaacgttctaaaaacgccgccgctaaacgtctacgtctacgcctacgctaaccccaatcccgaactcgatccgaaacgcgcaacccgaaaaaaacgaaaccgaacccgaaaaaaaaacaatacgcatacgcgaaacgaaccgaccgacactatcacaactaaacgaccgcgaaatcgatccctatccgcaaaatcgaataataaccccctcgaaaacaacgtataaaaattcgaacg

SEQ ID NO: 2895 - DNA, 755 bp, Artificial Sequence
  chemically treated genomic DNA (Homo sapiens) CpG-island No: 2895
agtagtcggttttgggcgttttttcgttatttaggtttttagaatttttcggatttaatggtaagttattgtataagtttagggttttttcggtttcgatcgaggatttggagatttcggggtttttcggtcgtttgttttatagtttacgaggcggatcgatttgcggggtgaggtatcgggagcgtatggtagtttcggtttcggttttttggcgtttttttagttacgcggtgaatgtttgagaggatagaggttcgcggttttttttattttatcggtagcgatcgtaaagttcgggagttgagttcgcggcgtgaagcggcggaggttagtagcgagggggtagggtcggcgttggcggttacggagtttgcgcgtcgttgggttcggaatttagggacgcgagttagcgttgggagttggcggagagacggttttgttattcggtttaggtagtgggcgttcgtttcgtttttagcgtttacgcgatttcggtttcgaggttttttcgagcgtagcgttttggaagcgtcgtcgttaagcgtttgcgtttgcgtttgcgttgattttagtttcggattcggttcgaggcgcgtagttcggagggggcggggtcgagttcgaagggaaggtagtgcgtatgcgcggggcgagtcggtcggtattgttatagttgagcggtcgcgagatcggtttttgttcgtagggtcgggtagtggttttttcggggatagcgtgtgaggattcgggcg

SEQ ID NO: 2896 - DNA, 755 bp, Artificial Sequence
  chemically treated genomic DNA (Homo sapiens) CpG-island No: 2896
cgcccgaatcctcacacgctatccccgaaaaaaccactacccgaccctacgaacaaaaaccgatctcgcgaccgctcaactataacaataccgaccgactcgccccgcgcatacgcactaccttcccttcgaactcgaccccgccccctccgaactacgcgcctcgaaccgaatccgaaactaaaatcaacgcaaacgcaaacgcaaacgcttaacgacgacgcttccaaaacgctacgctcgaaaaaacctcgaaaccgaaatcgcgtaaacgctaaaaacgaaacgaacgcccactacctaaaccgaataacaaaaccgtctctccgccaactcccaacgctaactcgcgtccctaaattccgaacccaacgacgcgcaaactccgtaaccgccaacgccgaccctaccccctcgctactaacctccgccgcttcacgccgcgaactcaactcccgaactttacgatcgctaccgataaaataaaaaaaaccgcgaacctctatcctctcaaacattcaccgcgtaactaaaaaaacgccaaaaaaccgaaaccgaaactaccatacgctcccgatacctcaccccgcaaatcgatccgcctcgtaaactataaaacaaacgaccgaaaaaccccgaaatctccaaatcctcgatcgaaaccgaaaaaaccctaaacttatacaataacttaccattaaatccgaaaaattctaaaaacctaaataacgaaaaaacgcccaaaaccgactact

SEQ ID NO: 2897 - DNA, 738 bp, Artificial Sequence
  chemically treated genomic DNA (Homo sapiens) CpG-island No: 2897
tagaagattttaaatgcggagtttgtttaagatggcggttacgattacgtcgcgataagacggtttcgagttcggtgtgttcgagtttggagttcgtcggatcgtattaatacggggattttttttttgttagttttaagacggcgttatcgtttttaaaggttatgttcgtcgtcgggatggcggtcgtacgtttttcgatatcgttcgtttttagattatttaaaatggcggcggttgcggggcggtacggggcggggttgcgtcgggggaagggacgcggcgcggggtatgttgggttacgcgcgggttgtcgggaacggggcggagcgcggttgcgtcggcgcgtcgaggggagaggtagtagtcgcgatggtgagcgggcgtgggggaggggcggtcgggtcgggtcggaagtagtaaattgaggttacgttttcgtcgatttttgttttcgtgtttacgtcggttcgtcgtttttaggacgtgttttttatgattcggcgttataagattattatttttacggacgttaaggagtttagtacggtgttcgaattgaagcgtatcgtcgagggtatttttaagcggttttttgacgagtagcggttgtataaggtgggtttcgcgggcgggtcgaggggagcgggtattcggcgtcgggtacggggttgacgtttacgttgttcgcgatgtaaatagtagcggtcggcgacgtttgcgggcgttcgagtcgcg

SEQ ID NO: 2898 - DNA, 738 bp, Artificial Sequence
  chemically treated genomic DNA (Homo sapiens) CpG-island No: 2898
cgcgactcgaacgcccgcaaacgtcgccgaccgctactatttacatcgcgaacaacgtaaacgtcaaccccgtacccgacgccgaatacccgctcccctcgacccgcccgcgaaacccaccttatacaaccgctactcgtcaaaaaaccgcttaaaaataccctcgacgatacgcttcaattcgaacaccgtactaaactccttaacgtccgtaaaaataataatcttataacgccgaatcataaaaaacacgtcctaaaaacgacgaaccgacgtaaacacgaaaacaaaaatcgacgaaaacgtaacctcaatttactacttccgacccgacccgaccgcccctcccccacgcccgctcaccatcgcgactactacctctcccctcgacgcgccgacgcaaccgcgctccgccccgttcccgacaacccgcgcgtaacccaacataccccgcgccgcgtcccttcccccgacgcaaccccgccccgtaccgccccgcaaccgccgccattttaaataatctaaaaacgaacgatatcgaaaaacgtacgaccgccatcccgacgacgaacataacctttaaaaacgataacgccgtcttaaaactaacaaaaaaaaaatccccgtattaatacgatccgacgaactccaaactcgaacacaccgaactcgaaaccgtcttatcgcgacgtaatcgtaaccgccatcttaaacaaactccgcatttaaaatcttcta

SEQ ID NO: 2899 - DNA, 738 bp, Artificial Sequence
  chemically treated genomic DNA (Homo sapiens) CpG-island No: 2899
cgcggttcgggcgttcgtaggcgtcgtcggtcgttattgtttatatcgcggatagcgtaggcgttagtttcgtgttcggcgtcgggtattcgtttttttcggttcgttcgcgggatttattttgtatagtcgttgttcgttaggaggtcgtttgaggatgttttcgacgatgcgttttagttcgaatatcgtgttggattttttggcgttcgtgaagatggtggttttgtggcgtcggattatgaggaatacgttttgggggcggcgggtcggcgtgagtacgaaggtagagatcgacgaggacgtaattttaatttgttgttttcggttcggttcggtcgttttttttttacgttcgtttattatcgcggttgttgttttttttttcgacgcgtcggcgtagtcgcgtttcgtttcgttttcggtagttcgcgcgtggtttagtatgtttcgcgtcgcgttttttttttcggcgtagtttcgtttcgtgtcgtttcgtagtcgtcgttattttaagtgatttggaagcgggcggtatcgaggggcgtgcggtcgttatttcgacggcgggtatggtttttggaggcggtggcgtcgttttgggattggtagaggggaggttttcgtgttggtgcggttcggcgggttttaagttcgggtatatcgagttcggggtcgttttgtcgcggcgtagtcgtggtcgttattttgggtaggtttcgtatttggggttttttg

SEQ ID NO: 2900 - DNA, 738 bp, Artificial Sequence
  chemically treated genomic DNA (Homo sapiens) CpG-island No: 2900
caaaaaaccccaaatacgaaacctacccaaaataacgaccacgactacgccgcgacaaaacgaccccgaactcgatatacccgaacttaaaacccgccgaaccgcaccaacacgaaaacctcccctctaccaatcccaaaacgacgccaccgcctccaaaaaccatacccgccgtcgaaataacgaccgcacgcccctcgataccgcccgcttccaaatcacttaaaataacgacgactacgaaacgacacgaaacgaaactacgccgaaaaaaaaaacgcgacgcgaaacatactaaaccacgcgcgaactaccgaaaacgaaacgaaacgcgactacgccgacgcgtcgaaaaaaaaaacaacaaccgcgataataaacgaacgtaaaaaaaaaacgaccgaaccgaaccgaaaacaacaaattaaaattacgtcctcgtcgatctctaccttcgtactcacgccgacccgccgcccccaaaacgtattcctcataatccgacgccacaaaaccaccatcttcacgaacgccaaaaaatccaacacgatattcgaactaaaacgcatcgtcgaaaacatcctcaaacgacctcctaacgaacaacgactatacaaaataaatcccgcgaacgaaccgaaaaaaacgaatacccgacgccgaacacgaaactaacgcctacgctatccgcgatataaacaataacgaccgacgacgcctacgaacgcccgaaccgcg

SEQ ID NO: 2901 - DNA, 1632 bp, Artificial Sequence
  chemically treated genomic DNA (Homo sapiens) CpG-island No: 2901
gggcggttcgcggggtcggtttcgtagtcgcgatagttcgtgcggtcgtttcggtatttcgggcgcggcgagtacggttaagggtagttcgaacggcgagtgcgggcgcggcgagtcgtagtgtagtttcgcggggttcgagggttcggcgcgggggtttaaggtgtcgttttcgtgtcgcggggcggtttcggggttcgcgtcggggtcggggtcggcggaggaggcgggtagcgaggaggcgggttcggcgggggagtcgcgcggtagttaggttagttttatgtagcgttagttcggcgcgtttttgtagtcgggcgttaataagttttcgttgcggatgttcggtagttagaaggtcgtggagcgcgagtaggagcgcgttaagtcggcgggggtttggattatttattcgtatagcgattttaggtatcgttttcgggagggtcggtcggcgcgagggggttcggggagtcgggcgcgcggggagtcgtttttggagcgtttggggagggcggggcggcgcgtcgggtcggtgatttcggggtttttcggtgatttcgggcgtgttcgggattcgtttcggagtgatttcggcgcgcgaggtttcgtttttgggggggtttttcgggtgatcgcggagcgttttttttttacgtatttcgatatttttcgttttgcggcgcggcgggtggggtgggtcgtagggttagggtttgagcgtagaggggtagagaggacgaatagaggggaacgtgggttttagagaggcggcggagcgggagggaggaggaacgaagggcgttcgggaaggacgcgttttagggaggtcgggggagagggggttaagcggtttttacggcgtttattcgcgtttcgtttgcgaggaggcgcgttcggggtcgcgggtttggaaagcgtgcgggtttttaggttgtgttttcgggagtcgttttattcgagtcgcgggcggtgcgcgtatgcggcggtgggtgtgtagacgtcgttgtggatttagtcggttaatgcgtggaaggttcggagtagggtcggcgcggggttatcgttattgatgtttgcggtcgtggtttttgggttgtgcgtgttgtggtcggagagcgagatcggcgcgtgttttcgtgggttgtgtgtgaataggggttcgtgatcgcggcggggttttcggggcgcgagtttgtggtcggagaggtgtgtttttaggagtgtgtttgcgtggtggtcgcgggcgtgtgcgttttcggtgggtttattttggtgggacgtgtggtttgtgtgtgttgggattaggtggcgggcgtgcgcgtgtacgttcggggtcggtgtgtatcggtgggtagtagtgtgagtcgtaggtaggttttatatacgcgattatggagggatgcgtgtgtgtttgtgtatttacgagtggggtgtgaggtggggtgtggagggtgtaggtggagggtgtaggtggggttcgtcgggttagcgaggtcgggcgcgcgggacgggcgcggttttagtattacggatagcgcgtcggatttgggaagtttgcggttttttcgtttgtttttttttttttaggtttgggcgttttaggatagtttttacggattttggattttt

SEQ ID NO: 2902 - DNA, 1632 bp, Artificial Sequence
  chemically treated genomic DNA (Homo sapiens) CpG-island No: 2902
aaaaatccaaaatccgtaaaaactatcctaaaacgcccaaacctaaaaaaaaaaaaacaaacgaaaaaaccgcaaacttcccaaatccgacgcgctatccgtaatactaaaaccgcgcccgtcccgcgcgcccgacctcgctaacccgacgaaccccacctacaccctccacctacaccctccacaccccacctcacaccccactcgtaaatacacaaacacacacgcatccctccataatcgcgtatataaaacctacctacgactcacactactacccaccgatacacaccgaccccgaacgtacacgcgcacgcccgccacctaatcccaacacacacaaaccacacgtcccaccaaaataaacccaccgaaaacgcacacgcccgcgaccaccacgcaaacacactcctaaaaacacacctctccgaccacaaactcgcgccccgaaaaccccgccgcgatcacgaacccctattcacacacaacccacgaaaacacgcgccgatctcgctctccgaccacaacacgcacaacccaaaaaccacgaccgcaaacatcaataacgataaccccgcgccgaccctactccgaaccttccacgcattaaccgactaaatccacaacgacgtctacacacccaccgccgcatacgcgcaccgcccgcgactcgaataaaacgactcccgaaaacacaacctaaaaacccgcacgctttccaaacccgcgaccccgaacgcgcctcctcgcaaacgaaacgcgaataaacgccgtaaaaaccgcttaaccccctctcccccgacctccctaaaacgcgtccttcccgaacgcccttcgttcctcctccctcccgctccgccgcctctctaaaacccacgttcccctctattcgtcctctctacccctctacgctcaaaccctaaccctacgacccaccccacccgccgcgccgcaaaacgaaaaatatcgaaatacgtaaaaaaaaaacgctccgcgatcacccgaaaaacccccccaaaaacgaaacctcgcgcgccgaaatcactccgaaacgaatcccgaacacgcccgaaatcaccgaaaaaccccgaaatcaccgacccgacgcgccgccccgccctccccaaacgctccaaaaacgactccccgcgcgcccgactccccgaaccccctcgcgccgaccgaccctcccgaaaacgatacctaaaatcgctatacgaataaataatccaaacccccgccgacttaacgcgctcctactcgcgctccacgaccttctaactaccgaacatccgcaacgaaaacttattaacgcccgactacaaaaacgcgccgaactaacgctacataaaactaacctaactaccgcgcgactcccccgccgaacccgcctcctcgctacccgcctcctccgccgaccccgaccccgacgcgaaccccgaaaccgccccgcgacacgaaaacgacaccttaaacccccgcgccgaaccctcgaaccccgcgaaactacactacgactcgccgcgcccgcactcgccgttcgaactacccttaaccgtactcgccgcgcccgaaataccgaaacgaccgcacgaactatcgcgactacgaaaccgaccccgcgaaccgccc

SEQ ID NO: 2903 - DNA, 1632 bp, Artificial Sequence
  chemically treated genomic DNA (Homo sapiens) CpG-island No: 2903
gggggtttagggttcgtgggggttgttttggggcgtttaggtttggaggaggagagataggcgggaaaatcgtaggttttttaggttcggcgcgttgttcgtggtgttgaaatcgcgttcgtttcgcgcgttcggtttcgttagttcggcgggttttatttatattttttatttgtattttttatattttattttatattttattcgtggatatataaatatatacgtatttttttatggtcgcgtgtgtgagatttgtttgcggtttatattattgtttatcggtgtatatcggtttcgggcgtatacgcgtacgttcgttatttggttttaatatatataaattatacgttttattaaaataaatttatcggaggcgtatacgttcgcgattattacgtaaatatatttttggagatatattttttcggttataggttcgcgtttcgggaatttcgtcgcggttacgggtttttgtttatatatagtttacggggatacgcgtcggtttcgtttttcggttatagtacgtatagtttaggaattacgatcgtaaatattagtggcggtggtttcgcgtcggttttgtttcgagttttttacgtattagtcggttggatttatagcggcgtttatatatttatcgtcgtatgcgcgtatcgttcgcggttcgggtggagcggttttcggggatatagtttggggattcgtacgttttttaggttcgcggtttcgggcgcgttttttcgtaggcggggcgcgggtggacgtcgtgggagtcgtttaattttttttttttcggtttttttggggcgcgtttttttcgggcgtttttcgttttttttttttttcgtttcgtcgtttttttggggtttacgtttttttttattcgttttttttgtttttttgcgtttagattttggttttgcggtttattttattcgtcgcgtcgtagggcggaggatgtcggggtgcgtgggaggggggcgtttcgcggttattcggggagtttttttagaggcggagtttcgcgcgtcggggttatttcggggcgggtttcggatacgttcgaggttatcgaggagtttcgaggttatcggttcggcgcgtcgtttcgttttttttaggcgttttaaggacggtttttcgcgcgttcggtttttcgggttttttcgcgtcgatcggttttttcggaggcggtatttgaagtcgttgtacgggtggatgatttaggttttcgtcgatttgacgcgtttttgttcgcgttttacggttttttggttgtcgaatattcgtagcgagaatttgttgacgttcggttgtaggagcgcgtcgaattggcgttgtatgaagttggtttggttgtcgcgcggttttttcgtcgggttcgttttttcgttgttcgtttttttcgtcggtttcggtttcggcgcgggtttcgaggtcgtttcgcggtacgagaacgatattttgggttttcgcgtcgggttttcgggtttcgcggggttgtattgcggttcgtcgcgttcgtattcgtcgttcgggttgtttttggtcgtgttcgtcgcgttcggggtgtcggggcggtcgtacgagttgtcgcggttgcggagtcggtttcgcgggtcgttt

SEQ ID NO: 2904 - DNA, 1632 bp, Artificial Sequence
  chemically treated genomic DNA (Homo sapiens) CpG-island No: 2904
aaacgacccgcgaaaccgactccgcaaccgcgacaactcgtacgaccgccccgacaccccgaacgcgacgaacacgaccaaaaacaacccgaacgacgaatacgaacgcgacgaaccgcaatacaaccccgcgaaacccgaaaacccgacgcgaaaacccaaaatatcgttctcgtaccgcgaaacgacctcgaaacccgcgccgaaaccgaaaccgacgaaaaaaacgaacaacgaaaaaacgaacccgacgaaaaaaccgcgcgacaaccaaaccaacttcatacaacgccaattcgacgcgctcctacaaccgaacgtcaacaaattctcgctacgaatattcgacaaccaaaaaaccgtaaaacgcgaacaaaaacgcgtcaaatcgacgaaaacctaaatcatccacccgtacaacgacttcaaataccgcctccgaaaaaaccgatcgacgcgaaaaaacccgaaaaaccgaacgcgcgaaaaaccgtccttaaaacgcctaaaaaaaacgaaacgacgcgccgaaccgataacctcgaaactcctcgataacctcgaacgtatccgaaacccgccccgaaataaccccgacgcgcgaaactccgcctctaaaaaaactccccgaataaccgcgaaacgcccccctcccacgcaccccgacatcctccgccctacgacgcgacgaataaaataaaccgcaaaaccaaaatctaaacgcaaaaaaacaaaaaaaacgaataaaaaaaaacgtaaaccccaaaaaaacgacgaaacgaaaaaaaaaaaaaacgaaaaacgcccgaaaaaaacgcgccccaaaaaaaccgaaaaaaaaaaaattaaacgactcccacgacgtccacccgcgccccgcctacgaaaaaacgcgcccgaaaccgcgaacctaaaaaacgtacgaatccccaaactatatccccgaaaaccgctccacccgaaccgcgaacgatacgcgcatacgacgataaatatataaacgccgctataaatccaaccgactaatacgtaaaaaactcgaaacaaaaccgacgcgaaaccaccgccactaatatttacgatcgtaattcctaaactatacgtactataaccgaaaaacgaaaccgacgcgtatccccgtaaactatatataaacaaaaacccgtaaccgcgacgaaattcccgaaacgcgaacctataaccgaaaaaatatatctccaaaaatatatttacgtaataatcgcgaacgtatacgcctccgataaatttattttaataaaacgtataatttatatatattaaaaccaaataacgaacgtacgcgtatacgcccgaaaccgatatacaccgataaacaataatataaaccgcaaacaaatctcacacacgcgaccataaaaaaatacgtatatatttatatatccacgaataaaatataaaataaaatataaaaaatacaaataaaaaatataaataaaacccgccgaactaacgaaaccgaacgcgcgaaacgaacgcgatttcaacaccacgaacaacgcgccgaacctaaaaaacctacgattttcccgcctatctctcctcctccaaacctaaacgccccaaaacaacccccacgaaccctaaaccccc

SEQ ID NO: 2905 - DNA, 531 bp, Artificial Sequence
  chemically treated genomic DNA (Homo sapiens) CpG-island No: 2905
ttttttttgcgtttttggcgttttgtttcggttttttttttttttttttttttttttagtgcgtttttcgtttcgggcgagaatacgtttttcgtcggcgtgtttagattcgttttcgttttcggagttttcggagttttcggcgtttcgattagttcgggtttgcgtttttaagggtcggcggcggggggcggggtttcggcgtttcgttttgttcgtttttttttttgacgtttttttttttttttttagtttttttatcgttttttttcgtcgtcgtttgggtcggtttcgcgtttttttcgcggttttcgttcgttcgtttgttcgtcgtttttatggcgttcggggttttcgttgtacggggttattaggattttcggcgtttttttttttttttcgttttgttttttttttcgtcgcgcggattcgggcgttttcggcgtttagtttttgagttcgcgtttttaggtcggcggggggggaggggaagagaggggattttgggattttcgttttttttattcggtt

SEQ ID NO: 2906 - DNA, 531 bp, Artificial Sequence
  chemically treated genomic DNA (Homo sapiens) CpG-island No: 2906
aaccgaataaaaaaaacgaaaatcccaaaatcccctctcttcccctccccccccgccgacctaaaaacgcgaactcaaaaactaaacgccgaaaacgcccgaatccgcgcgacgaaaaaaaaaacaaaacgaaaaaaaaaaaaaaacgccgaaaatcctaataaccccgtacaacgaaaaccccgaacgccataaaaacgacgaacaaacgaacgaacgaaaaccgcgaaaaaaacgcgaaaccgacccaaacgacgacgaaaaaaaacgataaaaaaactaaaaaaaaaaaaaaaaacgtcaaaaaaaaaaacgaacaaaacgaaacgccgaaaccccgccccccgccgccgacccttaaaaacgcaaacccgaactaatcgaaacgccgaaaactccgaaaactccgaaaacgaaaacgaatctaaacacgccgacgaaaaacgtattctcgcccgaaacgaaaaacgcactaaaaaaaaaaaaaaaaaaaaaaaaaaccgaaacaaaacgccaaaaacgcaaaaaaaa

SEQ ID NO: 2907 - DNA, 531 bp, Artificial Sequence
  chemically treated genomic DNA (Homo sapiens) CpG-island No: 2907
ggtcgggtggggggggcgggggttttagggtttttttttttttttttttttttcgtcggtttggggacgcgagtttaaaagttgggcgtcgagaacgttcgggttcgcgcggcgggagagggggtagggcgggggaggggaagggacgtcgagggttttagtggtttcgtgtagcggggatttcgggcgttatgggggcggcgggtaggcgggcgggcgggggtcgcggagggggcgcggagtcggtttaagcggcggcggagggaggcggtggaggggttggggagggaggaagggacgttagggggaggggcgggtagggcggggcgtcgggatttcgtttttcgtcgtcggtttttaaaggcgtaggttcgggttggtcggggcgtcgggggtttcgggggtttcgggggcggaggcgggtttgggtacgtcggcggggagcgtgttttcgttcgagacgagaggcgtattggagaggagagaaggggagagagaggtcggggtagagcgttagagacgtagagagag

SEQ ID NO: 2908 - DNA, 531 bp, Artificial Sequence
  chemically treated genomic DNA (Homo sapiens) CpG-island No: 2908
ctctctctacgtctctaacgctctaccccgacctctctctccccttctctcctctccaatacgcctctcgtctcgaacgaaaacacgctccccgccgacgtacccaaacccgcctccgcccccgaaacccccgaaacccccgacgccccgaccaacccgaacctacgcctttaaaaaccgacgacgaaaaacgaaatcccgacgccccgccctacccgcccctccccctaacgtcccttcctccctccccaacccctccaccgcctccctccgccgccgcttaaaccgactccgcgccccctccgcgacccccgcccgcccgcctacccgccgcccccataacgcccgaaatccccgctacacgaaaccactaaaaccctcgacgtcccttcccctcccccgccctaccccctctcccgccgcgcgaacccgaacgttctcgacgcccaacttttaaactcgcgtccccaaaccgacgaaaaaaaaaaaaaaaaaaaaaaaccctaaaacccccgccccccccacccgacc

SEQ ID NO: 2909 - DNA, 776 bp, Artificial Sequence
  chemically treated genomic DNA (Homo sapiens) CpG-island No: 2909
ttcgcggtcgagtttatttcggcggtatttttgaaatcggtttaggagtcgtcgttaggggtttcgttagagtattcgtaggattcgatcgaagtttttttttttttttatagttgcgacgattgcggtaggagttttcggttggagcgttttttgcgggtttattagcggtagtatatcggggagcggttttttatttgcgtcgagtgcgggaagaatttcggtaagaagacgtatttggtggcgtattcgcgcgtgtatttcggcgagcggtttttcgtttgcgaggagtgcggtcgtcgttttttttagggtagttatttggcggcgtatcggcgcgattacgttttcgatcggtttttcgtgtgtttcgattgcggtaaggtttttcgttataaattttatttggcggcgtatcggcgtatttatatcggcgagaagttttacgtttgtttcgattgcggtaaagtttttagttagaagtttaatttggtgtcgtatcggcgtatttatacgggcgagcggttttacgtttgtttcgattgcgatcgtagttttagttagaagtttaattttattatttatcgtaagagttatattcgggacggcgttttttgttgtgttatttgtggttagattttcgacgacgaggagagatttttggtttattagaagaagtacgatgtttgagacggtgggcggggtcgtgttggttgagagagggttggggtttttcgtggtgggagtcgtagtgggttgggggtgtttgtttagtg

SEQ ID NO: 2910 - DNA, 776 bp, Artificial Sequence
  chemically treated genomic DNA (Homo sapiens) CpG-island No: 2910
cactaaacaaacacccccaacccactacgactcccaccacgaaaaaccccaaccctctctcaaccaacacgaccccgcccaccgtctcaaacatcgtacttcttctaataaaccaaaaatctctcctcgtcgtcgaaaatctaaccacaaataacacaacaaaaaacgccgtcccgaatataactcttacgataaataataaaattaaacttctaactaaaactacgatcgcaatcgaaacaaacgtaaaaccgctcgcccgtataaatacgccgatacgacaccaaattaaacttctaactaaaaactttaccgcaatcgaaacaaacgtaaaacttctcgccgatataaatacgccgatacgccgccaaataaaatttataacgaaaaaccttaccgcaatcgaaacacacgaaaaaccgatcgaaaacgtaatcgcgccgatacgccgccaaataactaccctaaaaaaaacgacgaccgcactcctcgcaaacgaaaaaccgctcgccgaaatacacgcgcgaatacgccaccaaatacgtcttcttaccgaaattcttcccgcactcgacgcaaataaaaaaccgctccccgatatactaccgctaataaacccgcaaaaaacgctccaaccgaaaactcctaccgcaatcgtcgcaactataaaaaaaaaaaaaaacttcgatcgaatcctacgaatactctaacgaaacccctaacgacgactcctaaaccgatttcaaaaataccgccgaaataaactcgaccgcgaa

SEQ ID NO: 2911 - DNA, 776 bp, Artificial Sequence
  chemically treated genomic DNA (Homo sapiens) CpG-island No: 2911
tattaggtaggtatttttagtttattgcgatttttattacgaaggattttagtttttttttagttaatacggtttcgtttatcgttttagatatcgtgttttttttggtgggttaggagttttttttcgtcgtcgaaggtttggttatagatggtatagtagaaggcgtcgtttcggatgtggtttttgcggtgggtgatgaggttggatttttggttgaagttgcggtcgtagtcgggataggcgtagggtcgttcgttcgtgtggatgcgtcggtgcgatattaggttggatttttggttgaaggttttgtcgtagtcggggtagacgtagggtttttcgtcggtgtggatgcgtcggtgcgtcgttaggtagggtttgtggcggaaggttttgtcgtagtcgggatatacgaagggtcgatcgggggcgtggtcgcgtcgatgcgtcgttagatggttgttttgggagaagcggcggtcgtatttttcgtaggcgaagggtcgttcgtcggagtgtacgcgcgagtgcgttattaggtgcgtttttttgtcgaagtttttttcgtattcggcgtaggtgaagggtcgtttttcggtgtgttgtcgttggtgggttcgtaggaagcgttttagtcggaagtttttgtcgtagtcgtcgtagttgtagagggaggggggggtttcgatcgggttttgcgggtgttttggcggggtttttggcggcggtttttgggtcggttttagaggtatcgtcggggtgggttcggtcgcgga

SEQ ID NO: 2912 - DNA, 776 bp, Artificial Sequence
  chemically treated genomic DNA (Homo sapiens) CpG-island No: 2912
tccgcgaccgaacccaccccgacgatacctctaaaaccgacccaaaaaccgccgccaaaaaccccgccaaaacacccgcaaaacccgatcgaaacccccccctccctctacaactacgacgactacgacaaaaacttccgactaaaacgcttcctacgaacccaccaacgacaacacaccgaaaaacgacccttcacctacgccgaatacgaaaaaaacttcgacaaaaaaacgcacctaataacgcactcgcgcgtacactccgacgaacgacccttcgcctacgaaaaatacgaccgccgcttctcccaaaacaaccatctaacgacgcatcgacgcgaccacgcccccgatcgacccttcgtatatcccgactacgacaaaaccttccgccacaaaccctacctaacgacgcaccgacgcatccacaccgacgaaaaaccctacgtctaccccgactacgacaaaaccttcaaccaaaaatccaacctaatatcgcaccgacgcatccacacgaacgaacgaccctacgcctatcccgactacgaccgcaacttcaaccaaaaatccaacctcatcacccaccgcaaaaaccacatccgaaacgacgccttctactataccatctataaccaaaccttcgacgacgaaaaaaaactcctaacccaccaaaaaaaacacgatatctaaaacgataaacgaaaccgtattaactaaaaaaaaactaaaatccttcgtaataaaaatcgcaataaactaaaaatacctacctaata

SEQ ID NO: 2913 - DNA, 640 bp, Artificial Sequence
  chemically treated genomic DNA (Homo sapiens) CpG-island No: 2913
gtttttttagtttttttttaatttagaagtttggttaaacgtgtcgttttttttataacgttaacggagttggaacgtagcgttcggaggataattggttacggggaggaggggagaatttcgcggttcggagtacggcggttgaggtttaatttagttcgcgtttaattttattcggtgttaggaaggcgtgtggatttaaagttttaggtcgcggtgttaggttcggaggagtagagtcgcgcgtggttgggggtaggtcgtaaataaatcgacgggaggagggggaaggggtaacggcgaggcgggtggggtaaaataaaaggtaggatttcgttttaatttttcggcgttagttcgtagtcggttttattttatcgaggattagatgttgttttcggcgcggcgttttcgttcgggtcggaatatcgaaggttttaatatttttggagttcggagtttataaggttatcggtttcgcgattttcgttttatagcgttttatttgaattcgtaatttgggtttcgggcgtcgcggtcgggcgcgtttagttcggtttttttgttgaagagtttttggaatagcgtaggggttatgttagttacggttaggtaggggtcgtttcgttgggcgtttgtt

SEQ ID NO: 2914 - DNA, 640 bp, Artificial Sequence
  chemically treated genomic DNA (Homo sapiens) CpG-island No: 2914
aacaaacgcccaacgaaacgacccctacctaaccgtaactaacataacccctacgctattccaaaaactcttcaacaaaaaaaccgaactaaacgcgcccgaccgcgacgcccgaaacccaaattacgaattcaaataaaacgctataaaacgaaaatcgcgaaaccgataaccttataaactccgaactccaaaaatattaaaaccttcgatattccgacccgaacgaaaacgccgcgccgaaaacaacatctaatcctcgataaaataaaaccgactacgaactaacgccgaaaaattaaaacgaaatcctaccttttattttaccccacccgcctcgccgttaccccttccccctcctcccgtcgatttatttacgacctacccccaaccacgcgcgactctactcctccgaacctaacaccgcgacctaaaactttaaatccacacgccttcctaacaccgaataaaattaaacgcgaactaaattaaacctcaaccgccgtactccgaaccgcgaaattctcccctcctccccgtaaccaattatcctccgaacgctacgttccaactccgttaacgttataaaaaaaacgacacgtttaaccaaacttctaaattaaaaaaaaactaaaaaaac

SEQ ID NO: 2915 - DNA, 640 bp, Artificial Sequence
  chemically treated genomic DNA (Homo sapiens) CpG-island No: 2915
agtaagcgtttagcggagcgatttttgtttggtcgtggttagtatggtttttacgttgttttagaagttttttagtaagaggatcgggttgggcgcgttcggtcgcgacgttcgggatttagattgcgggtttaggtagggcgttgtggggcgggggtcgcggagtcgatggttttgtgggtttcgggttttaggggtgttggggttttcggtgtttcgattcgagcggaagcgtcgcgtcgagagtagtatttggttttcggtggggtggagtcggttgcgggttagcgtcgaagggttggagcgaggttttattttttattttattttattcgtttcgtcgttgtttttttttttttttttcgtcggtttgtttacgatttgtttttagttacgcgcgattttgttttttcggatttagtatcgcggtttgagattttgggtttatacgtttttttggtatcgagtagagttgggcgcgggttggattggattttagtcgtcgtatttcgggtcgcgaagtttttttttttttttcgtgattagttgtttttcgggcgttgcgttttagtttcgttggcgttgtggagagagcggtacgtttggttaagtttttgagttgagagaaggttggaggagt

SEQ ID NO: 2916 - DNA, 640 bp, Artificial Sequence
  chemically treated genomic DNA (Homo sapiens) CpG-island No: 2916
actcctccaaccttctctcaactcaaaaacttaaccaaacgtaccgctctctccacaacgccaacgaaactaaaacgcaacgcccgaaaaacaactaatcacgaaaaaaaaaaaaaaacttcgcgacccgaaatacgacgactaaaatccaatccaacccgcgcccaactctactcgataccaaaaaaacgtataaacccaaaatctcaaaccgcgatactaaatccgaaaaaacaaaatcgcgcgtaactaaaaacaaatcgtaaacaaaccgacgaaaaaaaaaaaaaaaaacaacgacgaaacgaataaaataaaataaaaaataaaacctcgctccaacccttcgacgctaacccgcaaccgactccaccccaccgaaaaccaaatactactctcgacgcgacgcttccgctcgaatcgaaacaccgaaaaccccaacacccctaaaacccgaaacccacaaaaccatcgactccgcgacccccgccccacaacgccctacctaaacccgcaatctaaatcccgaacgtcgcgaccgaacgcgcccaacccgatcctcttactaaaaaacttctaaaacaacgtaaaaaccatactaaccacgaccaaacaaaaatcgctccgctaaacgcttact

SEQ ID NO: 2917 - DNA, 660 bp, Artificial Sequence
  chemically treated genomic DNA (Homo sapiens) CpG-island No: 2917
cggttttacggtttcgcgttttttatttagttttcgattttaataattcgtattttttttttagtatttattttcgcggttcgcgtttttttttcgggtttcgtttttaatgtttcgcgtttttttttcgggtttgttagtatttaaatattcgggacggcggtggtacgtattttcgggtttacgttatgggagaaggaatgtacgacgtcgtcgggtcgtacgttaaacgttatcgtcgtgggttcggatatcgttttcgtcggttttagcgttacggtttttaggagtagcgcggtttataagttcgcgtcgacgtcgttttatttttcgttgggcgtcgttatgttggattagggtttttagggtaggggcgggtagacggggcgcggcgagggatacgtggagcgttcgtcggaggttacgtcggcgtcggttgtttacgtgattcggtacgtttcgttttgtttatcgttcggggttattattttgggggcgggattttgtcgagggggcgggatttttgtcgagggggcggggtcgtcgagggggcggggtcgtcgagggggcggtttcgtattttagggattttgcgtagttcggcgatttttggagggttttttaggtggtaatggagttcgttttggggttttagggttt

SEQ ID NO: 2918 - DNA, 660 bp, Artificial Sequence
  chemically treated genomic DNA (Homo sapiens) CpG-island No: 2918
aaaccctaaaaccccaaaacgaactccattaccacctaaaaaaccctccaaaaatcgccgaactacgcaaaatccctaaaatacgaaaccgccccctcgacgaccccgccccctcgacgaccccgccccctcgacaaaaatcccgccccctcgacaaaatcccgcccccaaaataataaccccgaacgataaacaaaacgaaacgtaccgaatcacgtaaacaaccgacgccgacgtaacctccgacgaacgctccacgtatccctcgccgcgccccgtctacccgcccctaccctaaaaaccctaatccaacataacgacgcccaacgaaaaataaaacgacgtcgacgcgaacttataaaccgcgctactcctaaaaaccgtaacgctaaaaccgacgaaaacgatatccgaacccacgacgataacgtttaacgtacgacccgacgacgtcgtacattccttctcccataacgtaaacccgaaaatacgtaccaccgccgtcccgaatatttaaatactaacaaacccgaaaaaaaaacgcgaaacattaaaaacgaaacccgaaaaaaaaacgcgaaccgcgaaaataaatactaaaaaaaaaatacgaattattaaaatcgaaaactaaataaaaaacgcgaaaccgtaaaaccg

SEQ ID NO: 2919 - DNA, 660 bp, Artificial Sequence
  chemically treated genomic DNA (Homo sapiens) CpG-island No: 2919
ggattttgagattttaaaacgaattttattattatttgagggattttttaaggatcgtcgggttacgtagggtttttagggtacgaggtcgttttttcggcggtttcgttttttcggcggtttcgttttttcggtaaaagtttcgttttttcgataaagtttcgtttttaagatggtggtttcgggcggtggatagggcggggcgtgtcgggttacgtggatagtcgacgtcgacgtggttttcggcggacgttttacgtgtttttcgtcgcgtttcgtttattcgtttttgttttgaggattttagtttaatatggcggcgtttagcggagggtggaacggcgtcggcgcgagtttgtgggtcgcgttgtttttaggggtcgtggcgttgaggtcggcggaggcggtgttcgagtttacgacggtggcgtttgacgtgcggttcggcggcgtcgtgtatttttttttttataacgtgggttcgggggtacgtgttatcgtcgtttcggatatttgagtgttggtaggttcggggagggggcgcggagtattgggggcggggttcgaggagggggcgcggatcgcggaggtgggtattgaagaaggggtgcggattgttagggtcggaggttgagtggggggcgcgggatcgtgaggtcg

SEQ ID NO: 2920 - DNA, 660 bp, Artificial Sequence
  chemically treated genomic DNA (Homo sapiens) CpG-island No: 2920
cgacctcacgatcccgcgccccccactcaacctccgaccctaacaatccgcaccccttcttcaatacccacctccgcgatccgcgccccctcctcgaaccccgcccccaatactccgcgccccctccccgaacctaccaacactcaaatatccgaaacgacgataacacgtacccccgaacccacgttataaaaaaaaaaatacacgacgccgccgaaccgcacgtcaaacgccaccgtcgtaaactcgaacaccgcctccgccgacctcaacgccacgacccctaaaaacaacgcgacccacaaactcgcgccgacgccgttccaccctccgctaaacgccgccatattaaactaaaatcctcaaaacaaaaacgaataaacgaaacgcgacgaaaaacacgtaaaacgtccgccgaaaaccacgtcgacgtcgactatccacgtaacccgacacgccccgccctatccaccgcccgaaaccaccatcttaaaaacgaaactttatcgaaaaaacgaaacttttaccgaaaaaacgaaaccgccgaaaaaacgaaaccgccgaaaaaacgacctcgtaccctaaaaaccctacgtaacccgacgatccttaaaaaatccctcaaataataataaaattcgttttaaaatctcaaaatcc

SEQ ID NO: 2921 - DNA, 558 bp, Artificial Sequence
  chemically treated genomic DNA (Homo sapiens) CpG-island No: 2921
gcgtggtgtttatcggagtgggggtgtttattgtatttcgcgtggtggttatcggagtgggggtgtttattttatttcgcgtggtgtttatcggagtggggtgtttattttattttacgcggtgtttatcggagtgggggtgtttattttatttcgcgtggtgtttatcggagtgggggtgtttattttatttcgcgtggtgtttatcggagtggggtgtttattttattttacgcggtgtttatcggagtggggtgtttattttattttacgcggtgtttatcggagtgggggtgtttattttatttcgcgtggtgtttatcggagtggggtgtttattttatttcgcgtggtgtttatcggagtggggtgtttattttattttacgcggtgtttatcggagtgggggtgtttattttatttcgcgtggtgtttatcggagtggggtgtttattttatttcgcgtggtgtttatcggagtggggtgtttattttattttacgcggtgtttatcggagtgggggtgtttattttatttcgcgtagtgttgattagttt

SEQ ID NO: 2922 - DNA, 558 bp, Artificial Sequence
  chemically treated genomic DNA (Homo sapiens) CpG-island No: 2922
aaactaatcaacactacgcgaaataaaataaacacccccactccgataaacaccgcgtaaaataaaataaacaccccactccgataaacaccacgcgaaataaaataaacaccccactccgataaacaccacgcgaaataaaataaacacccccactccgataaacaccgcgtaaaataaaataaacaccccactccgataaacaccacgcgaaataaaataaacaccccactccgataaacaccacgcgaaataaaataaacacccccactccgataaacaccgcgtaaaataaaataaacaccccactccgataaacaccgcgtaaaataaaataaacaccccactccgataaacaccacgcgaaataaaataaacacccccactccgataaacaccacgcgaaataaaataaacacccccactccgataaacaccgcgtaaaataaaataaacaccccactccgataaacaccacgcgaaataaaataaacacccccactccgataaccaccacgcgaaatacaataaacacccccactccgataaacaccacgc

SEQ ID NO: 2923 - DNA, 558 bp, Artificial Sequence
  chemically treated genomic DNA (Homo sapiens) CpG-island No: 2923
gaattgattaatattgcgcgggataaggtggatatttttatttcgataaatatcgcgtgggataaggtggatattttatttcgataaatattacgcgggataaggtggatattttatttcgataaatattacgcgggataaggtggatatttttatttcgataaatatcgcgtgggataaggtggatattttatttcgataaatattacgcgggataaggtggatattttatttcgataaatattacgcgggataaggtggatatttttatttcgataaatatcgcgtgggataaggtggatattttatttcgataaatatcgcgtgggataaggtggatattttatttcgataaatattacgcgggataaggtggatatttttatttcgataaatattacgcgggataaggtggatatttttatttcgataaatatcgcgtgggataaggtggatattttatttcgataaatattacgcgggataaggtggatatttttatttcgataattattacgcgggatatagtggatatttttatttcgataaatattacgt

SEQ ID NO: 2924 - DNA, 558 bp, Artificial Sequence
  chemically treated genomic DNA (Homo sapiens) CpG-island No: 2924
acgtaatatttatcgaaataaaaatatccactatatcccgcgtaataattatcgaaataaaaatatccaccttatcccgcgtaatatttatcgaaataaaatatccaccttatcccacgcgatatttatcgaaataaaaatatccaccttatcccgcgtaatatttatcgaaataaaaatatccaccttatcccgcgtaatatttatcgaaataaaatatccaccttatcccacgcgatatttatcgaaataaaatatccaccttatcccacgcgatatttatcgaaataaaaatatccaccttatcccgcgtaatatttatcgaaataaaatatccaccttatcccgcgtaatatttatcgaaataaaatatccaccttatcccacgcgatatttatcgaaataaaaatatccaccttatcccgcgtaatatttatcgaaataaaatatccaccttatcccgcgtaatatttatcgaaataaaatatccaccttatcccacgcgatatttatcgaaataaaaatatccaccttatcccgcgcaatattaatcaattc

SEQ ID NO: 2925 - DNA, 552 bp, Artificial Sequence
  chemically treated genomic DNA (Homo sapiens) CpG-island No: 2925
gggatcgcggggcgcggcgcggtgcggggggcgcggcgcgggggggcggcggcgggtgggggggtagtttcggcgttcgggaggtggtaaagtgagtttggatttttggcgcggttttttcgttttttttttttttttatttcggcgaggtttgtcgttcggttttttttcgttttatcgcgattaaaaaatacggtttaattaaatattcgtggttgtgacgttggcgagagaagttgttagcgggtggggggtggggggaaagaagaggaaaatcgagtcggcggttgcggtcgggtatcgtatggcgttagagaatttcggcggcgagcgggatttgcgtttgggtcgtcgttttttcgttcgcggtttcgggatcgttattttgaaaaggagtttcgaggtttggcgttcggcgcgcgatcgggatttcgcgtttagtttcggggattcggtcggcgttttttattcgcgagcggttcgcgagttatttttaggtttcgggaaatttttaagagggtttggggggtggggggagtaaaaaggggaggg

SEQ ID NO: 2926 - DNA, 552 bp, Artificial Sequence
  chemically treated genomic DNA (Homo sapiens) CpG-island No: 2926
ccctcccctttttactccccccaccccccaaaccctcttaaaaatttcccgaaacctaaaaataactcgcgaaccgctcgcgaataaaaaacgccgaccgaatccccgaaactaaacgcgaaatcccgatcgcgcgccgaacgccaaacctcgaaactccttttcaaaataacgatcccgaaaccgcgaacgaaaaaacgacgacccaaacgcaaatcccgctcgccgccgaaattctctaacgccatacgatacccgaccgcaaccgccgactcgattttcctcttctttccccccaccccccacccgctaacaacttctctcgccaacgtcacaaccacgaatatttaattaaaccgtattttttaatcgcgataaaacgaaaaaaaaccgaacgacaaacctcgccgaaataaaaaaaaaaaaaaaacgaaaaaaccgcgccaaaaatccaaactcactttaccacctcccgaacgccgaaactacccccccacccgccgccgcccccccgcgccgcgccccccgcaccgcgccgcgccccgcgatccc

SEQ ID NO: 2927 - DNA, 552 bp, Artificial Sequence
  chemically treated genomic DNA (Homo sapiens) CpG-island No: 2927
tttttttttttttattttttttattttttagatttttttgaaagtttttcggggtttgagagtggttcgcgggtcgttcgcgggtggggggcgtcggtcgggttttcggagttggacgcggggtttcgatcgcgcgtcgggcgttaggtttcgggatttttttttaaagtaacggtttcgggatcgcgggcggggaggcggcggtttaggcgtaggtttcgttcgtcgtcgaagttttttagcgttatacgatgttcggtcgtagtcgtcggttcggttttttttttttttttttttattttttattcgttgatagtttttttcgttaacgttatagttacggatatttaattagatcgtattttttaatcgcgatggggcgagaaggaatcgggcggtaggtttcgtcgagatggggagggggaggggacgggggggtcgcgttaagagtttaaatttattttgttatttttcggacgtcgaagttgtttttttattcgtcgtcgttttttcgcgtcgcgtttttcgtatcgcgtcgcgtttcgcgatttt

SEQ ID NO: 2928 - DNA, 552 bp, Artificial Sequence
  chemically treated genomic DNA (Homo sapiens) CpG-island No: 2928
aaaatcgcgaaacgcgacgcgatacgaaaaacgcgacgcgaaaaaacgacgacgaataaaaaaacaacttcgacgtccgaaaaataacaaaataaatttaaactcttaacgcgacccccccgtcccctccccctccccatctcgacgaaacctaccgcccgattccttctcgccccatcgcgattaaaaaatacgatctaattaaatatccgtaactataacgttaacgaaaaaaactatcaacgaataaaaaataaaaaaaaaaaaaaaaaaaaccgaaccgacgactacgaccgaacatcgtataacgctaaaaaacttcgacgacgaacgaaacctacgcctaaaccgccgcctccccgcccgcgatcccgaaaccgttactttaaaaaaaaatcccgaaacctaacgcccgacgcgcgatcgaaaccccgcgtccaactccgaaaacccgaccgacgccccccacccgcgaacgacccgcgaaccactctcaaaccccgaaaaactttcaaaaaaatctaaaaaataaaaaaaataaaaaaaaaaaaa

SEQ ID NO: 2929 - DNA, 637 bp, Artificial Sequence
  chemically treated genomic DNA (Homo sapiens) CpG-island No: 2929
gcggtcgggcggcgggggcggggaaggggcgggcgcggaggcggtgtcgtagttcgagtcggagttcgagtcggatttcgaggcgacgggagtcgaataggagtcgtcgttgaagttatcgtcgggtgtttagcgtcgtcgtcgttttcgagttttttcgcgtttttgttcgcgggcggtcggtgggtagcgggcgttatggtcgcgtcggagtcgttgcggtcgcgtttgtgtcgtttggtgcgcggagagtagggttacggtttttatttgtacggcgagaagggtcgtcgcgggtagtttattcggcgcgtggaattcggttttttcgtcgaggtcgtcgcgttgcgcgttggggatcgtttggtcgaggttaacggcgttaacgtggagggcgagacgtattattaggtgggggttagcgttcgttttcggttcgtcgtttttttttcgagcgcgtttttttggggcgagtaggggtcgtacgggggttcgagggggttttcgcggggaggacgcggacgttgtcgggaggtagcggttcggcgttttcggagtttcggcgtaggaagtttagttttgtacgggggtgggggggggtattttggtagggaggggttcgtattgcggtttttgg

SEQ ID NO: 2930 - DNA, 637 bp, Artificial Sequence
  chemically treated genomic DNA (Homo sapiens) CpG-island No: 2930
ccaaaaaccgcaatacgaacccctccctaccaaaatacccccccccacccccgtacaaaactaaacttcctacgccgaaactccgaaaacgccgaaccgctacctcccgacaacgtccgcgtcctccccgcgaaaaccccctcgaacccccgtacgacccctactcgccccaaaaaaacgcgctcgaaaaaaaaacgacgaaccgaaaacgaacgctaacccccacctaataatacgtctcgccctccacgttaacgccgttaacctcgaccaaacgatccccaacgcgcaacgcgacgacctcgacgaaaaaaccgaattccacgcgccgaataaactacccgcgacgacccttctcgccgtacaaataaaaaccgtaaccctactctccgcgcaccaaacgacacaaacgcgaccgcaacgactccgacgcgaccataacgcccgctacccaccgaccgcccgcgaacaaaaacgcgaaaaaactcgaaaacgacgacgacgctaaacacccgacgataacttcaacgacgactcctattcgactcccgtcgcctcgaaatccgactcgaactccgactcgaactacgacaccgcctccgcgcccgccccttccccgcccccgccgcccgaccgc

SEQ ID NO: 2931 - DNA, 637 bp, Artificial Sequence
  chemically treated genomic DNA (Homo sapiens) CpG-island No: 2931
ttaggagtcgtagtgcgggtttttttttgttaggatgtttttttttattttcgtgtaggattgagttttttgcgtcgggatttcgaaggcgtcgggtcgttgtttttcgataacgttcgcgtttttttcgcgggagttttttcgggttttcgtgcgatttttgttcgttttagggggacgcgttcggggagggggcggcgggtcgggggcgagcgttggtttttatttggtggtgcgtttcgttttttacgttgacgtcgttgatttcgattaggcggtttttagcgcgtagcgcggcggtttcggcgggggaatcgggttttacgcgtcggatgaattgttcgcggcggtttttttcgtcgtgtaggtggaagtcgtagttttgtttttcgcgtattaagcggtataggcgcggtcgtagcggtttcggcgcggttatggcgttcgttgtttatcggtcgttcgcgggtaggggcgcgggggagttcgggggcggcggcggcgttgggtattcggcggtggttttagcggcggtttttgttcggttttcgtcgtttcgggattcggttcgggtttcggttcgggttgcggtatcgttttcgcgttcgtttttttttcgttttcgtcgttcggtcgt

SEQ ID NO: 2932 - DNA, 637 bp, Artificial Sequence
  chemically treated genomic DNA (Homo sapiens) CpG-island No: 2932
acgaccgaacgacgaaaacgaaaaaaaaacgaacgcgaaaacgataccgcaacccgaaccgaaacccgaaccgaatcccgaaacgacgaaaaccgaacaaaaaccgccgctaaaaccaccgccgaatacccaacgccgccgccgcccccgaactcccccgcgcccctacccgcgaacgaccgataaacaacgaacgccataaccgcgccgaaaccgctacgaccgcgcctataccgcttaatacgcgaaaaacaaaactacgacttccacctacacgacgaaaaaaaccgccgcgaacaattcatccgacgcgtaaaacccgattcccccgccgaaaccgccgcgctacgcgctaaaaaccgcctaatcgaaatcaacgacgtcaacgtaaaaaacgaaacgcaccaccaaataaaaaccaacgctcgcccccgacccgccgccccctccccgaacgcgtccccctaaaacgaacaaaaatcgcacgaaaacccgaaaaaactcccgcgaaaaaaacgcgaacgttatcgaaaaacaacgacccgacgccttcgaaatcccgacgcaaaaaactcaatcctacacgaaaataaaaaaaaacatcctaacaaaaaaaaacccgcactacgactcctaa

SEQ ID NO: 2933 - DNA, 948 bp, Artificial Sequence
  chemically treated genomic DNA (Homo sapiens) CpG-island No: 2933
agcggagcggagcgttcgaaatttagtttttgcggatcgtaatttttgggaaaaaggcgtaaggtgggaacgtagggtcgtacgtgggaatcgttcgcggttgtcgggtttgtagtttttgttcgcgtagttgggagtcgtaggaggcggttcgggattttagtttgtagtttttatttcgtttttttttacgttttagttacggcgcggcgttatttgttgtagtttttttttttcggagaggttcgggtttttttttatattttcgcggtttagtttcgggttttaggtttcggtttcgggttagtattttcgcgtttaaggcggttatgtcggatttttgcggattatatatttcggcggtttatgcggtttcgttacgtgatgtaaggatcgtcggttttttcgttagagggcggtatagaattataatttttagtaagtttttaaggcggtttttcgcgtaatgtcgttatcggaagtgcgggtcgcgttttcggcggcgtttcggggttaggggggtgcgttttttttcgcgtcggggcggttcggagcgcggtggcgcggcgcggggtaagtggcggtttttacggggtaagtggcggtttttacggggtagcggtttagagaggcggatttcgtagtgttcgggtttcgggtttttattcgcgtttattgtaattcgatttcggagtttcgagtattttttagttttaagttatggcgggtgcgaacgggtttttgttgtaggcggtttcgtgatagtttttgttttatatgggtagaggagagacggtaaacgtcggggtttttaggatttcgcggcggtagttttaattcgtgtattgagtcgggcggggcgggcggtagcgtttgagtagagagttttttagattaggtttggtgtttttcgggtttttttaggtgtttgtttgcgagttggttagt

SEQ ID NO: 2934 - DNA, 948 bp, Artificial Sequence
  chemically treated genomic DNA (Homo sapiens) CpG-island No: 2934
actaaccaactcgcaaacaaacacctaaaaaaacccgaaaaacaccaaacctaatctaaaaaactctctactcaaacgctaccgcccgccccgcccgactcaatacacgaattaaaactaccgccgcgaaatcctaaaaaccccgacgtttaccgtctctcctctacccatataaaacaaaaactatcacgaaaccgcctacaacaaaaacccgttcgcacccgccataacttaaaactaaaaaatactcgaaactccgaaatcgaattacaataaacgcgaataaaaacccgaaacccgaacactacgaaatccgcctctctaaaccgctaccccgtaaaaaccgccacttaccccgtaaaaaccgccacttaccccgcgccgcgccaccgcgctccgaaccgccccgacgcgaaaaaaaacgcacccccctaaccccgaaacgccgccgaaaacgcgacccgcacttccgataacgacattacgcgaaaaaccgccttaaaaacttactaaaaattataattctataccgccctctaacgaaaaaaccgacgatccttacatcacgtaacgaaaccgcataaaccgccgaaatatataatccgcaaaaatccgacataaccgccttaaacgcgaaaatactaacccgaaaccgaaacctaaaacccgaaactaaaccgcgaaaatataaaaaaaaacccgaacctctccgaaaaaaaaaaactacaacaaataacgccgcgccgtaactaaaacgtaaaaaaaaacgaaataaaaactacaaactaaaatcccgaaccgcctcctacgactcccaactacgcgaacaaaaactacaaacccgacaaccgcgaacgattcccacgtacgaccctacgttcccaccttacgcctttttcccaaaaattacgatccgcaaaaactaaatttcgaacgctccgctccgct

SEQ ID NO: 2935 - DNA, 948 bp, Artificial Sequence
  chemically treated genomic DNA (Homo sapiens) CpG-island No: 2935
gttgattagttcgtaaataggtatttaggaaagttcgggagatattaggtttggtttagagagttttttatttagacgttgtcgttcgtttcgttcgatttagtgtacgggttaggattgtcgtcgcgaagttttgggagtttcgacgtttgtcgttttttttttatttatgtgaagtaggagttgttacggagtcgtttgtagtagagattcgttcgtattcgttatgatttaaaattaagggatgttcggagtttcggagtcgggttgtagtgggcgcgggtgagggttcgggattcggatattgcggggttcgtttttttaggtcgttgtttcgtggggatcgttatttgtttcgtggggatcgttatttatttcgcgtcgcgttatcgcgtttcgggtcgtttcgacgcggagaaaggcgtatttttttggtttcgggacgtcgtcggaagcgcgattcgtattttcggtagcggtattgcgcggagggtcgttttgggagtttgttgggagttgtagttttgtgtcgttttttggcggaaaggtcggcgatttttgtattacgtgacggggtcgtatgggtcgtcgggatgtgtagttcgtaggagttcggtatgatcgttttgagcgcgaggatgttgattcggagtcggagtttgggattcggggttgggtcgcgggggtgtagggaggagttcgggttttttcggagaagagaggttgtagtaggtagcgtcgcgtcgtggttggagcgtgggaggaggcgggataggggttgtaggttggagtttcgggtcgttttttgcggtttttagttgcgcgggtaggggttgtaaattcggtagtcgcgaacggtttttacgtgcggttttgcgtttttattttgcgttttttttttaaagattgcggttcgtaggggttgggtttcgggcgtttcgtttcgtt

SEQ ID NO: 2936 - DNA, 948 bp, Artificial Sequence
  chemically treated genomic DNA (Homo sapiens) CpG-island No: 2936
aacgaaacgaaacgcccgaaacccaacccctacgaaccgcaatctttaaaaaaaaaacgcaaaataaaaacgcaaaaccgcacgtaaaaaccgttcgcgactaccgaatttacaacccctacccgcgcaactaaaaaccgcaaaaaacgacccgaaactccaacctacaacccctatcccgcctcctcccacgctccaaccacgacgcgacgctacctactacaacctctcttctccgaaaaaacccgaactcctccctacacccccgcgacccaaccccgaatcccaaactccgactccgaatcaacatcctcgcgctcaaaacgatcataccgaactcctacgaactacacatcccgacgacccatacgaccccgtcacgtaatacaaaaatcgccgacctttccgccaaaaaacgacacaaaactacaactcccaacaaactcccaaaacgaccctccgcgcaataccgctaccgaaaatacgaatcgcgcttccgacgacgtcccgaaaccaaaaaaatacgcctttctccgcgtcgaaacgacccgaaacgcgataacgcgacgcgaaataaataacgatccccacgaaacaaataacgatccccacgaaacaacgacctaaaaaaacgaaccccgcaatatccgaatcccgaaccctcacccgcgcccactacaacccgactccgaaactccgaacatcccttaattttaaatcataacgaatacgaacgaatctctactacaaacgactccgtaacaactcctacttcacataaataaaaaaaaaacgacaaacgtcgaaactcccaaaacttcgcgacgacaatcctaacccgtacactaaatcgaacgaaacgaacgacaacgtctaaataaaaaactctctaaaccaaacctaatatctcccgaactttcctaaatacctatttacgaactaatcaac

SEQ ID NO: 2937 - DNA, 840 bp, Artificial Sequence
  chemically treated genomic DNA (Homo sapiens) CpG-island No: 2937
tttagttgcgttatttggtcgaagttagtgaagcggcgcgggcggtcgcgtacgaaacgggtttattggcggttagcggtatttagttgggcgaggcgtattagtgtcgtggtcgtcgttagcgttattagtagttatcgcgtttaggtttcgagtcgtagtacgcgttagcgtttttttttgtgttaagtacgggtttcggttacggcgaagtgtacggcgaatagtagtaggtatatttgtggggggcgcggttaggagggcgggagggacgttgtcggggcggggttttgcgagggggcgggacgttgtcggggcggggttttgcgagggggcgggacgttgtcggggcggggttttacgagggggcgggacgttgtcggggcggggttttgcgagggggcgggacgttgcgagggggcggggcgttgcgaggggtgagacgttgtcggggcggggtttcgcgagggggcgggacgttgtcggtgggaggcgcggggtttggtcggggacgggcgtatcgaggtgagtagaggtagcgagaggttcgcgttgaggcggcgtagcgtaaaggggcggacgttgagggcggttagggcgcggtcggtcgtcgggaattcgaggcgtagcgtgacggcggcgtgtagttttacggtcgggttgtagcgcgtgagttttaggaatatagcgcggtttttgcgtagagggtgcgggttagtaggagcgggtggtagggcgggagttgcggggatcgcgtagtgtaggcgtggttgaggggttgtggaagtcgtttaggttagcgggggtcggaggagtgagggtgggtttttggttggtgat

SEQ ID NO: 2938 - DNA, 840 bp, Artificial Sequence
  chemically treated genomic DNA (Homo sapiens) CpG-island No: 2938
atcaccaaccaaaaacccaccctcactcctccgacccccgctaacctaaacgacttccacaacccctcaaccacgcctacactacgcgatccccgcaactcccgccctaccacccgctcctactaacccgcaccctctacgcaaaaaccgcgctatattcctaaaactcacgcgctacaacccgaccgtaaaactacacgccgccgtcacgctacgcctcgaattcccgacgaccgaccgcgccctaaccgccctcaacgtccgcccctttacgctacgccgcctcaacgcgaacctctcgctacctctactcacctcgatacgcccgtccccgaccaaaccccgcgcctcccaccgacaacgtcccgccccctcgcgaaaccccgccccgacaacgtctcacccctcgcaacgccccgccccctcgcaacgtcccgccccctcgcaaaaccccgccccgacaacgtcccgccccctcgtaaaaccccgccccgacaacgtcccgccccctcgcaaaaccccgccccgacaacgtcccgccccctcgcaaaaccccgccccgacaacgtccctcccgccctcctaaccgcgccccccacaaatatacctactactattcgccgtacacttcgccgtaaccgaaacccgtacttaacacaaaaaaaaacgctaacgcgtactacgactcgaaacctaaacgcgataactactaataacgctaacgacgaccacgacactaatacgcctcgcccaactaaataccgctaaccgccaataaacccgtttcgtacgcgaccgcccgcgccgcttcactaacttcgaccaaataacgcaactaaa

SEQ ID NO: 2939 - DNA, 840 bp, Artificial Sequence
  chemically treated genomic DNA (Homo sapiens) CpG-island No: 2939
gttattagttaggagtttatttttattttttcggttttcgttggtttaggcggtttttatagttttttagttacgtttgtattgcgcggttttcgtagttttcgttttgttattcgtttttattgattcgtattttttgcgtaggagtcgcgttgtgtttttggagtttacgcgttatagttcggtcgtggggttgtacgtcgtcgttacgttgcgtttcgagttttcggcggtcggtcgcgttttggtcgtttttagcgttcgtttttttgcgttgcgtcgttttagcgcgggtttttcgttgtttttgtttatttcggtacgttcgttttcggttagatttcgcgttttttatcggtagcgtttcgttttttcgcggggtttcgtttcggtagcgttttatttttcgtagcgtttcgttttttcgtagcgtttcgttttttcgtagggtttcgtttcggtagcgtttcgttttttcgtagggtttcgtttcggtagcgtttcgttttttcgtagggtttcgtttcggtagcgtttcgttttttcgtagggtttcgtttcggtagcgtttttttcgtttttttgatcgcgttttttataggtgtgtttgttgttgttcgtcgtgtatttcgtcgtggtcgaggttcgtatttggtatagggaagggcgttggcgcgtgttgcggttcggagtttgggcgcggtggttgttggtggcgttgacggcggttacggtattggtacgtttcgtttagttgggtgtcgttgatcgttagtggattcgtttcgtgcgcggtcgttcgcgtcgttttattagtttcgattaggtggcgtagttgag

SEQ ID NO: 2940 - DNA, 840 bp, Artificial Sequence
  chemically treated genomic DNA (Homo sapiens) CpG-island No: 2940
ctcaactacgccacctaatcgaaactaataaaacgacgcgaacgaccgcgcacgaaacgaatccactaacgatcaacgacacccaactaaacgaaacgtaccaataccgtaaccgccgtcaacgccaccaacaaccaccgcgcccaaactccgaaccgcaacacgcgccaacgcccttccctataccaaatacgaacctcgaccacgacgaaatacacgacgaacaacaacaaacacacctataaaaaacgcgatcaaaaaaacgaaaaaaacgctaccgaaacgaaaccctacgaaaaaacgaaacgctaccgaaacgaaaccctacgaaaaaacgaaacgctaccgaaacgaaaccctacgaaaaaacgaaacgctaccgaaacgaaaccctacgaaaaaacgaaacgctacgaaaaaacgaaacgctacgaaaaataaaacgctaccgaaacgaaaccccgcgaaaaaacgaaacgctaccgataaaaaacgcgaaatctaaccgaaaacgaacgtaccgaaataaacaaaaacaacgaaaaacccgcgctaaaacgacgcaacgcaaaaaaacgaacgctaaaaacgaccaaaacgcgaccgaccgccgaaaactcgaaacgcaacgtaacgacgacgtacaaccccacgaccgaactataacgcgtaaactccaaaaacacaacgcgactcctacgcaaaaaatacgaatcaataaaaacgaataacaaaacgaaaactacgaaaaccgcgcaatacaaacgtaactaaaaaactataaaaaccgcctaaaccaacgaaaaccgaaaaaataaaaataaactcctaactaataac

SEQ ID NO: 2941 - DNA, 916 bp, Artificial Sequence
  chemically treated genomic DNA (Homo sapiens) CpG-island No: 2941
ggtttcggtttcggtttcgtttttattttcgttttcgcggaattttaggttcgcgcgtgcgtattggtagtagggaatttttagtttcgtcgtagagagcgggagggggcgtgagaggggagtttcgtgcgcgtttagtcggtttcgcgtgcgttgttaggacgatcgggcggggtcgcggggtcgtcggtcgtttattgcgtttgcgcgggggtgttcgttatttgcgtcggggttttttcgtcgcgcgttagtagaagaggggatgtcgcgtttagcgcgtatgcgtcggttttattcgatatttttcgtttttcgtttttaatttatttattttgagggtcggggaatttttattcgtcgtagtgcgtatgggggcggggcggggaaatcggtttaaatcggagtggggtttgtcgaggaggtggcgggggagggagcgagagcggggttttttcgaggtttttatttcggttttcgtcgttgttttagtaatcgggcgcgcgggtcgtagtgcgcgggcggcggcggtttcggggaagtcgggtggttttgcgtttgcgcggggtttcgcgtttgtagtcggggttttttttcgagtatcggggggacggcgggggagtagaggatgggcgcgggggagcgggtgttggggaggaagagatcgtgggggaagagacggcgcgggaggaaagaaggggaggaggggtgggtgtcgaggagggggcggtgggggaaaacgtaatgggtagggattgtagggaggggtgtagggagaggcgagtttggggatgcgcgttagggagggggtgacgggggagagcgtagagggagggggacgataaaggcggagggggatgggagggggagtttagggagtagagaagggatatggataaggagaggggtatattgg

SEQ ID NO: 2942 - DNA, 916 bp, Artificial Sequence
  chemically treated genomic DNA (Homo sapiens) CpG-island No: 2942
ccaatatacccctctccttatccatatcccttctctactccctaaactccccctcccatccccctccgcctttatcgtccccctccctctacgctctcccccgtcaccccctccctaacgcgcatccccaaactcgcctctccctacacccctccctacaatccctacccattacgttttcccccaccgccccctcctcgacacccacccctcctccccttctttcctcccgcgccgtctcttcccccacgatctcttcctccccaacacccgctcccccgcgcccatcctctactcccccgccgtccccccgatactcgaaaaaaaaccccgactacaaacgcgaaaccccgcgcaaacgcaaaaccacccgacttccccgaaaccgccgccgcccgcgcactacgacccgcgcgcccgattactaaaacaacgacgaaaaccgaaataaaaacctcgaaaaaaccccgctctcgctccctcccccgccacctcctcgacaaaccccactccgatttaaaccgatttccccgccccgcccccatacgcactacgacgaataaaaattccccgaccctcaaaataaataaattaaaaacgaaaaacgaaaaatatcgaataaaaccgacgcatacgcgctaaacgcgacatcccctcttctactaacgcgcgacgaaaaaaccccgacgcaaataacgaacacccccgcgcaaacgcaataaacgaccgacgaccccgcgaccccgcccgatcgtcctaacaacgcacgcgaaaccgactaaacgcgcacgaaactcccctctcacgccccctcccgctctctacgacgaaactaaaaattccctactaccaatacgcacgcgcgaacctaaaattccgcgaaaacgaaaataaaaacgaaaccgaaaccgaaacc

SEQ ID NO: 2943 - DNA, 916 bp, Artificial Sequence
  chemically treated genomic DNA (Homo sapiens) CpG-island No: 2943
ttagtgtatttttttttttgtttatattttttttttattttttaagtttttttttttattttttttcgtttttgtcgtttttttttttttacgttttttttcgttattttttttttggcgcgtatttttaggttcgtttttttttgtatttttttttatagtttttatttattgcgtttttttttatcgtttttttttcggtatttatttttttttttttttttttttttcgcgtcgtttttttttttacggtttttttttttttagtattcgttttttcgcgtttattttttattttttcgtcgttttttcggtgttcgagggggaatttcggttgtaggcgcggagtttcgcgtaggcgtagagttattcggttttttcgaggtcgtcgtcgttcgcgtattgcggttcgcgcgttcggttgttaaggtaacggcgggggtcggagtgggaatttcgggaagatttcgttttcgttttttttttcgttattttttcggtaaattttatttcggtttgaatcggttttttcgtttcgtttttatgcgtattgcggcgggtgaggatttttcggtttttagggtgggtgggttgggggcggggggcggggggtgtcgggtggggtcgacgtatgcgcgttgggcgcggtatttttttttttgttggcgcgcgacgggaaagtttcggcgtaaatggcgagtattttcgcgtaggcgtagtgagcgatcggcggtttcgcggtttcgttcggtcgttttggtaacgtacgcggggtcggttgggcgcgtacggaattttttttttacgttttttttcgttttttgcggcggagttggggattttttgttgttagtgcgtacgcgcgagtttgggatttcgcgggggcgggggtgggggcggggtcggggtcggggtt

SEQ ID NO: 2944 - DNA, 916 bp, Artificial Sequence
  chemically treated genomic DNA (Homo sapiens) CpG-island No: 2944
aaccccgaccccgaccccgcccccacccccgcccccgcgaaatcccaaactcgcgcgtacgcactaacaacaaaaaatccccaactccgccgcaaaaaacgaaaaaaaacgtaaaaaaaaaattccgtacgcgcccaaccgaccccgcgtacgttaccaaaacgaccgaacgaaaccgcgaaaccgccgatcgctcactacgcctacgcgaaaatactcgccatttacgccgaaactttcccgtcgcgcgccaacaaaaaaaaaaataccgcgcccaacgcgcatacgtcgaccccacccgacaccccccgccccccgcccccaacccacccaccctaaaaaccgaaaaatcctcacccgccgcaatacgcataaaaacgaaacgaaaaaaccgattcaaaccgaaataaaatttaccgaaaaaataacgaaaaaaaaaacgaaaacgaaatcttcccgaaattcccactccgacccccgccgttaccttaacaaccgaacgcgcgaaccgcaatacgcgaacgacgacgacctcgaaaaaaccgaataactctacgcctacgcgaaactccgcgcctacaaccgaaattccccctcgaacaccgaaaaaacgacgaaaaaataaaaaataaacgcgaaaaaacgaatactaaaaaaaaaaaaaccgtaaaaaaaaaaacgacgcgaaaaaaaaaaaaaaaaaaaaaaataaataccgaaaaaaaaacgataaaaaaaaacgcaataaataaaaactataaaaaaaaatacaaaaaaaaacgaacctaaaaatacgcgccaaaaaaaaaataacgaaaaaaaacgtaaaaaaaaaaaaacgacaaaaacgaaaaaaaataaaaaaaaaaacttaaaaaataaaaaaaaaatataaacaaaaaaaaaaatacactaa

SEQ ID NO: 2945 - DNA, 1027 bp, Artificial Sequence
  chemically treated genomic DNA (Homo sapiens) CpG-island No: 2945
attcgcgatagtcggcgaggggcgttagggagtttaaggtacgcgttaattttttgcggtcgcgtcgcgttttgcgttgttagacgttcgttgttatggcgttagggaggggataagagtttaggattttagcgcgcgtcgtaatttgtgcggttacgttcggttcgcgttgagagagcgtttggtagttagcgggtggacgcgttttttagcggagggtataaagtttggtcgtaggtacgtaggatatttagaacggagcgatggggacgtcgcgggtcgtaatacggattttgtttgggtgttagttcgggtttatagcgcggtcgaggcgtattttgcgttatatattgtttttttattggagaaagcgggacggtcgttacggacggcgtaatttttgcgtgcgtcgcggatcgacgtttgagggcgttagtagggttcgatttttttgtttcgttttcgtttttgttttcgggttcggttagcgtcgcggtttttggtttcgtttttatacgggttcgtaagtaggtatcgttttcgattttgtttttagtttcggttcgggttcggttttcgcgagtacggcgcgcgttttcggtttttgtggtcgcgcgttggtttggaggttgatttggaggtttatttggaggtcgagttgattcggtaggttttgcgcgggtaatatggcggcgttcggcgagcggggtcgtttttacggcgggaattttttttttttgtcggggggcgcgcgtttcgagatgatggacgatttggcgatcgacgcgcggggtcggggcgcggggcggagagacgcggtcgtttcggtttcgacgttagtttaggcgtcgattttcgatttttttgtcgtcgaggacgtttttcggaggcggtcgtgtcgggtttgcgtcgattttaagacgtggatgcggacgtagtagaaggtgtagttttttgttcgattttttttagtttcgcgtagtttttgttttcgttttcgtttaggtatttcggtagagttttttag

SEQ ID NO: 2946 - DNA, 1027 bp, Artificial Sequence
  chemically treated genomic DNA (Homo sapiens) CpG-island No: 2946
ctaaaaaactctaccgaaatacctaaacgaaaacgaaaacaaaaactacgcgaaactaaaaaaaatcgaacaaaaaactacaccttctactacgtccgcatccacgtcttaaaatcgacgcaaacccgacacgaccgcctccgaaaaacgtcctcgacgacaaaaaaatcgaaaatcgacgcctaaactaacgtcgaaaccgaaacgaccgcgtctctccgccccgcgccccgaccccgcgcgtcgatcgccaaatcgtccatcatctcgaaacgcgcgccccccgacaaaaaaaaaaaattcccgccgtaaaaacgaccccgctcgccgaacgccgccatattacccgcgcaaaacctaccgaatcaactcgacctccaaataaacctccaaatcaacctccaaaccaacgcgcgaccacaaaaaccgaaaacgcgcgccgtactcgcgaaaaccgaacccgaaccgaaactaaaaacaaaatcgaaaacgatacctacttacgaacccgtataaaaacgaaaccaaaaaccgcgacgctaaccgaacccgaaaacaaaaacgaaaacgaaacaaaaaaatcgaaccctactaacgccctcaaacgtcgatccgcgacgcacgcaaaaattacgccgtccgtaacgaccgtcccgctttctccaataaaaaaacaatatataacgcaaaatacgcctcgaccgcgctataaacccgaactaacacccaaacaaaatccgtattacgacccgcgacgtccccatcgctccgttctaaatatcctacgtacctacgaccaaactttataccctccgctaaaaaacgcgtccacccgctaactaccaaacgctctctcaacgcgaaccgaacgtaaccgcacaaattacgacgcgcgctaaaatcctaaactcttatcccctccctaacgccataacaacgaacgtctaacaacgcaaaacgcgacgcgaccgcaaaaaattaacgcgtaccttaaactccctaacgcccctcgccgactatcgcgaat

SEQ ID NO: 2947 - DNA, 1027 bp, Artificial Sequence
  chemically treated genomic DNA (Homo sapiens) CpG-island No: 2947
ttgggaagttttgtcggggtatttgggcgggggcggggataggggttgcgcggggttgggagaaatcgggtagggaattgtattttttgttgcgttcgtatttacgttttgaagtcgacgtaggttcggtacggtcgttttcgggaggcgttttcggcgataggagaatcggaggtcggcgtttgggttggcgtcgaggtcgaggcggtcgcgttttttcgtttcgcgtttcggtttcgcgcgtcggtcgttaggtcgtttattatttcggagcgcgcgtttttcggtaggaagaagaggttttcgtcgtggaagcggtttcgttcgtcgggcgtcgttatgttgttcgcgtaaggtttgtcgggttagttcggtttttagatgagtttttaggttagtttttaggttagcgcgcggttataggagtcggaggcgcgcgtcgtgttcgcgggggtcgggttcgagtcggggttgggggtagagtcgggggcggtgtttgtttgcgggttcgtgtggaggcggagttagaggtcgcggcgttggtcgggttcgaggataggggcggggacggagtaggagggtcggattttgttggcgtttttaggcgtcgattcgcggcgtacgtaggggttgcgtcgttcgtggcggtcgtttcgttttttttagtaaaagagtagtgtgtggcgtaaggtgcgtttcggtcgcgttgtggattcgagttgatatttaggtaaagttcgtgttgcggttcgcgacgtttttatcgtttcgttttgagtgttttgcgtgtttgcggttaggttttgtgtttttcgttgaggggcgcgtttattcgttggttgttaagcgtttttttaacgcgggtcgggcgtgatcgtatagattgcggcgcgcgttagggttttgggtttttgttttttttttggcgttatggtaacgggcgtttggtaacgtagggcgcggcgcggtcgtagagggttggcgcgtgttttgggttttttggcgtttttcgtcggttgtcgcggat

SEQ ID NO: 2948 - DNA, 1027 bp, Artificial Sequence
  chemically treated genomic DNA (Homo sapiens) CpG-island No: 2948
atccgcgacaaccgacgaaaaacgccaaaaaacccaaaacacgcgccaaccctctacgaccgcgccgcgccctacgttaccaaacgcccgttaccataacgccaaaaaaaaaacaaaaacccaaaaccctaacgcgcgccgcaatctatacgatcacgcccgacccgcgttaaaaaaacgcttaacaaccaacgaataaacgcgcccctcaacgaaaaacacaaaacctaaccgcaaacacgcaaaacactcaaaacgaaacgataaaaacgtcgcgaaccgcaacacgaactttacctaaatatcaactcgaatccacaacgcgaccgaaacgcaccttacgccacacactactcttttactaaaaaaaacgaaacgaccgccacgaacgacgcaacccctacgtacgccgcgaatcgacgcctaaaaacgccaacaaaatccgaccctcctactccgtccccgcccctatcctcgaacccgaccaacgccgcgacctctaactccgcctccacacgaacccgcaaacaaacaccgcccccgactctacccccaaccccgactcgaacccgacccccgcgaacacgacgcgcgcctccgactcctataaccgcgcgctaacctaaaaactaacctaaaaactcatctaaaaaccgaactaacccgacaaaccttacgcgaacaacataacgacgcccgacgaacgaaaccgcttccacgacgaaaacctcttcttcctaccgaaaaacgcgcgctccgaaataataaacgacctaacgaccgacgcgcgaaaccgaaacgcgaaacgaaaaaacgcgaccgcctcgacctcgacgccaacccaaacgccgacctccgattctcctatcgccgaaaacgcctcccgaaaacgaccgtaccgaacctacgtcgacttcaaaacgtaaatacgaacgcaacaaaaaatacaattccctacccgatttctcccaaccccgcgcaacccctatccccgcccccgcccaaataccccgacaaaacttcccaa

SEQ ID NO: 2949 - DNA, 1161 bp, Artificial Sequence
  chemically treated genomic DNA (Homo sapiens) CpG-island No: 2949
aacgtagggataggtttaggggcgtgggcgttcgaggcgggttcgtagaggtcgggtcgtcgtagggttttgagcgtcgcgtcgtacgtaggtgttttttatcgtcgttttcgggtttatcgttaacgagggttacgtgaatatcgatagcggtttcgagttgcgttgcgtgtttaacgggaacgcgggcgtttgtcgtttcggcgtcgcgttgggtttcggagtttttttcgtttgcgtcgtttttttgttgttcgatgtgcgtttttagtaaattagtagcgttcgcgatcgtcggcgcgcggtgttgttggatttgggttttttaggtgggcggggtcggggcggtgagcgcggagagtttttcgggtgggcggggagggggcggggtttgggcggggaatatcgttggagtttttagttgggcgtggtcgtgacgaggggcggggattgaggtagggagtgttaatgggtttttcgggtgggcggggagggggcggagtttggacggggagcgtcgcgggattttttaggtaggcggggttcgggtttgggcggagtttgggcgcggaacgggtttggcgttttcgggtgggcggggttagcgtaggagagggaggcgggatttcgcgttacgcggcgagtttaggcgaggcgttttaagtttcgggtttatcgattttttttttttcgggcgaggtcgtcgtgggttatcgcgtggagcgtcgttttgacgcgtcgtattgttcgtaggattttggttttttttgtggttcgtgggtttttgtttttttattaattagtggtagcgtacggcgttagggtcggttacgacgtaggcgggggacgcggcgcgggtcgttatcgtttttagttttttttttatttttagttgggtgagtgcggggttcgggagggcggggcgaaggggcgggcgttcggttgatttcggttgatttcgttgatttcgtttcgcgtaggtggcgtttatcgtgaaggttttgtagcggtttcgtttgggtatcgatatgttatttttcgttatcgaatagttgagtatcggggcgagttaggtttatttcggttattcggtgggtagcggcgtggagggtatcgagatttattagagttcgttttttatcgagattttggatattagtt

SEQ ID NO: 2950 - DNA, 1161 bp, Artificial Sequence
  chemically treated genomic DNA (Homo sapiens) CpG-island No: 2950
aactaatatccaaaatctcgataaaaaacgaactctaataaatctcgataccctccacgccgctacccaccgaataaccgaaataaacctaactcgccccgatactcaactattcgataacgaaaaataacatatcgatacccaaacgaaaccgctacaaaaccttcacgataaacgccacctacgcgaaacgaaatcaacgaaatcaaccgaaatcaaccgaacgcccgccccttcgccccgccctcccgaaccccgcactcacccaactaaaaataaaaaaaaaactaaaaacgataacgacccgcgccgcgtcccccgcctacgtcgtaaccgaccctaacgccgtacgctaccactaattaataaaaaaacaaaaacccacgaaccacaaaaaaaaccaaaatcctacgaacaatacgacgcgtcaaaacgacgctccacgcgataacccacgacgacctcgcccgaaaaaaaaaaaatcgataaacccgaaacttaaaacgcctcgcctaaactcgccgcgtaacgcgaaatcccgcctccctctcctacgctaaccccgcccacccgaaaacgccaaacccgttccgcgcccaaactccgcccaaacccgaaccccgcctacctaaaaaatcccgcgacgctccccgtccaaactccgccccctccccgcccacccgaaaaacccattaacactccctacctcaatccccgcccctcgtcacgaccacgcccaactaaaaactccaacgatattccccgcccaaaccccgccccctccccgcccacccgaaaaactctccgcgctcaccgccccgaccccgcccacctaaaaaacccaaatccaacaacaccgcgcgccgacgatcgcgaacgctactaatttactaaaaacgcacatcgaacaacaaaaaaacgacgcaaacgaaaaaaactccgaaacccaacgcgacgccgaaacgacaaacgcccgcgttcccgttaaacacgcaacgcaactcgaaaccgctatcgatattcacgtaaccctcgttaacgataaacccgaaaacgacgataaaaaacacctacgtacgacgcgacgctcaaaaccctacgacgacccgacctctacgaacccgcctcgaacgcccacgcccctaaacctatccctacgtt

SEQ ID NO: 2951 - DNA, 1161 bp, Artificial Sequence
  chemically treated genomic DNA (Homo sapiens) CpG-island No: 2951
ggttggtgtttagggtttcggtgaagggcgggttttggtaggtttcggtgttttttacgtcgttgtttatcggatagtcggggtaggtttggttcgtttcggtgtttagttgttcggtggcgaagagtgatatgtcggtgtttaggcggaatcgttgtagggtttttacggtgagcgttatttgcgcggggcggggttagcggggttagtcgggattagtcgagcgttcgttttttcgtttcgttttttcgggtttcgtatttatttagttgaggatggagaagaagttgaaggcgatggcggttcgcgtcgcgtttttcgtttgcgtcgtggtcggttttggcgtcgtgcgttgttattgattggtgaggaagtagaagtttacgaattataggaaggattagagttttgcgaatagtgcggcgcgttagggcgacgttttacgcggtggtttacggcggtttcgttcggaggaggaaaggtcggtgggttcgaggtttggggcgtttcgtttgggttcgtcgcgtggcgcgaggtttcgttttttttttttgcgttgatttcgtttattcgggagcgttagattcgtttcgcgtttaggtttcgtttagattcgggtttcgtttatttagaaagtttcgcggcgtttttcgtttaggtttcgtttttttttcgtttattcgggaggtttattgatattttttgttttagttttcgtttttcgttacggttacgtttagttggaaattttagcggtgtttttcgtttaggtttcgtttttttttcgtttattcggaaggtttttcgcgtttatcgtttcggtttcgtttatttgagaagtttaggtttagtaatatcgcgcgtcggcggtcgcggacgttgttgatttgttggaagcgtatatcgagtagtaggaaggcggcgtaggcgaggaaggtttcgaggtttagcgcgacgtcgaagcggtaggcgttcgcgttttcgttgaatacgtagcgtagttcggggtcgttgtcggtgtttacgtagttttcgttgacgatgggttcgaagacggcgatggagaatatttgcgtgcggcgcggcgtttagggttttgcggcgattcgatttttgcgagttcgtttcgagcgtttacgtttttgggtttgtttttgcgtt

SEQ ID NO: 2952 - DNA, 1161 bp, Artificial Sequence
  chemically treated genomic DNA (Homo sapiens) CpG-island No: 2952
aacgcaaaaacaaacccaaaaacgtaaacgctcgaaacgaactcgcaaaaatcgaatcgccgcaaaaccctaaacgccgcgccgcacgcaaatattctccatcgccgtcttcgaacccatcgtcaacgaaaactacgtaaacaccgacaacgaccccgaactacgctacgtattcaacgaaaacgcgaacgcctaccgcttcgacgtcgcgctaaacctcgaaaccttcctcgcctacgccgccttcctactactcgatatacgcttccaacaaatcaacaacgtccgcgaccgccgacgcgcgatattactaaacctaaacttctcaaataaacgaaaccgaaacgataaacgcgaaaaaccttccgaataaacgaaaaaaaaacgaaacctaaacgaaaaacaccgctaaaatttccaactaaacgtaaccgtaacgaaaaacgaaaactaaaacaaaaaatatcaataaacctcccgaataaacgaaaaaaaaacgaaacctaaacgaaaaacgccgcgaaactttctaaataaacgaaacccgaatctaaacgaaacctaaacgcgaaacgaatctaacgctcccgaataaacgaaatcaacgcaaaaaaaaaaaacgaaacctcgcgccacgcgacgaacccaaacgaaacgccccaaacctcgaacccaccgacctttcctcctccgaacgaaaccgccgtaaaccaccgcgtaaaacgtcgccctaacgcgccgcactattcgcaaaactctaatccttcctataattcgtaaacttctacttcctcaccaatcaataacaacgcacgacgccaaaaccgaccacgacgcaaacgaaaaacgcgacgcgaaccgccatcgccttcaacttcttctccatcctcaactaaataaatacgaaacccgaaaaaacgaaacgaaaaaacgaacgctcgactaatcccgactaaccccgctaaccccgccccgcgcaaataacgctcaccgtaaaaaccctacaacgattccgcctaaacaccgacatatcactcttcgccaccgaacaactaaacaccgaaacgaaccaaacctaccccgactatccgataaacaacgacgtaaaaaacaccgaaacctaccaaaacccgcccttcaccgaaaccctaaacaccaacc

SEQ ID NO: 2953 - DNA, 708 bp, Artificial Sequence
  chemically treated genomic DNA (Homo sapiens) CpG-island No: 2953
tttcgtcgttagtcgtacggtcgggatttcgttttgggtggttttattaggtttttttcggaagtcggcgtcgtcgggtttacggtcggattttagtgaggtaaagtttttattcggtcgtcgggagtttcgttgttttcgggtcgcgttttcggcgtttcgtatttggcgtagtttttcgcggtatacggcgtagtagcgttgttcgtagagtattcgtattttggtagagtagcggtagtatatcgggtggtcgtagcggttttagcgtcgtggtttttaggttttcgtagtatagtacgtagttttcgttttttcgtttaggagttgtcgtcgttttcgtttttatgttcgcgcgtcgtttttcggcgtttttcggtcgtcgttatggttcgggattcggtttttttttcggtcggtcgtggcgtcgagcggtttggttttcggcgggttcgtttttttcgggtaaacgttatcgttttatttagtaacgggttcgttcggcgtaagtgcgcgtcgcgattttcgttttagcgcggcgtcggttagagcggtggttttgatagaggtcgttttattatgagtcgatcgttcgaaggttcgcgcggttacgcggttagtttcgggtttttttgggttacgcgtgttacgttaatattcgtcgggttttacgaattggcgttgttagatgaaatacggtataattgg

SEQ ID NO: 2954 - DNA, 708 bp, Artificial Sequence
  chemically treated genomic DNA (Homo sapiens) CpG-island No: 2954
ccaattataccgtatttcatctaacaacgccaattcgtaaaacccgacgaatattaacgtaacacgcgtaacccaaaaaaacccgaaactaaccgcgtaaccgcgcgaaccttcgaacgatcgactcataataaaacgacctctatcaaaaccaccgctctaaccgacgccgcgctaaaacgaaaatcgcgacgcgcacttacgccgaacgaacccgttactaaataaaacgataacgtttacccgaaaaaaacgaacccgccgaaaaccaaaccgctcgacgccacgaccgaccgaaaaaaaaaccgaatcccgaaccataacgacgaccgaaaaacgccgaaaaacgacgcgcgaacataaaaacgaaaacgacgacaactcctaaacgaaaaaacgaaaactacgtactatactacgaaaacctaaaaaccacgacgctaaaaccgctacgaccacccgatatactaccgctactctaccaaaatacgaatactctacgaacaacgctactacgccgtataccgcgaaaaactacgccaaatacgaaacgccgaaaacgcgacccgaaaacaacgaaactcccgacgaccgaataaaaactttacctcactaaaatccgaccgtaaacccgacgacgccgacttccgaaaaaaacctaataaaaccacccaaaacgaaatcccgaccgtacgactaacgacgaaa

SEQ ID NO: 2955 - DNA, 708 bp, Artificial Sequence
  chemically treated genomic DNA (Homo sapiens) CpG-island No: 2955
ttagttgtgtcgtgttttatttgataacgttagttcgtggagttcggcgagtgttgacgtgatacgcgtggtttagaggagttcggggttggtcgcgtggtcgcgcggattttcgagcggtcggtttatggtagagcggtttttattagggttatcgttttagtcggcgtcgcgttgaggcggaagtcgcgacgcgtatttgcgtcgggcgggttcgttgttgggtggggcggtgacgtttgttcggaaggggcgggttcgtcgggagttaggtcgttcggcgttacgatcggtcgagaggggggtcggatttcggattatggcggcggtcggggggcgtcgaggggcggcgcgcggatatggaggcggaggcggcggtagtttttgagcgggaaggcgggagttgcgtgttgtgttgcggagatttggaggttacggcgttggggtcgttgcgattattcggtgtgttatcgttgttttattaagatgcgggtgttttgcgagtagcgttattgcgtcgtgtgtcgcgaggagttgcgttaggtgcggggcgtcgggggcgcggttcgggggtagcggggttttcggcgatcggatggggattttgttttattgaggttcggtcgtgggttcggcggcgtcggttttcgagagaggtttggtggggttatttagggcggggtttcggtcgtgcggttgacggcgggg

SEQ ID NO: 2956 - DNA, 708 bp, Artificial Sequence
  chemically treated genomic DNA (Homo sapiens) CpG-island No: 2956
ccccgccgtcaaccgcacgaccgaaaccccgccctaaataaccccaccaaacctctctcgaaaaccgacgccgccgaacccacgaccgaacctcaataaaacaaaatccccatccgatcgccgaaaaccccgctacccccgaaccgcgcccccgacgccccgcacctaacgcaactcctcgcgacacacgacgcaataacgctactcgcaaaacacccgcatcttaataaaacaacgataacacaccgaataatcgcaacgaccccaacgccgtaacctccaaatctccgcaacacaacacgcaactcccgccttcccgctcaaaaactaccgccgcctccgcctccatatccgcgcgccgcccctcgacgccccccgaccgccgccataatccgaaatccgacccccctctcgaccgatcgtaacgccgaacgacctaactcccgacgaacccgccccttccgaacaaacgtcaccgccccacccaacaacgaacccgcccgacgcaaatacgcgtcgcgacttccgcctcaacgcgacgccgactaaaacgataaccctaataaaaaccgctctaccataaaccgaccgctcgaaaatccgcgcgaccacgcgaccaaccccgaactcctctaaaccacgcgtatcacgtcaacactcgccgaactccacgaactaacgttatcaaataaaacacgacacaactaa

SEQ ID NO: 2957 - DNA, 699 bp, Artificial Sequence
  chemically treated genomic DNA (Homo sapiens) CpG-island No: 2957
cggttcgtttttagttttttgcgtttcggtatttgggcgttttaattttattgcgcgtttaaatttagtcgagtcggttcgtggttcgtttcgtcgggcggtcgtcgacgcgagcgttttggcgtggcgtttaggggagcggggggttttcgcgagtcggtcgcggttggtattgttgttgtttttgtttttgttgtcgttgtttttcggcgcgtggtataagtacgtggcgagttttcgttattatacggtgggtcgcgtcgttggtttgtttatggggttgcgtcgtttattttatttgtggcgtcgcgcgttgcgcgcggtcgtcgggtttttggttagggatattttttttttcgaattcgtagttcgcgaggttttttttttgttgttttcgtgggtttaggagttgtgggagacgcgacgtaggagtttttaggtagggattttcgttcgtgcgtttcggagttcgcgcgttttagagtttgcgttggaatcggagtttttggattttagcggagttggttaggtacgtgagaggggagaggtttggatcgtcgcgggtaagggggtttcgggaggtttgagtcggagtacggagtcgcgcgtttagggggtattttcgggtttttttattttttgtttcgcgtttagaagagttttttttgggtaggttcgattttggtattcgggggcggt

SEQ ID NO: 2958 - DNA, 699 bp, Artificial Sequence
  chemically treated genomic DNA (Homo sapiens) CpG-island No: 2958
accgcccccgaataccaaaatcgaacctacccaaaaaaaactcttctaaacgcgaaacaaaaaataaaaaaacccgaaaataccccctaaacgcgcgactccgtactccgactcaaacctcccgaaacccccttacccgcgacgatccaaacctctcccctctcacgtacctaaccaactccgctaaaatccaaaaactccgattccaacgcaaactctaaaacgcgcgaactccgaaacgcacgaacgaaaatccctacctaaaaactcctacgtcgcgtctcccacaactcctaaacccacgaaaacaacaaaaaaaaaacctcgcgaactacgaattcgaaaaaaaaaatatccctaaccaaaaacccgacgaccgcgcgcaacgcgcgacgccacaaataaaataaacgacgcaaccccataaacaaaccaacgacgcgacccaccgtataataacgaaaactcgccacgtacttataccacgcgccgaaaaacaacgacaacaaaaacaaaaacaacaacaataccaaccgcgaccgactcgcgaaaaccccccgctcccctaaacgccacgccaaaacgctcgcgtcgacgaccgcccgacgaaacgaaccacgaaccgactcgactaaatttaaacgcgcaataaaattaaaacgcccaaataccgaaacgcaaaaaactaaaaacgaaccg

SEQ ID NO: 2959 - DNA, 699 bp, Artificial Sequence
  chemically treated genomic DNA (Homo sapiens) CpG-island No: 2959
atcgttttcgggtgttagggtcgagtttgtttagggaaagtttttttgggcgcggagtagggaatggaagggttcgagggtgttttttgaacgcgcggtttcgtgtttcggtttagatttttcgagatttttttgttcgcggcggtttaggtttttttttttttacgtatttggttagtttcgttgaagtttagggatttcggttttagcgtaggttttggggcgcgcgggtttcggggcgtacggacggggatttttgtttgggagtttttgcgtcgcgttttttatagtttttgaatttacgagggtagtaggagaggagtttcgcgggttgcgggttcgggggagagggtgtttttggttaggggttcggcggtcgcgcgtagcgcgcggcgttatagatagggtgagcgacgtagttttatgagtaggttagcggcgcggtttatcgtgtggtagcggggattcgttacgtgtttgtattacgcgtcggagggtagcggtagtaggagtagaagtagtagtagtgttagtcgcggtcggttcgcgggagtttttcgtttttttgggcgttacgttagggcgttcgcgtcgacggtcgttcggcggggcgggttacgaatcggttcggttgggtttgggcgcgtagtggagttgggacgtttaggtatcggagcgtaggaggttggaggcgagtcg

SEQ ID NO: 2960 - DNA, 699 bp, Artificial Sequence
  chemically treated genomic DNA (Homo sapiens) CpG-island No: 2960
cgactcgcctccaacctcctacgctccgatacctaaacgtcccaactccactacgcgcccaaacccaaccgaaccgattcgtaacccgccccgccgaacgaccgtcgacgcgaacgccctaacgtaacgcccaaaaaaacgaaaaactcccgcgaaccgaccgcgactaacactactactacttctactcctactaccgctaccctccgacgcgtaatacaaacacgtaacgaatccccgctaccacacgataaaccgcgccgctaacctactcataaaactacgtcgctcaccctatctataacgccgcgcgctacgcgcgaccgccgaacccctaaccaaaaacaccctctcccccgaacccgcaacccgcgaaactcctctcctactaccctcgtaaattcaaaaactataaaaaacgcgacgcaaaaactcccaaacaaaaatccccgtccgtacgccccgaaacccgcgcgccccaaaacctacgctaaaaccgaaatccctaaacttcaacgaaactaaccaaatacgtaaaaaaaaaaaaacctaaaccgccgcgaacaaaaaaatctcgaaaaatctaaaccgaaacacgaaaccgcgcgttcaaaaaacaccctcgaacccttccattccctactccgcgcccaaaaaaactttccctaaacaaactcgaccctaacacccgaaaacgat

SEQ ID NO: 2961 - DNA, 1057 bp, Artificial Sequence
  chemically treated genomic DNA (Homo sapiens) CpG-island No: 2961
ttttgtcgcgttggagtatattagagtgggtttgttcggcgcgtacgcgttttcggtgggcggtgtcgagtatcgtagcgtagtatatagtagtaacgtgagtattaataggttggatatcgcgtagatggtaatgattaagtaaatattgatatttattagcgtcgtttttggatttatagcgtttgtcgacgttttcgacgaagtttgtggcgtttggtcgttttttattagcgataatagtatcgttgtcgtggtcgttagcgcgggtttatcgtggttttttattagtattagaaggcggtggtgcggcgcgtttatttcgtttagagggcgcgtcgtgttgatttcgttagtgtatagttttacgcggaacgggatgcgcgcgtcgatcgtcgttagttgtaatttatacgaaagttacgtattgtagttcgaatcggcgtttatcgcgcgtattttcgttattacgtggtttgtatttatcgatcgcggtattagttcgtttattgtgtttttcgcgttgttagtttcgggcgttagtagcgtcggagcgttgtcgttttcgtttagtacgaatatttgtagcgttacgttgttgtttagaggcggtacgttagagtcgcgcgcgtttatttggaattgtaatagttttagtttttcgtggtttaacggttgtagcgcgtatattttgtcgtttttcgcgtgtatcgatacgtagttcgatagcgtacgttcgtttattcgtcgttttattagcgagtaggagattagcgcgtttttttgtgcgttcgcgttttgagtagatatcgtgaagatgtggtagttcggcggattgtttttttttacgaatatcgtgtattcgggttgcgcgaacgtcggcgcgttgtcgtttacgtcggttatttttatcgatacgttggtcgtggtttatagcgaaggcgagttttcgtttcgcgcggttattattagtttataggttgatacgttttcgcggtttagggcgttgtttagtattaatgagtagtagtttttgtaggtggatattagtttgaag

SEQ ID NO: 2962 - DNA, 1057 bp, Artificial Sequence
  chemically treated genomic DNA (Homo sapiens) CpG-island No: 2962
cttcaaactaatatccacctacaaaaactactactcattaatactaaacaacgccctaaaccgcgaaaacgtatcaacctataaactaataataaccgcgcgaaacgaaaactcgccttcgctataaaccacgaccaacgtatcgataaaaataaccgacgtaaacgacaacgcgccgacgttcgcgcaacccgaatacacgatattcgtaaaaaaaaacaatccgccgaactaccacatcttcacgatatctactcaaaacgcgaacgcacaaaaaaacgcgctaatctcctactcgctaataaaacgacgaataaacgaacgtacgctatcgaactacgtatcgatacacgcgaaaaacgacaaaatatacgcgctacaaccgttaaaccacgaaaaactaaaactattacaattccaaataaacgcgcgcgactctaacgtaccgcctctaaacaacaacgtaacgctacaaatattcgtactaaacgaaaacgacaacgctccgacgctactaacgcccgaaactaacaacgcgaaaaacacaataaacgaactaataccgcgatcgataaatacaaaccacgtaataacgaaaatacgcgcgataaacgccgattcgaactacaatacgtaactttcgtataaattacaactaacgacgatcgacgcgcgcatcccgttccgcgtaaaactatacactaacgaaatcaacacgacgcgccctctaaacgaaataaacgcgccgcaccaccgccttctaatactaataaaaaaccacgataaacccgcgctaacgaccacgacaacgatactattatcgctaataaaaaacgaccaaacgccacaaacttcgtcgaaaacgtcgacaaacgctataaatccaaaaacgacgctaataaatatcaatatttacttaatcattaccatctacgcgatatccaacctattaatactcacgttactactatatactacgctacgatactcgacaccgcccaccgaaaacgcgtacgcgccgaacaaacccactctaatatactccaacgcgacaaaa

SEQ ID NO: 2963 - DNA, 1057 bp, Artificial Sequence
  chemically treated genomic DNA (Homo sapiens) CpG-island No: 2963
ttttaagttggtgtttatttataagaattattatttattagtgttggatagcgttttggatcgcgagagcgtattagtttatgaattggtggtgatcgcgcgggacgggggttcgttttcgttgtgggttacggttagcgtgtcggtgggggtggtcgacgtgaacgataacgcgtcggcgttcgcgtagttcgagtatacggtgttcgtgaaggaaaataattcgtcgggttgttatatttttacggtgtttgtttaggacgcggacgtataggagaacgcgttggttttttattcgttggtggagcggcgggtgggcgagcgtgcgttgtcgagttacgtgtcggtgtacgcggagagcggtaaggtgtacgcgttgtagtcgttggattacgaggagttggagttgttgtagttttaggtgagcgcgcgcgattttggcgtgtcgtttttgggtagtaacgtgacgttgtaggtgttcgtgttggacgagaacgataacgtttcggcgttgttgacgttcggggttggtagcgcgggaggtatagtgagcgagttgatgtcgcggtcggtgggtgtaggttacgtggtggcgaaggtgcgcgcggtggacgtcgattcgggttataatgcgtggttttcgtatgaattgtagttggcggcggtcggcgcgcgtatttcgtttcgcgtggggttgtatattggcgagattagtacgacgcgttttttggacgaggtggacgcgtcgtattatcgttttttggtgttggtgaaggattacggtgagttcgcgttgacggttacggtaacggtgttgttgtcgttggtggagagcggttaagcgttataggtttcgtcgagggcgtcggtaggcgttgtgggtttagaagcggcgttggtggatgttaatgtttatttgattattgttatttgcgcggtgtttagtttgttggtgtttacgttgttgttgtatattgcgttgcggtgttcggtatcgtttatcgagggcgcgtgcgcgtcgggtaagtttattttagtgtgttttagcgcggtaggg

SEQ ID NO: 2964 - DNA, 1057 bp, Artificial Sequence
  chemically treated genomic DNA (Homo sapiens) CpG-island No: 2964
ccctaccgcgctaaaacacactaaaataaacttacccgacgcgcacgcgccctcgataaacgataccgaacaccgcaacgcaatatacaacaacaacgtaaacaccaacaaactaaacaccgcgcaaataacaataatcaaataaacattaacatccaccaacgccgcttctaaacccacaacgcctaccgacgccctcgacgaaacctataacgcttaaccgctctccaccaacgacaacaacaccgttaccgtaaccgtcaacgcgaactcaccgtaatccttcaccaacaccaaaaaacgataatacgacgcgtccacctcgtccaaaaaacgcgtcgtactaatctcgccaatatacaaccccacgcgaaacgaaatacgcgcgccgaccgccgccaactacaattcatacgaaaaccacgcattataacccgaatcgacgtccaccgcgcgcaccttcgccaccacgtaacctacacccaccgaccgcgacatcaactcgctcactatacctcccgcgctaccaaccccgaacgtcaacaacgccgaaacgttatcgttctcgtccaacacgaacacctacaacgtcacgttactacccaaaaacgacacgccaaaatcgcgcgcgctcacctaaaactacaacaactccaactcctcgtaatccaacgactacaacgcgtacaccttaccgctctccgcgtacaccgacacgtaactcgacaacgcacgctcgcccacccgccgctccaccaacgaataaaaaaccaacgcgttctcctatacgtccgcgtcctaaacaaacaccgtaaaaatataacaacccgacgaattattttccttcacgaacaccgtatactcgaactacgcgaacgccgacgcgttatcgttcacgtcgaccacccccaccgacacgctaaccgtaacccacaacgaaaacgaacccccgtcccgcgcgatcaccaccaattcataaactaatacgctctcgcgatccaaaacgctatccaacactaataaataataattcttataaataaacaccaacttaaaa

SEQ ID NO: 2965 - DNA, 1047 bp, Artificial Sequence
  chemically treated genomic DNA (Homo sapiens) CpG-island No: 2965
tcggcgcgtatcggtttacggtgggcggcgttgagtaacgtagcgtagtgtatagtagtagcgtgagtattagtaggttggatatcgtatagatggcgatgatgaggtatacgttaatatttattagagtcgtttcgggatttatagcgtttattgaggttcgcgacgacgtttttggggtttggtcgttttttattagcgatattagtatcgtggtcgtggacgttagcgcgggtttatcgtggttttttattagtattagtaggcggtggcgcggagcgttcgttttatttaggatgcgtgtcgtgttgatttcgttagtgtatagttttacgtggaacgggatgtgcgcgtcgatcgtcgtcggttgtaattcgtaggatagttaagcgttatagtcggagttagcgtttatcgcgcgtattttcgttattacgtggttcgtatttatcgatcgcggtattaattcgttaattgcgttttttgcgttgttagtcggagtcgttagtagtgtcggcgcgttgtcgttttcgtttagtacgaatatttgtagcgttacgttgttgtttagaggcggtacgtcggcgtcgcgcgcgtttatttggaattgtagtagttttagtttttcgtggtttagcggttgtagcgcgtatattttgtcgtttttcgcgtgtatcgatacgtagttcgatagtgcgtgttcgtttattcgtcgttttattagcgagtaggatattagcgcgtttttttgcgcgttcgcgttttatgtcgatatcgtgaagatgtggtagttcggcgggttgtttttttttacgaatattgtgtattcgggttgcgcgaacgtaggcgtattgtcgtttacgtcggttatttttacggatattttagtcgtggtttatagcgaaggcgagtttttatttcgcgtagttattattagtttataggtcgatacgttttcgcggtttagggcgttgtttagtattaacgagtagtaatttttgtaggtggatattagtttgaagggaatatgaggtgttagtgagtaga

SEQ ID NO: 2966 - DNA, 1047 bp, Artificial Sequence
  chemically treated genomic DNA (Homo sapiens) CpG-island No: 2966
tctactcactaacacctcatattcccttcaaactaatatccacctacaaaaattactactcgttaatactaaacaacgccctaaaccgcgaaaacgtatcgacctataaactaataataactacgcgaaataaaaactcgccttcgctataaaccacgactaaaatatccgtaaaaataaccgacgtaaacgacaatacgcctacgttcgcgcaacccgaatacacaatattcgtaaaaaaaaacaacccgccgaactaccacatcttcacgatatcgacataaaacgcgaacgcgcaaaaaaacgcgctaatatcctactcgctaataaaacgacgaataaacgaacacgcactatcgaactacgtatcgatacacgcgaaaaacgacaaaatatacgcgctacaaccgctaaaccacgaaaaactaaaactactacaattccaaataaacgcgcgcgacgccgacgtaccgcctctaaacaacaacgtaacgctacaaatattcgtactaaacgaaaacgacaacgcgccgacactactaacgactccgactaacaacgcaaaaaacgcaattaacgaattaataccgcgatcgataaatacgaaccacgtaataacgaaaatacgcgcgataaacgctaactccgactataacgcttaactatcctacgaattacaaccgacgacgatcgacgcgcacatcccgttccacgtaaaactatacactaacgaaatcaacacgacacgcatcctaaataaaacgaacgctccgcgccaccgcctactaatactaataaaaaaccacgataaacccgcgctaacgtccacgaccacgatactaatatcgctaataaaaaacgaccaaaccccaaaaacgtcgtcgcgaacctcaataaacgctataaatcccgaaacgactctaataaatattaacgtatacctcatcatcgccatctatacgatatccaacctactaatactcacgctactactatacactacgctacgttactcaacgccgcccaccgtaaaccgatacgcgccga

SEQ ID NO: 2967 - DNA, 1047 bp, Artificial Sequence
  chemically treated genomic DNA (Homo sapiens) CpG-island No: 2967
tttgtttattgatattttatgttttttttaagttggtgtttatttataagaattattattcgttggtgttggatagcgttttggatcgcgagagcgtgtcggtttatgagttggtggtgattgcgcgggatgggggttcgttttcgttgtgggttacggttagagtgttcgtggaggtggtcgacgtgaacgataatgcgtttgcgttcgcgtagttcgagtatatagtgttcgtgaaggagaataattcgtcgggttgttatatttttacggtgtcggtatgggacgcggacgcgtagaagaacgcgttggtgttttattcgttggtggagcggcgggtgggcgagtacgtattgtcgagttacgtgtcggtgtacgcggagagcggtaaggtgtacgcgttgtagtcgttagattacgaggagttggagttgttgtagttttaggtgagcgcgcgcgacgtcggcgtgtcgtttttgggtagtaacgtgacgttgtaggtgttcgtgttggacgagaacgataacgcgtcggtattgttggcgatttcggttggtagcgtaggaggcgtagttagcgagttggtatcgcggtcggtgggtgcgggttacgtggtggcgaaagtgcgcgcggtggacgttgatttcggttataacgtttggttgttttacgagttgtaatcggcggcggtcggcgcgtatatttcgttttacgtggggttgtatattggcgagattagtacgatacgtattttggatgaggcggacgtttcgcgttatcgtttgttggtgttggtgaaggattacggtgagttcgcgttgacgtttacggttacggtgttggtgtcgttggtggagaacggttaggttttaaagacgtcgtcgcgggttttagtgggcgttgtggatttcgaagcggttttggtggatattaacgtgtattttattatcgttatttgtgcggtgtttagtttgttggtgtttacgttgttgttgtatattgcgttgcgttgtttagcgtcgtttatcgtgagtcggtgcgcgtcgg

SEQ ID NO: 2968 - DNA, 1047 bp, Artificial Sequence
  chemically treated genomic DNA (Homo sapiens) CpG-island No: 2968
ccgacgcgcaccgactcacgataaacgacgctaaacaacgcaacgcaatatacaacaacaacgtaaacaccaacaaactaaacaccgcacaaataacgataataaaatacacgttaatatccaccaaaaccgcttcgaaatccacaacgcccactaaaacccgcgacgacgtctttaaaacctaaccgttctccaccaacgacaccaacaccgtaaccgtaaacgtcaacgcgaactcaccgtaatccttcaccaacaccaacaaacgataacgcgaaacgtccgcctcatccaaaatacgtatcgtactaatctcgccaatatacaaccccacgtaaaacgaaatatacgcgccgaccgccgccgattacaactcgtaaaacaaccaaacgttataaccgaaatcaacgtccaccgcgcgcactttcgccaccacgtaacccgcacccaccgaccgcgataccaactcgctaactacgcctcctacgctaccaaccgaaatcgccaacaataccgacgcgttatcgttctcgtccaacacgaacacctacaacgtcacgttactacccaaaaacgacacgccgacgtcgcgcgcgctcacctaaaactacaacaactccaactcctcgtaatctaacgactacaacgcgtacaccttaccgctctccgcgtacaccgacacgtaactcgacaatacgtactcgcccacccgccgctccaccaacgaataaaacaccaacgcgttcttctacgcgtccgcgtcccataccgacaccgtaaaaatataacaacccgacgaattattctccttcacgaacactatatactcgaactacgcgaacgcaaacgcattatcgttcacgtcgaccacctccacgaacactctaaccgtaacccacaacgaaaacgaacccccatcccgcgcaatcaccaccaactcataaaccgacacgctctcgcgatccaaaacgctatccaacaccaacgaataataattcttataaataaacaccaacttaaaaaaaacataaaatatcaataaacaaa

SEQ ID NO: 2969 - DNA, 1228 bp, Artificial Sequence
  chemically treated genomic DNA (Homo sapiens) CpG-island No: 2969
tagcgtgggttttttcggcgcgtacgcgtttttagtgggcgttgtcgattattatagcgtcgtatatagtagtagcgtgagtattaggaggttggatattacgtagatggcgatgattaggtatacgttgatatttattagcgtagtttttgggttcgcggcgttcgttaaagttcgggaagaggtttttggcgtttgttcgttttttattaacgatattagtacggtggtcgtggtcgttagcgtcggtttatcgtgattttttattagtattagaagtcggtggcgcggcgagtttgtttcgtttagggtacgcgttgtgtttatttcgttcgtgtatagttttacgcggaacgggatgcgcgagtcgttcgtcgtcggttgtaatttatatgaaagttacgcgttgtagtttgagttcgtatttattgcgcgtattttcgttattacgtggttcgtatttatcgatcgcggtattagtttgttaattgcgtttttcgcgttgttagtttgagtcgttagtagtgtcggcgcgttgtcgttttcgtttagtacgaatatttgtagcgttacgttgttgtttagaggcggtacgttcgtatcgcgcgcgtttatttggaattgtagtagttttagtttttcgtggtttaacggttgtagcgcgtatattttgtcgtttttcgcgtgtatcgatacgtagttcgatagcgcgcggtcgtttaatcgtcgttttattagcgagtaggatattagcgcgtttttttgcgcgttcgcgtttcgcgtcgatattgtgaagatgtggtagtttggtgggttgtttttttttacgaatacggtgtattcgggttgtgcgaacgtaggcgtattgtcgtttacgtcggttatttttacggatattttggtcgtggtttatagagaaggcgaatttttatttcgcgtagttattattagtttataggtttatacgttttcgcggtttagggcgttgtttagtattaacgagtagtaatttttgaaggtggatattagtttgaagggaacgtggggcgttagcgagtaggttatttgttcgttgatatttgagttacggttagatacgttgattagggtaatgatcgtgttgggttgagcgttttttcgtattgggagggataaggaagttacggcgattttaggagagttatcgttggtgtttaagatttttatttagattgtatagtgatttgtt

SEQ ID NO: 2970 - DNA, 1228 bp, Artificial Sequence
  chemically treated genomic DNA (Homo sapiens) CpG-island No: 2970
aacaaatcactatacaatctaaataaaaatcttaaacaccaacgataactctcctaaaatcgccgtaacttccttatccctcccaatacgaaaaaacgctcaacccaacacgatcattaccctaatcaacgtatctaaccgtaactcaaatatcaacgaacaaataacctactcgctaacgccccacgttcccttcaaactaatatccaccttcaaaaattactactcgttaatactaaacaacgccctaaaccgcgaaaacgtataaacctataaactaataataactacgcgaaataaaaattcgccttctctataaaccacgaccaaaatatccgtaaaaataaccgacgtaaacgacaatacgcctacgttcgcacaacccgaatacaccgtattcgtaaaaaaaaacaacccaccaaactaccacatcttcacaatatcgacgcgaaacgcgaacgcgcaaaaaaacgcgctaatatcctactcgctaataaaacgacgattaaacgaccgcgcgctatcgaactacgtatcgatacacgcgaaaaacgacaaaatatacgcgctacaaccgttaaaccacgaaaaactaaaactactacaattccaaataaacgcgcgcgatacgaacgtaccgcctctaaacaacaacgtaacgctacaaatattcgtactaaacgaaaacgacaacgcgccgacactactaacgactcaaactaacaacgcgaaaaacgcaattaacaaactaataccgcgatcgataaatacgaaccacgtaataacgaaaatacgcgcaataaatacgaactcaaactacaacgcgtaactttcatataaattacaaccgacgacgaacgactcgcgcatcccgttccgcgtaaaactatacacgaacgaaataaacacaacgcgtaccctaaacgaaacaaactcgccgcgccaccgacttctaatactaataaaaaatcacgataaaccgacgctaacgaccacgaccaccgtactaatatcgttaataaaaaacgaacaaacgccaaaaacctcttcccgaactttaacgaacgccgcgaacccaaaaactacgctaataaatatcaacgtatacctaatcatcgccatctacgtaatatccaacctcctaatactcacgctactactatatacgacgctataataatcgacaacgcccactaaaaacgcgtacgcgccgaaaaaacccacgcta

SEQ ID NO: 2971 - DNA, 1228 bp, Artificial Sequence
  chemically treated genomic DNA (Homo sapiens) CpG-island No: 2971
ggtaggttattgtatagtttgggtggaaattttggatattaacgataatttttttgaagtcgtcgtgatttttttgttttttttagtacgagaggacgtttagtttagtacggttattgttttgattagcgtgtttgatcgtgatttaggtgttaacggataggtgatttgttcgttgacgttttacgttttttttaagttggtgtttatttttaagaattattattcgttggtgttggatagcgttttggatcgcgagaacgtgtgggtttatgaattggtggtgattgcgcgggatgggggttcgttttttttgtgggttacggttagggtattcgtggaggtggtcgacgtgaacgataatgcgtttgcgttcgtatagttcgagtatatcgtgttcgtgaaggagaataatttattaggttgttatatttttatagtgtcggcgcgggacgcggacgcgtaggagaacgcgttggtgttttattcgttggtggagcggcggttgggcgatcgcgcgttgtcgagttacgtgtcggtgtacgcggagagcggtaaggtgtacgcgttgtagtcgttggattacgaggagttggagttgttatagttttaggtgagcgcgcgcgatgcgggcgtgtcgtttttgagtagtaacgtgacgttgtaggtgttcgtgttggacgagaacgataacgcgtcggtattgttggcgatttaggttggtagcgcgggaggcgtagttaataagttagtatcgcggtcggtgggtgcgggttacgtggtggcgaaggtgcgcgtagtggatgcggatttaggttataacgcgtggtttttatatgaattgtagtcggcggcgggcggttcgcgtatttcgtttcgcgtggggttgtatacgggcgagataagtataacgcgtgttttggacgaggtagattcgtcgcgttatcgatttttagtattggtgaaggattacggtgagtcggcgttgacggttacggttatcgtgttggtgtcgttggtggagagcggataggcgttaaaggttttttttcggattttggcgggcgtcgcgagtttagaggttgcgttggtggatgttaacgtgtatttgattatcgttatttgcgtggtgtttagttttttggtatttacgttgttgttgtatacggcgttgtggtggtcggtaacgtttattgagggcgcgtgcgcgtcggggaagtttacgttg

SEQ ID NO: 2972 - DNA, 1228 bp, Artificial Sequence
  chemically treated genomic DNA (Homo sapiens) CpG-island No: 2972
caacgtaaacttccccgacgcgcacgcgccctcaataaacgttaccgaccaccacaacgccgtatacaacaacaacgtaaataccaaaaaactaaacaccacgcaaataacgataatcaaatacacgttaacatccaccaacgcaacctctaaactcgcgacgcccgccaaaatccgaaaaaaaacctttaacgcctatccgctctccaccaacgacaccaacacgataaccgtaaccgtcaacgccgactcaccgtaatccttcaccaatactaaaaatcgataacgcgacgaatctacctcgtccaaaacacgcgttatacttatctcgcccgtatacaaccccacgcgaaacgaaatacgcgaaccgcccgccgccgactacaattcatataaaaaccacgcgttataacctaaatccgcatccactacgcgcaccttcgccaccacgtaacccgcacccaccgaccgcgatactaacttattaactacgcctcccgcgctaccaacctaaatcgccaacaataccgacgcgttatcgttctcgtccaacacgaacacctacaacgtcacgttactactcaaaaacgacacgcccgcatcgcgcgcgctcacctaaaactataacaactccaactcctcgtaatccaacgactacaacgcgtacaccttaccgctctccgcgtacaccgacacgtaactcgacaacgcgcgatcgcccaaccgccgctccaccaacgaataaaacaccaacgcgttctcctacgcgtccgcgtcccgcgccgacactataaaaatataacaacctaataaattattctccttcacgaacacgatatactcgaactatacgaacgcaaacgcattatcgttcacgtcgaccacctccacgaataccctaaccgtaacccacaaaaaaaacgaacccccatcccgcgcaatcaccaccaattcataaacccacacgttctcgcgatccaaaacgctatccaacaccaacgaataataattcttaaaaataaacaccaacttaaaaaaaacgtaaaacgtcaacgaacaaatcacctatccgttaacacctaaatcacgatcaaacacgctaatcaaaacaataaccgtactaaactaaacgtcctctcgtactaaaaaaaacaaaaaaatcacgacgacttcaaaaaaattatcgttaatatccaaaatttccacccaaactatacaataacctacc

SEQ ID NO: 2973 - DNA, 529 bp, Artificial Sequence
  chemically treated genomic DNA (Homo sapiens) CpG-island No: 2973
tgaatatcgtattagtttatttatagcgtcgttagtttatttaaggcgttagtagcgtagataaagttgtcgttttagtattaatatttggtagcgttatattgttgtttagaggcggtatgttcgcgtcgcgcgtttttatttagaattgtagtagttttagtttttcgtagtttagtggttgtaacgcgtattttttgtcgtttttcgcgtgtatttatatatagttagatagcgcgtattcgtttattcgttgttttattaacgagtaggatattagtacgtttttttgcgcgtttcggtttcgcgcggatattgtgaagtcgtggtagtttcgcgggttgttattttttacgaatattatgtattcgggttgttggaacgttagggtattgtggtttattgttcggttatttttacggattcgatggttgtggttaataatgaaagcgagtttttatttcgagcgattattaataatggatagatttgtttttttggtttagggcgttgtggagtattaacgaat

SEQ ID NO: 2974 - DNA, 529 bp, Artificial Sequence
  chemically treated genomic DNA (Homo sapiens) CpG-island No: 2974
attcgttaatactccacaacgccctaaaccaaaaaaacaaatctatccattattaataatcgctcgaaataaaaactcgctttcattattaaccacaaccatcgaatccgtaaaaataaccgaacaataaaccacaataccctaacgttccaacaacccgaatacataatattcgtaaaaaataacaacccgcgaaactaccacgacttcacaatatccgcgcgaaaccgaaacgcgcaaaaaaacgtactaatatcctactcgttaataaaacaacgaataaacgaatacgcgctatctaactatatataaatacacgcgaaaaacgacaaaaaatacgcgttacaaccactaaactacgaaaaactaaaactactacaattctaaataaaaacgcgcgacgcgaacataccgcctctaaacaacaatataacgctaccaaatattaatactaaaacgacaactttatctacgctactaacgccttaaataaactaacgacgctataaataaactaatacgatattca

SEQ ID NO: 2975 - DNA, 529 bp, Artificial Sequence
  chemically treated genomic DNA (Homo sapiens) CpG-island No: 2975
attcgttggtattttatagcgttttggattaagagagtaaatttatttattgttggtaatcgttcggaatggggattcgtttttattgttggttatagttatcgggttcgtggaagtggtcgaatagtgaattataatgttttggcgttttagtagttcgagtatatggtgttcgtgaaaggtaataattcgcggggttgttacgattttatagtgttcgcgcgggatcgggacgcgtaggagaacgtgttggtgttttattcgttgatggaatagcgggtgggcgagtgcgcgttgtttagttatgtgtgggtgtacgcggagagcggtaagaggtacgcgttgtagttattggattacgaggagttggagttgttgtagttttaggtgagagcgcgcgacgcgggtatgtcgtttttgagtagtaatgtgacgttgttaggtattagtgttggaacgataattttgtttgcgttgttggcgttttgggtgggttggcggcgttgtgagtgagttggtgcggtattta

SEQ ID NO: 2976 - DNA, 529 bp, Artificial Sequence
  chemically treated genomic DNA (Homo sapiens) CpG-island No: 2976
taaataccgcaccaactcactcacaacgccgccaacccacccaaaacgccaacaacgcaaacaaaattatcgttccaacactaatacctaacaacgtcacattactactcaaaaacgacatacccgcgtcgcgcgctctcacctaaaactacaacaactccaactcctcgtaatccaataactacaacgcgtacctcttaccgctctccgcgtacacccacacataactaaacaacgcgcactcgcccacccgctattccatcaacgaataaaacaccaacacgttctcctacgcgtcccgatcccgcgcgaacactataaaatcgtaacaaccccgcgaattattacctttcacgaacaccatatactcgaactactaaaacgccaaaacattataattcactattcgaccacttccacgaacccgataactataaccaacaataaaaacgaatccccattccgaacgattaccaacaataaataaatttactctcttaatccaaaacgctataaaataccaacgaat

SEQ ID NO: 2977 - DNA, 1060 bp, Artificial Sequence
  chemically treated genomic DNA (Homo sapiens) CpG-island No: 2977
tatatgcgttttcggtgggcgtcgtcgagtattttagtgtagtgtatagtagtagcgtgagtattagtaagttggatatcgcgtagatggcgatgattaggtatacgttgatatttattagggttatttcgggcgttacgtttattgaagttcgcgacgaggttttgggtgtttggttgttttttataagcgatataagtatagtggtcgtggtcgttagcgacggttcgttatggttttttattagtattagtaggcgttggcgtggcgagttagttttatttagagcgcgcgtcgtattgatttcgttcgtgtatagttttacgcgaaacgggatgcgtgtattaatcgtcgtcgattgtaatttatacgatagttacgcgttgtatttagagttagcgtttattgcgcgtattttagttattacgtgattcgtaattatcgatcgtagtattagtttattgattgtatcgttcgcgttgttagcgggagacgttagtagcgcgggagcgttgtcgttttcgtttagtacgaatatttgtagcgttaagttgttgtttagaggcggtacgtttttatcgcgcgcgtttatttggaattgtagtagttttagtttttcgtggtttagcggttgtagcgcgtatattttgtcgtttttcgcgtgtatcgatacgtagttcgatagcgagcgttcgtttaatcgtcgttttattagagagtaggatattagggcgtttttttgcgcgttcgcgttttacgtagatatcgtgaagatgtggtagtttggcgggttgtttttttttacgaatatcgtgtattcggattgcgcgaacgtaggcgcgttgtcgtttacgtcggttatttttatagatacgttggtcgtggtttatagcggaggcgagttttcgtttcgcgcggttattattagtttataggtcgatattttttcgcggtttagagcgttgtttagtattaatgagtagtaatttttgtaggtggatattagtttgaacggaacgtgaggcgttagagagtaggtgatttgttcgttggtttttga

SEQ ID NO: 2978 - DNA, 1060 bp, Artificial Sequence
  chemically treated genomic DNA (Homo sapiens) CpG-island No: 2978
tcaaaaaccaacgaacaaatcacctactctctaacgcctcacgttccgttcaaactaatatccacctacaaaaattactactcattaatactaaacaacgctctaaaccgcgaaaaaatatcgacctataaactaataataaccgcgcgaaacgaaaactcgcctccgctataaaccacgaccaacgtatctataaaaataaccgacgtaaacgacaacgcgcctacgttcgcgcaatccgaatacacgatattcgtaaaaaaaaacaacccgccaaactaccacatcttcacgatatctacgtaaaacgcgaacgcgcaaaaaaacgccctaatatcctactctctaataaaacgacgattaaacgaacgctcgctatcgaactacgtatcgatacacgcgaaaaacgacaaaatatacgcgctacaaccgctaaaccacgaaaaactaaaactactacaattccaaataaacgcgcgcgataaaaacgtaccgcctctaaacaacaacttaacgctacaaatattcgtactaaacgaaaacgacaacgctcccgcgctactaacgtctcccgctaacaacgcgaacgatacaatcaataaactaatactacgatcgataattacgaatcacgtaataactaaaatacgcgcaataaacgctaactctaaatacaacgcgtaactatcgtataaattacaatcgacgacgattaatacacgcatcccgtttcgcgtaaaactatacacgaacgaaatcaatacgacgcgcgctctaaataaaactaactcgccacgccaacgcctactaatactaataaaaaaccataacgaaccgtcgctaacgaccacgaccactatacttatatcgcttataaaaaacaaccaaacacccaaaacctcgtcgcgaacttcaataaacgtaacgcccgaaataaccctaataaatatcaacgtatacctaatcatcgccatctacgcgatatccaacttactaatactcacgctactactatacactacactaaaatactcgacgacgcccaccgaaaacgcatata

SEQ ID NO: 2979 - DNA, 1060 bp, Artificial Sequence
  chemically treated genomic DNA (Homo sapiens) CpG-island No: 2979
ttaggagttaacggataggttatttgttttttgacgttttacgtttcgtttaagttggtgtttatttataagaattattatttattggtgttggatagcgttttggatcgcgagagggtgtcggtttatgagttggtggtgatcgcgcgggacgggggttcgttttcgttgtgggttacggttagcgtgtttgtggaggtggtcgacgtgaacgataacgcgtttgcgttcgcgtagttcgagtatacggtgttcgtgaaggagaataattcgttaggttgttatatttttacggtgtttgcgtgggacgcggacgcgtaggagaacgttttggtgttttattttttggtggagcggcggttgggcgagcgttcgttgtcgagttacgtgtcggtgtacgcggagagcggtaaggtgtacgcgttgtagtcgttggattacgaggagttggagttgttatagttttaggtgagcgcgcgcgatgggggcgtgtcgtttttgggtagtaatttgacgttgtaggtgttcgtgttggacgagaacgataacgttttcgcgttgttggcgtttttcgttggtagcgcgggcggtgtagttagtgagttggtgttgcggtcggtggttgcgggttacgtggtggttaaggtgcgcgtagtggacgttgattttggatataacgcgtggttgtcgtatgaattgtagtcggcggcggttggtgtacgtatttcgtttcgcgtggggttgtatacgggcgagattagtacgacgcgcgttttggatgagattgattcgttacgttagcgtttattggtgttggtgaaggattatggcgagtcgtcgttgacggttacggttattgtgtttgtgtcgtttgtggagggtagttaggtatttaaggtttcgtcgcgggttttagtgggcgtggcgttcgaggtggttttggtggatgttaacgtgtatttgattatcgttatttgcgcggtgtttagtttgttggtgtttacgttgttgttgtatattgtattgaggtgttcggcggcgtttatcgagggcgtatgtg

SEQ ID NO: 2980 - DNA, 1060 bp, Artificial Sequence
  chemically treated genomic DNA (Homo sapiens) CpG-island No: 2980
cacatacgccctcgataaacgccgccgaacacctcaatacaatatacaacaacaacgtaaacaccaacaaactaaacaccgcgcaaataacgataatcaaatacacgttaacatccaccaaaaccacctcgaacgccacgcccactaaaacccgcgacgaaaccttaaatacctaactaccctccacaaacgacacaaacacaataaccgtaaccgtcaacgacgactcgccataatccttcaccaacaccaataaacgctaacgtaacgaatcaatctcatccaaaacgcgcgtcgtactaatctcgcccgtatacaaccccacgcgaaacgaaatacgtacaccaaccgccgccgactacaattcatacgacaaccacgcgttatatccaaaatcaacgtccactacgcgcaccttaaccaccacgtaacccgcaaccaccgaccgcaacaccaactcactaactacaccgcccgcgctaccaacgaaaaacgccaacaacgcgaaaacgttatcgttctcgtccaacacgaacacctacaacgtcaaattactacccaaaaacgacacgcccccatcgcgcgcgctcacctaaaactataacaactccaactcctcgtaatccaacgactacaacgcgtacaccttaccgctctccgcgtacaccgacacgtaactcgacaacgaacgctcgcccaaccgccgctccaccaaaaaataaaacaccaaaacgttctcctacgcgtccgcgtcccacgcaaacaccgtaaaaatataacaacctaacgaattattctccttcacgaacaccgtatactcgaactacgcgaacgcaaacgcgttatcgttcacgtcgaccacctccacaaacacgctaaccgtaacccacaacgaaaacgaacccccgtcccgcgcgatcaccaccaactcataaaccgacaccctctcgcgatccaaaacgctatccaacaccaataaataataattcttataaataaacaccaacttaaacgaaacgtaaaacgtcaaaaaacaaataacctatccgttaactcctaa

SEQ ID NO: 2981 - DNA, 1084 bp, Artificial Sequence
  chemically treated genomic DNA (Homo sapiens) CpG-island No: 2981
ttatcgcgttagaatatattagcgtcggtttgttaggcgcgtattcgttttcggtgggtatcgtcgagtatcgtagtatagtgtatagtagtagcgtgagaattaataggttagatatcgcgtagatggcgatgattaggtatacgttgatatttattagcgttatttcggggttcgtggtatttattgacgttcgcgacgatgattttggcgtttggtcgttttttattagcgatattagtatagtggtcgtggtcgttagcgttggtttttcgtggttttttattagtattagtaggcgttggcgcggtgcgttcgtttcgtttagggtacgcgttgtgttgatttcgttcgtgtatagttttacgcggaacgggatgttcgcgttggtcgtttttggttgtagttcgtatgaaagttacgcgttgtagttcgagtcggcgtttattgcgcgtattttttttattattacgtcggcgtttatcgatcgtagtattatttcgtttattgcgtcgttagtgttttttattcgaggtgttagtagcgtcggcgtattgtcgttttcgtttagtacgaatatttgtagcgttacgttgttgtttagaggcggtacgttcgcgtcgcgcgcgtttatttggaattgtagtagttttagtttttcgtggtttaacggttgtagcgcgtatattttgtcgtttttcgcgtgtattgatacgtagttcgatagcgagcgttcgtttaatcgtcgttttattagcgagtaggatattagggcgtttttttgcgcgttagcgtttcgcgtagatatcgtgaagatgtggtagttcggcgggttgtttttttttacgaatatcgtgtattcggattgcgcgaacgttggtgcgttgtcgtttacgtcggttatttttatagatattttggtcgtggtttatagtgaaggcgagttttcgtttcgcgcggtaattattagttcgtaggcggatatattttcgcggtttagagttttgtttagtattaacgagtagtaatttttgtaggtggatattagtttgaaggggacgtggggcgttagggagtaggtaat

SEQ ID NO: 2982 - DNA, 1084 bp, Artificial Sequence
  chemically treated genomic DNA (Homo sapiens) CpG-island No: 2982
attacctactccctaacgccccacgtccccttcaaactaatatccacctacaaaaattactactcgttaatactaaacaaaactctaaaccgcgaaaatatatccgcctacgaactaataattaccgcgcgaaacgaaaactcgccttcactataaaccacgaccaaaatatctataaaaataaccgacgtaaacgacaacgcaccaacgttcgcgcaatccgaatacacgatattcgtaaaaaaaaacaacccgccgaactaccacatcttcacgatatctacgcgaaacgctaacgcgcaaaaaaacgccctaatatcctactcgctaataaaacgacgattaaacgaacgctcgctatcgaactacgtatcaatacacgcgaaaaacgacaaaatatacgcgctacaaccgttaaaccacgaaaaactaaaactactacaattccaaataaacgcgcgcgacgcgaacgtaccgcctctaaacaacaacgtaacgctacaaatattcgtactaaacgaaaacgacaatacgccgacgctactaacacctcgaataaaaaacactaacgacgcaataaacgaaataatactacgatcgataaacgccgacgtaataataaaaaaaatacgcgcaataaacgccgactcgaactacaacgcgtaactttcatacgaactacaaccaaaaacgaccaacgcgaacatcccgttccgcgtaaaactatacacgaacgaaatcaacacaacgcgtaccctaaacgaaacgaacgcaccgcgccaacgcctactaatactaataaaaaaccacgaaaaaccaacgctaacgaccacgaccactatactaatatcgctaataaaaaacgaccaaacgccaaaatcatcgtcgcgaacgtcaataaataccacgaaccccgaaataacgctaataaatatcaacgtatacctaatcatcgccatctacgcgatatctaacctattaattctcacgctactactatacactatactacgatactcgacgatacccaccgaaaacgaatacgcgcctaacaaaccgacgctaatatattctaacgcgataa

SEQ ID NO: 2983 - DNA, 1084 bp, Artificial Sequence
  chemically treated genomic DNA (Homo sapiens) CpG-island No: 2983
gttatttgttttttgacgttttacgttttttttaagttggtgtttatttataagaattattattcgttggtgttggatagagttttggatcgcgagagtgtgttcgtttacgagttggtggttatcgcgcgggacgggggttcgtttttattgtgggttacggttagggtgtttgtggaggtggtcgacgtgaacgataacgtattagcgttcgcgtagttcgagtatacggtgttcgtgaaggagaataattcgtcgggttgttatatttttacggtgtttgcgcgggacgttgacgcgtaggagaacgttttggtgttttattcgttggtggagcggcggttgggcgagcgttcgttgtcgagttacgtgttagtgtacgcggagagcggtaaggtgtacgcgttgtagtcgttggattacgaggagttggagttgttatagttttaggtgagcgcgcgcgacgcgggcgtgtcgtttttgggtagtaacgtgacgttgtaggtgttcgtgttggacgagaacgataatgcgtcggcgttgttgatatttcggatgaggggtattgacggcgtagtgagcgagatggtgttgcggtcggtgggcgtcggcgtagtggtggggaaggtgcgcgtagtggacgtcgattcgggttataacgcgtggtttttatacgagttgtagttagaaacggttagcgcgagtatttcgtttcgcgtggggttgtatacgggcgagattagtataacgcgtgttttggacgaaacggacgtatcgcgttagcgtttattggtgttggtgaaagattacggggagttagcgttgacggttacggttattgtgttggtgtcgttggtggagagcggttaggcgttaaagttatcgtcgcgggcgttagtgggtgttacgggtttcgaggtgacgttggtggatgttaacgtgtatttgattatcgttatttgcgcggtgtttagtttgttggtttttacgttgttgttgtatattgtgttgcggtgttcggcgatgtttatcgagggcgagtgcgcgtttggtaagtcgacgttggtgtgttttagcgcggtgg

SEQ ID NO: 2984 - DNA, 1084 bp, Artificial Sequence
  chemically treated genomic DNA (Homo sapiens) CpG-island No: 2984
ccaccgcgctaaaacacaccaacgtcgacttaccaaacgcgcactcgccctcgataaacatcgccgaacaccgcaacacaatatacaacaacaacgtaaaaaccaacaaactaaacaccgcgcaaataacgataatcaaatacacgttaacatccaccaacgtcacctcgaaacccgtaacacccactaacgcccgcgacgataactttaacgcctaaccgctctccaccaacgacaccaacacaataaccgtaaccgtcaacgctaactccccgtaatctttcaccaacaccaataaacgctaacgcgatacgtccgtttcgtccaaaacacgcgttatactaatctcgcccgtatacaaccccacgcgaaacgaaatactcgcgctaaccgtttctaactacaactcgtataaaaaccacgcgttataacccgaatcgacgtccactacgcgcaccttccccaccactacgccgacgcccaccgaccgcaacaccatctcgctcactacgccgtcaatacccctcatccgaaatatcaacaacgccgacgcattatcgttctcgtccaacacgaacacctacaacgtcacgttactacccaaaaacgacacgcccgcgtcgcgcgcgctcacctaaaactataacaactccaactcctcgtaatccaacgactacaacgcgtacaccttaccgctctccgcgtacactaacacgtaactcgacaacgaacgctcgcccaaccgccgctccaccaacgaataaaacaccaaaacgttctcctacgcgtcaacgtcccgcgcaaacaccgtaaaaatataacaacccgacgaattattctccttcacgaacaccgtatactcgaactacgcgaacgctaatacgttatcgttcacgtcgaccacctccacaaacaccctaaccgtaacccacaataaaaacgaacccccgtcccgcgcgataaccaccaactcgtaaacgaacacactctcgcgatccaaaactctatccaacaccaacgaataataattcttataaataaacaccaacttaaaaaaaacgtaaaacgtcaaaaaacaaataac

SEQ ID NO: 2985 - DNA, 950 bp, Artificial Sequence
  chemically treated genomic DNA (Homo sapiens) CpG-island No: 2985
tcgcgtagatggcgatgattaggtatacgttgatatttattagcgtcgttttcggatttaaaacgttagtcgattgtttcgatgacgtttttggagtttggtcgttttttattagcgatattagaatcgtggtcgtggcggttagcgtaggtttattatgattttttattaggattagtagacggtggcgcggagagttcgtttcgtttaggatacgagtggtgttgatttcgttcgtgtatagttttacgcggaacgggatgcgagggttgtttgtagttggttgtagtttatacgaaagttacgcgttgtagttcgagtcggcgtttattgcgcgtattttcgttattacgtggttcgcgtttatagatcgcggtattagtttgttcgttgcgttattagtgttatttattcgaggttttagtagtgtcggcgcgttgttattttcgtttagtacgaatatttgtagcgttacgttgttgtttagaggcggtacgttcgcgtcgcgcgcgtttatttggaattgtagtagttttagtttttcgtggtttagcggttgtagcgcgtatattttgtcgtttttcgtgtgtatcgaaatgtagttcgatagcgagcgttcgtttattcgtcgttttataagcgagtaggatattagcgcgtttttttgcgcgttcgcgtttcgcgtagatatcgtgaagatgtggtagttcggcgggttgtttttttttacgaatatcgtgtattcgggttgcgcgaacgtcggagtattgtcgtttacgtcggttatttttatagataagttggcggtggtttatagcgaaggcgagttttcgtttcgcgcggttattattaatttataggtcgatattttttcgcggtttagggcgttgtttagtattaacgagtagtaatttttgaaggtggatattagtttgaaggggatatggggt

SEQ ID NO: 2986 - DNA, 950 bp, Artificial Sequence
  chemically treated genomic DNA (Homo sapiens) CpG-island No: 2986
accccatatccccttcaaactaatatccaccttcaaaaattactactcgttaatactaaacaacgccctaaaccgcgaaaaaatatcgacctataaattaataataaccgcgcgaaacgaaaactcgccttcgctataaaccaccgccaacttatctataaaaataaccgacgtaaacgacaatactccgacgttcgcgcaacccgaatacacgatattcgtaaaaaaaaacaacccgccgaactaccacatcttcacgatatctacgcgaaacgcgaacgcgcaaaaaaacgcgctaatatcctactcgcttataaaacgacgaataaacgaacgctcgctatcgaactacatttcgatacacacgaaaaacgacaaaatatacgcgctacaaccgctaaaccacgaaaaactaaaactactacaattccaaataaacgcgcgcgacgcgaacgtaccgcctctaaacaacaacgtaacgctacaaatattcgtactaaacgaaaataacaacgcgccgacactactaaaacctcgaataaataacactaataacgcaacgaacaaactaataccgcgatctataaacgcgaaccacgtaataacgaaaatacgcgcaataaacgccgactcgaactacaacgcgtaactttcgtataaactacaaccaactacaaacaaccctcgcatcccgttccgcgtaaaactatacacgaacgaaatcaacaccactcgtatcctaaacgaaacgaactctccgcgccaccgtctactaatcctaataaaaaatcataataaacctacgctaaccgccacgaccacgattctaatatcgctaataaaaaacgaccaaactccaaaaacgtcatcgaaacaatcgactaacgttttaaatccgaaaacgacgctaataaatatcaacgtatacctaatcatcgccatctacgcga

SEQ ID NO: 2987 - DNA, 950 bp, Artificial Sequence
  chemically treated genomic DNA (Homo sapiens) CpG-island No: 2987
gttttatgttttttttaagttggtgtttatttttaagaattattattcgttggtgttggatagcgttttggatcgcgagagagtgtcggtttatgagttggtggtaatcgcgcgggacgggggttcgttttcgttgtgggttatcgttagtttgtttgtggaggtggtcgacgtgaacgataatgtttcggcgttcgcgtagttcgagtatacggtgttcgtgaaggagaataattcgtcgggttgttatatttttacggtgtttgcgcgagacgcggacgcgtaggagaacgcgttggtgttttattcgtttgtggagcggcgggtgggcgagcgttcgttgtcgagttatatttcggtgtatacggagagcggtaaggtgtacgcgttgtagtcgttggattacgaggagttagagttgttgtagttttaggtgagcgcgcgcgacgcgggcgtgtcgtttttgggtagtaacgtgacgttgtaggtgttcgtgttggacgagaatgataacgcgtcggtattgttggagtttcgggtgggtggtattggtggcgtagcgagtaagttggtgtcgcggtttgtgggcgcgggttacgtggtagcgaaggtgcgcgtagtggacgtcgattcgggttataacgcgtggttttcgtatgagttgtagttagttgtaagtagttttcgtatttcgtttcgcgtggggttgtatacgggcgagattagtattattcgtgttttggacgaagcggatttttcgcgttatcgtttgttggttttggtgaaggattatggtgaatttgcgttgatcgttacggttacggttttggtgtcgttggtggagagcggttaggttttaaaagcgttatcgaggtagtcggttggcgttttgggttcggaagcggcgttggtggatgttaacgtgtatttgattatcgttatttgcgcgg

SEQ ID NO: 2988 - DNA, 950 bp, Artificial Sequence
  chemically treated genomic DNA (Homo sapiens) CpG-island No: 2988
ccgcgcaaataacgataatcaaatacacgttaacatccaccaacgccgcttccgaacccaaaacgccaaccgactacctcgataacgcttttaaaacctaaccgctctccaccaacgacaccaaaaccgtaaccgtaacgatcaacgcaaattcaccataatccttcaccaaaaccaacaaacgataacgcgaaaaatccgcttcgtccaaaacacgaataatactaatctcgcccgtatacaaccccacgcgaaacgaaatacgaaaactacttacaactaactacaactcatacgaaaaccacgcgttataacccgaatcgacgtccactacgcgcaccttcgctaccacgtaacccgcgcccacaaaccgcgacaccaacttactcgctacgccaccaataccacccacccgaaactccaacaataccgacgcgttatcattctcgtccaacacgaacacctacaacgtcacgttactacccaaaaacgacacgcccgcgtcgcgcgcgctcacctaaaactacaacaactctaactcctcgtaatccaacgactacaacgcgtacaccttaccgctctccgtatacaccgaaatataactcgacaacgaacgctcgcccacccgccgctccacaaacgaataaaacaccaacgcgttctcctacgcgtccgcgtctcgcgcaaacaccgtaaaaatataacaacccgacgaattattctccttcacgaacaccgtatactcgaactacgcgaacgccgaaacattatcgttcacgtcgaccacctccacaaacaaactaacgataacccacaacgaaaacgaacccccgtcccgcgcgattaccaccaactcataaaccgacactctctcgcgatccaaaacgctatccaacaccaacgaataataattcttaaaaataaacaccaacttaaaaaaaacataaaac

SEQ ID NO: 2989 - DNA, 1139 bp, Artificial Sequence
  chemically treated genomic DNA (Homo sapiens) CpG-island No: 2989
ttgagtatcgtaacgtcgtgtatagtagtagggtaagtattaatagattggatatcgcgtagatggcgatgattaggtatacgttgatatttattagttcggtttttgggtttgtaatgtttaacgatgttcgcgacgacgtttttggtgtttggtcgttttttattagcgatattagtacggtggttgtggttgttagcgagggtttttcgtggttttttataagtattagaaggcggtggcgcggtgcgttcgttttatttagggttcgtgtcgtgttgattttattagtgtatagttttacgcggaacgggatgttcgtatcggtcgttatcggttgtaatttatacgaaagttacgcgttgtagtttgagttagcgttaattgtacgtattttcgttattatatggttcgcgtttatagatcgcggtataagtttttttattgcgttattagtgttatttattcgaggcgttagtagtgtcggcgcgttgtcgttttcgtttagtacgaatatttgtagcgttacgttgttgtttagaggcggtacgttcgtatcgcgcgcgtttatttggaattgtaatagttttagtttttcgtggtttaacggttgtagcgcgtatattttgtcgtttttcgcgtgtattgatacgtagttcgatagcgcgcgttcgtttattcgtagttttattagcgagtaggatattagcgcgtttttttgcgcgttcgcgtttttcgtcgatatagtgaagatgtggtagttcggcgggttgtttttttttacgaatatcgtatattcgggttgcgcgaacgtcggggcgttgtcgtttacgtcggttatttttacggatacgttagtagtggtttatagagaaggcgagttttcgtttcgcgcggtaattattagtttataggcggatatattttcgcggtttagagcgttgtttagtattaatgaatagtaatttttgaaggtggatattaatttgaagggaacgcggggcgttagggagtaggtaatttgttcgttgattttaaaatttcggttaaatacgttaattaatgtgatgacggtatttggttgggcgttttttggaatagggagagatagggaagtgagagttaattgtggagtattg

SEQ ID NO: 2990 - DNA, 1139 bp, Artificial Sequence
  chemically treated genomic DNA (Homo sapiens) CpG-island No: 2990
caatactccacaattaactctcacttccctatctctccctattccaaaaaacgcccaaccaaataccgtcatcacattaattaacgtatttaaccgaaattttaaaatcaacgaacaaattacctactccctaacgccccgcgttcccttcaaattaatatccaccttcaaaaattactattcattaatactaaacaacgctctaaaccgcgaaaatatatccgcctataaactaataattaccgcgcgaaacgaaaactcgccttctctataaaccactactaacgtatccgtaaaaataaccgacgtaaacgacaacgccccgacgttcgcgcaacccgaatatacgatattcgtaaaaaaaaacaacccgccgaactaccacatcttcactatatcgacgaaaaacgcgaacgcgcaaaaaaacgcgctaatatcctactcgctaataaaactacgaataaacgaacgcgcgctatcgaactacgtatcaatacacgcgaaaaacgacaaaatatacgcgctacaaccgttaaaccacgaaaaactaaaactattacaattccaaataaacgcgcgcgatacgaacgtaccgcctctaaacaacaacgtaacgctacaaatattcgtactaaacgaaaacgacaacgcgccgacactactaacgcctcgaataaataacactaataacgcaataaaaaaacttataccgcgatctataaacgcgaaccatataataacgaaaatacgtacaattaacgctaactcaaactacaacgcgtaactttcgtataaattacaaccgataacgaccgatacgaacatcccgttccgcgtaaaactatacactaataaaatcaacacgacacgaaccctaaataaaacgaacgcaccgcgccaccgccttctaatacttataaaaaaccacgaaaaaccctcgctaacaaccacaaccaccgtactaatatcgctaataaaaaacgaccaaacaccaaaaacgtcgtcgcgaacatcgttaaacattacaaacccaaaaaccgaactaataaatatcaacgtatacctaatcatcgccatctacgcgatatccaatctattaatacttaccctactactatacacgacgttacgatactcaa

SEQ ID NO: 2991 - DNA, 1139 bp, Artificial Sequence
  chemically treated genomic DNA (Homo sapiens) CpG-island No: 2991
taatgttttatagttgatttttatttttttgtttttttttattttagaggacgtttaattaggtatcgttattatattgattagcgtgtttgatcgagattttggagttaacggataggttatttgttttttgacgtttcgcgttttttttaagttggtgtttatttttaagaattattatttattggtgttggatagcgttttggatcgcgagagtgtgttcgtttatgagttggtggttatcgcgcgggacgggggttcgttttttttgtgggttattgttagcgtgttcgtggaggtggtcgacgtgaacgataacgtttcggcgttcgcgtagttcgagtatacggtgttcgtgaaggagaataattcgtcgggttgttatatttttattgtgtcggcgggggacgcggacgcgtagaagaacgcgttggtgttttattcgttggtggagttgcgggtgggcgagcgcgcgttgtcgagttacgtgttagtgtacgcggagagcggtaaggtgtacgcgttgtagtcgttggattacgaggagttggagttgttgtagttttaggtgagcgcgcgcgatgcgggcgtgtcgtttttgggtagtaacgtgacgttgtaggtgttcgtgttggacgagaacgataacgcgtcggtattgttggcgtttcgggtgggtggtattggtggcgtagtgagagagtttgtgtcgcggtttgtgggcgcgggttatgtggtggcgaaggtacgtgtagttgacgttgatttaggttataacgcgtggttttcgtatgagttgtaatcggtggcggtcggtgcgagtatttcgtttcgcgtggggttgtatattggtgagattagtacgatacgagttttagatgagacggacgtatcgcgttatcgttttttggtgtttgtgaaggattacggggagttttcgttgatagttatagttatcgtgttggtgtcgttggtggaaagcggttaggtattaaaggcgtcgtcgcgggtatcgttgggtattgtaggtttagagatcgagttggtggatgttaacgtgtatttgattatcgttatttgcgcggtgtttagtttgttggtgtttattttgttgttgtatacggcgttgcggtgtttag

SEQ ID NO: 2992 - DNA, 1139 bp, Artificial Sequence
  chemically treated genomic DNA (Homo sapiens) CpG-island No: 2992
ctaaacaccgcaacgccgtatacaacaacaaaataaacaccaacaaactaaacaccgcgcaaataacgataatcaaatacacgttaacatccaccaactcgatctctaaacctacaatacccaacgatacccgcgacgacgcctttaatacctaaccgctttccaccaacgacaccaacacgataactataactatcaacgaaaactccccgtaatccttcacaaacaccaaaaaacgataacgcgatacgtccgtctcatctaaaactcgtatcgtactaatctcaccaatatacaaccccacgcgaaacgaaatactcgcaccgaccgccaccgattacaactcatacgaaaaccacgcgttataacctaaatcaacgtcaactacacgtaccttcgccaccacataacccgcgcccacaaaccgcgacacaaactctctcactacgccaccaataccacccacccgaaacgccaacaataccgacgcgttatcgttctcgtccaacacgaacacctacaacgtcacgttactacccaaaaacgacacgcccgcatcgcgcgcgctcacctaaaactacaacaactccaactcctcgtaatccaacgactacaacgcgtacaccttaccgctctccgcgtacactaacacgtaactcgacaacgcgcgctcgcccacccgcaactccaccaacgaataaaacaccaacgcgttcttctacgcgtccgcgtcccccgccgacacaataaaaatataacaacccgacgaattattctccttcacgaacaccgtatactcgaactacgcgaacgccgaaacgttatcgttcacgtcgaccacctccacgaacacgctaacaataacccacaaaaaaaacgaacccccgtcccgcgcgataaccaccaactcataaacgaacacactctcgcgatccaaaacgctatccaacaccaataaataataattcttaaaaataaacaccaacttaaaaaaaacgcgaaacgtcaaaaaacaaataacctatccgttaactccaaaatctcgatcaaacacgctaatcaatataataacgatacctaattaaacgtcctctaaaataaaaaaaaacaaaaaaataaaaatcaactataaaacatta

SEQ ID NO: 2993 - DNA, 1151 bp, Artificial Sequence
  chemically treated genomic DNA (Homo sapiens) CpG-island No: 2993
tcgtcgtgtacgcgttttcggtgggtggcgtcgagtatcgtagcgttgtgtatagtagtagcgtgaggattagtaggttggatatcgcgtagatggcgatgattaggtatacgttgatatttattagcgtcgtttttgggttcgcggcgtttatcgacgttcgtgatgacgtttttggagtttggttattttttattagcgatattagaatcgtggtcgtcgttgttagcgtcggtttatcgtggttttttattagtattagtagtcggtggcgcggagagttcgtttcgtttaggatacgagtggtgttgatttcgttcgtgtatagttttacgcgaaacgggaagcgagcgttgtttgtcgggggttgtagtttatacgaaagttacgcgttgtagtttgagtcggcgttaattgcgcgtattttcgttattatttggtttgtatttagtgatcgcggtattagttcgtttattgtattattagtattatttattcgaggcgttagtagcgtcggcgcgttgtcgttttcgtttagtacgaatatttgtagcgttacgttgttgtttagaggcggtacgttcgcgtcgcgcgcgtttatttgaaattgtagtagttttagtttttcgtggtttagcggttgtagcgcgtatattttgtcgtttttcgcgtgtatcgaaatgtagttcgataacgcgcgttcgtttattcgtcgttttattagcgagtaggatattagcgcgtttttttgcgcgttcgcgtttcgcgtagatatcgtgaagatgtggtagttcggcgggttgtttttttttacgaatattgtgtattcgggttgcgcgaacgtcggagtattgttatttatgtcggttatttttatagataagttggcggtggtttatagcgaaggcgagttttcgtttcgcgcggttattattaatttataggtcgatacgttttcgcggtttagggtattgtttagtattaacgagtagtaatttttgaaggtggatattagtttgaaagggacgtgaggcgttagcgagtagtttatttgttcgttggtatttgaatcgaggtcgtttacgttaattagggcgatgatagtattaaattgagcgtttttacgtataggtaaggataaggaagttagt

SEQ ID NO: 2994 - DNA, 1151 bp, Artificial Sequence
  chemically treated genomic DNA (Homo sapiens) CpG-island No: 2994
actaacttccttatccttacctatacgtaaaaacgctcaatttaatactatcatcgccctaattaacgtaaacgacctcgattcaaataccaacgaacaaataaactactcgctaacgcctcacgtccctttcaaactaatatccaccttcaaaaattactactcgttaatactaaacaataccctaaaccgcgaaaacgtatcgacctataaattaataataaccgcgcgaaacgaaaactcgccttcgctataaaccaccgccaacttatctataaaaataaccgacataaataacaatactccgacgttcgcgcaacccgaatacacaatattcgtaaaaaaaaacaacccgccgaactaccacatcttcacgatatctacgcgaaacgcgaacgcgcaaaaaaacgcgctaatatcctactcgctaataaaacgacgaataaacgaacgcgcgttatcgaactacatttcgatacacgcgaaaaacgacaaaatatacgcgctacaaccgctaaaccacgaaaaactaaaactactacaatttcaaataaacgcgcgcgacgcgaacgtaccgcctctaaacaacaacgtaacgctacaaatattcgtactaaacgaaaacgacaacgcgccgacgctactaacgcctcgaataaataatactaataatacaataaacgaactaataccgcgatcactaaatacaaaccaaataataacgaaaatacgcgcaattaacgccgactcaaactacaacgcgtaactttcgtataaactacaacccccgacaaacaacgctcgcttcccgtttcgcgtaaaactatacacgaacgaaatcaacaccactcgtatcctaaacgaaacgaactctccgcgccaccgactactaatactaataaaaaaccacgataaaccgacgctaacaacgacgaccacgattctaatatcgctaataaaaaataaccaaactccaaaaacgtcatcacgaacgtcgataaacgccgcgaacccaaaaacgacgctaataaatatcaacgtatacctaatcatcgccatctacgcgatatccaacctactaatcctcacgctactactatacacaacgctacgatactcgacgccacccaccgaaaacgcgtacacgacga

SEQ ID NO: 2995 - DNA, 1151 bp, Artificial Sequence
  chemically treated genomic DNA (Homo sapiens) CpG-island No: 2995
attgatttttttatttttgtttgtacgtgaagacgtttaatttggtattgttatcgttttaattagcgtgaacgatttcgatttaggtgttaacgggtaggtgaattgttcgttgacgttttacgttttttttaagttggtgtttatttttaagaattattattcgttggtgttggatagtgttttggatcgcgagagcgtgtcggtttatgagttggtggtaatcgcgcgggacgggggttcgttttcgttgtgggttatcgttagtttgtttgtggaggtggtcgatatgaatgataatgtttcggcgttcgcgtagttcgagtatatagtgttcgtgaaggagaataattcgtcgggttgttatatttttacggtgtttgcgcgagacgcggacgcgtaggagaacgcgttggtgttttattcgttggtggagcggcgggtgggcgagcgcgcgttgtcgagttatatttcggtgtacgcggagagcggtaaggtgtacgcgttgtagtcgttggattacgaggagttagagttgttgtagttttaggtgagcgcgcgcgacgcgggcgtgtcgtttttgggtagtaacgtgacgttgtaggtgttcgtgttggacgagaacgataacgcgtcggcgttgttggcgtttcgggtgggtggtattggtggtgtagtgagcgagttggtgtcgcggttattgggtgtaggttaagtggtggcgaaggtgcgcgtagttgacgtcgatttaggttataacgcgtggttttcgtatgagttgtagttttcggtaagtagcgttcgtttttcgtttcgcgtggggttgtatacgggcgagattagtattattcgtgttttggacgaagcggatttttcgcgttatcggttgttggtgttggtgaaagattacggtgagtcggcgttgatagcgacggttacggttttggtgtcgttggtggagagtggttaggttttaaaggcgttattacgggcgtcggtgggcgtcgcgggtttagaggcggcgttggtggatgttaacgtgtatttgattatcgttatttgcgcggtatttagtttgttggtttttacgttattgttgtatatagcgttgcggtgttcggcgttatttatcgagggcgcgtgtacggcgg

SEQ ID NO: 2996 - DNA, 1151 bp, Artificial Sequence
  chemically treated genomic DNA (Homo sapiens) CpG-island No: 2996
ccgccgtacacgcgccctcgataaataacgccgaacaccgcaacgctatatacaacaataacgtaaaaaccaacaaactaaataccgcgcaaataacgataatcaaatacacgttaacatccaccaacgccgcctctaaacccgcgacgcccaccgacgcccgtaataacgcctttaaaacctaaccactctccaccaacgacaccaaaaccgtaaccgtcgctatcaacgccgactcaccgtaatctttcaccaacaccaacaaccgataacgcgaaaaatccgcttcgtccaaaacacgaataatactaatctcgcccgtatacaaccccacgcgaaacgaaaaacgaacgctacttaccgaaaactacaactcatacgaaaaccacgcgttataacctaaatcgacgtcaactacgcgcaccttcgccaccacttaacctacacccaataaccgcgacaccaactcgctcactacaccaccaataccacccacccgaaacgccaacaacgccgacgcgttatcgttctcgtccaacacgaacacctacaacgtcacgttactacccaaaaacgacacgcccgcgtcgcgcgcgctcacctaaaactacaacaactctaactcctcgtaatccaacgactacaacgcgtacaccttaccgctctccgcgtacaccgaaatataactcgacaacgcgcgctcgcccacccgccgctccaccaacgaataaaacaccaacgcgttctcctacgcgtccgcgtctcgcgcaaacaccgtaaaaatataacaacccgacgaattattctccttcacgaacactatatactcgaactacgcgaacgccgaaacattatcattcatatcgaccacctccacaaacaaactaacgataacccacaacgaaaacgaacccccgtcccgcgcgattaccaccaactcataaaccgacacgctctcgcgatccaaaacactatccaacaccaacgaataataattcttaaaaataaacaccaacttaaaaaaaacgtaaaacgtcaacgaacaattcacctacccgttaacacctaaatcgaaatcgttcacgctaattaaaacgataacaataccaaattaaacgtcttcacgtacaaacaaaaataaaaaaatcaat

SEQ ID NO: 2997 - DNA, 746 bp, Artificial Sequence
  chemically treated genomic DNA (Homo sapiens) CpG-island No: 2997
tgttgatttcgtttgtgtatagttttacgcggaacgggatgcgcgtattgttaggcgttggttgtagtttatacgaaagttaagcgttgtagttcgaattagggtttattgcgcgtattttcgttattacgtggttcgtatttattgatttcggtattagttcgtttattgcgtcgtcggtgttatttattcgaggtattagtagcgtcggcgcgttgtcgttttcgtttagtacgaatatttgtagcgttacgttgttgtttagaggcggtacgttcgcgtcgcgcgcgtttatttggaattgtagtagttttattttttcgtggtttagcggttgtagcgcgtatattttgtcgtttttcgcgtgtatcgaaacgtaattcgatagcgggcgttcgtttattcgtcgttttattagcgagtaggatattagggcgtttttttgcgcgttcgcgtttcgtgtagatatcgtgaagatgtggtagtttggcgggttgtttttttttacgaatacggtatattggggttgcgcgaacgtcggagcgttgtcgtttacgtcggttatttttatagatacgttggcggtggtttatagcgaaggcgagttttcgtttcgcgcggttattattagtttatagatcgatacgttttcgcggtttagggcgttgtttagtattaacgagtagtaatttttgaaggtggatattagtttgaagggaacgtggggtattagggagtaggttatt

SEQ ID NO: 2998 - DNA, 746 bp, Artificial Sequence
  chemically treated genomic DNA (Homo sapiens) CpG-island No: 2998
aataacctactccctaataccccacgttcccttcaaactaatatccaccttcaaaaattactactcgttaatactaaacaacgccctaaaccgcgaaaacgtatcgatctataaactaataataaccgcgcgaaacgaaaactcgccttcgctataaaccaccgccaacgtatctataaaaataaccgacgtaaacgacaacgctccgacgttcgcgcaaccccaatataccgtattcgtaaaaaaaaacaacccgccaaactaccacatcttcacgatatctacacgaaacgcgaacgcgcaaaaaaacgccctaatatcctactcgctaataaaacgacgaataaacgaacgcccgctatcgaattacgtttcgatacacgcgaaaaacgacaaaatatacgcgctacaaccgctaaaccacgaaaaaataaaactactacaattccaaataaacgcgcgcgacgcgaacgtaccgcctctaaacaacaacgtaacgctacaaatattcgtactaaacgaaaacgacaacgcgccgacgctactaatacctcgaataaataacaccgacgacgcaataaacgaactaataccgaaatcaataaatacgaaccacgtaataacgaaaatacgcgcaataaaccctaattcgaactacaacgcttaactttcgtataaactacaaccaacgcctaacaatacgcgcatcccgttccgcgtaaaactatacacaaacgaaatcaaca

SEQ ID NO: 2999 - DNA, 746 bp, Artificial Sequence
  chemically treated genomic DNA (Homo sapiens) CpG-island No: 2999
ggtgatttgttttttaatgttttacgttttttttaagttggtgtttatttttaagaattattattcgttggtgttggatagcgttttggatcgcgagagcgtgtcggtttatgagttggtggtgatcgcgcgggacgggggttcgttttcgttgtgggttatcgttagcgtgtttgtggaagtggtcgacgtgaacgataacgtttcggcgttcgcgtagttttagtatatcgtgttcgtgaaggagaataattcgttaggttgttatatttttacggtgtttgtacgggacgcggacgcgtaggagaacgttttggtgttttattcgttggtggagcggcgggtgggcgagcgttcgttgtcgagttacgtttcggtgtacgcggagagcggtaaggtgtacgcgttgtagtcgttggattacgaggaagtggagttgttgtagttttaggtgagcgcgcgcgacgcgggcgtgtcgtttttgggtagtaacgtgacgttgtaggtgttcgtgttggacgagaacgataacgcgtcggcgttgttggtgtttcgagtgggtggtatcggcggcgtagtgagcgagttggtgtcgaggttagtgggtgcgggttacgtggtggcgaaggtgcgcgtagtggattttgattcgggttataacgtttggttttcgtatgagttgtagttagcgtttggtagtgcgcgtatttcgtttcgcgtggggttgtatataggcgagattagta

SEQ ID NO: 3000 - DNA, 746 bp, Artificial Sequence
  chemically treated genomic DNA (Homo sapiens) CpG-island No: 3000
tactaatctcgcctatatacaaccccacgcgaaacgaaatacgcgcactaccaaacgctaactacaactcatacgaaaaccaaacgttataacccgaatcaaaatccactacgcgcaccttcgccaccacgtaacccgcacccactaacctcgacaccaactcgctcactacgccgccgataccacccactcgaaacaccaacaacgccgacgcgttatcgttctcgtccaacacgaacacctacaacgtcacgttactacccaaaaacgacacgcccgcgtcgcgcgcgctcacctaaaactacaacaactccacttcctcgtaatccaacgactacaacgcgtacaccttaccgctctccgcgtacaccgaaacgtaactcgacaacgaacgctcgcccacccgccgctccaccaacgaataaaacaccaaaacgttctcctacgcgtccgcgtcccgtacaaacaccgtaaaaatataacaacctaacgaattattctccttcacgaacacgatatactaaaactacgcgaacgccgaaacgttatcgttcacgtcgaccacttccacaaacacgctaacgataacccacaacgaaaacgaacccccgtcccgcgcgatcaccaccaactcataaaccgacacgctctcgcgatccaaaacgctatccaacaccaacgaataataattcttaaaaataaacaccaacttaaaaaaaacgtaaaacattaaaaaacaaatcacc

SEQ ID NO: 3001 - DNA, 1015 bp, Artificial Sequence
  chemically treated genomic DNA (Homo sapiens) CpG-island No: 3001
gtacgcgttttcggtgggtagcgtagagtatcgtagcgcggtgtatagtagtagcgtgagtattaaaaggttggatatcgcgtagatggtaatgattaggtatacgttgatatttattagcgtagtatcgggatttatagcgtttattaacgttcgtgaggaggtttttggcgtttgtttattttttataagtgatattagtatagtggtcgtggtcgttagcgcgggttcgtcgtggttttttattagtattagtaggcggtggcgcggagcgttcgtttcgtttagggtacgcgttgtgttgatttcgttagtgtatagttttacgcggaacgggatgcgcgcgttattagttttcggttgtagttcgtacgaaagttacgcgttgtagttcgagttagtatttatcgcgcgtatttttgttattacgtggtttatatttatcgattatggtattagttcgtttattgcgttattagtgttattcgttcgaggcgttagtagtgttggcgcgttgtcgttttcgtttagtacgaatatttgtagcgttacgttgttgtttagaggtggtacgtcggtatcgcgagcggttatttgaaattgtagtagttttagtttttcgtggtttagcggttgtagcgcgtatattttgtcgtttttcgtatgtatcgaaacgtagttcgatagcgcgcgtttttttattcgtcgttttattagcgagtaggatattagcgcgtttttttgcgcgttcgcgttttacgtagatatagtgaagatgtggtagttcggcgggttgtttttttttacgaatattgtgtattcgggttgcgcgaacgtcggagcgttgtcgtttatattagttatttttatagaaatattggtcgtggtttatagcgaaggcgagttttcgtttcgcgcggttattattagtttataggttgatacgttttcgcggtttagggtattgtttagtattaacgagtagtaatttttgaaggtggatattagtttgaag

SEQ ID NO: 3002 - DNA, 1015 bp, Artificial Sequence
  chemically treated genomic DNA (Homo sapiens) CpG-island No: 3002
cttcaaactaatatccaccttcaaaaattactactcgttaatactaaacaataccctaaaccgcgaaaacgtatcaacctataaactaataataaccgcgcgaaacgaaaactcgccttcgctataaaccacgaccaatatttctataaaaataactaatataaacgacaacgctccgacgttcgcgcaacccgaatacacaatattcgtaaaaaaaaacaacccgccgaactaccacatcttcactatatctacgtaaaacgcgaacgcgcaaaaaaacgcgctaatatcctactcgctaataaaacgacgaataaaaaaacgcgcgctatcgaactacgtttcgatacatacgaaaaacgacaaaatatacgcgctacaaccgctaaaccacgaaaaactaaaactactacaatttcaaataaccgctcgcgataccgacgtaccacctctaaacaacaacgtaacgctacaaatattcgtactaaacgaaaacgacaacgcgccaacactactaacgcctcgaacgaataacactaataacgcaataaacgaactaataccataatcgataaatataaaccacgtaataacaaaaatacgcgcgataaatactaactcgaactacaacgcgtaactttcgtacgaactacaaccgaaaactaataacgcgcgcatcccgttccgcgtaaaactatacactaacgaaatcaacacaacgcgtaccctaaacgaaacgaacgctccgcgccaccgcctactaatactaataaaaaaccacgacgaacccgcgctaacgaccacgaccactatactaatatcacttataaaaaataaacaaacgccaaaaacctcctcacgaacgttaataaacgctataaatcccgatactacgctaataaatatcaacgtatacctaatcattaccatctacgcgatatccaaccttttaatactcacgctactactatacaccgcgctacgatactctacgctacccaccgaaaacgcgtac

SEQ ID NO: 3003 - DNA, 1015 bp, Artificial Sequence
  chemically treated genomic DNA (Homo sapiens) CpG-island No: 3003
ttttaagttggtgtttatttttaagaattattattcgttggtgttggatagtgttttggatcgcgagagcgtgttagtttatgagttggtggtgatcgcgcgagacgggggttcgttttcgttgtgggttacggttagtgtttttgtggaggtggttgatgtgaacgataacgtttcggcgttcgcgtagttcgagtatatagtgttcgtgaaggagaataattcgtcgggttgttatatttttattgtgtttgcgtgggacgcggacgcgtaggagaacgcgttggtgttttattcgttggtagagcggcgggtaggggagcgcgcgttgtcgagttacgtttcggtgtatgcggagagcggtaaggtgtacgcgttgtagtcgttggattacgaggagttagagttgttgtagttttaggtgatcgttcgcgatgtcggcgtgttatttttgggtagtaacgtgacgttgtaggtgttcgtgttggacgaaaacgataacgcgttagtattgttagcgtttcgggcgggtggtattggtggcgtagtgagcgagttggtgttatggtcggtgggtgtgggttacgtggtggtaaaggtgcgcgcggtggatgttgattcgggttataacgcgtggttttcgtacgagttgtagtcggggattggtggcgcgcgtatttcgtttcgcgtggggttgtatattggcgagattagtataacgcgtgttttggacgaaacggacgtttcgcgttatcgtttattggtattggtgaaggattacggcgagttcgcgttgacggttacggttattgtgttggtgttatttgtggagagtggataggcgttaaaggtttttttacgggcgttggtgggcgttgtgggtttcgatgttgcgttggtggatgttaacgtatatttgattattgttatttgcgcggtgtttagttttttggtgtttacgttgttgttgtatatcgcgttgcggtgttttgcgttgtttatcgagggcgcgtgt

SEQ ID NO: 3004 - DNA, 1015 bp, Artificial Sequence
  chemically treated genomic DNA (Homo sapiens) CpG-island No: 3004
acacgcgccctcgataaacaacgcaaaacaccgcaacgcgatatacaacaacaacgtaaacaccaaaaaactaaacaccgcgcaaataacaataatcaaatatacgttaacatccaccaacgcaacatcgaaacccacaacgcccaccaacgcccgtaaaaaaacctttaacgcctatccactctccacaaataacaccaacacaataaccgtaaccgtcaacgcgaactcgccgtaatccttcaccaataccaataaacgataacgcgaaacgtccgtttcgtccaaaacacgcgttatactaatctcgccaatatacaaccccacgcgaaacgaaatacgcgcgccaccaatccccgactacaactcgtacgaaaaccacgcgttataacccgaatcaacatccaccgcgcgcacctttaccaccacgtaacccacacccaccgaccataacaccaactcgctcactacgccaccaataccacccgcccgaaacgctaacaatactaacgcgttatcgttttcgtccaacacgaacacctacaacgtcacgttactacccaaaaataacacgccgacatcgcgaacgatcacctaaaactacaacaactctaactcctcgtaatccaacgactacaacgcgtacaccttaccgctctccgcatacaccgaaacgtaactcgacaacgcgcgctcccctacccgccgctctaccaacgaataaaacaccaacgcgttctcctacgcgtccgcgtcccacgcaaacacaataaaaatataacaacccgacgaattattctccttcacgaacactatatactcgaactacgcgaacgccgaaacgttatcgttcacatcaaccacctccacaaaaacactaaccgtaacccacaacgaaaacgaacccccgtctcgcgcgatcaccaccaactcataaactaacacgctctcgcgatccaaaacactatccaacaccaacgaataataattcttaaaaataaacaccaacttaaaa

SEQ ID NO: 3005 - DNA, 743 bp, Artificial Sequence
  chemically treated genomic DNA (Homo sapiens) CpG-island No: 3005
gcgcggggcgtttatttcgtttagggtacgggtcgtgttgatttttttcgtgtatagttttacgcgaaacgggatgcgcgtatcgtcggttttaggttgtagtttatacgaaagttacgcgttgtagtttgagtttgtatttattgcgcgtattttcgttattacgtggttcgtatttattgatcgcggtattagttcgtttattgcgttatcgatgttatttattcgaggtattagtagtgtcggcgcgttgtcgttttcgtttagtacgaatatttgtagcgttacgttgttgtttagaggcggtacgttcgtatcgcgcgtatttatttggaattgtagtagttttagtttttcgtggtttagcggttgtagcgcgtatattttgtcgtttttcgcgtgtatcgatacgtagttcgatagcgcgcgtttttttattcgtcgttttattagcgagtaggatattagggcgtttttttgcgcgttcgcgtttcgcgtagatatcgtgaagatgtggtagttcggcgggttgtttttttttacgaatatcgtgtattcggattgcgagaatgtcggcgtattgtcgtttacgtcggttatttttacggatacgttggtcgtggtttatagtgaaggcgagttttcgtttcgagtagttattattagtttataggtcgatacgttttcgcggtttagagggttgtttagtattaatgagtagtaatttttgaaggtggatatta

SEQ ID NO: 3006 - DNA, 743 bp, Artificial Sequence
  chemically treated genomic DNA (Homo sapiens) CpG-island No: 3006
taatatccaccttcaaaaattactactcattaatactaaacaaccctctaaaccgcgaaaacgtatcgacctataaactaataataactactcgaaacgaaaactcgccttcactataaaccacgaccaacgtatccgtaaaaataaccgacgtaaacgacaatacgccgacattctcgcaatccgaatacacgatattcgtaaaaaaaaacaacccgccgaactaccacatcttcacgatatctacgcgaaacgcgaacgcgcaaaaaaacgccctaatatcctactcgctaataaaacgacgaataaaaaaacgcgcgctatcgaactacgtatcgatacacgcgaaaaacgacaaaatatacgcgctacaaccgctaaaccacgaaaaactaaaactactacaattccaaataaatacgcgcgatacgaacgtaccgcctctaaacaacaacgtaacgctacaaatattcgtactaaacgaaaacgacaacgcgccgacactactaatacctcgaataaataacatcgataacgcaataaacgaactaataccgcgatcaataaatacgaaccacgtaataacgaaaatacgcgcaataaatacaaactcaaactacaacgcgtaactttcgtataaactacaacctaaaaccgacgatacgcgcatcccgtttcgcgtaaaactatacacgaaaaaaatcaacacgacccgtaccctaaacgaaataaacgccccgcgc

SEQ ID NO: 3007 - DNA, 743 bp, Artificial Sequence
  chemically treated genomic DNA (Homo sapiens) CpG-island No: 3007
tggtgtttatttttaagaattattatttattggtgttggatagttttttggatcgcgagagcgtgtcggtttatgagttggtggtgattgttcgggacgggggttcgtttttattgtgggttacggttagcgtgttcgtggaggtggtcgacgtgaacgataatgcgtcggtattttcgtagttcgagtatacggtgttcgtgaaggagaataattcgtcgggttgttatatttttacggtgtttgcgcgggacgcggacgcgtaggagaacgttttggtgttttattcgttggtggaacggcgggtgggggagcgcgcgttgtcgagttacgtgtcggtatacgcggagagcggtaaggtgtacgcgttgtagtcgttggattacgaggagttagagttgttgtagttttaggtgagtgcgcgcgatgcgggcgtgtcgtttttgggtagtaacgtgacgttgtaggtgttcgtgttggacgagaacgataacgcgtcggtattgttgatgtttcgggtgggtggtatcggtggcgtagtgagcgagttggtgtcgcggttagtgggtgcgggttacgtggtagcgaaggtgcgcgtagtggatgtagatttaggttataacgcgtggttttcgtatgagttgtagtttgggatcggcggtgcgcgtatttcgtttcgcgtggggttgtatacgggagagattagtacgattcgtgttttggacgaggtggacgtttcgcgt

SEQ ID NO: 3008 - DNA, 743 bp, Artificial Sequence
  chemically treated genomic DNA (Homo sapiens) CpG-island No: 3008
acgcgaaacgtccacctcgtccaaaacacgaatcgtactaatctctcccgtatacaaccccacgcgaaacgaaatacgcgcaccgccgatcccaaactacaactcatacgaaaaccacgcgttataacctaaatctacatccactacgcgcaccttcgctaccacgtaacccgcacccactaaccgcgacaccaactcgctcactacgccaccgataccacccacccgaaacatcaacaataccgacgcgttatcgttctcgtccaacacgaacacctacaacgtcacgttactacccaaaaacgacacgcccgcatcgcgcgcactcacctaaaactacaacaactctaactcctcgtaatccaacgactacaacgcgtacaccttaccgctctccgcgtataccgacacgtaactcgacaacgcgcgctcccccacccgccgttccaccaacgaataaaacaccaaaacgttctcctacgcgtccgcgtcccgcgcaaacaccgtaaaaatataacaacccgacgaattattctccttcacgaacaccgtatactcgaactacgaaaataccgacgcattatcgttcacgtcgaccacctccacgaacacgctaaccgtaacccacaataaaaacgaacccccgtcccgaacaatcaccaccaactcataaaccgacacgctctcgcgatccaaaaaactatccaacaccaataaataataattcttaaaaataaacacca

SEQ ID NO: 3009 - DNA, 1166 bp, Artificial Sequence
  chemically treated genomic DNA (Homo sapiens) CpG-island No: 3009
cgcgcgcgtattttcggtgggtggtatcgagtatcgtagcgtagtgtatagtagtatcgtgagtattaataggttggatatcgcgtagatggcgatgattaggtatacgttgatatttattagcgtagtttttgagttcgcggcgtttatttacgttcgcgacgaggttttgggtgtttggttattttttattaacgatattaatacggtggtcgtggttgttaacgttggttcgtcgtggttttttattagtacgagtaggcggtgtcgaggggagttagtttcgtttagggtacgtgtcgtgttgattttattcgtgtatagttttacgcggaacgggatgcgagcgttgttagtatttagttgaagttcgtacgaaagttacgcgttgtagtttgagttagcgtttattgcgcgtattttcgttattacgtgttttgtatttatcgattacggtattagtttatttattgcgttagtagcggtgttagttttaggcgttaatagtgtcggcgcgttgtcgttttcgtttagtacgaatatttgtagcgttacgttgttgtttagaggcggtacgttcgtatttcgcgcgtttatttggaattgtagtagttttattttttcgtggtttagcggttgtagcgcgtatattttgtcgtttttcgcgtgtatcgaaacgtagttcgataacgcgcgttcgtttattcgtcgttttattagcgagtaggatattagcgcgtttttttgcgcgttcgtattttacgttgatatcgtgaagatgtggtagttcggcgggttgtttttttttacgaatattgtgtatttaggttgtgcgaacgtcggcgcgttgtcgtttacgtcggttatttcgatggatacgttggtggtggtttatagtgaaggcgagttttcgtttcgtgcggttattattagtttataggttgatacgttttcgcggtttagggcgttgtttagtattaacgagtagtaatttttgaaggtggatattagtttgaaagggacgtggggcgttagggagtaggtgatatgtttattcgtattagagtcgcgattcgatatcgtgatgagagtaatgatagtgtttagggaagcgttttttgagatgggaagtgagagagacgttattgagatttttggtgtgttat

SEQ ID NO: 3010 - DNA, 1166 bp, Artificial Sequence
  chemically treated genomic DNA (Homo sapiens) CpG-island No: 3010
ataacacaccaaaaatctcaataacgtctctctcacttcccatctcaaaaaacgcttccctaaacactatcattactctcatcacgatatcgaatcgcgactctaatacgaataaacatatcacctactccctaacgccccacgtccctttcaaactaatatccaccttcaaaaattactactcgttaatactaaacaacgccctaaaccgcgaaaacgtatcaacctataaactaataataaccgcacgaaacgaaaactcgccttcactataaaccaccaccaacgtatccatcgaaataaccgacgtaaacgacaacgcgccgacgttcgcacaacctaaatacacaatattcgtaaaaaaaaacaacccgccgaactaccacatcttcacgatatcaacgtaaaatacgaacgcgcaaaaaaacgcgctaatatcctactcgctaataaaacgacgaataaacgaacgcgcgttatcgaactacgtttcgatacacgcgaaaaacgacaaaatatacgcgctacaaccgctaaaccacgaaaaaataaaactactacaattccaaataaacgcgcgaaatacgaacgtaccgcctctaaacaacaacgtaacgctacaaatattcgtactaaacgaaaacgacaacgcgccgacactattaacgcctaaaactaacaccgctactaacgcaataaataaactaataccgtaatcgataaatacaaaacacgtaataacgaaaatacgcgcaataaacgctaactcaaactacaacgcgtaactttcgtacgaacttcaactaaatactaacaacgctcgcatcccgttccgcgtaaaactatacacgaataaaatcaacacgacacgtaccctaaacgaaactaactcccctcgacaccgcctactcgtactaataaaaaaccacgacgaaccaacgttaacaaccacgaccaccgtattaatatcgttaataaaaaataaccaaacacccaaaacctcgtcgcgaacgtaaataaacgccgcgaactcaaaaactacgctaataaatatcaacgtatacctaatcatcgccatctacgcgatatccaacctattaatactcacgatactactatacactacgctacgatactcgataccacccaccgaaaatacgcgcgcg

SEQ ID NO: 3011 - DNA, 1166 bp, Artificial Sequence
  chemically treated genomic DNA (Homo sapiens) CpG-island No: 3011
ataatatattagaagttttaataacgttttttttattttttattttagagaacgtttttttgggtattgttattgtttttattacggtgtcggatcgcgattttggtacgaatggatatgttatttgttttttgacgttttacgttttttttaagttggtgtttatttttaagaattattattcgttggtgttggatagcgttttggatcgcgagagcgtgttagtttatgagttggtggtgatcgtacgggacgggggttcgtttttattgtgggttattattagcgtgtttatcgaggtggtcgacgtgaacgataacgcgtcggcgttcgtatagtttgagtatatagtattcgtgaaggagaataattcgtcgggttgttatatttttacggtgttagcgtgggatgcggacgcgtaggagaacgcgttggtgttttattcgttggtggagcggcgggtgggcgagcgcgcgttgtcgagttacgtttcggtgtacgcggagagcggtaaggtgtacgcgttgtagtcgttggattacgaggaagtggagttgttgtagttttaggtgagcgcgcgggatgcgggcgtgtcgtttttgggtagtaacgtgacgttgtaggtgttcgtgttggacgagaacgataacgcgtcggtattgttggcgtttagggttggtatcgttgttggcgtagtgagtgagttggtgtcgtggtcggtgggtgtagggtacgtggtggcgaaggtgcgcgtagtggacgttgatttaggttataacgcgtggttttcgtacgagttttagttgggtattggtagcgttcgtatttcgtttcgcgtggggttatatacgggtgagattagtacgatacgtgttttagacgaggttgatttttttcgatatcgtttattcgtgttggtgaaggattacggcgaattagcgttgatagttacggttatcgtgttagtgtcgttggtggaaagtggttaggtatttaaggtttcgtcgcgggcgtgggtgggcgtcgcgggtttagaggttacgttggtggatgttaacgtgtatttgattatcgttatttgcgcggtatttagtttgttggtgtttacggtgttgttgtatattgcgttgcggtgttcggtgttatttatcgagggtgcgcgcgcg

SEQ ID NO: 3012 - DNA, 1166 bp, Artificial Sequence
  chemically treated genomic DNA (Homo sapiens) CpG-island No: 3012
cgcgcgcgcaccctcgataaataacaccgaacaccgcaacgcaatatacaacaacaccgtaaacaccaacaaactaaataccgcgcaaataacgataatcaaatacacgttaacatccaccaacgtaacctctaaacccgcgacgcccacccacgcccgcgacgaaaccttaaatacctaaccactttccaccaacgacactaacacgataaccgtaactatcaacgctaattcgccgtaatccttcaccaacacgaataaacgatatcgaaaaaaatcaacctcgtctaaaacacgtatcgtactaatctcacccgtatataaccccacgcgaaacgaaatacgaacgctaccaatacccaactaaaactcgtacgaaaaccacgcgttataacctaaatcaacgtccactacgcgcaccttcgccaccacgtaccctacacccaccgaccacgacaccaactcactcactacgccaacaacgataccaaccctaaacgccaacaataccgacgcgttatcgttctcgtccaacacgaacacctacaacgtcacgttactacccaaaaacgacacgcccgcatcccgcgcgctcacctaaaactacaacaactccacttcctcgtaatccaacgactacaacgcgtacaccttaccgctctccgcgtacaccgaaacgtaactcgacaacgcgcgctcgcccacccgccgctccaccaacgaataaaacaccaacgcgttctcctacgcgtccgcatcccacgctaacaccgtaaaaatataacaacccgacgaattattctccttcacgaatactatatactcaaactatacgaacgccgacgcgttatcgttcacgtcgaccacctcgataaacacgctaataataacccacaataaaaacgaacccccgtcccgtacgatcaccaccaactcataaactaacacgctctcgcgatccaaaacgctatccaacaccaacgaataataattcttaaaaataaacaccaacttaaaaaaaacgtaaaacgtcaaaaaacaaataacatatccattcgtaccaaaatcgcgatccgacaccgtaataaaaacaataacaatacccaaaaaaacgttctctaaaataaaaaataaaaaaaacgttattaaaacttctaatatattat

SEQ ID NO: 3013 - DNA, 974 bp, Artificial Sequence
  chemically treated genomic DNA (Homo sapiens) CpG-island No: 3013
atatcgcgtagatggcgatgattaggtatacgttgatatttattagcgtcgtttttgggttcgcgatatttatcgacgttcgcgaagacgtttttggcgtttggtcgttttttattagagatataagtatagtggtcgtggttgttagcgtcggtttatcgtgattttttattagtattagaaggcggtagcgcgataagttagtttcgtttaggatacgagtcgtgttgatttcgttcgtgtatagttttacgcggaacgggatgcgcgcgtcgtttgttgtcggttgtagtttataggatagttacgcgttgtagttcgagtcggcgtttattgcgcgtattttcgttattatatgattcgtatttattaatcgcggtattagtttattgattgtattaatagtgttatttattcgaggcgttagtagcgtcggcgcgttgtcgttttcgtttagtacgaatatttgtagcgttacgttgttgtttagaggcggtacgttcgtatttcgcgcgtttatttggaattgtagtagttttagtttttcgtggtttaggggttgtagtgcgtatattttgtcgtttttcgcgtgtattgatacgtagttcgatagcgcgcgttcgtttattcgtcgttttattagcgaataggatattagcgcgtttttttgcgcgttcgcgtttcgcgtagatatcgtgaagatgtggtagttcggcgggttgtttttttttacgaatattgtgtattcgggttgcgcgaacgtaggcgcgttgttatttacgtcggttatttttacggatattttggtcgtggtttatagcgaaggcgagttttcgtttcgcgcggttattattagtttatagatcgataggttttcgcgatttagggcgttgtttaatattaacgagtagtaatttttgaaggtggatattagtttgaaggggacgtggggtattaaggagtaagttatttgt

SEQ ID NO: 3014 - DNA, 974 bp, Artificial Sequence
  chemically treated genomic DNA (Homo sapiens) CpG-island No: 3014
acaaataacttactccttaataccccacgtccccttcaaactaatatccaccttcaaaaattactactcgttaatattaaacaacgccctaaatcgcgaaaacctatcgatctataaactaataataaccgcgcgaaacgaaaactcgccttcgctataaaccacgaccaaaatatccgtaaaaataaccgacgtaaataacaacgcgcctacgttcgcgcaacccgaatacacaatattcgtaaaaaaaaacaacccgccgaactaccacatcttcacgatatctacgcgaaacgcgaacgcgcaaaaaaacgcgctaatatcctattcgctaataaaacgacgaataaacgaacgcgcgctatcgaactacgtatcaatacacgcgaaaaacgacaaaatatacgcactacaacccctaaaccacgaaaaactaaaactactacaattccaaataaacgcgcgaaatacgaacgtaccgcctctaaacaacaacgtaacgctacaaatattcgtactaaacgaaaacgacaacgcgccgacgctactaacgcctcgaataaataacactattaatacaatcaataaactaataccgcgattaataaatacgaatcatataataacgaaaatacgcgcaataaacgccgactcgaactacaacgcgtaactatcctataaactacaaccgacaacaaacgacgcgcgcatcccgttccgcgtaaaactatacacgaacgaaatcaacacgactcgtatcctaaacgaaactaacttatcgcgctaccgccttctaatactaataaaaaatcacgataaaccgacgctaacaaccacgaccactatacttatatctctaataaaaaacgaccaaacgccaaaaacgtcttcgcgaacgtcgataaatatcgcgaacccaaaaacgacgctaataaatatcaacgtatacctaatcatcgccatctacgcgatat

SEQ ID NO: 3015 - DNA, 974 bp, Artificial Sequence
  chemically treated genomic DNA (Homo sapiens) CpG-island No: 3015
gtaggtgatttgttttttaatgttttacgttttttttaagttggtgtttatttttaagaattattattcgttggtgttggatagcgttttggatcgcgagagtttgtcggtttatgagttggtggtgatcgcgcgggacgggggttcgttttcgttgtgggttacggttagggtgttcgtggaggtggtcgacgtgaatgataacgcgtttgcgttcgcgtagttcgagtatatagtattcgtgaaggagaataattcgtcgggttgttatatttttacggtgtttgcgcgggacgcggacgcgtaggagaacgcgttggtgttttattcgttggtggaacggcgggtgggcgagcgcgcgttgtcgaattacgtgttagtgtacgcggagagcggtaaggtgtacgtattgtagtttttggattacgaggagttggagttgttgtagttttaggtgagcgcgcgggatgcgggcgtgtcgtttttgggtagtaacgtgacgttgtaggtgttcgtgttggacgagaacgataacgcgtcggcgttgttggcgtttcgagtgggtggtattattggtgtagttagtgagttggtgtcgcgattggtgggtgcgggttatgtggtggcgaaggtgcgcgtagtggacgtcgattcgggttataacgcgtggttgttttatgaattgtagtcggtagtaggcggcgcgcgtatttcgtttcgcgtggggttgtatacgggcgagattagtacgattcgtgttttggacgaggttgatttgtcgcgttatcgttttttggtgttagtgaaggattacggtgagtcggcgttgatagttacggttattgtgtttgtatttttggtggagagcggttaggcgttaaaggcgttttcgcgggcgtcggtgggtgtcgcgggtttagaggcggcgttggtggatgttaacgtgtatttgattatcgttatttgcgcggtgt

SEQ ID NO: 3016 - DNA, 974 bp, Artificial Sequence
  chemically treated genomic DNA (Homo sapiens) CpG-island No: 3016
acaccgcgcaaataacgataatcaaatacacgttaacatccaccaacgccgcctctaaacccgcgacacccaccgacgcccgcgaaaacgcctttaacgcctaaccgctctccaccaaaaatacaaacacaataaccgtaactatcaacgccgactcaccgtaatccttcactaacaccaaaaaacgataacgcgacaaatcaacctcgtccaaaacacgaatcgtactaatctcgcccgtatacaaccccacgcgaaacgaaatacgcgcgccgcctactaccgactacaattcataaaacaaccacgcgttataacccgaatcgacgtccactacgcgcaccttcgccaccacataacccgcacccaccaatcgcgacaccaactcactaactacaccaataataccacccactcgaaacgccaacaacgccgacgcgttatcgttctcgtccaacacgaacacctacaacgtcacgttactacccaaaaacgacacgcccgcatcccgcgcgctcacctaaaactacaacaactccaactcctcgtaatccaaaaactacaatacgtacaccttaccgctctccgcgtacactaacacgtaattcgacaacgcgcgctcgcccacccgccgttccaccaacgaataaaacaccaacgcgttctcctacgcgtccgcgtcccgcgcaaacaccgtaaaaatataacaacccgacgaattattctccttcacgaatactatatactcgaactacgcgaacgcaaacgcgttatcattcacgtcgaccacctccacgaacaccctaaccgtaacccacaacgaaaacgaacccccgtcccgcgcgatcaccaccaactcataaaccgacaaactctcgcgatccaaaacgctatccaacaccaacgaataataattcttaaaaataaacaccaacttaaaaaaaacgtaaaacattaaaaaacaaatcacctac

SEQ ID NO: 3017 - DNA, 585 bp, Artificial Sequence
  chemically treated genomic DNA (Homo sapiens) CpG-island No: 3017
ggtagcgtttttaagcgtttggatattttcgatcgttagggtattttgtatcgttttagtatttatattaagatgttttttgttcgcgagtttttcgagaggttggtgttcgtttttcgcgataagtttgagtattttaatagttattattattcggttttcggtaaggttattttggttcggtatcgcgttaatgtttttcgggaggttttgcggatcggttttggggtgcgttttttcgagttcgtttagtatttgttggacgtgtatcggttcgtggggatggatatttattgggattatgttagtcggttttgtagtttttgttttatcgattacgatttcgtaggtaagttcgagagtatggaggacgatgttaatttttttttgagttttattcgcgcgtcgcggaatttgattttttttcggtttaaggatcggtattcgtaggaggcgcggattatagcgaggatcgtttattagtatttcgtttaattttcggttttgtaaaggtagcgtatttacgatttttattatatggattatttgatgtttaattattttaagttttttgtagatttgtat

SEQ ID NO: 3018 - DNA, 585 bp, Artificial Sequence
  chemically treated genomic DNA (Homo sapiens) CpG-island No: 3018
atacaaatctacaaaaaacttaaaataattaaacatcaaataatccatataataaaaatcgtaaatacgctacctttacaaaaccgaaaattaaacgaaatactaataaacgatcctcgctataatccgcgcctcctacgaataccgatccttaaaccgaaaaaaaatcaaattccgcgacgcgcgaataaaactcaaaaaaaaattaacatcgtcctccatactctcgaacttacctacgaaatcgtaatcgataaaacaaaaactacaaaaccgactaacataatcccaataaatatccatccccacgaaccgatacacgtccaacaaatactaaacgaactcgaaaaaacgcaccccaaaaccgatccgcaaaacctcccgaaaaacattaacgcgataccgaaccaaaataaccttaccgaaaaccgaataataataactattaaaatactcaaacttatcgcgaaaaacgaacaccaacctctcgaaaaactcgcgaacaaaaaacatcttaatataaatactaaaacgatacaaaataccctaacgatcgaaaatatccaaacgcttaaaaacgctacc

SEQ ID NO: 3019 - DNA, 585 bp, Artificial Sequence
  chemically treated genomic DNA (Homo sapiens) CpG-island No: 3019
gtatagatttgtaaagggtttggaatagttgaatattaggtaatttatgtagtagaagtcgtaggtgcgttgtttttgtagggtcgagagttgggcgaagtattggtgggcgattttcgttgtggttcgcgttttttgcgagtgtcggtttttgaatcgggggaaggttaggtttcgcggcgcgcggatgaggtttaggaagaagttggtatcgttttttatgttttcgaatttgtttacgaaatcgtagtcgatgaggtaggggttgtagagtcggttgatatggttttagtgaatgtttatttttacgggtcggtgtacgtttagtaggtattggacgaattcgggaaaacgtattttagagtcggttcgtagggtttttcgagaggtattggcgcggtatcgggttaggatggttttgtcgaagatcgggtgatagtagttgttggggtgtttaaatttgtcgcggaaggcggatattagtttttcgaagggttcgcggataaagagtattttggtgtaggtgttgagacggtgtaagatattttggcggtcgaaggtgtttaggcgtttgagagcgttgtt

SEQ ID NO: 3020 - DNA, 585 bp, Artificial Sequence
  chemically treated genomic DNA (Homo sapiens) CpG-island No: 3020
aacaacgctctcaaacgcctaaacaccttcgaccgccaaaatatcttacaccgtctcaacacctacaccaaaatactctttatccgcgaacccttcgaaaaactaatatccgccttccgcgacaaatttaaacaccccaacaactactatcacccgatcttcgacaaaaccatcctaacccgataccgcgccaatacctctcgaaaaaccctacgaaccgactctaaaatacgttttcccgaattcgtccaatacctactaaacgtacaccgacccgtaaaaataaacattcactaaaaccatatcaaccgactctacaacccctacctcatcgactacgatttcgtaaacaaattcgaaaacataaaaaacgataccaacttcttcctaaacctcatccgcgcgccgcgaaacctaaccttcccccgattcaaaaaccgacactcgcaaaaaacgcgaaccacaacgaaaatcgcccaccaatacttcgcccaactctcgaccctacaaaaacaacgcacctacgacttctactacataaattacctaatattcaactattccaaaccctttacaaatctatac

SEQ ID NO: 3021 - DNA, 550 bp, Artificial Sequence
  chemically treated genomic DNA (Homo sapiens) CpG-island No: 3021
gtcgttagggggcgtttaggttcggtcggagtcggcggtcgggatttaggcgtcgtttcggttcgtgcgtattcgtttcgcggttttagtcggttttcggttcgggcgtttttggagttaggcgggggcgtagtgtcggttagtcgcgcgtttcgttttttaggagtcgggaaatggtcgtcgaggaggaggaggaggtacgggcggggcgtaaaggaaataggaggaagaggaaggggaggaggagtgggagtgggagaaaaggaggaaggggcggtcgaagcggagattggggaggggcgttcggggcgcggatttcggtcgcggggagttttggttgtcgtcgtttttatcgcgtcgcgcgcgtaaaggaaatggcgcgtttagtcgcgagcggtcggttcggtgttttagcgcgtttttttttcgcggcggtcgatcgcgtgttcgtagacgttacgggagaggggtagcggggtagagattttgggagggcggttagggagcgggggaggggcggtttggttttcggtttcgttttagtttcgat

SEQ ID NO: 3022 - DNA, 550 bp, Artificial Sequence
  chemically treated genomic DNA (Homo sapiens) CpG-island No: 3022
atcgaaactaaaacgaaaccgaaaaccaaaccgcccctcccccgctccctaaccgccctcccaaaatctctaccccgctacccctctcccgtaacgtctacgaacacgcgatcgaccgccgcgaaaaaaaaacgcgctaaaacaccgaaccgaccgctcgcgactaaacgcgccatttcctttacgcgcgcgacgcgataaaaacgacgacaaccaaaactccccgcgaccgaaatccgcgccccgaacgcccctccccaatctccgcttcgaccgccccttcctccttttctcccactcccactcctcctccccttcctcttcctcctatttcctttacgccccgcccgtacctcctcctcctcctcgacgaccatttcccgactcctaaaaaacgaaacgcgcgactaaccgacactacgcccccgcctaactccaaaaacgcccgaaccgaaaaccgactaaaaccgcgaaacgaatacgcacgaaccgaaacgacgcctaaatcccgaccgccgactccgaccgaacctaaacgccccctaacgac

SEQ ID NO: 3023 - DNA, 550 bp, Artificial Sequence
  chemically treated genomic DNA (Homo sapiens) CpG-island No: 3023
gtcggggttggagcggagtcgggggttaggtcgtttttttttcgttttttggtcgtttttttagggtttttgtttcgttgtttttttttcgtgacgtttgcggatacgcggtcggtcgtcgcgggggagggacgcgttggggtatcgggtcgatcgttcgcggttagacgcgttattttttttacgcgcgcggcgcgatggagacggcggtagttaagatttttcgcggtcgaggttcgcgtttcggacgtttttttttagttttcgtttcggtcgttttttttttttttttttttatttttattttttttttttttttttttttttttgttttttttgcgtttcgttcgtgtttttttttttttttcggcgattatttttcggtttttaggaaacggagcgcgcgattggtcggtattgcgttttcgtttggttttagggacgttcgggtcggagatcggttgggatcgcggggcgggtgcgtacgggtcggaacggcgtttgggtttcgatcgtcggtttcggtcgggtttggacgttttttagcggt

SEQ ID NO: 3024 - DNA, 550 bp, Artificial Sequence
  chemically treated genomic DNA (Homo sapiens) CpG-island No: 3024
accgctaaaaaacgtccaaacccgaccgaaaccgacgatcgaaacccaaacgccgttccgacccgtacgcacccgccccgcgatcccaaccgatctccgacccgaacgtccctaaaaccaaacgaaaacgcaataccgaccaatcgcgcgctccgtttcctaaaaaccgaaaaataatcgccgaaaaaaaaaaaaaaacacgaacgaaacgcaaaaaaaacaaaaaaaaaaaaaaaaaaaaaaaaaataaaaataaaaaaaaaaaaaaaaaaaacgaccgaaacgaaaactaaaaaaaaacgtccgaaacgcgaacctcgaccgcgaaaaatcttaactaccgccgtctccatcgcgccgcgcgcgtaaaaaaaataacgcgtctaaccgcgaacgatcgacccgataccccaacgcgtccctcccccgcgacgaccgaccgcgtatccgcaaacgtcacgaaaaaaaaacaacgaaacaaaaaccctaaaaaaacgaccaaaaaacgaaaaaaaaacgacctaacccccgactccgctccaaccccgac

SEQ ID NO: 3025 - DNA, 959 bp, Artificial Sequence
  chemically treated genomic DNA (Homo sapiens) CpG-island No: 3025
tttcgagttcggaggaggttcgggcgtcgcgtggtcggtcggcggggggcggggggttgggtcgcggagggcgttggggtttgggcgtatcgttttcgggagggttttggtcgcggtttcggcgggaaggcgcgggtttcgggagaggcgggtggggatcgttcggcgaaaggaggggaaacggcgcgtttttgtcgttaggcgcgggcgcgcggagttaattgcgattttaattttttgtttcgcggcgtagtcgagtttcgagttaggagtcgtcgcgcgcgttcgttcgcgttgggtaatttggggtcggatcgttgttttttacgttcgggttgggtcgcggcgaggcgttggttaggggttggagtggggggttggttttttttttagtaatcgagggaggtcgtcggagagagaggagggaggagaggaggtgggagcggcgggagggtagtcggagagcggcgcgaggaggaggcggcggcggcggaggcggcggtcgcgaagaggggaggaggcgaggggagggtggggaggggaggtttcggcgcgtcgcgtcgcgaggggtcgcgtgaagcgggggtcggggcgggaggggtgggtggggggagggttgggggcgagagagaaagtaattttaggacgagatcggagcgattcgcgtagcgagtataggcggcgaagttgcgttcggcgttcgagatcggtagttgcgtggggcgggggttgcgttcgagttcgatttgtcggtttcgaggtaagtttagcgcgggcggttatcgtttagagtcgcgtaattttgtttcgaagtggttgcgatatcgagaaagtcgttcggttagggtttggatttgggcgggggcggtcgttttgtttttttgttgggcggcgggggttggcggcgcgggggtgtttagtataaaggtttggtgtaagagtggggttgtttacgtggg

SEQ ID NO: 3026 - DNA, 959 bp, Artificial Sequence
  chemically treated genomic DNA (Homo sapiens) CpG-island No: 3026
cccacgtaaacaaccccactcttacaccaaacctttatactaaacacccccgcgccgccaacccccgccgcccaacaaaaaaacaaaacgaccgcccccgcccaaatccaaaccctaaccgaacgactttctcgatatcgcaaccacttcgaaacaaaattacgcgactctaaacgataaccgcccgcgctaaacttacctcgaaaccgacaaatcgaactcgaacgcaacccccgccccacgcaactaccgatctcgaacgccgaacgcaacttcgccgcctatactcgctacgcgaatcgctccgatctcgtcctaaaattactttctctctcgcccccaaccctccccccacccacccctcccgccccgacccccgcttcacgcgacccctcgcgacgcgacgcgccgaaacctcccctccccaccctcccctcgcctcctcccctcttcgcgaccgccgcctccgccgccgccgcctcctcctcgcgccgctctccgactaccctcccgccgctcccacctcctctcctccctcctctctctccgacgacctccctcgattactaaaaaaaaaaccaaccccccactccaacccctaaccaacgcctcgccgcgacccaacccgaacgtaaaaaacaacgatccgaccccaaattacccaacgcgaacgaacgcgcgcgacgactcctaactcgaaactcgactacgccgcgaaacaaaaaattaaaatcgcaattaactccgcgcgcccgcgcctaacgacaaaaacgcgccgtttcccctcctttcgccgaacgatccccacccgcctctcccgaaacccgcgccttcccgccgaaaccgcgaccaaaaccctcccgaaaacgatacgcccaaaccccaacgccctccgcgacccaaccccccgccccccgccgaccgaccacgcgacgcccgaacctcctccgaactcgaaa

SEQ ID NO: 3027 - DNA, 959 bp, Artificial Sequence
  chemically treated genomic DNA (Homo sapiens) CpG-island No: 3027
tttacgtgggtaattttatttttgtattaggtttttgtgttgggtattttcgcgtcgttagttttcgtcgtttagtagagggataaagcggtcgttttcgtttaggtttagattttggtcgggcgattttttcggtatcgtagttatttcggggtagggttgcgcggttttgagcggtggtcgttcgcgttgagtttatttcggagtcggtagatcgggttcgggcgtagttttcgttttacgtagttgtcggtttcgggcgtcgggcgtagtttcgtcgtttatgttcgttgcgcgggtcgtttcggtttcgttttggagttattttttttttcgtttttaattttttttttatttatttttttcgtttcggttttcgttttacgcggtttttcgcggcgcggcgcgtcggggttttttttttttatttttttttcgttttttttttttttcgcggtcgtcgttttcgtcgtcgtcgtttttttttcgcgtcgtttttcggttgttttttcgtcgtttttatttttttttttttttttttttttttcggcggtttttttcgattgttggagagaaaattagttttttattttagtttttagttagcgtttcgtcgcggtttagttcggacgtaaagggtagcgattcggttttaaattatttagcgcgaacgggcgcgcgcggcgatttttggttcggggttcggttgcgtcgcggggtagaggattagagtcgtaattagtttcgcgcgttcgcgtttggcgataaaaacgcgtcgtttttttttttttcgtcgggcgatttttattcgtttttttcgaagttcgcgttttttcgtcggggtcgcggttaggattttttcgggagcggtgcgtttaggttttagcgtttttcgcggtttagtttttcgtttttcgtcggtcggttacgcggcgttcgggtttttttcgggttcgggg

SEQ ID NO: 3028 - DNA, 959 bp, Artificial Sequence
  chemically treated genomic DNA (Homo sapiens) CpG-island No: 3028
ccccgaacccgaaaaaaacccgaacgccgcgtaaccgaccgacgaaaaacgaaaaactaaaccgcgaaaaacgctaaaacctaaacgcaccgctcccgaaaaaatcctaaccgcgaccccgacgaaaaaacgcgaacttcgaaaaaaacgaataaaaatcgcccgacgaaaaaaaaaaaaacgacgcgtttttatcgccaaacgcgaacgcgcgaaactaattacgactctaatcctctaccccgcgacgcaaccgaaccccgaaccaaaaatcgccgcgcgcgcccgttcgcgctaaataatttaaaaccgaatcgctaccctttacgtccgaactaaaccgcgacgaaacgctaactaaaaactaaaataaaaaactaattttctctccaacaatcgaaaaaaaccgccgaaaaaaaaaaaaaaaaaaaaaaaaataaaaacgacgaaaaaacaaccgaaaaacgacgcgaaaaaaaaacgacgacgacgaaaacgacgaccgcgaaaaaaaaaaaaaacgaaaaaaaaataaaaaaaaaaaaccccgacgcgccgcgccgcgaaaaaccgcgtaaaacgaaaaccgaaacgaaaaaaataaataaaaaaaaaattaaaaacgaaaaaaaaaataactccaaaacgaaaccgaaacgacccgcgcaacgaacataaacgacgaaactacgcccgacgcccgaaaccgacaactacgtaaaacgaaaactacgcccgaacccgatctaccgactccgaaataaactcaacgcgaacgaccaccgctcaaaaccgcgcaaccctaccccgaaataactacgataccgaaaaaatcgcccgaccaaaatctaaacctaaacgaaaacgaccgctttatccctctactaaacgacgaaaactaacgacgcgaaaatacccaacacaaaaacctaatacaaaaataaaattacccacgtaaa

SEQ ID NO: 3029 - DNA, 507 bp, Artificial Sequence
  chemically treated genomic DNA (Homo sapiens) CpG-island No: 3029
atttttttcggtgggtttgtatacgggcgaggtgcgtacggcgcgagttttgttggatagagacgcgtttaagtagagtttcgtggtggtcgtttaggattacggttagttttcgtttttcgttattgttacgtttatcgtggtcgtggtcgataggattttcgatattttggtcgatttgggtagtttcgagtttttcgttaaatttaacgattcggattttattttgtatttggtggtggcggcggtcgcggttttttgcgtttttttggttttcgttatcgtgttgttggcgtataggttgcggcgttggtataagttacgtttgttataggtttcgggaggcggtttagcgagtatgttcggttcgtattttgtgggcgtggacggggttcgggtttttttgtagatttatttttacgaggttttttttattgcggattcgcggaagagttatttgatttttttttagtttaattatgcggatatatttattagttaggagag

SEQ ID NO: 3030 - DNA, 507 bp, Artificial Sequence
  chemically treated genomic DNA (Homo sapiens) CpG-island No: 3030
ctctcctaactaataaatatatccgcataattaaactaaaaaaaaatcaaataactcttccgcgaatccgcaataaaaaaaacctcgtaaaaataaatctacaaaaaaacccgaaccccgtccacgcccacaaaatacgaaccgaacatactcgctaaaccgcctcccgaaacctataacaaacgtaacttataccaacgccgcaacctatacgccaacaacacgataacgaaaaccaaaaaaacgcaaaaaaccgcgaccgccgccaccaccaaatacaaaataaaatccgaatcgttaaatttaacgaaaaactcgaaactacccaaatcgaccaaaatatcgaaaatcctatcgaccacgaccacgataaacgtaacaataacgaaaaacgaaaactaaccgtaatcctaaacgaccaccacgaaactctacttaaacgcgtctctatccaacaaaactcgcgccgtacgcacctcgcccgtatacaaacccaccgaaaaaaat

SEQ ID NO: 3031 - DNA, 507 bp, Artificial Sequence
  chemically treated genomic DNA (Homo sapiens) CpG-island No: 3031
tttttttggttgatgagtgtgttcgtatagttgggttgggggaaaattaggtggttttttcgcgagttcgtagtgagggagatttcgtgggaataggtttgtaggaaagttcgaatttcgtttacgtttataaagtgcgaatcgggtatgttcgttaagtcgtttttcgaagtttgtagtagacgtgatttgtgttagcgtcgtagtttgtgcgttagtagtacgatgacgaaggttaggaagacgtaggagatcgcggtcgtcgttattattaggtatagagtgaggttcgaatcgttgggtttggcggagggttcgaggttgtttaggtcggttaggatgtcggagattttgtcggttacggttacggtgagcgtgatagtggcggagagcgggggttggtcgtggttttggacggttattacgagattttgtttgagcgcgtttttgtttagtagggttcgcgtcgtgcgtatttcgttcgtgtgtagatttatcgagaagagt

SEQ ID NO: 3032 - DNA, 507 bp, Artificial Sequence
  chemically treated genomic DNA (Homo sapiens) CpG-island No: 3032
actcttctcgataaatctacacacgaacgaaatacgcacgacgcgaaccctactaaacaaaaacgcgctcaaacaaaatctcgtaataaccgtccaaaaccacgaccaacccccgctctccgccactatcacgctcaccgtaaccgtaaccgacaaaatctccgacatcctaaccgacctaaacaacctcgaaccctccgccaaacccaacgattcgaacctcactctatacctaataataacgacgaccgcgatctcctacgtcttcctaaccttcgtcatcgtactactaacgcacaaactacgacgctaacacaaatcacgtctactacaaacttcgaaaaacgacttaacgaacatacccgattcgcactttataaacgtaaacgaaattcgaactttcctacaaacctattcccacgaaatctccctcactacgaactcgcgaaaaaaccacctaattttcccccaacccaactatacgaacacactcatcaaccaaaaaaa

SEQ ID NO: 3033 - DNA, 538 bp, Artificial Sequence
  chemically treated genomic DNA (Homo sapiens) CpG-island No: 3033
atttttttcggtgggtttgtatacgggcgaggtgcgtacggcgcgagttttgttggatagagacgcgtttaagtagagtttcgtggtggtcgtttaggattacggttagtttttttttttcgttattgttacgtttatcgtggtcgtggtcgataggattttcgatattttggtcgatttgggtagtttcgagtttttcgttaaatttaacgattcggattttattttgtatttggtggtggcggtggtcgcggttttttgcgtttttttggttttcgttatcgtgttgttggcgtttaggttgcggcgttggtataagttacgtttgttgtaggtttcgggaggcggtttggcgagtacgttcggttcgtattttgtgggcgcggacggggttcgggtttttttgtagatttatttttacgaggttttttttattgcggattcgcggaagagttatttgatttttttttagtttaattatgcggatacgtttattagttaggagagttgtgagaaaagcgagttttttttgataatt

SEQ ID NO: 3034 - DNA, 538 bp, Artificial Sequence
  chemically treated genomic DNA (Homo sapiens) CpG-island No: 3034
aattatcaaaaaaaactcgcttttctcacaactctcctaactaataaacgtatccgcataattaaactaaaaaaaaatcaaataactcttccgcgaatccgcaataaaaaaaacctcgtaaaaataaatctacaaaaaaacccgaaccccgtccgcgcccacaaaatacgaaccgaacgtactcgccaaaccgcctcccgaaacctacaacaaacgtaacttataccaacgccgcaacctaaacgccaacaacacgataacgaaaaccaaaaaaacgcaaaaaaccgcgaccaccgccaccaccaaatacaaaataaaatccgaatcgttaaatttaacgaaaaactcgaaactacccaaatcgaccaaaatatcgaaaatcctatcgaccacgaccacgataaacgtaacaataacgaaaaaaaaaaactaaccgtaatcctaaacgaccaccacgaaactctacttaaacgcgtctctatccaacaaaactcgcgccgtacgcacctcgcccgtatacaaacccaccgaaaaaaat

SEQ ID NO: 3035 - DNA, 538 bp, Artificial Sequence
  chemically treated genomic DNA (Homo sapiens) CpG-island No: 3035
agttattagaagaggttcgttttttttatagtttttttggttgatgagcgtgttcgtatagttgggttgggggaaaattaggtggttttttcgcgagttcgtagtgagggagatttcgtgggaataggtttgtaggaaagttcgaatttcgttcgcgtttataaagtgcgagtcgggcgtattcgttaagtcgtttttcgaagtttgtagtaggcgtgatttgtgttagcgtcgtagtttgagcgttagtagtacgatgacgaaggttaggaagacgtaggagatcgcggttatcgttattattaggtatagagtgaggttcgaatcgttgggtttggcggagggttcgaggttgtttaggtcggttaggatgtcggggattttgtcggttacggttacggtgagcgtgatagtggcggagagagggggttggtcgtggttttggacggttattacgaggttttgtttgagcgcgtttttgtttagtagggttcgcgtcgtgcgtatttcgttcgtgtgtagatttatcgagaagagt

SEQ ID NO: 3036 - DNA, 538 bp, Artificial Sequence
  chemically treated genomic DNA (Homo sapiens) CpG-island No: 3036
actcttctcgataaatctacacacgaacgaaatacgcacgacgcgaaccctactaaacaaaaacgcgctcaaacaaaacctcgtaataaccgtccaaaaccacgaccaaccccctctctccgccactatcacgctcaccgtaaccgtaaccgacaaaatccccgacatcctaaccgacctaaacaacctcgaaccctccgccaaacccaacgattcgaacctcactctatacctaataataacgataaccgcgatctcctacgtcttcctaaccttcgtcatcgtactactaacgctcaaactacgacgctaacacaaatcacgcctactacaaacttcgaaaaacgacttaacgaatacgcccgactcgcactttataaacgcgaacgaaattcgaactttcctacaaacctattcccacgaaatctccctcactacgaactcgcgaaaaaaccacctaattttcccccaacccaactatacgaacacgctcatcaaccaaaaaaactataaaaaaaacgaacctcttctaataact

SEQ ID NO: 3037 - DNA, 507 bp, Artificial Sequence
  chemically treated genomic DNA (Homo sapiens) CpG-island No: 3037
gcgaggtgcgtacggcgcgcgttttgttggatagagacgcgtttaagtagagtttagtggtggtcgtttaggattacggttagtttttttttttcgttattgttacgtttatcgtggtcgtggtcgataggattttcgatattttggtcgatttgggtagtttcgagtttttcgttaaatttaacgattcggattttattttgtatttggtggtggcggtggtcgcggttttttgcgtttttttggttttcgttatcgtgttgttggcgtttagattgtagcgttggtataagttacgtttgttgtaggtttcgggaggtggtttagcgagtatgttcggttcgtattttgtgggcgtggaaggggttcgggtttttttgtagatttatttttacgaggttttatttattgtagattcgcgtaagagttatttgatttttttttagtttaattatgtcgatacgtttattaattaggagagttatgagaaaagcgagttttttttga

SEQ ID NO: 3038 - DNA, 507 bp, Artificial Sequence
  chemically treated genomic DNA (Homo sapiens) CpG-island No: 3038
tcaaaaaaaactcgcttttctcataactctcctaattaataaacgtatcgacataattaaactaaaaaaaaatcaaataactcttacgcgaatctacaataaataaaacctcgtaaaaataaatctacaaaaaaacccgaaccccttccacgcccacaaaatacgaaccgaacatactcgctaaaccacctcccgaaacctacaacaaacgtaacttataccaacgctacaatctaaacgccaacaacacgataacgaaaaccaaaaaaacgcaaaaaaccgcgaccaccgccaccaccaaatacaaaataaaatccgaatcgttaaatttaacgaaaaactcgaaactacccaaatcgaccaaaatatcgaaaatcctatcgaccacgaccacgataaacgtaacaataacgaaaaaaaaaaactaaccgtaatcctaaacgaccaccactaaactctacttaaacgcgtctctatccaacaaaacgcgcgccgtacgcacctcgc

SEQ ID NO: 3039 - DNA, 507 bp, Artificial Sequence
  chemically treated genomic DNA (Homo sapiens) CpG-island No: 3039
ttagaagaggttcgttttttttatagtttttttggttgataagcgtgtcggtatagttgggttgggggaaaattagatgatttttacgcgagtttgtagtgagtgagatttcgtgggaataggtttgtaggaaagttcgaattttttttacgtttataaagtgcgagtcgggtatgttcgttaagttatttttcgaagtttgtagtaggcgtgatttgtgttagcgttgtagtttgagcgttagtagtacgatgacgaaggttaggaagacgtaggagatcgcggttatcgttattattaggtatagagtgaggttcgaatcgttgggtttggcggagggttcgaggttgtttaggtcggttaggatgtcggggattttgtcggttacggttacggtgagcgtgatagtggcggagagagggggttggtcgtggttttggacggttattattaggttttgtttgagcgcgtttttgtttagtagggcgcgcgtcgtgcgtatttcgt

SEQ ID NO: 3040 - DNA, 507 bp, Artificial Sequence
  chemically treated genomic DNA (Homo sapiens) CpG-island No: 3040
acgaaatacgcacgacgcgcgccctactaaacaaaaacgcgctcaaacaaaacctaataataaccgtccaaaaccacgaccaaccccctctctccgccactatcacgctcaccgtaaccgtaaccgacaaaatccccgacatcctaaccgacctaaacaacctcgaaccctccgccaaacccaacgattcgaacctcactctatacctaataataacgataaccgcgatctcctacgtcttcctaaccttcgtcatcgtactactaacgctcaaactacaacgctaacacaaatcacgcctactacaaacttcgaaaaataacttaacgaacatacccgactcgcactttataaacgtaaaaaaaattcgaactttcctacaaacctattcccacgaaatctcactcactacaaactcgcgtaaaaatcatctaattttcccccaacccaactataccgacacgcttatcaaccaaaaaaactataaaaaaaacgaacctcttctaa

SEQ ID NO: 3041 - DNA, 568 bp, Artificial Sequence
  chemically treated genomic DNA (Homo sapiens) CpG-island No: 3041
ggtgtcgttatacgtgttagtgagcgcgtagagcggggtggtgttcgcgtagcgcgtttttgattacgagtagttgcgcgttttcgcgtttacgttgtaggttcgcgattacggttcgtttacgtttagcgttaacgtgagtttgcgcgtgttggtgggagatcgtaatgataacgtatcgcgggtgttgtatttagttttgggttttgacggtttcgcgtttttcgatatggtatttcgttttgtagagttcggttatttagtgattaaggtggtagcggtggacgtcgattcgggatataacgtttggttgttttattacgtgttgtaggttagtgagttcggattttttagtttggggttgcgtattggggaggtgcgtacggttcgagttttaggcgatagggacgtagttcgttagcgtttgttggtcgttgtgcgtgacggtggatagtcgttattttttgttatcgttacgttttatttggttttcgtagataatttgtaagagatattgttagattttagcgatcgttttgtattttttgatttttaggttgaattgtag

SEQ ID NO: 3042 - DNA, 568 bp, Artificial Sequence
  chemically treated genomic DNA (Homo sapiens) CpG-island No: 3042
ctacaattcaacctaaaaatcaaaaaatacaaaacgatcgctaaaatctaacaatatctcttacaaattatctacgaaaaccaaataaaacgtaacgataacaaaaaataacgactatccaccgtcacgcacaacgaccaacaaacgctaacgaactacgtccctatcgcctaaaactcgaaccgtacgcacctccccaatacgcaaccccaaactaaaaaatccgaactcactaacctacaacacgtaataaaacaaccaaacgttatatcccgaatcgacgtccaccgctaccaccttaatcactaaataaccgaactctacaaaacgaaataccatatcgaaaaacgcgaaaccgtcaaaacccaaaactaaatacaacacccgcgatacgttatcattacgatctcccaccaacacgcgcaaactcacgttaacgctaaacgtaaacgaaccgtaatcgcgaacctacaacgtaaacgcgaaaacgcgcaactactcgtaatcaaaaacgcgctacgcgaacaccaccccgctctacgcgctcactaacacgtataacgacacc

SEQ ID NO: 3043 - DNA, 568 bp, Artificial Sequence
  chemically treated genomic DNA (Homo sapiens) CpG-island No: 3043
ttgtagtttagtttgggggttagagagtatagggcggtcgttgaggtttggtagtattttttgtaagttgtttgcgaagattagatgaagcgtggcggtggtagagagtggcggttgtttatcgttacgtatagcgattagtaggcgttggcgggttgcgtttttgtcgtttaaggttcgagtcgtgcgtatttttttagtgcgtagttttaggttgaagagttcgggtttattggtttgtagtacgtggtaggatagttaggcgttgtgtttcgagtcggcgtttatcgttattattttagttattaggtagtcgggttttgtagagcgaggtattatatcgaagaacgcggagtcgttaggatttagagttgggtatagtattcgcggtgcgttgttattgcggttttttattaatacgcgtaggtttacgttggcgttgagcgtgggcgagtcgtggtcgcgggtttgtagcgtgagcgcgaaggcgcgtagttgttcgtgattaaaggcgcgttgcgcgaatattatttcgttttgcgcgtttattgatacgtatgacgatatt

SEQ ID NO: 3044 - DNA, 568 bp, Artificial Sequence
  chemically treated genomic DNA (Homo sapiens) CpG-island No: 3044
aatatcgtcatacgtatcaataaacgcgcaaaacgaaataatattcgcgcaacgcgcctttaatcacgaacaactacgcgccttcgcgctcacgctacaaacccgcgaccacgactcgcccacgctcaacgccaacgtaaacctacgcgtattaataaaaaaccgcaataacaacgcaccgcgaatactatacccaactctaaatcctaacgactccgcgttcttcgatataatacctcgctctacaaaacccgactacctaataactaaaataataacgataaacgccgactcgaaacacaacgcctaactatcctaccacgtactacaaaccaataaacccgaactcttcaacctaaaactacgcactaaaaaaatacgcacgactcgaaccttaaacgacaaaaacgcaacccgccaacgcctactaatcgctatacgtaacgataaacaaccgccactctctaccaccgccacgcttcatctaatcttcgcaaacaacttacaaaaaatactaccaaacctcaacgaccgccctatactctctaacccccaaactaaactacaa

SEQ ID NO: 3045 - DNA, 507 bp, Artificial Sequence
  chemically treated genomic DNA (Homo sapiens) CpG-island No: 3045
acgttaatgataacgcgtcggttttcggatagttagtttatttggtttacgtgttagaaaataattagtcgggtgtttttatagcgtaagttagtgtttttgatttagatttcgggtttaacggtcgtgttttttatttttttattgttagcgatttggagttacgaacgttgtcgttttacgtgttcgtgagcgcgtagagcggggtggtgttcgcgtagcgcgttttcgattacgagtagttgcgtattttcgagtttacgttgtaggttcgcgattagggttcgttcgcgtttagcgttaatgtgagtttgcgcgtgttggtgggcgatcgtaacgataacgtatcgcgggtgttgtattttgcgttgggtttcgacggtttcgcgtttttcgatatagtgtcgcgggtcgcgtagttaggttatttggtgattaaggtggtggtcgtggacgcggattcggggtataatgtttggttgttttattacgtggtgtaggttagtg

SEQ ID NO: 3046 - DNA, 507 bp, Artificial Sequence
  chemically treated genomic DNA (Homo sapiens) CpG-island No: 3046
cactaacctacaccacgtaataaaacaaccaaacattataccccgaatccgcgtccacgaccaccaccttaatcaccaaataacctaactacgcgacccgcgacactatatcgaaaaacgcgaaaccgtcgaaacccaacgcaaaatacaacacccgcgatacgttatcgttacgatcgcccaccaacacgcgcaaactcacattaacgctaaacgcgaacgaaccctaatcgcgaacctacaacgtaaactcgaaaatacgcaactactcgtaatcgaaaacgcgctacgcgaacaccaccccgctctacgcgctcacgaacacgtaaaacgacaacgttcgtaactccaaatcgctaacaataaaaaaataaaaaacacgaccgttaaacccgaaatctaaatcaaaaacactaacttacgctataaaaacacccgactaattattttctaacacgtaaaccaaataaactaactatccgaaaaccgacgcgttatcattaacgt

SEQ ID NO: 3047 - DNA, 507 bp, Artificial Sequence
  chemically treated genomic DNA (Homo sapiens) CpG-island No: 3047
tattggtttgtattacgtggtaggatagttaggtattgtgtttcgagttcgcgtttacggttattattttggttattaggtagtttggttgcgcggttcgcggtattgtgtcgaagagcgcggagtcgtcgggatttagcgtagggtatagtattcgcggtgcgttgtcgttacggtcgtttattaatacgcgtaggtttatattggcgttgagcgcgggcgagttttggtcgcgggtttgtagcgtgagttcgaaggtgcgtagttgttcgtggtcgaaggcgcgttgcgcgaatattatttcgttttgcgcgtttacggatacgtaggacgatagcgttcgtgattttaggtcgttggtaatgagagagtaggagatacggtcgttgagttcgaagtttgggttagaggtattgatttgcgttatggaggtattcggttggttgttttttggtacgtggattaggtaggttgattgttcgaaaatcggcgcgttgttattgacgt

SEQ ID NO: 3048 - DNA, 507 bp, Artificial Sequence
  chemically treated genomic DNA (Homo sapiens) CpG-island No: 3048
acgtcaataacaacgcgccgattttcgaacaatcaacctacctaatccacgtaccaaaaaacaaccaaccgaatacctccataacgcaaatcaatacctctaacccaaacttcgaactcaacgaccgtatctcctactctctcattaccaacgacctaaaatcacgaacgctatcgtcctacgtatccgtaaacgcgcaaaacgaaataatattcgcgcaacgcgccttcgaccacgaacaactacgcaccttcgaactcacgctacaaacccgcgaccaaaactcgcccgcgctcaacgccaatataaacctacgcgtattaataaacgaccgtaacgacaacgcaccgcgaatactataccctacgctaaatcccgacgactccgcgctcttcgacacaataccgcgaaccgcgcaaccaaactacctaataaccaaaataataaccgtaaacgcgaactcgaaacacaatacctaactatcctaccacgtaatacaaaccaata

SEQ ID NO: 3049 - DNA, 613 bp, Artificial Sequence
  chemically treated genomic DNA (Homo sapiens) CpG-island No: 3049
ggcgcggtttcgtaggcgggaggcgatgttgtcgacgttattgttgttattattattacggagagatggggcggggcgggagtatcgggtttttttcggaagttttttttgagtttatttagtgtttggggtcgcggcgatcgatgatagttgggcgtcggtcgagtttttttcgggtcgcgcgggggcgtatgcgcggggtcgcgggatcgatcggtcgcgttcgggttttttcgtattcgttcgatttcgttttttcggttcgttgttcggtaatttttgttcggcgcgtttttattggttggcggcggttcgggtttcggtcgcgcgtggttatttggttagcgcgggttcggcgtggtcgggggtttggtttcgggcgcgggtcgatgtcgtttcgtatttgatttttttcggcgcggggagggggttcgagaggatggagagagttggattattttggaagaaaattttattgattcgttttttattttggggacgtacggttttagcggcggggggcgagggtacggttgggtgggggtaggggcggttaggatttttttttcggatatgtacggattttttgatcgtcgtttcggttatttttttg

SEQ ID NO: 3050 - DNA, 613 bp, Artificial Sequence
  chemically treated genomic DNA (Homo sapiens) CpG-island No: 3050
caaaaaaataaccgaaacgacgatcaaaaaatccgtacatatccgaaaaaaaaatcctaaccgcccctacccccacccaaccgtaccctcgccccccgccgctaaaaccgtacgtccccaaaataaaaaacgaatcaataaaattttcttccaaaataatccaactctctccatcctctcgaaccccctccccgcgccgaaaaaaatcaaatacgaaacgacatcgacccgcgcccgaaaccaaacccccgaccacgccgaacccgcgctaaccaaataaccacgcgcgaccgaaacccgaaccgccgccaaccaataaaaacgcgccgaacaaaaattaccgaacaacgaaccgaaaaaacgaaatcgaacgaatacgaaaaaacccgaacgcgaccgatcgatcccgcgaccccgcgcatacgcccccgcgcgacccgaaaaaaactcgaccgacgcccaactatcatcgatcgccgcgaccccaaacactaaataaactcaaaaaaaacttccgaaaaaaacccgatactcccgccccgccccatctctccgtaataataataacaacaataacgtcgacaacatcgcctcccgcctacgaaaccgcgcc

SEQ ID NO: 3051 - DNA, 613 bp, Artificial Sequence
  chemically treated genomic DNA (Homo sapiens) CpG-island No: 3051
tagggagatggtcggggcggcggttagggggttcgtgtatgttcgggaggaaggttttggtcgtttttgtttttatttagtcgtattttcgtttttcgtcgttggaatcgtgcgtttttaagataagagacgggttaataaagtttttttttaagatggtttagttttttttattttttcgggtttttttttcgcgtcgggaaaggttagatgcgaggcggtatcgattcgcgttcggagttaggttttcggttacgtcgagttcgcgttgattaagtgattacgcgcggtcggggttcgggtcgtcgttagttaatgggagcgcgtcgggtagaggttgtcgggtaacgagtcgggggggcggggtcgggcgggtgcggggaggttcgagcgcggtcgatcgatttcgcggtttcgcgtatgcgttttcgcgcggttcggagggggttcggtcggcgtttagttgttatcgatcgtcgcggttttaggtattgaataagtttaggaagggttttcgggaagggttcggtgttttcgtttcgttttattttttcgtaatagtaatggtagtaatagcgtcggtagtatcgtttttcgtttgcgggatcgcgtt

SEQ ID NO: 3052 - DNA, 613 bp, Artificial Sequence
  chemically treated genomic DNA (Homo sapiens) CpG-island No: 3052
aacgcgatcccgcaaacgaaaaacgatactaccgacgctattactaccattactattacgaaaaaataaaacgaaacgaaaacaccgaacccttcccgaaaacccttcctaaacttattcaatacctaaaaccgcgacgatcgataacaactaaacgccgaccgaaccccctccgaaccgcgcgaaaacgcatacgcgaaaccgcgaaatcgatcgaccgcgctcgaacctccccgcacccgcccgaccccgcccccccgactcgttacccgacaacctctacccgacgcgctcccattaactaacgacgacccgaaccccgaccgcgcgtaatcacttaatcaacgcgaactcgacgtaaccgaaaacctaactccgaacgcgaatcgataccgcctcgcatctaacctttcccgacgcgaaaaaaaaacccgaaaaaataaaaaaaactaaaccatcttaaaaaaaaactttattaacccgtctcttatcttaaaaacgcacgattccaacgacgaaaaacgaaaatacgactaaataaaaacaaaaacgaccaaaaccttcctcccgaacatacacgaaccccctaaccgccgccccgaccatctcccta

SEQ ID NO: 3053 - DNA, 561 bp, Artificial Sequence
  chemically treated genomic DNA (Homo sapiens) CpG-island No: 3053
tcgaagtcggggttcgttttcgtttgtattttcgtttagggttttcgcgatcgcgcgtttcgcggtgggcggggtttgtcggttgtattttcgttcggtttttaagtttcggcgtttatttcgcgcgtggttattttttttttttttgagattttgagtaggagtcggtcgttttttagttttagcgcgcggacgcggtcgatgtagtgcgttaggcggtcgttgagttcgcgtagttttttttttttttgtagtcgcgataggcgcgtgggcgatagcggcgtggcgggttcgttcgcgcggtcgggtagcggcgtggttatggtggcggcggttcgcggtttgcgttgttttcgacggcggttcgggttcggcgggtttatttaattcgcgtcgtcggttgtaagatggcgtcgcgtcgcgtcgcgttcgtcgttcgtcgcggcggggtagtttgggattggtagttcgatcgtcgggcgcgcgcggggtacgtcggaagttgaagttttcgtttagttttcgtttcgtagaggcgttgattttagagatagatttttt

SEQ ID NO: 3054 - DNA, 561 bp, Artificial Sequence
  chemically treated genomic DNA (Homo sapiens) CpG-island No: 3054
aaaaaatctatctctaaaatcaacgcctctacgaaacgaaaactaaacgaaaacttcaacttccgacgtaccccgcgcgcgcccgacgatcgaactaccaatcccaaactaccccgccgcgacgaacgacgaacgcgacgcgacgcgacgccatcttacaaccgacgacgcgaattaaataaacccgccgaacccgaaccgccgtcgaaaacaacgcaaaccgcgaaccgccgccaccataaccacgccgctacccgaccgcgcgaacgaacccgccacgccgctatcgcccacgcgcctatcgcgactacaaaaaaaaaaaaaactacgcgaactcaacgaccgcctaacgcactacatcgaccgcgtccgcgcgctaaaactaaaaaacgaccgactcctactcaaaatctcaaaaaaaaaaaaaataaccacgcgcgaaataaacgccgaaacttaaaaaccgaacgaaaatacaaccgacaaaccccgcccaccgcgaaacgcgcgatcgcgaaaaccctaaacgaaaatacaaacgaaaacgaaccccgacttcga

SEQ ID NO: 3055 - DNA, 561 bp, Artificial Sequence
  chemically treated genomic DNA (Homo sapiens) CpG-island No: 3055
aggaagtttgtttttggagttagcgtttttgcgaagcgagagttggacggagattttaattttcggcgtgtttcgcgcgcgttcggcggtcggattattagttttaggttgtttcgtcgcggcgggcggcgggcgcggcgcggcgcggcgttattttgtagtcggcggcgcggattgaatgagttcgtcgagttcgggtcgtcgtcgggagtagcgtaggtcgcgagtcgtcgttattatggttacgtcgttgttcggtcgcgcgggcgggttcgttacgtcgttgtcgtttacgcgtttgtcgcggttgtaggagaaggaggagttgcgcgagtttaacgatcgtttggcgtattatatcgatcgcgttcgcgcgttggagttggagaacgatcggtttttgtttaagattttagagaaggaggaggtgattacgcgcgaggtgggcgtcggggtttaggggtcgggcgggggtgtagtcggtaggtttcgtttatcgcggggcgcgcgatcgcggggattttgggcgggggtgtagacggggacgggtttcggtttcgg

SEQ ID NO: 3056 - DNA, 561 bp, Artificial Sequence
  chemically treated genomic DNA (Homo sapiens) CpG-island No: 3056
ccgaaaccgaaacccgtccccgtctacacccccgcccaaaatccccgcgatcgcgcgccccgcgataaacgaaacctaccgactacacccccgcccgacccctaaaccccgacgcccacctcgcgcgtaatcacctcctccttctctaaaatcttaaacaaaaaccgatcgttctccaactccaacgcgcgaacgcgatcgatataatacgccaaacgatcgttaaactcgcgcaactcctccttctcctacaaccgcgacaaacgcgtaaacgacaacgacgtaacgaacccgcccgcgcgaccgaacaacgacgtaaccataataacgacgactcgcgacctacgctactcccgacgacgacccgaactcgacgaactcattcaatccgcgccgccgactacaaaataacgccgcgccgcgccgcgcccgccgcccgccgcgacgaaacaacctaaaactaataatccgaccgccgaacgcgcgcgaaacacgccgaaaattaaaatctccgtccaactctcgcttcgcaaaaacgctaactccaaaaacaaacttcct

SEQ ID NO: 3057 - DNA, 601 bp, Artificial Sequence
  chemically treated genomic DNA (Homo sapiens) CpG-island No: 3057
agaggggaagagtcgtgggagttgggagaggagggaaagaggggaagagtcgtgggagttggtagaggagggaaagggggagtcgaacgtgaagggcgaagggcggggcggggtaggagagtcggggtatagagtaggtaggtgttaatggtatgggaaggaagagtaagaagtggggtaagaaggtgtcgcggtacgaggggaaggtgagatttaagaaggtgtcggttaagaagttggtgtcggcgtggaaggagaaggtgtggggcgaggaaataacgaagggcgaggaaagatttcgaggcgaagagatagtttttatcgagaaggggtagggcgaggaggaggggcgttattagagggcgggacggggcgacgggttcgcgcgggaagaattaatcgtcgagaattcggggaaggaacgggtttataaagattaagtggaggagtaggggcgcggttaggagcggaagtagagtgaggagtaagtttcgggcgagaaacgggggttcggtcgggagtaagagtaggggcggggtcgggagtaagagtaggggcggggttcggagacgggcgagattaggtatagtatttagttttt

SEQ ID NO: 3058 - DNA, 601 bp, Artificial Sequence
  chemically treated genomic DNA (Homo sapiens) CpG-island No: 3058
aaaaactaaatactatacctaatctcgcccgtctccgaaccccgcccctactcttactcccgaccccgcccctactcttactcccgaccgaacccccgtttctcgcccgaaacttactcctcactctacttccgctcctaaccgcgcccctactcctccacttaatctttataaacccgttccttccccgaattctcgacgattaattcttcccgcgcgaacccgtcgccccgtcccgccctctaataacgcccctcctcctcgccctaccccttctcgataaaaactatctcttcgcctcgaaatctttcctcgcccttcgttatttcctcgccccacaccttctccttccacgccgacaccaacttcttaaccgacaccttcttaaatctcaccttcccctcgtaccgcgacaccttcttaccccacttcttactcttccttcccataccattaacacctacctactctataccccgactctcctaccccgccccgcccttcgcccttcacgttcgactccccctttccctcctctaccaactcccacgactcttcccctctttccctcctctcccaactcccacgactcttcccctct

SEQ ID NO: 3059 - DNA, 601 bp, Artificial Sequence
  chemically treated genomic DNA (Homo sapiens) CpG-island No: 3059
aggggttgggtattgtatttggtttcgttcgttttcgggtttcgtttttgtttttgttttcggtttcgtttttgtttttgttttcggtcgggttttcgtttttcgttcggggtttgttttttattttgttttcgtttttgatcgcgtttttatttttttatttggtttttatggattcgtttttttttcgggttttcggcgattggtttttttcgcgcgggttcgtcgtttcgtttcgttttttggtaacgtttttttttttcgttttgttttttttcgatgaaaattgttttttcgtttcgggattttttttcgtttttcgttgttttttcgttttatattttttttttttacgtcggtattagttttttagtcggtatttttttgagttttatttttttttcgtatcgcgatatttttttgttttattttttattttttttttttatgttattaatatttgtttgttttatatttcgatttttttgtttcgtttcgtttttcgttttttacgttcggtttttttttttttttttttgttagtttttacgattttttttttttttttttttttttttagtttttacgatttttttttttt

SEQ ID NO: 3060 - DNA, 601 bp, Artificial Sequence
  chemically treated genomic DNA (Homo sapiens) CpG-island No: 3060
aaaaaaaaaaaatcgtaaaaactaaaaaaaaaaaaaaaaaaaaaaaaaatcgtaaaaactaacaaaaaaaaaaaaaaaaaaaccgaacgtaaaaaacgaaaaacgaaacgaaacaaaaaaatcgaaatataaaacaaacaaatattaataacataaaaaaaaaaaataaaaaataaaacaaaaaaatatcgcgatacgaaaaaaaaataaaactcaaaaaaataccgactaaaaaactaataccgacgtaaaaaaaaaaaatataaaacgaaaaaacaacgaaaaacgaaaaaaaatcccgaaacgaaaaaacaattttcatcgaaaaaaaacaaaacgaaaaaaaaaaacgttaccaaaaaacgaaacgaaacgacgaacccgcgcgaaaaaaaccaatcgccgaaaacccgaaaaaaaaacgaatccataaaaaccaaataaaaaaataaaaacgcgatcaaaaacgaaaacaaaataaaaaacaaaccccgaacgaaaaacgaaaacccgaccgaaaacaaaaacaaaaacgaaaccgaaaacaaaaacaaaaacgaaacccgaaaacgaacgaaaccaaatacaatacccaacccct

SEQ ID NO: 3061 - DNA, 956 bp, Artificial Sequence
  chemically treated genomic DNA (Homo sapiens) CpG-island No: 3061
cggtcgtagttttagtcgggtcgcgttcgcgagaaatagcggagaggttttagtaggcgggcgtcgtcggataggtttatcgttcgcgtcggtttcggggaatcgttttttcgcgttcgtagtatttgttcgcggcgcggattttatatcgcggtcgttcgttttaggggaggagtgagttcgttttagcggcgttaattcggggattcggggtaagggttcggggttattcgtcgtcgggcgcgttttttattcggaaagcggcgacggtttttaagttgggttgcggagtgggaggcgcgtcgagttttaagtagataatgcgggagaagggtgatgcgtagggaggaggggttcgtaaagttgaggttttcgcgtcgttcggttatttattcgtgtcgttcgtttttgaagtttcgcgtagttttcgatttttttttggggttcgttttatcgagcggtcgtaggggacgggtcgcgtttcgtatttcgatttttttttaaattataaaattttttttaatttcgttaattaagttgcgtttttatcgtgcggttttcggggttttttcgcgggtcgagtcgagatagttttttattttcgtcgcggagaaagataataggttgtttttttttcggcggcggtagtagcggttgcggttaaagcggcggtaatcgaggcgagtaatgggtacggcggtttcggtcgagtcgaggggttttatcgttgttgtttcggtttcgcgatagttttgtacgtagttttagttatttcgcgtatcggttataagtcgttcgggggtggtcggggtacgtaagagggtagtaacgtttgcgagttttttcgtgagtatacgcggagtaagggttgcgagttgggattgtacggtagagttgtttatttcgttttacgagattaatagtaaggtatttgggcggggcgtttaggttgttaa

SEQ ID NO: 3062 - DNA, 956 bp, Artificial Sequence
  chemically treated genomic DNA (Homo sapiens) CpG-island No: 3062
ttaacaacctaaacgccccgcccaaataccttactattaatctcgtaaaacgaaataaacaactctaccgtacaatcccaactcgcaacccttactccgcgtatactcacgaaaaaactcgcaaacgttactaccctcttacgtaccccgaccacccccgaacgacttataaccgatacgcgaaataactaaaactacgtacaaaactatcgcgaaaccgaaacaacaacgataaaacccctcgactcgaccgaaaccgccgtacccattactcgcctcgattaccgccgctttaaccgcaaccgctactaccgccgccgaaaaaaaaacaacctattatctttctccgcgacgaaaataaaaaactatctcgactcgacccgcgaaaaaaccccgaaaaccgcacgataaaaacgcaacttaattaacgaaattaaaaaaaattttataatttaaaaaaaaatcgaaatacgaaacgcgacccgtcccctacgaccgctcgataaaacgaaccccaaaaaaaaatcgaaaactacgcgaaacttcaaaaacgaacgacacgaataaataaccgaacgacgcgaaaacctcaactttacgaacccctcctccctacgcatcacccttctcccgcattatctacttaaaactcgacgcgcctcccactccgcaacccaacttaaaaaccgtcgccgctttccgaataaaaaacgcgcccgacgacgaataaccccgaacccttaccccgaatccccgaattaacgccgctaaaacgaactcactcctcccctaaaacgaacgaccgcgatataaaatccgcgccgcgaacaaatactacgaacgcgaaaaaacgattccccgaaaccgacgcgaacgataaacctatccgacgacgcccgcctactaaaacctctccgctatttctcgcgaacgcgacccgactaaaactacgaccg

SEQ ID NO: 3063 - DNA, 956 bp, Artificial Sequence
  chemically treated genomic DNA (Homo sapiens) CpG-island No: 3063
ttagtaatttgagcgtttcgtttaggtgttttattattggtttcgtggagcgggatgggtagttttgtcgtgtaattttagttcgtagtttttgtttcgcgtgtatttacgggaggattcgtagacgttattgtttttttgcgtgtttcggttattttcgggcggtttgtagtcggtgcgcggggtggttggggttacgtgtagagttgtcgcggagtcggaatagtagcggtgaagtttttcggttcggtcgagatcgtcgtgtttattgttcgtttcggttgtcgtcgttttagtcgtagtcgttgttgtcgtcgtcgggggagaggtagtttattgttttttttcgcggcgaaggtgaggagttgtttcggttcggttcgcgggggagtttcgggagtcgtacggtgagagcgtaatttagttggcggagttgggggaagttttgtgatttgaggaggggtcggggtgcggagcgcggttcgttttttgcggtcgttcggtggggcgggttttagaggagggtcgggggttgcgcggggttttaggggcgggcggtacggatgggtagtcgggcggcgcggggattttagttttgcggattttttttttttgcgtattatttttttttcgtattgtttgtttggggttcggcgcgttttttatttcgtagtttaatttgggggtcgtcgtcgtttttcggatggggggcgcgttcggcggcggatggtttcgaatttttgtttcgggttttcgggttggcgtcgttggggcggatttattttttttttggggcgggcggtcgcggtgtggagttcgcgtcgcgaataagtgttgcgggcgcgagggagcggtttttcggggtcgacgcggacggtaaatttgttcggcggcgttcgtttgttggggttttttcgttgtttttcgcgggcgcggttcggttgaaattgcgatcg

SEQ ID NO: 3064 - DNA, 956 bp, Artificial Sequence
  chemically treated genomic DNA (Homo sapiens) CpG-island No: 3064
cgatcgcaatttcaaccgaaccgcgcccgcgaaaaacaacgaaaaaaccccaacaaacgaacgccgccgaacaaatttaccgtccgcgtcgaccccgaaaaaccgctccctcgcgcccgcaacacttattcgcgacgcgaactccacaccgcgaccgcccgccccaaaaaaaaaataaatccgccccaacgacgccaacccgaaaacccgaaacaaaaattcgaaaccatccgccgccgaacgcgccccccatccgaaaaacgacgacgacccccaaattaaactacgaaataaaaaacgcgccgaaccccaaacaaacaatacgaaaaaaaaataatacgcaaaaaaaaaaaatccgcaaaactaaaatccccgcgccgcccgactacccatccgtaccgcccgcccctaaaaccccgcgcaacccccgaccctcctctaaaacccgccccaccgaacgaccgcaaaaaacgaaccgcgctccgcaccccgacccctcctcaaatcacaaaacttcccccaactccgccaactaaattacgctctcaccgtacgactcccgaaactcccccgcgaaccgaaccgaaacaactcctcaccttcgccgcgaaaaaaaacaataaactacctctcccccgacgacgacaacaacgactacgactaaaacgacgacaaccgaaacgaacaataaacacgacgatctcgaccgaaccgaaaaacttcaccgctactattccgactccgcgacaactctacacgtaaccccaaccaccccgcgcaccgactacaaaccgcccgaaaataaccgaaacacgcaaaaaaacaataacgtctacgaatcctcccgtaaatacacgcgaaacaaaaactacgaactaaaattacacgacaaaactacccatcccgctccacgaaaccaataataaaacacctaaacgaaacgctcaaattactaa

SEQ ID NO: 3065 - DNA, 855 bp, Artificial Sequence
  chemically treated genomic DNA (Homo sapiens) CpG-island No: 3065
gtttaggtcgcgttttttagtttcgcggttttaggttttcgttcgttcgaggcggagttcgggaggtcggggcggggtttcgggtcggttatttatttgggttgttagttattttagtttcgcgaatagttggtgtcgttggtgtcgtcgtcgtcgtcgtcgtcgtcgtcgtcgtttagtcgagatttcggggttttgcggtttattatttttttcgatacgatatggttaagcgtcgtcgtttagagaagcgcgagtcgttattcgaatcggtcgtcgttaatatttcgtttcggttcggggttgagaaggaagtcgagaaggaggaggaggaggaggcggcggcgggcgggggaagaggacgatcgtttcgggtttcgtttgagttcgtagtataggacgaggaggcgggagcggcgcggtgagagagaggcggatgaaggggaggcgacgttttttttagggttttgcgcggtttacgtcgtcggggttttcgaggaggaggacgacgaggaataggcggtggcggtagttttttacgtttatacggttattgttttttcgtttttcggtttcgttcgtcgcgtcgtcgttgtcgtacggtatgttgggagcgagaggcggggtcggtttcgtcgtgtttgcggagagaggcgggttttgtcggcggggcggggtcgatagtaggtcgtttcgttttttacggttttaggtttttggacggcgaagaggtttgggcgtacggtgacgaattttaagacgggatttttattattgcggttatatattttttttttaaatgtttttcggaaagtatcggaggttaggtagttaggtgtaaataggcgtttaatt

SEQ ID NO: 3066 - DNA, 855 bp, Artificial Sequence
  chemically treated genomic DNA (Homo sapiens) CpG-island No: 3066
aattaaacgcctatttacacctaactacctaacctccgatactttccgaaaaacatttaaaaaaaaaatatataaccgcaataataaaaatcccgtcttaaaattcgtcaccgtacgcccaaacctcttcgccgtccaaaaacctaaaaccgtaaaaaacgaaacgacctactatcgaccccgccccgccgacaaaacccgcctctctccgcaaacacgacgaaaccgaccccgcctctcgctcccaacataccgtacgacaacgacgacgcgacgaacgaaaccgaaaaacgaaaaaacaataaccgtataaacgtaaaaaactaccgccaccgcctattcctcgtcgtcctcctcctcgaaaaccccgacgacgtaaaccgcgcaaaaccctaaaaaaaacgtcgcctccccttcatccgcctctctctcaccgcgccgctcccgcctcctcgtcctatactacgaactcaaacgaaacccgaaacgatcgtcctcttcccccgcccgccgccgcctcctcctcctcctccttctcgacttccttctcaaccccgaaccgaaacgaaatattaacgacgaccgattcgaataacgactcgcgcttctctaaacgacgacgcttaaccatatcgtatcgaaaaaaataataaaccgcaaaaccccgaaatctcgactaaacgacgacgacgacgacgacgacgacgacgacaccaacgacaccaactattcgcgaaactaaaataactaacaacccaaataaataaccgacccgaaaccccgccccgacctcccgaactccgcctcgaacgaacgaaaacctaaaaccgcgaaactaaaaaacgcgacctaaac

SEQ ID NO: 3067 - DNA, 855 bp, Artificial Sequence
  chemically treated genomic DNA (Homo sapiens) CpG-island No: 3067
gattggacgtttgtttatatttgattgtttggttttcggtgtttttcgggaagtatttgggagaaaagtgtgtggtcgtagtagtggagatttcgttttaggattcgttatcgtacgtttagattttttcgtcgtttaagagtttggggtcgtggggagcggggcggtttgttatcggtttcgtttcgtcgataggattcgttttttttcgtaggtacggcggggtcgatttcgtttttcgtttttagtatgtcgtgcgatagcggcggcgcggcgagcggagtcgggaggcggggaagtagtggtcgtgtgagcgtgaggagttgtcgttatcgtttgtttttcgtcgttttttttttcgggggtttcggcgacgtgggtcgcgtagggttttggaagagacgtcgttttttttttattcgttttttttttatcgcgtcgttttcgttttttcgttttgtgttgcgggtttaggcggaattcgaaacggtcgtttttttttttcgttcgtcgtcgtttttttttttttttttttttcggttttttttttagtttcgggtcggagcggggtgttggcggcggtcggttcgggtggcgattcgcgtttttttgggcggcggcgtttggttatatcgtgtcggggaaggtaatgagtcgtagagtttcggggtttcggttgagcggcggcggcggcggcggcggcggcggcggtattaacggtattaattattcgcggagttggaatgattggtaatttaggtgggtgatcggttcgggatttcgtttcgatttttcgggtttcgtttcgggcgggcggaggtttagggtcgcggggttgggaggcgcggtttaggt

SEQ ID NO: 3068 - DNA, 855 bp, Artificial Sequence
  chemically treated genomic DNA (Homo sapiens) CpG-island No: 3068
acctaaaccgcgcctcccaaccccgcgaccctaaacctccgcccgcccgaaacgaaacccgaaaaatcgaaacgaaatcccgaaccgatcacccacctaaattaccaatcattccaactccgcgaataattaataccgttaataccgccgccgccgccgccgccgccgccgccgctcaaccgaaaccccgaaactctacgactcattaccttccccgacacgatataaccaaacgccgccgcccaaaaaaacgcgaatcgccacccgaaccgaccgccgccaacaccccgctccgacccgaaactaaaaaaaaaaccgaaaaaaaaaaaaaaaaaaaaacgacgacgaacgaaaaaaaaaaacgaccgtttcgaattccgcctaaacccgcaacacaaaacgaaaaaacgaaaacgacgcgataaaaaaaaaacgaataaaaaaaaaacgacgtctcttccaaaaccctacgcgacccacgtcgccgaaacccccgaaaaaaaaaacgacgaaaaacaaacgataacgacaactcctcacgctcacacgaccactacttccccgcctcccgactccgctcgccgcgccgccgctatcgcacgacatactaaaaacgaaaaacgaaatcgaccccgccgtacctacgaaaaaaaacgaatcctatcgacgaaacgaaaccgataacaaaccgccccgctccccacgaccccaaactcttaaacgacgaaaaaatctaaacgtacgataacgaatcctaaaacgaaatctccactactacgaccacacacttttctcccaaatacttcccgaaaaacaccgaaaaccaaacaatcaaatataaacaaacgtccaatc

SEQ ID NO: 3069 - DNA, 990 bp, Artificial Sequence
  chemically treated genomic DNA (Homo sapiens) CpG-island No: 3069
tcggttcgcgtttcgtatttacgtacggagtggtaggttacgagtttggttgttttttcgggtatcgggtaggtggggaagagcggtttgagtaggtaggtggcgaagattagggttacgatgtattgcgatgaaggtcggatgatgagtagttcgatttagagtttgaggaaggcgggtagcgagtcgtagacgtttagtatgtaggcgtagtcgtcgttcgatttggagatggtggtgtttagtttcgcgtagtagagcgcgtttacgatggagaagacgtcgtacgcggtttatattattagcgttagtttcggcgagtttgtttttttgagtacgttcgtgggcgttacgaagatgttcgagtttatgatggcgattacgatgacggttacgtttttgagtagcgtgatgtttttttgtagggttacgttttcgttttcgtttgtcggcgtcgcgtcgttcgcgcgtttggcggttattattttttttcgcgtttttttttttttttcggttatcggggtcgttagcgcgcgtcgtttcgggttcgtattcgttatgttttgtttatcggtcgggtttgggatattcgggagtcgtagtcgagcgaggattgtgcgcgtcgttcgtcgttcgtcgttcgtagttgcgttaggaatttcgttcgcgtcgttttttaggtttcggtttattggtttcgtttatcgttcgcggttttttttcgattcgtggttcggtcgcggtttttagtttcgttttttcgatttagttcggagtacgtgcgtcgttcggtttagtttggtaggcgatttttaggttcgcgtggttttcgaaggttttcgtatttttgcgttatggagatttcggtttcgcgatttattttttcggcgttcgcgttattttagttcgttttttcgggtgcgtttgggcggggtttggtagttagggcgagtttttttatttattggttcgtagtttttcgttaagttt

SEQ ID NO: 3070 - DNA, 990 bp, Artificial Sequence
  chemically treated genomic DNA (Homo sapiens) CpG-island No: 3070
aaacttaacgaaaaactacgaaccaataaataaaaaaactcgccctaactaccaaaccccgcccaaacgcacccgaaaaaacgaactaaaataacgcgaacgccgaaaaaataaatcgcgaaaccgaaatctccataacgcaaaaatacgaaaaccttcgaaaaccacgcgaacctaaaaatcgcctaccaaactaaaccgaacgacgcacgtactccgaactaaatcgaaaaaacgaaactaaaaaccgcgaccgaaccacgaatcgaaaaaaaaccgcgaacgataaacgaaaccaataaaccgaaacctaaaaaacgacgcgaacgaaattcctaacgcaactacgaacgacgaacgacgaacgacgcgcacaatcctcgctcgactacgactcccgaatatcccaaacccgaccgataaacaaaacataacgaatacgaacccgaaacgacgcgcgctaacgaccccgataaccgaaaaaaaaaaaaaaacgcgaaaaaaaataataaccgccaaacgcgcgaacgacgcgacgccgacaaacgaaaacgaaaacgtaaccctacaaaaaaacatcacgctactcaaaaacgtaaccgtcatcgtaatcgccatcataaactcgaacatcttcgtaacgcccacgaacgtactcaaaaaaacaaactcgccgaaactaacgctaataatataaaccgcgtacgacgtcttctccatcgtaaacgcgctctactacgcgaaactaaacaccaccatctccaaatcgaacgacgactacgcctacatactaaacgtctacgactcgctacccgccttcctcaaactctaaatcgaactactcatcatccgaccttcatcgcaatacatcgtaaccctaatcttcgccacctacctactcaaaccgctcttccccacctacccgatacccgaaaaaacaaccaaactcgtaacctaccactccgtacgtaaatacgaaacgcgaaccga

SEQ ID NO: 3071 - DNA, 990 bp, Artificial Sequence
  chemically treated genomic DNA (Homo sapiens) CpG-island No: 3071
aggtttgacgagaggttgcgggttagtgggtgaaggggttcgttttgattgttaggtttcgtttaggcgtattcgggaggacgggttgggatgacgcgggcgtcgggggggtaggtcgcgaggtcggggtttttatggcgtaggagtacgggggttttcgaggattacgcgggtttgggaatcgtttgttaggttaggtcggacgacgtacgtgtttcgagttgggtcgagggggcggggttgagggtcgcggtcgggttacgggtcggggaggagtcgcggacggtgggcggggttagtgggtcggggtttaaaaggcggcgcgggcggggtttttgacgtagttgcgggcggcgggcggcgagcggcgcgtataattttcgttcggttgcggttttcgggtgttttaggttcggtcggtaagtagagtatggcgggtgcgggttcgaagcggcgcgcgttagcggtttcggtggtcgaggagaaggaagaggcgcgggagaagatgatggtcgttaagcgcgcggacggcgcggcgtcggtaggcgagggcgagggcgtgattttgtaggggaatattacgttatttaagggcgtggtcgttatcgtggtcgttattatgagttcgggtattttcgtgacgtttacgggcgtgtttaaggaggtaggttcgtcggggttggcgttggtggtgtgggtcgcgtgcggcgttttttttatcgtgggcgcgttttgttacgcggagttgggtattattatttttaaatcgggcggcgattacgtttatatgttggacgtttacggttcgttgttcgttttttttaagttttggatcgagttgtttattattcggtttttatcgtagtatatcgtggttttggttttcgttatttatttgtttaagtcgtttttttttatttgttcggtgttcgaggaggtagttaagttcgtagtttgttatttcgtgcgtgagtacggggcgcgggtcgg

SEQ ID NO: 3072 - DNA, 990 bp, Artificial Sequence
  chemically treated genomic DNA (Homo sapiens) CpG-island No: 3072
ccgacccgcgccccgtactcacgcacgaaataacaaactacgaacttaactacctcctcgaacaccgaacaaataaaaaaaaacgacttaaacaaataaataacgaaaaccaaaaccacgatatactacgataaaaaccgaataataaacaactcgatccaaaacttaaaaaaaacgaacaacgaaccgtaaacgtccaacatataaacgtaatcgccgcccgatttaaaaataataatacccaactccgcgtaacaaaacgcgcccacgataaaaaaaacgccgcacgcgacccacaccaccaacgccaaccccgacgaacctacctccttaaacacgcccgtaaacgtcacgaaaatacccgaactcataataacgaccacgataacgaccacgcccttaaataacgtaatattcccctacaaaatcacgccctcgccctcgcctaccgacgccgcgccgtccgcgcgcttaacgaccatcatcttctcccgcgcctcttccttctcctcgaccaccgaaaccgctaacgcgcgccgcttcgaacccgcacccgccatactctacttaccgaccgaacctaaaacacccgaaaaccgcaaccgaacgaaaattatacgcgccgctcgccgcccgccgcccgcaactacgtcaaaaaccccgcccgcgccgccttttaaaccccgacccactaaccccgcccaccgtccgcgactcctccccgacccgtaacccgaccgcgaccctcaaccccgccccctcgacccaactcgaaacacgtacgtcgtccgacctaacctaacaaacgattcccaaacccgcgtaatcctcgaaaacccccgtactcctacgccataaaaaccccgacctcgcgacctacccccccgacgcccgcgtcatcccaacccgtcctcccgaatacgcctaaacgaaacctaacaatcaaaacgaaccccttcacccactaacccgcaacctctcgtcaaacct

SEQ ID NO: 3073 - DNA, 657 bp, Artificial Sequence
  chemically treated genomic DNA (Homo sapiens) CpG-island No: 3073
gagttcgggcggtggcggcggtggtcggaggcggtggtgttttttttttttcgtttcggcgtcggcggtgattcgagcgagcggtcgcgttttcgatgagattgttggcgggttggttgtgtttgagtttggcgttcgtgtggttggcgcggaggatgtggacgttgcggacgtcgtttattcgttttttgtacgtgaatatgattagcggttcgggtgggtcggcggcgggcgcgggcggtaggaaggagaattattaggtacgggttggggcggggcggggcgggggcgtggcggtcggttttttcgcgttgggttcggttattgtgcgggacggtttcgcgagggggcggttcgttttcgttttttcgtttcggttttttggaaagtttttttcgcgtttttttcgtcgggcgtcgatttcgcgagtttcgggtattcggtcgcggtttcgcgagcgttttttgtttcgtagcgtaggcggggtatgtttttcgggttcgatcgtgagcggttcggagtttcgtattgtttttgggtttcgggcggtgattgcggacgttcggtagcgggattggggaattttggggttagagcgtggttgggggcgttcgtttggtatcgaggtttgagattgaagagattcggttagattta

SEQ ID NO: 3074 - DNA, 657 bp, Artificial Sequence
  chemically treated genomic DNA (Homo sapiens) CpG-island No: 3074
taaatctaaccgaatctcttcaatctcaaacctcgataccaaacgaacgcccccaaccacgctctaaccccaaaattccccaatcccgctaccgaacgtccgcaatcaccgcccgaaacccaaaaacaatacgaaactccgaaccgctcacgatcgaacccgaaaaacataccccgcctacgctacgaaacaaaaaacgctcgcgaaaccgcgaccgaatacccgaaactcgcgaaatcgacgcccgacgaaaaaaacgcgaaaaaaactttccaaaaaaccgaaacgaaaaaacgaaaacgaaccgccccctcgcgaaaccgtcccgcacaataaccgaacccaacgcgaaaaaaccgaccgccacgcccccgccccgccccgccccaacccgtacctaataattctccttcctaccgcccgcgcccgccgccgacccacccgaaccgctaatcatattcacgtacaaaaaacgaataaacgacgtccgcaacgtccacatcctccgcgccaaccacacgaacgccaaactcaaacacaaccaacccgccaacaatctcatcgaaaacgcgaccgctcgctcgaatcaccgccgacgccgaaacgaaaaaaaaaaaacaccaccgcctccgaccaccgccgccaccgcccgaactc

SEQ ID NO: 3075 - DNA, 657 bp, Artificial Sequence
  chemically treated genomic DNA (Homo sapiens) CpG-island No: 3075
tggatttggtcgggtttttttagttttaggtttcggtgttaggcgggcgtttttagttacgttttggttttaaagttttttagtttcgttgtcgggcgttcgtagttatcgttcgggatttaggaataatgcggggtttcgggtcgtttacgatcgggttcgggaggtatgtttcgtttgcgttgcggaataaaaggcgttcgcggggtcgcggtcgggtgttcggggttcgcggagtcgacgttcggcggggaaggcgcggggaaaattttttaaggggtcgaggcggaggggcgagggcgggtcgttttttcgcggagtcgtttcgtataatagtcgggtttagcgcgggaaggtcggtcgttacgttttcgtttcgtttcgttttagttcgtatttggtggtttttttttttgtcgttcgcgttcgtcgtcggtttattcgggtcgttagttatgtttacgtatagggagcgggtgagcggcgttcgtagcgtttatatttttcgcgttagttatacggacgttaggtttaggtatagttagttcgttagtagttttatcgggggcgcggtcgttcgttcggattatcgtcggcgtcggggcgaggaggaggaggtattatcgttttcggttatcgtcgttatcgttcgagttt

(The sequence listing continues in the following parts.)

The invention claimed is:

1. A kit, comprising:
   (a) a reagent containing bisulfite;
   (b) primer or probe oligonucleotides for detection of the cytosine methylation state of the Septin 9 gene, where the primer or probe oligonucleotides each individually comprise at least 14 contiguous bases of a portion of a sequence selected from the group consisting of SEQ ID NOs: 12693, 12694, 12695, and 12696, wherein the portion of the sequence comprises at least one CpG dinucleotide, and wherein at least one of the primer or probe oligonucleotides is a peptide nucleic acid (PNA) oligomer or is bound to a solid support or to a fluorescent or radionuclide label; and
   (c) instructions for conducting a method for detecting the degree of methylation of a genomic DNA sample.

2. An isolated oligonucleotide or peptide nucleic acid (PNA) oligomer for the detection of the cytosine methylation state of the Septin 9 gene, wherein the isolated oligonucleotide or PNA oligomer comprises at least 14 contiguous bases of a portion of a sequence selected from the group consisting of SEQ ID NOS: 12693, 12694, 12695, and 12696, wherein the portion of the sequence comprises at least one CpG dinucleotide, and wherein the isolated oligonucleotide is between 14-22 nucleotides in length and is bound to a solid support or to a fluorescent or radionuclide label.

3. The oligonucleotide or PNA oligomer of claim 2, wherein the cytosine of the CpG dinucleotide is found in approximately the middle third of the oligonucleotide or PNA oligomer.

4. The oligonucleotide or PNA oligomer of claim 2, wherein the isolated PNA oligomer is between 14-22 nucleotides in length.

5. The oligonucleotide or PNA oligomer of claim 2, wherein the isolated oligonucleotide or PNA oligomer is the PNA oligomer.

6. An isolated oligonucleotide for the detection of the cytosine methylation state of the Septin 9 gene, wherein the isolated oligonucleotide comprises at least 14 contiguous bases of a portion of a sequence selected from the group consisting of SEQ ID NOS: 12693, 12694, 12695, and 12696, wherein the portion of the sequence comprises at least one CpG dinucleotide, and wherein the isolated oligonucleotide is between 14-22 nucleotides in length and is bound to a fluorescent or radionuclide label.

7. The oligonucleotide of claim 6, wherein the cytosine of the CpG dinucleotide is found in approximately the middle third of the oligonucleotide.

\* \* \* \* \*